United States Patent 9,328,346 (POLYCOMB-ASSOCIATED NON-CODING RNAS) - sequence listing, part 104

SEQ ID NO: 21196 - RNA, 593360 nt, Homo sapiens
augacucaaaauuucuuaaguuagguucaaguuucugacauaggaugggauugugaacucugccaaaaauuagugaaagggcugggugugguggcucacgccuguaaucacaacacuuugggagguggaggcggguagaucaccugaggucaggaguuugagacgagccuggccaacauggugaaacccagucucuacuaaaaacacaaaaauuagcugggcaugguagugcacaccuguaaucccagcuacuugggaggcugaggcgggacaaucacuugaacccaggaggcagaggaugcagugagccgagaucgugccacugcacuccagccugggcaacagagcgaaacucgucucaaaaaaaaagugaaaggguuguaagaagcaccccaguuggagacauguaaaauggaaauucucuuaauauuuccaaaugcuugaaggccaaagccaaaugcaaauuccacaagcccuucuuauuuucaauuaauuucaaaucaucuaaguuguucagucauuuauacaauuuugaaucagugcucagagcuaaggaauuaugaugaucuuacuucccaccuacagaucaggcuaacaaaaauguuaacacugcaaaccaaccuguaagaauaucagugaauguuuauggaucagcaucuagucuaaguauuuugugccgucaucaccuugaaaaaauggauugcaccacauauuacaccgccugccuuucucagaccguccuggugcaacuuuaucaaguaagaggccacaaggacauuauuuuuguuuuuaacguguggcaagauagacccucuuuuucaggaguuauuuucuuuucgucaagauuucauauccaaauauauuuaacaagaugacuaaaucuagggcauaagacacuacaaaagaaaaaacaucagacaaaaacuguaaacaagaugucaaagaaacuaaaauguaaacuuaauuaaaaaaagaaaacaagagaaaaacucagagcaagguguaaacauaccagacacacaggacacaggaagaggcucugguugcugcugccccagaaaggaacugugaucuucugcauugcaagcagccugcuaaucaaagccugaaaaaucgcccccaaaucaaaacgcaucaaagggcugcaggugcacauucugcaugaggagugagagaaucagcauuaucauggcaaauagcucucagccugguaagcgaaggauucaggcuccuacugaagggacaaucuagguaauggccucauuuagccaagaaaaucuguaagaaagcuauugguggaaagaaaagacuugaaacagauuggcugacaaaugccauguggcucuacagccaccgagucacaguggcaggaagaagaaaugcauguggcuggugggcuuguuaucacaggugcagaaaacuucaacuccuaacugagcuccaacacacaggcacugcuaccuuagugucuguuaacuuucaaagacgccgcguuuuugcuaaaucucagugccauuugcauacuacuuggagguggggcugggaagggcugugaguguccaucuguuugccuggaaugcauuuaguugauaauagagucagaugggggaagggaauuagaggaagagcaggguauuugguaacaugcaaucuaguaaacuuccggcacaaaaauaccuggcuuauuuucauuauucaauuacccauuaauacauaccaaucaaaaaauaauuggggaauaguauauuaauacugaaaguaaucaacaguauaagagcagguccaucuucacuggcagucaagcuuuuggugugcuguauugcaccugguuaacuaacccaugagauuuugguugaauuuucuaagaagucacgguuuagcacuggaauggaauagaaagugugugucugugauugugugugaguguacgguguguguguguguguguguguguguguguacuuccucuagucagaaaccucugaucacuuugucuagccugggauuauggaaacuagacaaagaagguguguucugaagagcuguguaucuuacacacauacacaggcggcuucuuauauacccacacauacaaacacacaugcccugcaaaagaucauuguucaaugcugaggaaauguucaccgcagucugauaaaugcuguggcugggaguuucaguagcacaguguccaaaaacguugagccaucuguggagaccagagcccacucuggccccagggugaggucccuaugacaggugggcgcuguuccgcagccagugcaggcccuguugggaguacuggaccaggugcuccaugcugcugugcagggugaccggccccaugagcagauccaggucguugaagaauucuagggggacagaaagaguuguuaagaaugccacacaugcuaggugugcuauccugagcaacugauguaaggaaaaauuccauucauggucucuauauaaaucaaggauucuccguuccaucauguaacuuuagcauuccuuugaacaaaauaaaauccaaggauggggaacucauccuauauccaaauaaauaaauacaugauaucugccauuucuaacucaaaugaauaguauuugcuuagccaaauagcaaagaaaauccauauccuccagcugcauucuccuaguccaguaaugcuucccacuccugaacgugaacguggcucugucgucccucacccuguacucaauucugguaugcgcugagccccuggagugaguccaaggggugaggcuccagguuccugggggcaaaucagagaugggucacgagacaucuggacugaagucaccuucuagcuuuugaacauucccuagguuugcccuuucaccaaauguuuaugauguggccaagcacgguggcucacaccuggaauuccggcacuuuaggaggcugaggcggguagaacgcuugaggucaggagaucgcgaccagucaggacaacauggcaaaacccugucucuacuaaagauacaaacaaacauuagccaggugugguggcgcacaccuguaaucccagcuacuccggaggcugaggugggagaaucgcuugaacccgggaggaggagguugcagugagcugagauugugccacugcacuccagccugggccacagagcaagacuccgccucaaaaacaaacaaauaucuaugauguaccaaggcacucugcuaggugcagggguggguaggggaugauagcaggaugaauugugugggcucugcugucucaaaaucacaguuuaguggcugauagaggaaaacacauucauauggcuacucuacugucauggcuggucacugcauacauuucuugggaguaagcaucugggagaagugucucaaagguccucacauacaugcugaaugaagacuugcuggggcagggauggggagguggcuaggagguuggccagggcagggauccagggguagaacagaggaggaggagcagguagggguaggggaacaaugccaagucugcacuggacacuuggcacugagcccucugguaggagacaucuagcaggcagcuggcagugccaucuggagcuuggccugcucacagucucccaaacuggacacguguauuucuauacauuuguccuuucuguuuuguccacuggugacacccaccccaccuauuucagucacucaacugcuaagcgcuuuucuuuucuuuauuuuuuccuugagauggagucucgcucugucgcccaggcuggagugcaauggugcgaucuuggcugucugcaaccacugcccgccuuccagguucaagcgauucuccugccucagcccccugaguagcugggauuacaggcgagcaccaccacacccggcuaauguuuguauuuucaguagagacgggguuucuccauguuggccagccugguuucaaacuccugaccucaggcgauccacucaccucagccucccaaaaucuaagugcuuuucaaagcccuguuccaugguuccaugccagcuccucuagcaagcuccuccugguggcuucugacccccauggcauucucauuggacuuucucugggcugcauguuauguacuaugugguuuuauuuacaaucucaugcacucugccauacauuccuuaucucauccugaacaucuugcucuuuggagcuaucaugcucccaugcuaucaugggaacauaguuugcauuucauggagugaacucagauuugcacucuuaccugcugcuguagggccaauaguaaauuaguauaaucuuucaggagaagaguuaacagcauauguugauauauauaacaauauauaucuuaagagaaucuguaucuguugacccccaaauuuuauuccacaacucccuccuaagaaaauaaucagaaauauggccgggugugguggcucacgccuguaaucccaguacuuugggaggcugaggcaggcagaucacgaggucaagagaucgagaucauccuggccaacauggugaaaccccgccucuacuaaaaauacaaaaaaauuagcugggagcgguggcacaugccuguagucccagcuacucgggaggcugaggcagaagaaucgcuugaacccaggagacggagguugcagugagccgagauagugcccauugcacuucagccuggcaacagagcaagauucugucucaaaccaaaaaaaaaaaaaaaaaaaaaaagaaaaagaaaaagaaaaagaaaauaaccagaaauaugaacaaugacuuauguagggauauuuacaccaacauuauuugucacaguggaaaaaaauuggaaggaacuuaaaugucuaacaacaggggaaugguuugagaaaucaggauacuuugugacuguauaaucaauguacuaggauauuauuauagaaccaccauaaaggguguuuuugaacuaguuagugacaugagaaaaugccugauauaaugucaaaugaagaaaggauauacaacugugugaguaucccagcuacucaggaggccgaggcagaagaaucgcuugaacccgggaggcggaagccccugguuccccguggggugugcgcucaccucgguuuuccuuggccagguugucggccaucucccaguagucguagcugugcaggaugcuguuggugaugcugacgugguuggccgccaucugguggaugcgcugugggaugcugacgauggucgacggggacagggcgcuggcguuggagaggcugcccugagaccccacggagcuggcgggagagggguugggagacaugggggaugggguuccagugcuccuggaaggggagagguagaaaaaccagaguggcgaggucgggagcaagcgaggcagggcagccccuuggggaacagaaagcaaagcgcaguggcccagcaccaugcauugucuggcuuacggcauugacuuuggaaaagcgaacuuacuuuccacuggccccccacggagauggggcuugggcggcuuuagaugaguucugcaagaaaauaaaaacacugacagugagugccaucugcgugaggugaaacaggugacaugaacguguuuucaggugacugcagagagaagcaaaggcagacacugcaggaaaaaggcaccuucagagaaacuggaccugggaagucuccaucacaguucucuguucccuuucuggaagggagucgggacagcugccuggacuucggaaguuuaacaguauuucucuuaaagggaguugcucuugaacauuccuaagagaauauauuuaaauguauuucccuagcagacaggauacucaaaaguucuaguuuaucugaauauucugauuuagaaguuauuuugcauggacaaggugccugcaucagcccucagugagguaagugaagggcuucacccacagccuggguuuuuauguacaaauuuuagguaccacauuaagucauaaucccaacggucuguuaaaucuugaagcagccuuacuuuuucauuguaaauuaauuuuucuuaaaaggaaaaaagagcaggaacacccucauaucuccccuuauauacaauacuuuauauuuaaaaguaggacauguuugcagaaacagucgacauacauuuacuuagugccugaaaauacaugacaucagauuguauuguuuuaacuuaggaaguuuaaaaguauuucuucuuaaaguaaguugcuguugcauauuccuaauagaauugauuaaaauauauuuccagaacagacaggauguucaaacauucugguuuaucugaauauucugguuuaggaaguucuguugcacaagccaggugcuugcaucagauauuuaaaaguuuugccucuaguuagggaaguugcucaaugcacaguuagauuuccccucugagaacccaaucaugccuucauaggacuguuaagggagaaagcggucuuugugaugcugaugggaguuuuccccuuccagagacaagaaaacagccucagccugguucuccagagacaacauguuucuuuugguuagaaagaacuuuauggaguggugacugauuuuucugguuuuagugcggguguuauuaaaauggcaagaaauggccugucagaacucugaggugcuacaauggcaagauguaaauguaaggacaacaccgcaaaccaugccacuuuuaccugugucaggaaauacaauuauuuucaugaggagaauuaggaaaccuuccugaacaggggagcuuauccucccuuucuugacacaauguuacugacaccuuucucaagcuggugcuacuggacugaucacuuuguuuccacuucauccugugguucugagaacgugaucuauagaaugcauguucuggauauaagaacacuaauggcagaaggggagaaaggcuuggggguugcagaaacaguccaguaaaggcuacugaauggaggaagaaggcagugacucacgccuguaaucccagcacuaugggaggcugagguggguggaucaccugaagucaggagucugagaccagccuggaugacauggugaaaccccaucucuacuaaagauacaaaaaauuggccgggugugguggcacacgccuguaaucccaacuacuugggaggcugagacagaaucgcuugaaccugggagguggagguuagggugagccaagauugugccacugcacuccagccugggugacggagcgagacuccgucucaaaaaaaaacaacaaaaaaagaagucuugaguucucuuccucuaccacuaagccccaugcccaagaaauaccgguaggaacaaaguucuuuuuuuuuagagauagcucuguacugauaaaacacauauagccaaauugucuuggguaccuaaagauuucaugguuucugaacucaaaguagcauuuaaauagcccuugaggcuggguguauggcucacauugguaauccuagcacuuugggaggccaaggcaguaggcucgcuggaggacaggaguucgagaagggucuggacaacacaaggagacccucugucuacaaaaaaugaaaaaaugagcuggguguggugguguguaucuguggucucagcgacuugggaggcugaggugggaggacugcuugagcccaggaauucacagcugcagugagcuccgacuguaccacugcacucuagccugggcaacagaacgggacagaaaaaaaaaaaaaguccuugaaacuuuguauccaaguuucaguuaucaggaauaaguucuggagaucuauuguaugggauggugacuacaauuaauaaugauauauaguauacuugaaaaucucuaaaagaaucgauuuuaaauguucccaucacaaaaacgguaaguaugugaggugauggauauguuaauuagcuugguuuaaucauuccacaauguauaaauauaucaaaacaucacauuauacauaaguacacgcaauuuguuguugauuaauuaaaaaaauuuuaaaaauagcuuuugaugaaggguaaaugacauuaauuccuugaggagcaacucugauuuucugguuguguuuuccuuuuuuuuuuuuuuuuuugagacaaagucucacucugucgcccaggcuggagugcaguggcgccaucucugcucacugcaaccucugccucccggguucaaacgauucucgugccucagccucccuaguagcuaggauuacagaugccugccaccacgccuggcguguuuucuacccauucuguauguauuagugggcugcagagaauauuaagaacuuguaucccuuaaaaguuuguuguagccccuggcggcuuacagaauucagcuuccuucuuuauucaagcauuuuccuugacuguaauaauucucuuuaguaguagaucuuacguucuggauuuuugaacacuauugauguugacuuuaggcaccugaaggaaagggaaggcucagugcugguucuuguccugaagacacaggacggucaaugggcugagaaagugauguccauggccuagcaccugguuacucuacaugcacaauuggaaggcagugugcugaacauaccccaggaacccccagcacagccuggccauuagagaucaccucuagaggagguugggcaugaacagaucucaaaugaugguuguguaucugacaaagggcuguuggagauagagacggcauaauuucuaguuucuauagauaaacagagaagaggaccagaaaucucaaauuaauuauuaauguaaggucgaccucacaacaguacaucagcgaaggcuuuuaaaaauuuauucucccagugaaaauaauuucauucccugagauaaguaaaagguggcaugguuugcaauuuuaucccuauagcuacacacugcuaucuacugcuucugaguucuaacaagccaucucuuaccauuuuaaauaacgccauuaaaaauuaaauaagcuacuagagacuggcuaagagggaauggcucuaagggguuacuucuaaggaaaagaagcucuaagugagcaugaggaauuuauguuagcuauaaagaugaauuuccuaggacaguggaacgaguaacuggaucuucuuucucuugaagccauaaaaauaccuggacaaggcugggcgugguggcucacaccuguauuccuagcacucugggagguggaggcggggagaucaccugaggucaggaguucgagaccagcaugaccaacauggugaaaccccaucucuacuaaaaauacaaaauuagccaggcgugguggugugcgccuguaaucugagcuacuugggaggcugaggcaggagaauugcuugaacccaggaggcggagguugcagugagccgagaucgcaccauugcacugcagccugggcaacaaagagugaaacucugucuccaaaaauacauaaaaaaauaaaaauaaaaaaauaaaaauacuuggacaagaaggcagggagauacauuagaugggcucucaaagguccauucugaggccugaaagccacaaguguggcauaaaugggguuaccuuggggaccagaggugaccugcauuaaccccaaagcaauggagucuaccaggugcuucacaaauuugacagggagacaagugaaauuaaggaacaauucugcucauucacuagacaguaccuugaaauagucgauuagugcuuuugaauacuuuacagcguggucccuuuugagucgaaacauccgccaguacaggagggccaggcaucgguaacugcaggcgaaaagagaaacaggcccagaagcggcugagugcgucgugcgcaaacaagacuuaaacauuuuuguuguuguucuaagguacucaauaacaauaccuuguuucuacauaggaaaucuuucuauacgugcauauaaugucugugagggaacaucuuuuguccaaaaauagaauucaaaauuccaagaagguauuccauaaauacauuuaucacuagauaauuuuacagcauuaggugaaucacucuguugggucacaggggccggccgcuuccuucuuccaccacgagagggcgcugucucuccacgagaggcgcgagguagcucuaguacgcagccuucacugcuucgcgggcgagccccgcucugcggaaaggacgacgcugccaccugauguuacugaacuauaagcagcuccacuaaagucacaaacaugaauguacuuuauaaacaacaaaaacacuaugcugggaauaggugccaucauuauaaacaacaaaaacacuaugcugggaauaggugccaucauuuuauuauuuccuauaauauuuuguauacuuauuuauauaucaguauucuaucuuauauaaucauauuauugucauuuaguguauuauuccaauaugggacuuaaaguuugaaaggggcacaaaaggcguuucugagacuuauccucucuuccuuggagcucuucacucaguuauuugcuaacucggaucugaugcugacauccagaauaccaacauucugggugcaauggcaccaucuccuccuaccaaccaaauccaggacagguaacaauuugagaccuuuuuugugucuguugcuguuauuauuauuuuuuaauucaacugucuuuauuucacugcuugguagacauguauucuaucaacauucucugccuuccaccuacugaugaguaagaaagggcugacagguaaaggaacuauagguuacccgaucguucccuuuuuucuguggcaucauuuucaaaguaagcggcugcgccgggugcgauggcucacgccuguaaucccagcacucugggaggcugaggcaggcagaucacuugaggucaggaguucaagaccagccugaccaacauggugaaaccccaucucuacuaaaaauacaaaaauuaggccgggcacaguggcucaugccuguaaucccagcacuuugguaggccugucgauuuucaaucacugugaauucagaucauguauaguacggcagcaaaaaauggucuggacuuucccuggucauuagaacugcucuggggcuuuguauguuagaagacauugggcaaacacuaugccuuucagcaccugguuugccaaugauggcaugcgaggcuggggcugcuauucuaagcggagaugggcacucaccauaaugcagccaguuguuugucuucugguguggcauuggggccugaguggguuuuuagucucauagcauaccuuagaaaaagcggggaggaggaauagaauaaaaaacauaaaaagcaaagaaauaguaaaacuagcuuuuuuauuaacagaacuucuaugaugguaguucucccugccugauccuuagcuuuucauaguacuugcugauaauucuuucuuaaaagcuagcuggugcugcuccauuuucccaaguauuacauuacugugaugacuagaacagcuacuuucugcucuuuaacaguacaaguucaaaugcuacagauugucgggagugauaccaguucaagaacuauucauguauaugcuaacauguccauuuuuccacauuuugauuuauggcugagugucugacagauggaggugaaguucuauccuucugugcuuaccuccagaagaauuuccauccuggguaugcagaggaaugcuuagauuuaccccucuuucuuuguuauguaacuuuuacuuugacagcuacauaaguguccugaguacauuuuuaaucucuguuugcuucuacagacagauacuacgagaaacuaguggcuuuuauggacugcacuuaauuccauuuauuuuucugaaccaaggggacuguggccauugcuuucucccaacaacauaccaaauuacauaugcagacucuuugagagagcugaggcaguauguguaaugaucagauuguccuagguucaaaucucagcucagcgacuuauaaguuguaagugcuuagacaaauguauuaacaucuuuaagccuccauuuccuuaucuauaaaauaagacuaauacugccaaucacauaacauuguguuaagaauuaacuaagauagcguuuguaaagcucuugggauaguuggcuggcuuguaaauugcucaagaaacauacuguuaucaucgcacuaucuccucaacaugcagacuuguagcauuuuucaguguuaucucuuugcauaauuuuuacagcgguugcucuggauuuuacaauauacauguaauuuauugguaucaacauuuuaucacuuugggauaguauggaagucuuacuucaauuuagauaccuuuaccuuccccacuuaaaaauagcauugucuugaguaucagauggugguauaauuuuuuauuguuuuguuuuguagcaguggggucuuacuauguugucugggcugguuucaaacuccuggccucaagcuauccucccagcuuggccuccuaaagugcuguaauuacagaugugagccacugugccuggacugcugguauaauuuuuguuucaauccucaaaccugguuuauaaacucauaaggaguaguuuauuguauauauaucuaugugucuguucuuccuucuuucccaaugcucccauauuccuucuuuugucauuuuauuucuguuugagaaacuucuuuuagccagucuuuaagggugggucuuuuagagacacauacuuguacuuuuccuaaaucugaggcuaucuuuauuucccuucauucuugaagaauaguuucacugacucuagaauucauggcuucacaguuccuucuuugaacccuuggaaacugucacgccacucccucccagccugcaugguuucagagaagccugcugucauucgaauugauucuccccugcagauaauuaucguuucucccuggcugcuuucaggauauuuggccuuuaguuuuuggaaauguaaucaugguguguuuuugcaugcauuucuuuggguuuaucuuauuuagguuuuucucugcuucuuaaaucuguagguuuaugucuuuugacaaauuuggcaaguuucagccauuauuucuucaaauacucucucaguccuacucucuauuccucuccucugagacuuccaugacacaaauguuggauuuuuucuuauugugcuugaggcuguguucauuuaauuuuuucagucuauuucuucuuuacugcucagauuggguaaauuauauuuuuuguccucaaguucauugacucucuccugucaucuccacucuacuacugaguccauuuuugggguuuauauuaucaaauucuacaguuucacaauuuccauuuaguucuuuuuaaaauaacuuccauuucuuugaaaagauuuucugguuuuguuuguugagugauaacugugauuauugaagcauuuuuacgauggcugcuuuaaaaauccuugucagauaauugcagcaacugauucaucuuugcauugaggucuucugaucaucuuuuuucaugccaguggugacuguccuaguucuugguaugaugagugaguuccuaugguauccuggacauuuugaccauuagguuaggagacucuugaguccuauuuuaaacccagccacccuguuuaggucuagcaggaaggcccuagccuacuuugggggcugugguuccaaugauaauuuaauuuucagagccuuucugauacuauuuuagucugugugguugaucuggugccaccggggcuucagcucaucccugaugguacugccugcggagaguggaagggugggaggagagggucaccaggcugagcucgugugguggcagugcuccacugacccacgccugcuuggccaucuggaguucccuggugaagggaauucugcccguagggacaaaguguacauccugggcuaggucaucuugguggugagaaccccuugccagcgcuccaggcccuucagugucucaguaggggagaggagggucaggcagggugggcaaugugcggauguaauuaaugcuguuuucuuuuuuuuuuuucuuucuugagacagagucucgcucugucgcccaggcuggagugcaguggcgcgaucuuggcucacugcgagcuccgccuuccagguucacgccauucuccugccucagccuccugaguagcuaggacuacaggugccggccaccacgcccggcuaauuuuuuguauuuuuaguagagacgggguuucaucguauuagccaggauggucucaaucuccugaccucaugcucugccugccucagccucccaaagugcugggauuacaggcgugagccaccgcgcccagaaaauuaaugcuauuuucuaauguagguugaaaaaagagcuagccaggugcgguggcucacgcuuguaaucucagcacuuugggaggccgaagcaggcagagcaccugaggucaggaguucaagaccauccugaccaacauggagaaaccccaucucuacuaaaaauacaaaauuagcuggaugugguggugcaugccuguaauccgagcuacuggggaggcugaggcaggagaaucacuugaacucgggaggcagagguuguggugagcugagauugugccauugcacuccagccugggcaguaagagugaaauuuagucucaaaaaaaaaaaaaaaaaaaaaaagaaagaaagaaaaagagccaaauuugucuuuuugucuuuguuuucucuguauuuugcgugauucuaucgauucugaaguaucuagaagguggacaguguucucuaccugugaaagauuacuuccaucagugggcacagugggugugguaccccagcacccucucuuugaugguauaucuggcuggcaugguuuuuuguuuguuugggcuugcuuguuugauuuucaagugugaaugccuuuaagcaggucaugauacuccaguucacagcaggcccuauggcuugcuuauucauugauuccuuaauuguuuauuaagcacauacuaugugccagaaaauauucgaagggcugaggauuccccaguuagcaaaucagacaaaacccaaaaaacucccugugcucaagguacucacacucuagggcaucuuccagcuuugucccuguccaguuucucccacuuuccucccugccugccuaugaacaucucaggcugggccuuguucugaggaaggaauguauggaucuaggauccguuagaguaacuuuuaccagucuuuuuacuuugcugcuuucauuucaucacuacugaaaguaaugugccauauaaaaagacaguauaaaggauucaccaauauauugauuuaguagaaauacuuuauuaagaaaaaugggcaguguugacuuuaaaacauucuugaaaaaugcuuuauggaggugauguguucucugaugucggcaugacaguuucaaaggcuggaaacuauuuacugagggaaagugguguguaaaacaccaaguagcaucuuugggccaauguagaccaaaaagaucacauccuaagaugauuagaaaucuuccaugcagaauguuuggacaugguggaaaaugucuaagcuuugauugcacagaaccccagaaucagaaaaacuuuuaaaaguuaguuuuaggaagaauuauuucucauuauggauauuagacauuaugucaagcaguuaaacuggcuaaaaacauaaaccauacuaugaagguucucaguagggcuaauggaugaaauucccuuaacuguugguuacagagaugugauggaggugccuuuccaggucuccaucauggaggauaaguguuugccaucgaaugccuugacacgucugcucacaggucuucacccagguuuggggauggugcccauguccaguuuuuagaccagacaguauaagauggcuucuccuuccauaaaauccuccugaauguucuuccauuaaauacuccagaaguauuuacugauggagcuaagauuuagaugauacuaaccugaaccagauuuuuuuuuuuuuuuaaagcagccuagggcugaaauaggcucaaaaucugccacuuccuagcugagaggagcaggcaugucacagcccacucagacucagccuccucccucagcaauugggggcuacagcagcugccccccuugcucacggaggacagagggggcagggugugccaagacgccuugcacgaccuuacccucuuauuuuggggggaugaacacugguuccuggugggggauggugcaggcugacauucuuuucucuguaaccauagugcuuccacacauuccucacuccuccccucauccagcaagaaaacacggugcuuaccugaugagcucuacuguuucugaauacaucguauaaggagauuuggauuccauggggccuuguuccauugcauuuccacacucgauaaacgacaaugcugcuucagcauaguucaaagccuuuccaaacuuuuccaccugaucaacagaguuaauacagugucuuccuaaacaauaguuuuuuuuaaauggcauugucauguaguuuauacaccuuauuugagaaacccaacucugacuucuaaaauccuaugaagcugagagaagaaagaaauagaauacuucuuuuccuacuuauuuucucaaacugcuacuggcuuggaguaagugagcgaacaguuauauacagaauuguaucaaacccaugugacagcugucaaucaacagagcucagaacugcauggcugcucugauuucuguuucccucuuucuaaccccuaaugguuuggcgacuucauuccuuguuccuccaugcuaugcuaaauaugcaucaaaguugguaggucuggucccauauaagaguuuucauacuucuuuugguacauccccaacuuggaugguucuaggccuugguuauuaucuuuuacauuauuuguggcacuuauaucuccaugccuuccucuucucaauuuuuuuuaauuuuuuuauuuuugagauggagucucccugcaaccucugccuccuauguucaagcgauucuccugccucagccucccacguagcuggaauuacaggcaggcauaggccaccacaccuggccucaauuguuuuuuuuuuuuguuguuguuaauauuuagaaccucacuuaagagugagagugaguaggggaaaggagaggagauaaaccucaaggagcuauuucagcuuugcuaaaauaggacaaaaaguugaaaauuauuaauaaaaaugauuuuugguugggccuggcggcucaugccuguaaucccaguguuuugggaaggugaggcaggaggaucacucgagccuggaaguuugagguuccagugagcuaugaucgccccacugugcuccaaccuggauaacacagcaagacgcugucucuaaaggcaaaacaaaacacauuucuacgggauuaucuguagcugucgaaauuuguguuauucuuuccccacaucagcaagggcagccacaaaucagcuuuauauucuuaagaucucaucagucuaaacuuaugcaucaaguuccugguuccauaccuuacuacucuuuguagguaauuacauauucuaacucuggauugcagaaucuccccaguuuucaaaugauucauucaucaauuaaaacagaaugacauaauacucaaauacuauuccaagucuugccacuaaaaauacaaaaaaaacuucauuaguaaugauagcuucaaaaccagaaaugcagagcaaaacuuccucuccuuagcaaaucaaaauuuuaaacugcuuauaaagguaguguaggcuauaaugcaacauuucuuuuuucuuuuuuuuuuuuuuggagacagggucucacucugucacccaggcuggagugcaguggcaugaucuuggcucauugcaaucucugccucccggguucaagcgagucuucugucucagccucccaaguagcugggauuacaggugugcaccaccacaccuggcucauuuuuuuuuuuuuuuuuguauuuuuaguagaaacaggguuucaccauguuggccaggcuggucucgaacuccugaccucaaaugauccaccugccuuagccucccaaagugcugggauuacaggugugagccaccgugccuggccuauaaugcaacauuucuugauaacacuuucagaugaagucauuucauuuaguauuaauauuuccuaaagcacccaauucugugguaugugcacuccacaagcgaaagcucuuuccaggaacauauaauagacuuggagagagaaaauguacaccuacaagacaguucaaagugcaaggcagucugugauuacccaacaaaauacaaaaugaggcauccagugcaaaugagauggaggaaagugagcuagugauggggccgcagagaggcugggaaggccacagggaggagacugaauaugacgccgggaaggaaugguaggguuuggcuagauuuggggaggaugcugagggugugagugugcccaugagagugugugagagugaaucucugcaggugcaaaggcccgcuggcuggcaggagcaaggugugcuuagaggucaguaggggaccagccuggcuggagcagagugucuccucuugggaaaucgucaacaggaaagauaggguugggcaagaggacaaugaaugaauaaugcuguaaacuuuagaugcuggauucaggcagaaaaucucuuucuccuuaaaaaucugaugcucuucuccaagaguggccauucauuggcuucuccagaugaccagaacuguccaucagacucagauuguguggacaagagcuguaccuuccgcugcccuccucuauuuucugauacguagggguuauuccuccuguaccccaguguacauaggcaguggucuucacguaaauaaguguuuaauaggugacacugguagcauuggaagagggguacuguuacuguuuaaacaucuucaguauucugaaggucacuggaaaugccuucuucauuuccagcaccugccucaaucucaguuaugaacacuggaggagacuaaaacuggaauuacuaggugggaagaugucccuuuggacuucauucauuuaagauggaacaaccacaugaucucuuuuagaaaagaaaacaaaguuuuccaucucuugccugagagcuucaagcuuuccaaaacaggagaucauccaagcaagaaaaguuauucuuugaaaacaucaaaucauggugacuuuagagucuuacgugcagauaauaguuucuguguuguacaguuucagagaaagcauucauuucggcagauacaugugaagaacacaaguguuuuugaaaagagauuugauccugggaccaagccaaggguuugucaggcuaacaagagaaaaaugcaaaucuagauuuuacuuuuuaaaggaaaaaaaaauacuaccgcccacugccuccacuggcucuaguuacuauucaaaccuuaggacuaaauugaaauauucauuugucuagggcuuuuucccagucaggcauuauugguugaagucauacuuuauugggcuaugaacauuugauuauauaaacauuucuccauugaacagacccggccauccuuguaauagauuuuauaauuaccccagcuauauugucccagugaugaagcugcaguacacacauaauuuggaagaacguaucuggaaagaaaagggucucaccauugcaucugcuuuaugcuucauucguuuagcuucuugcauaaaauaaucggcacugcgaggccuacaaggagagaaugauauuaaacgucauuauggcuuaagugcaacgucuuuuuaaaauauuccuuccuuucacucaaacuuaaggcacaauuuaaaaacucugcuuaaugcggaauuaaguguguuuuuugccuuuccaaacuacugccuguaugucaaauaccacaauacauuuucucuuaaguuagcaauucgaaacacacucaacauacgccaguagucucuauuuacaguggauuuaacauggcccccuagggccuaauuugugaauauauuuuuuuauuguaugguuaaaaaaaaagcgagaaaucuuauuuuagguaauauuuacauaaaacaauccccuuuuaauguaaagauuguaaauauaccucauaauaauuguauggcuauauaugggugaguauauuuauguauccuuaugaaaauaagugucauuuauaugcauaucuaguaccuagaguuuuauguauauauugaauuaucuuaaagccucacagugaaaaauaaaaagagguaauguuggaugauuacauuccaguuguaaugaaguuaauuguaaaaugaugucuaccuuguaacaaugcaaacaugccauguauucucuagaguucugauuagcuagcugguaaacauuaacagcagacauguggauuauuaaagcaauaacccuggccagcggugacucugccgggagaugaagguaacucauccagagacugauuugaguguguguaaugaggcccaguuacgcuaagguacucauuagacaguaucuuuaaguguuuagcccgauagauuaaaaaaaugacauuuuuaggcaccggcagcauaaacuuuauauaaucaauaaacuugaccuauucaugaauaucaaauauaagccaggacucucugaacgggagauucgacggaaguagugauauuaaucauggacuguuuagccaaugauuacaugcuuauuuugaacugccuuauuucagauccuaaugggucuuuuaccuuauuguaauauuagguagucagaacauucauguauccaaagaggucaaaacgcuuagaaaagcaaugugugacaaugacauugcauuuuaaucaaacaaaccagaaucacagcauaguuuuggggucaaaauguuuccucaccccauccccaugccccccucugagggcuggagccguccauucauuguggugggucuuucacugagggugaggccugaggucuccuuccuaggaaggcccugcuccugccacuccguuuucucucuugcaucuccugggugcccaugcuuucuccauaugaauggcuuuguuguugccuuggugaguuuuccuucuuuguccacauauugacacauauuguaagaauguccauauauugucuggucuuugguuccaacucuggcaauugauguuauuuuuguuguuguuuuuugagaaagguucucacucugucgccuaggcuggagggcagugguacaaucacccauacugcagcaucaaccaccugggguuaagcgacccucccaccacagccucccagguagcugggacuacaggugugugccacuaugccuggcuaacuuuuuguauuuuuaguggagacgggguuuugccauguugcaaaggcuggucuugaacuccugaggucaagugauccaccugccucggccucccaaagugcugggauuacauggcuuccaucacaucaccauccugcucacagaccuaaaaucaaucuccagggucuacgagauaaaaucucaguucagauccccaauaaucuugcccaacccacuuaaucauauugcuuacucacgaaggcccuugaccaaagucagagguggcuccucauugucuugauaacauggcauccugguccgaggagcucugcucaucacuucccccaccuggaacacucuccucucuguucauucacugagugccuucuaggagccgaauguugccuggcccucaauuucccccgccguaaggcguuccgaguaaccuugguccauguuccccucuguccuuccugagcucacacagcacuucuuguuuacuacacuugguauuucauuaucuucugagcuguacugggcaugugugcaacuugauugcugguacguuuuuaguaaggaccaugcuguagacuucuuugaucuuucccacccuguaguuuuuggcacacgguagaagguaagcaggucucccuugaaugaauggcacugaauucauuuugagcuuagaaaagaguggugccuuccgauggggugcagcaucgcauccaaugagccagagagugucuccauggcaaccugaaauucuccacaucauuaucuguucuauacucuaguauauaaguuaggucauuuuuuuuuucuugcccuguuuugucacuaacaguucacuacuucaaaugcauuucauuaaaggauuaucuugguaauaagcuaugguaucuuaguuuccaccagccuucuaaguuacccuuauggauggcaguggcucacaauuccuaauauaagcuccuuaaucaauauuguuuucaucugcagcauaggggcauauuuuuaaauccugauauggaggcugagucacagacucucaccauagcacauguggguaaguaacacaccuaauuuucugaccguaucagagcagcuauaaucagagcaguaaccugagaugcuaauagcauagguaccaucuggaggccacuuaacgaacacauuuguuagaacucucaucuuugcauagaauggagggcucacuauaaugagucacugaagauugccugaugauuggcccauuuucuccuuucgagugauuucuagugcuguacuuccagagcagaucauuauaaagccagcaggaccaaugggaugucacccaguguccagccuugccacgaaucacaaaggcaucccuucugacagcaauacacaagucaguaggaaaaguaaaauugcuugucaccauugugacaguuauagaauauaauacagcaaagguacuaaaaugagaucuuaucugaguguucaaauagauuuuccaucuaaucuucuauuuuuuuuuuaacauggaaaaccuagaguuuucauuuuucauuuguguaauaaaauucuucccauuguuucccacagugaugguauuuuaugaugacacaugagcaaaccuaauaaaaguuuaauuaaacaccauaaauggaacuaacugugaaucaugggcucuucagaaacggggcuugagugaucugaaagccagagcuuagcugcaugcaucuucauuaugagagcucucuccaacaaaagcauucugagcacuugauccaaauagaauguuuucuuuucuucucuucccccucccaccacccccccccccccaccuagaaacacacggucuugguucucagcagcaucaggguuugagcuacccccauauuucuucuggcaugggaauauuaaagcaaccuugcuuuuuguucuccuuuguggccgggauagaguugaauggucucccacggagagccuggcagacuccuuucuguaauuccuaccucugugaaaugccgcccucaguagagccagccuguuuugugaaaacuggcagggaugagagcucaauguguuugaacaacaaguuccucggcgcggcagaaauuggaugauuuucuuagggaaguugaaauccaaaucagacaaauaggcaacugcauaccaaaugaauucaucaucugcuauccgauaugucagcuugucaucugauaagccccagagguguuaauaugucccaagcuuugaggagaaugcauaagaaauuaaguaauuauuuuuaauacacagagucagugaagacuauggaugagggcacuucagagucagccacuccaggaugcuggcacugccuuuauaggcacuuccccacagauccagguagauugcauuuggguagcaaggauucaaacacagcuuuuauuuccacaacuuugaugucggcuggggcucagagucccuggaaccgggcuucucccaggcacaagcggucauucacuguuucuucaggccacaggacugcuucccucucagccggccacagaaggcaggguuugcucugcaggacgcucaggcuaaguggggcggguguugaaucaaaaguaacuuucuguugaaaugggaaauuaucaaucugaugguuguuuuucucugagugugacauuuaaaauaaucuuacaaaacccuaaagaugauuggacagcugagauuucaauccaggagaucugaauguccuugucuccgcacccugucccccgcaccccuuugcaaauccuacuucauuucuuucucucucucucucacucacucuuacucucucacucuguuuugguuagaacaaaagaagcuccuggccuugagacagggauuucauaaugggagaaauuccauaugaagaccaauaaaggcuuaaugauuaaucaggaaaacaaaaagguagggucccugcuuugaaaggacuaggagaggagacccucaagagaacaugcccacugcaagccccuggugggggagcgccuucccagcugcaauuucgccuacucaaggaucuuaauugguguccuuugacuaaaucaugcugcuagggauucaaccuuuuacaauaugcgaguauucccauccucuauaaaauuaaaauccuuuagcucugagacugcugugcaaguacauuacaaaugucaagucccucuuccuuccucccggccacauuucacaugccauggccuucagcgccuggcgucuauagucagucuuuccucacugucgggagguucagguagccgggcuccuguuacgggcaccauggggacagaagggacguuuggugguuuggcugaaugugcugauugugacugacuuuuccaugugacauacaggcagcagccagcacuuccuccagggagcggcaggcagcccuggcaccugggguucucuggcuuccuagcacagcagaacggugggcaggauggaggaggugguuuuccagccaagcaucucaccaccacuuagcccuguucaggacuucuguacggaggccuucaugacacaguuguucucucucaauuuuccccagccaagaauuccccugucacuaauuaugauaccaaguaacuuacagcucauggcuuugcacuaauaagaucaguuucuaggccucaaguugaaucaaguguugucauucauugacacaaauucuuacagauccguuuuuuaaacaaaaguuugauaaccacacuagugucaccuuaauacuguggcugucaaguagugaauguugugcguuugcuuaaugucaggggaggaggugaggucacacugccaccaauaugagcccacaacauacaaaggacaggcugaccugauuacauuuuuaaaaauaaauguuauucuucucaguucugucuguaucccaaaggaacuaacuggugccuguuuacaggcauuauagggauuacaggcacaugcuaacacgcccggcugauuuuuugguaaguaaccuaggaaaacgggcuuggaaacccauuaauuuacauucaccugcauguagauuccuuauagucauagaaaaaaaaaauugcaggcacucuucccugggaauguaauuuauaauucagcuggguucauucaacacuuguuauugagagccuacuggcuucagcuguugucugaaucccauguuuauucaaccauuaacaaguauuuauaauacaaagagaugaguuuacuuuuuuaaaaaagcugcaugaugcggcuuuaaaaauuaaaugacaguguggcaucuguuacuuuuuggaucacuguaacuggauuuccaucaacucgaaaucacuccaguguuaauuaucuagucuuuucuuccacugguggccucucuuuggucauuucacugcuuguuuuuacaaauggcugaaguucacucuucacccucggugaagagaagucaagggaggugacagggcugaggucuuccucugucacugaggcugcugguggggaagcuggcacagaauggaggugggcaggaaggaggccgagaauuaaauuuaguaauccuaggaaaccuuccuggagaggucaucaugugccucucucuccccugaagaacugagaauuaauuaaucauuauacuucagcucuugugccuguacuuggcacuuaguaagugcuccauauguaccaaaaggaaccugggagacguuuugcacaauuuuaggugacauucuagcccagugaucucuugaagguugcuuauuuuuacugcuuaaaggaagagacgaugccuauuuuugcuuuuuuuucuuuaagauggaguuucacucuuguugcccagauuggagugcaauggcaugaucucggcucacugcaaccuccgcuuccuggguucaagugauucuccugccucagccuccugaguagcugggauuacaggugccuggcuaauuuuuuuuuuuuuuuuuuguauuuuuaguagagaugggguuucacuguguuggccaggcucgucucaagcuccugaccucaagugauccacccaccucggcucccccaagugcugggauuacaggcaugagccaccgcgccuggccuauuuuugcuuuucaagcuugaagaaucuuuccacaacuuucuuaguucgaugguugaguggcuguuugaguugcauguuuauuuuacuguuauggauuucaaaucaguugggacauauggcaauuggaaugcgacaucuaucucuccauaugauggauauguaacaguguuuuuuuauucuauuauaucuauauccauaaaaggagaaacaguuucauuguagcugucagccaggaaaauuauacacauugcuaaugggaagaacaaaugauaacagccucuuuguugacaccaauagugacaagauuauauuaguuucagccauagcagauuaagaaacauuuccucuuauaaaaaguccaagggcugccagccacgguggcucacgccuauaauccugcacuuugggaggcuggggugggaggguuguuugaggccaggaguucgagaccagccuggacaacauagugagacaugauuuuuuuuuuuuuugagacacagucucgcuguugcccaggcugaagagugguagcacgaucucagcuuacugcagccuccaccucccagguucaagcaauucucugccucagccuccggaguagcugagauuacaggugccugccaccacaccuggcuaauuguuguauuuuuaguagagacaagauuucaccaucuuggccaggcuggucuugaacuccugaccuagugauucaccugccccagucucccaaagugcugggauuacaggugugagccacugcgcccagccgugagacgcuuuuucuacaaaaaaaaaaaaaaaaauuuaacugggugugguagcaugcaucuguagacccagcuacucaggaggcugaggcaagaagauagcguaagcccaggaguuugaggcugcacugagccaugcucauaccacugcacucuagccugcgugacagggcaagacccugucucaaaaaaaaaaaaaaaaaaaaaguccaaguaccuguagaucaaaguacaaucauuuaguuguugcuguuucugaccuagcuuucugguucauacacuggaaaauuccuugcauuuuaauaugacauauguguuuguauuuuguguguauauaccaugcucucaaaaccacccacugcaaguaugcgguggugugaguaccucagggucuaaugcuccuucuguuugaucauguuguuggguuaugacuuccaaaugcaaauuucuauguuauccuuauauacaauuuuaaucucuucuuuuuacaaauggcugaaguucacaugaacaauuuauaucacugaacccuaauuauaaauguaguuggccaccugacuguacucccacuccaugcccucccugggggguuaaucaccaccuaccucccuggcugcuuggcaaaggcgaugaagacagugagaggaagcgggguggugagggccaggaguguguguggggugggacgcagcugccaccacaggaagagaagaaacacacaugcccuccugggcugcccucaagccuuccuaaacccaguuaccuuggaauguguucauuuaacaaaacaaacaacaaauguggauuuggcuuucacccccaaaacccugugcccuaauuagcuuacaggaguucaugcaauacuugaagacuaaaacuuaguauuuuaaauuucccagggaauuguacagaggugaauaaauagaucaugccgagacuccggguggcaguuagggauggaggagcggggcggacgaugaggcuggaguagccaccccugcauggugcuuucugugcuccaugugacaccccuuaggagacggcauuuaauggauccuaggagggccccgcugagcgagcuguggcauuugucacugggacucuuggacauguagagccauuuuauuuuccaguguccagugggguuagugguuuguagucugcuccucagcuggacuggaagcccucagagggcagaagugccuauuucugcugcugcuccaccccagagcugaauuuuuccuuguucacccagccauguauuugacgcccguaggacugcuaaagcugaaaagaggauucuucugccuuccaggcuuguccuugacacauacauuuucccuacgagccgaaauaauuuucagcaucauuuuaucauuucucauuugucauuuucagccucucgagagcauuccaggauguuguuuuuauucaucuucuccucuuguuuuuccuccuuuuaaaaugaugcugggaauggaaguuauacuugugugaaacugaaagugcuagaauugggugaaggaugauggcauuuuucuuccuauauaagaaucauuuauacuaugauaaagaauauagcaguuggaggaaaaaagcuuucaggaguaaaacacuauuauucauugccuauuauaauuuacaaaaacaacaaugcuucucuuucuaguagcauaaaaccgccaacagcccaaguacaagugcuuagaaguguaagacucauuaaugcuauuugccuuuguuuuuugauguccuggauccaaccccauuagcacugauuauuccgucuacccaaaaaccccaccaggacucaggcgugcacucaaaauuaaggcuccaauuccauucaagagggacauuuaaaugaccaagucccaggggaaaaaaaggccgcacuguagcugaagguggccacaccaaggugcccaugccccuuccaccugagcagcuucuguucugucuugccccucaccacauuuaaaagcgucugaacuuacauaucaucgaagacaaguuucugccucuugcagucccuguggccguuggagccuggagaccacggcuucgucugcggccgugacuuguggaggggaauguuuucagaauuguugugagcugcuuucuaaacaacaaacaacacacaucuuugagaaauuggccaccuggugaagcgagcagcccaucacauacauacauacguagaauaucuuuggcucuacagaacaucuuugugugcuguauuagaauugauggugauuuugucucaauaaagaaauacaugcauucuagguauuugcugagggcuucuaccuguguucucaacugucauucuuaugacacuaucaaaagggaagucaugacgccuacucucacagauccagaaacaggcuuggugagguucagcaaguugcccacacucagugacugugguggaggccagggguuaggguuuagaugcccacuuuucccaguccgcuagacuggaggcuggccaguucagucuucaucagcauccuccagggggcuggugaaaacacagauugccaggccccacccugagagucugggauucagcagggcugggguggggaccuagaaucugccuuuccaucugguucccggugaugcggaugcuguaaucacccaugauccuggaaccacgcuuucagaaccauucacucaucucaacagucaaccagucacucaucucacagguuugcugguucuuguuggcugucugugaagaccagaaggagucaacaggaaucacuaggaauuacuuaaaaaauaaaucgacugggcacggugucucacaccuguaaucccagcacuuugggaggcugaggcagggagaucaccugaggucaggaguucgaggccagacugaccaacauggugaaacuccgucucuacuaaaaauacaaaauuagcuagacguggugauacaugccugcaaucccagcuacucgggaggcugaggcaggagaaucgcuugaaaccuggaggcagagguugcggugagccgagaccaugccauugcacuccagccugggcaacaagagugaaacuccgucucaaaaaaaaaaaaaaauaaauaaauaaauucuaggccaggcaugguggcucacaccuguaaucccagcacuuugggaggccaaggcagguagauuaccugaggucaggaguucaagaccagccuggccaacauggcaaaacccugucucuacuaaaaauacaaaauuuagccaggcguggugguaggugccuguaaucccagcuacucaggaggcugaggcaggagaaucguuugaaccugggagguggagguugcagugagccaagacugcaccauugcacuccagccuggacaagaacaaaacugcaucucaaauauauauguauacauauguguguguguauauauauauauauggaacacacuagucuguggaaaaguuuuaaaaaucacauuacuugggauacagacauuuacauggcaccuauugugugccaaacacauggaucauaaaacaaugucagugguuaggaaaugcaaaugguuucucugaaguaauuaaauugaguguauacaaaugcuucuuuaaauagggacugcuuuuacguguagcacuguaaggguuagagucuacugucauagaagaccaggaagcucagaugucaacauuuuaaaauuguucuuaaacuccuccaguggccucugcuugcucuugguaaaaggagcgaucccagccaaguggccccucagccauucuuugccuguggccucuguuccccagauucaugagcgugugcaguucuuucucgggaccucugcacuugcugcuuccucugccuguaaugcucuuugucucuuaguauauggugacuugccuuuuagagaucucgcaucaggggucagccaucuauggccagggagucaaaucuggcccuuuuuuuaaaauaaaguuuuacuguaaaccaauccugccuauguauuuaucuacugucugcuuuccugcuacaacagcagaguugaguagcugggauggagacugugcagcccauaaacccuuaaauuauuuaucugacucuuuacagcagcaguucucaacuggggcaaguugacaaugcccggagacauuuuuaguugucaccacugcgagugggugcucauagcaucuacuggguggaggccagggaugcugccaaacauccuacguugcacaggacagccccaccacaaguaauuacucaguccaaaaugugaaaaccugcuucgcagaggccgggcgcgguggcucaugccuguaaucccagcacuuugggaggcugaggcgggcagaucacgaggucaggagaucgagaccauccuggcuaacauggugaaaacccgucucuacuaaaaaaauacaaaaaauuagcccugggcgugguggccggcgccuguagucccagcuacucgggaggcugaggcagaagaauggcgugaaccuaggagguggagcuugcagugagccgaggucgcgccacugcauuccagucugggugacagagcgagacuccgucucaaaaaaaacccaaaaaaccugcuuugcagaaaguuugccacuccuaggacuaauucaagcugcuuuguuauaagagcuccuaguucuuugugaguucccuuuuuaguacugaaaccauugguggugaaucaugcaugugugugauccccuguauaaggcucucucccuagaacuguaagcuucaugggggcacaaaugggauccgcuggauuguuauugcaucucuggugcucagcacagugcccagcacguaauaaguacuuaccgaaugagcaccucuucggugaaaaauaacuaaauaaaaucuacaauugguuuauaguucucugcguaucauaguugcucaugauauaaggauauagagggaaauaaaaaaacuugaguugguggcuuuuuguuccauguuuuucuaauauaggucuuccccaauucuuucagucuagaauuaaagaccacugcucccaagugagggugcacaaaaaagguucauuuccugaggaugcuguaagauuuaggcucucgugggaacuuccagcaacuuguaauaaucuuuaauucaugggauaaaguguuacacacugcucccucccucaucuuucucaucuuucuuugcagaauccuguucuuuuuuuuuuuuuugagacagagucucgcucugucacccaggcugcagugcaguggugcaaucucggcucacuguaaccuccaccucccagguucaagcgauucuccugcuucagccuccugaguagcugagauuacaggcaugugccaccacgcuuggccacccagcugguugugauaggcacagugauuaugacaggggaggguuuggaaguaacuaauguuccugaaaggaugagugguccaggaccacuggcuguuagaggcuggcauggcagugaagaggaacuaacauguaguguuaguugcuuaggcgucccuagguguuggaguuuuuuuuuuuuuuuuuuugagacagagucuugcugugucgcccaggcuggagugcagugccgagaucucagcucacugcaaccuccaccucccagguucaagcaauucuacuaccucagccuccugaauagcugggacuacaggcgccugccaccacgcuaggcuaauuuuuguauuuucaguauagaugggguuucaccauguuggccaggcuggucuugaacuccugaccucaggcgauccgcccgccgcagccucccaaagugcugggauuacaggcaugagccaccacgcccggucggggucuuuucaugauauugucucuuuuaagucuuaucacuaccauuuugcagguaaagaaacaggagcagagagauuaagcaacuggcccaagaucacacugcagcuaagaggugaggucagauugugaacccaaguccccugcucuuccccuggggcgugcuggaaucacccgagaucacuggaaaaggggugguggugggggucccccacugcagcugcgacacuggccaauaagggcagagugggggcccuguagcuuucagugugggguuucaaucccagauuuaacucugcccugggauaagaaauuuuucccaacagaaagauugguugguucaaacuccuaauuuacuuugucccgggaugguauuacuuugaggucuuuucuuuucagaaggaaaaauaaaaucuugccuaagcaaccgaggguuagaacucucccucaggguucuucuuccccgcucucuguugggacagugaagggggcuguccucuguugggucuuccuagaagcgggaggcauucaggaauucucaagggaccucaagcauguguucagacugugcuagguuagagacagagcuugggggugcucaauuucauuuugguuuuaauugggaaaggaagagcaucaacaaaccgugaggucuccgccgugaggcugcagcuggcugucggccuuaggcuuuuugcuggaagaggcugaaguaaacaaacuguugccauuaggucggcuggaagaaguuaaguccucgcugguguauuuguguuuagaugcaucagagaggggugagaugggcgaccgaagcauuuuuucauuuuuauuuauugguauugccacacugaaaaaggaaauuacgguaauggaauguuacagagucagcacagggaaagguaaauguuuucauaugacccaaaccacccaacugggaccuguugguaggagaagcuuauugggaauuauuauaccaggaaacaaguuaauggcauuaggaucauaacaaacaauaagcaaaucucacucacucuuucuuuucucuucccaucaggaugaguaguaauucuggagccagcaccaaaguacacgacuaagacuaauaacaccuucauuuuccaaguccuuuauccaaggaucucaaaauacccaacaaacaacuuacuguuuuccuaacaagcauaaggagcaagcagugggaaagucaaucaacaacaauaaaugaauucuacauuucugucuuuuuuugagacgggaucuggcucugcugcccaggcuggagagcaguggcaggaucuuggcucacuguagcccuaaccuccugggcucaggcaauccucccacuucagccuccugaguagcagggacuacagguaugcaucaccacaccgggcuaauuuuucauauuuuuuguagagauaggguuucaccauguugcccaagcuggucucgaacuccuggauucaaggugccucggccucccaaagugcugggauuacagacaugagccaucgugcccagccaaauucuacacuucuuuuuauuuuuuauuuuuuugagauggaguuucgcucuugucacccaggcuggagugcaauggcacaaucuuggcucacugcagccucugccuccuggguucaagugauuuuccugccucagccucccgaggacucccgaguagcugggauuacaggugccugccaccacauccagcuacuuuuuguauuuuuaguagagacgggguuucaccaugucagccaggcuggucuugaacuucuaaucucaggugauccaccugccucggccucccaaagugcugggauuacaggcgugagcuaccgugcccaguccauauuccacauuucuaaaaagacuuuugcuaucucaucugagcuuguacuaaauauaauauagaaaaauaauaaaaccagagaacaaccugcaauaugugaagccaauucuuaauaucugaguuuaugacuuaaccagggauugaucagauuaaaccuagaauauaaaaacggugaguaggaggccgggugugguggcucacgccuguaaucccagcacuuugggaggccaaggugggcguaucacuugaggucgggaguucgagaccagccuggccaacacggugaaacccccucucugcuaaaaauacaaaaauuagccgggugugguggcgcaugccuguaaucccagcuacucagcucaggaggcugaggcaggagaaucgcuugggagagguggacguugcagugaggcgagauugcgccacugcacuccagcaugggcgacagaauaagacuccgucuccaaaauaaauacauaaauaaauaaaauaauaaauaaaaauggugaguagaaguuacaguuucugauuccuaacuccuuauuuuaccuucaaaacuacugucugugcuugaauguaacauucuccaaaaucaaccaucagugaagagggauucacuuauaucugaguuugcaauguauauuauauuguuaggccucuauuacuuaaaaguauuguuuggggaagacagauuaguuugaaauaaacucagucaucacuaauuuaggauacuuccagaggucaccugguagagucaguuaaaaaaugguaaagccaucuaacaaagauuuacucauuauucuugggguugggaucucuuaauugcacguguugguuaucaccgcaaagaagccacuaaagucacuucgaaaagcaauuuccuuagcugguggucacaguggagaaauuacaaacacagaccucuagaacaaaugacaaaaccaagguucugaauguuaugcaaauggauacauguggggauagcauuucuggugaaaagcacuguuccaaaagcacggugugucuaacaacauagaggcugugucacgcaaaagugcuuugggagaaucaaaaguugcucaucuagugauggcuaagaugcugaugcugaagauaaugcgaacagccugauuauaauuguuucucgaaaugugagugaagaaagaccuuuuccucagucucuauuauuugacauacuuuaugauuuuuacagugcauggaaaacaaaacugugacauuaaauauuaucauggauaucaugauugccuguuuuucaucacugcaaguuuauauauauauucaaguuggccaaagaaacuuucuuuggagcucuucuuugaaauuggcaauccccuucucuuggacugcuguacagcacugguaaaacuugauaguaguaaucacaauuccagagguacacagaccaccuuucucagaauguacucuaagcauuuuauaugcauugugucaccacuuaacagcaacaaaaccaucagaacuaagaggcucuuccaggcuaagucucuagagcaagaguuuuuuaaccugggguccaauaacuugaauagagaagugaccucuucauuuucacuaaccucucacuguaacagaacauuuccuucaacuaugaguaaagguaugaaaccagagucaugguuuagcaggagcaguaguacaacacuugagaccgugucaccgguauaaaucacagcuauuuucuuuuuuucuuuuucuuuucuuuuuugagauggaaccucucugucgcccaggcuggagugccauggcacaaucucggcucccugcaaccucugccucccggguuugagcgauucucuggccucagccucccaaguagcugggacuacaggagugugccaccacacccagcuaauuuuuuuauauuuuuaguagauacgggguuucaccauauuggccaggcuggucuugaacuccugaccuugugauccgcccgccucagccucccaaagugcugggauuacaggcgugagccaccgcacccggccaaaucacagcuauuuucauaucauauugcaguugugcauacauacgguuuauauuccucacugcuuagaaauucuggaagccaccagaucagcuagaaagguuauuuagugcauuaacaagcacuaaaggauaucacacauuuaaaaauauuuggggacuacauuuuccccauuuccccuuucccaauauuuugggcuggcauccacccugcaaagaggaccgaggagugggcagcaugcaggggcagcccucccuccugcucagacccacaggagcccucgccuuucaaggugauuccggcgcugcagugugccugugugugugcacccucacccuccaguucccucgccaaguuuuagcacugcucuacaucuuuuccuaaccuuucaguuuacauuuuuauguguugugccgagacauucaucucucuucaaaauucuauguauacggucagggagggugaggagugucuuagagaggaaaagugguuuccgugcugugguauuucaaaauggaaagagcuucuacgacugaugauaagcuacuuguuucuaauaaauaccugggaucuugcuuugcuuguaagccauucaucacagaggggagucagugcuggaugcguccaucuggaaccucuugagaggaguguguggguggccauuuaaccuugggagcacggacccuucuaaggccacaauuuuagucuauauccaauuaauugcuuuaggugcuacacauggagauucagcuugaaguguguauuucuucgucuguguaauaagcuuaguguucuuaggaguuuagcgguuaccauuaaaauauugauuagaaauucaguuauuaaguuuuuuugggggaagggcaugucuuggggagugcagagcuguguguaacuaguaucuggucuuugguuauggagaagaaccuugcgugaguaucuggagcuauaauguguggcacauguguagccauaauaauaagauuuggguuaaaggagggaagcaagucugcagaccuugaccagaguaguccucaaaaagccugacccuccuccaacauagcaggugacuuucagacccagagaucucuccagcucacuuccacuuuggagggaaugcacguaccuguugauguucauguugcagugguuugcagacaaaguauuacugguggagguggccagucuugaagagcugucuuucucucccugggacuucuugaucucccuguagucgucuucguugucacacuguaugggaauaaacuaaagucaaucagcacuggauuucaagagguauuaugaguucccaggcaccgacuuccacagagcaaggccuccugggagccccacucaccuggcuuccccgaagcacagccugagcagcugugccccugccauagcuuccccauuagcuccucaacaagcaaggaugaaaucugucaguuuuacaauugacagcugauggagaggagaggcacgacgccaugauucaacauuuugaauucugaaagcugcucugccaucaaccggcuuaggauuuagcccuccaacuggucugaguucccacugcagcuccagcggcacucaccuuggcauuucuugguaucagaauaaaguacagcaaguguguguucucugggauucaugccauaagggcaguggcaagccuggacuuuucuguuuuaaaaauucuugcuuuggccaggugcgguggcucaugccuguaaucccagcacuuugggaggccgaggcaggcgaaucacgaggucaggagaucaacaccauccuggccaacauggugaaaccccaucucuacuaaaauacaaaaaauuagccaggugugguggugcacgccuguagucccagcuacuugggaggcugaggcaggagaaucgcuugaaccugggaggcagagauuuaagugagcugagaucacgccacugcacuccagccuggugacagagugagacuccgucucaaaaaaaaaaaaaaaaauuauugccuuuugugaacugcaagcagaagcuauuaucucuuggugccuuaauucuaguuuucaauuacuaucccaugacaucuuagaauccauaaaguaccuuuuucuaaaacaguacuuugauuggauccuuguugccaugauuggguuuaauuuuauuuguuuauuuagagacagucuugcucugucacccaggcuggagugcaguggugcgaucauggcucacugcagccucgaccucccaggcucaggugauccucccgccucagccuuccaaguagcugggaaugcaagugugugccaccaugccuggcuaauuuuuuguauuuuuuguagagacggggcuuugccauguugcucaggcugaucucaaacuccugggcucaagcgauccucccaccuuggccucccaaagugcugggauuacaggugucagcuaucaggccagccuguguuuaacuuuagauauguguuaaggugcaacacaaauauauucagaaaguaccauuuuccaugagauaacaggaaccuaguaugguauccucagggcugucugcauuguuuuccaggagacaagugccaacaccaaagagagaaagacucugacuuucucgcucuggcugggauuuugccacacagccucugccacaggggcucccagaugcccacacuguaauaguacccccauggagggcccaaaccaaagcuccgaguucuuaguccuuagcuccagggcuccagcagggcgagacuccacaaauuugacagccaggucuauggggucccaucuccagcacccaguacugggguacuaaugcccagaauaccaaguaaagagcacuauaagaauguucuuucacuucucuugugucuguguuuaaugauucuuuagauuuuaugaguacagccaggugucaggcuuacuguaaaugaagcuucuuaaguuaaaauaaaaauggccauaaguaauacaacuauuuaaacacagaauauuacggaauuuuauguaagucuuucugcacaucucucuaguaaacucugcaugccuggauggcuuuauguauuuccaaucugucuauauauuaccaaugucuaucucugcauauuucauguguauauuuccaucagcguauucaguuagccauccaucccagagguaauagccacacucauucccagaugauuaacugauugauugauuccuacacucaacaaagacugagcaccagcaaguaguaaggaagacaggguguguagagaaaaacaggaggaauagcagguagggaagaaaaugagcugccaaguauuacugaguugcauuguuggaacauauugugugaaucugacaacaccccugcaaagaugucaacauuuuuuuuuuuuuuuuuuuuuuugagacagagucucacucuauugccaggcuggagugcaauggcaugaucucagcucagugcagccucugccuccaggguucaagcgauucuccugccucagccuccugaguagcugggauuacaggcacgcgccaccacgcccagcuauuuuuguauuuuuaguagagacaggguuucaccauguuggccaggauggucucgaucucuugaucucgugaucugcccaccuuggccucccaaagugcugugauuauaggaguaagccaccacggccggcccagaugucagcauuuucuagauggagaaacugauguucagagaaaguaaggucaccugauuaaggucacugaggaggccaaggaccauaaauaaccuucugggucuagcgcaaaaugaaaacgcugggcccuuuguucaaaaagcaggaaaagagugauguuauaaagcccucaaauagaaaacauucuccauucuuucacagucucugucauggaggugucuacaguauuugcuauacacacuguacuucuuugggcauggggauacuuggggaggcaaguguagccucucaagggcucugucugcccuuggacaagguauaugugugcagcccaccagugugggcguuccccuucugccaaucagaggcccuaccuguggugcccgaguugucaggcauuuccccaacaacccacagcaagugggcaacccccaggggauuucaagacccucuuuggaaugucuuacuaccuggaugagggaugggcaagauucuuccucugccugcaccuaggccccuucuuggggcaagggcagcaauagucccuggacuaagacaggaagugggaggcugccuagggcccagggugccaggaggcagaagcgcaggcagaaccugcccugcagaaacaggcaggaggugggaacacagugagucaaagcuccauaugccccugcacauguaccaucaauuugcagcaucacaaauucaaagauuacaggaaaaauuuuaagauggcagccacaagcauucaauuccaaggggcccugggugaugcacaccacuauggucccaugcauggggcccaugaaaagcuggaccugcaggagggaaacgguaaagacaggauuugaagucaggacacuuuggugugaaaauccacacacuuuccauuauaugugagcacucucagggcaauggggaccaacuaagggcgcccacugccggcuaauaauggccagugcuggguggaaacuauguuggggccucuuuauaaaauuaucuuugcuggccacgugcaguggcucaugccuguaaucccagcacuuuaggaggccgaggcaggcggaucaccugagguugggaguucgagaccagccugaccaacaauggugaaaccccgucuguacuaaaaauaccaaauuagccaggcaugguggcacaugccuguaauccaagcuacucgggaggcugaggcaggagaaucacuugaacccaggaggcggagguuguggugagccaagaugguggagcaucauugcacuccagccugggcaacaagagcgaaacucugucucaaaaaaaaaaaaaaaaauuuuuuuuucuuugcauccauaccaaggaaaagcaaaaagcugccccuugaacauauuucuuuucaugaacuuucuugcaagggcuucaaauucuacuuuauagggauaaauuacuuaauguuauuaauauuaugugaagaaaaacauccuuugguacuuuauuuuuuauuuuauuuauuuauuucuuugagauggcgucuugcucuguugccuaggcuggagugcaguggcaugaucuuggcucacugcaaccuccgccucccagguucaagugauucuccugucucagcugccugaguagcugggacuacaggugugcaccaucaugucuggcuaauuuuuuguauuuuaguagagaugggauuuuaccauguuguccaggcuggucuugaacuccugagcucaggcaauccgcccaucucagccucccaaagugcuaggauuagaggcuugagccaccguacccggucugguacuuuagaaugaauuucucuggucauaggugcccuuagguuacaaagaugauugucauaaaaaggagacugagugccuucuccaugcgcacuuacaaagcaagaaauauauucaucguggccaggacaagguaacaagcuguacuccuuaguccccuucucaaucagggauucgaaauagcugugaaacguauguguccagucuaacuuuucuauugauagacuagacugucuucagaaaacuggaaaauauacagaccucagacugauuucuuauugugacgcucugaagccagacagccuggguuaauuccuggcucagccccuuaggaccuauguaaccuugggcaaguugcuuuaggcucucugagccucuguucccucuccguaaaauggguaugacaauauuugccucauaaaguuauaaggaugaaaugauuuaacauguauaaagugccuagagcagcaucugucauggggaccuauauaccugugagcuguuguuacugaaaacuuuguccuaaauuuggagccauccaugcauauugcaaucuuggucugucacccauuguauuuuucacagugauaaaaauuacuuaugaagauacaguaacaggagggguuaaaaacccucaaaauuggcuuuaauggaugauuaagguauuccccugcacaaaaaccuucgaaaugggcuacacguucaggcucugcugccagagaugccccccagcucucccuguccuugcuuuugcugcccuucucacucccuggacucaccgcuuccauuccugacccuggacguauucaaauaucccuccucuacagagcccuguuuucagggccccuccaccaugaagcccuccuugaucaaugcuaacagaagcaacagcugcugguucugaugcugcaucagggucugccguauucauuuucaccugccacaaccuugaacuucaugaggccacuggccucuugggccaaugagugaucccaccaucaaugucaccccauuccugccagcaaagagugaggguucucauguguuuagcuuucucacaggcccuacauccagcugcgugugcacacgcuugauaaauauuuccuauuuugacaugcagugggacaaggcuuaauuaccuauaacuauaaaauagggauaauaggcugggcgugguggcucaugccuguaaucccagcacuuugggaggcugaggcaggcagaucacuugaggucaggaguucgagaccagcccggccaacauggugaaacccugucuuuacuaaaaauacaaaaaaauuagcugggcauggugguggacaccuguaaucccagauacuugggaggcugagguaggagaaucgccugaaccugggaggcagagguugcagugaaccgagauugugccaucguacuccugcuugggcgacagagugagacucccucccccccccccaaaaaaagggauaauaaugguacuucccucacugagcaguucuaaggacuaaguuagauguuaagugcuuacaacagugucuggauauagaaaguacccuagaaguguguguuagguaaggacacacaaaacuccugcggcagccuaccgucccaaacagcagccuaugggugcucuauccaaguacccacaaguuaagagauagccccuuccccuccacgcccccgcaccccagucagccccaggccuaccuugcguuuccucuuggauuuuggcaaagccuuuucugcagguguguccgagguguggcugggcggugcgcucucagaguccuugguggcaggggcgcucaauaccccuggcuccuggggcagguguucugggauccuggacaggagggucaggucgauuuugacccagagagaccugaucucaucacuguccuuuagaggggagagaaguucguuccggccaaaggggaccaguguguagaacugcuccuccagcuccuuggcgaugucacuggugguccuggcguugauggagccuacaggggcccuaggaccacugcccccguuggcagcggccuccuucagccucugaucauucccggaggaggcagaggcagccacggucugugcuuuggacagaggguacuccuccugcucggacuccaggucggaguccgaggaggaggaugaagaugacgacucugucucaaugaacuccuuggauuuggggacgauccugcuuagcccccgcgugcggcgcuucucgcaggucacggaggagcgcagcuccuugcgguggcucgcucuguuguugccacagggccugguuuuggugggcuccggggggaccaccacgcucguccccagcgcguccgcggccgcgggcuccucgggccgguggcaguuggcgccguccccggcugagguccucucggugcgccuggugggcuucuugcccgcggaccuccgggcaggcgcgggcgcguucuccgcgggcgcacagggcacugcggguggcggggcggcugcgcucaccgccacggccacggccgcgggcggggacuucugcuucacgccuuuacucccaggggccuuguuggcuguccuuggccuuugcuccuccuugcaagugcucuugaucuccuucucucucaggcugggcuggcaaacgucggggacuuucccacaguccuggacguccucuuucaccggguuguaguacugauugcucucugacccguggcuuucauuuuggaucagaauaggaggcuuguggggauuaacuuuguuuagccauuuauccagcugccacuuguuagaggaugccgguucagccugaaagcagaaaaccggugacaaacaaaacaucuuucauuacaggcucacuuaaaaggggccuggcuguuuuuaucuugacuuacuucucuaaguauaugagcagaaaacgaaugggcuggaagcaaaaggaaaauggaagcauuaagcguguguggcagccccauguggcacucaggaugccuggaugaugcuguccuuaccggcccguggcacuaaauguccuugcagcacuuccucuuuggaaaaauaaggaaagcauugugucucauuagaacccauuuccuaguacuuuugaguguuaguauaaauuuuuuuauauaauuauauguacauauguaaacuugaaauuccccaaaacucagagaauuguuuagaggcccugagcauaaaucacuuguuuuuuuggugagacuuaaaacuuuggggagaucugaagggggacuaaguggaaccuacaaucccaaacaauuaacacaugauuuauguguugaaggcagguaggcuguaguaauuugguaguaggagcaaugaccuugggaagauggcuuguuuugcauauagaacuauuucagagguauuugugcaucuuuggcagccugacugggucagucuauccucaaccugcuuccaucacacuuugcuagaaauauuucaaacauggaggugagauggaacacuuuccugcaagcagguuugcuaacuuagagcaacucaugaaagucauugguuuugaacuguggccccacagguuggcucugugguugaggguggggggauggcuagggaaugcccugaaauggaugggaaauguguagaugcauuuuguuucuagaagaggucuguacuuuucaguugugucucuaagaaucuaugucucagaagcaaaaaaaaauuaaggaccaauccaauaauuucacagggaguaaaugcugaugucuaaaaagucaauuuauccagcauuaugauaauuaagagaaaacagguguauugagaagaauagaauuuuagccagaguauuuucaauuugugacucuaagugaaauggggaaaguauuuuggcuaaggugauguguuuuuucuucccuauggccuuccaccuuucgaauucguggcauccauuguuucagaggagaccagauaccaggcuagaguaagaagacacugcuuagcuccauacuucaagcuugaucaguucaagucuagagcaaauugggucuguugccagagaaaaaaugguuuaacacaauaaauaaaaauaauaaaguuuaauaaaauuuuaauaaaaauaauaaauacauuuaaauaauaaaauuugaaaagguuccuuugaaguaucaagguuuguuuuucaacagugaggccuguauuaagagcagaacucagggcucuuggccucaccccaggcacugaggauuucagaaggggaauaagagggcuguaucauagaagcaggggccuuggcugaguccgggcacaacucagggaaaugggaagccucugaugggccagaacggguuggggccaagaggaauuggccacagagcguggggaucaggcaaccagagcuaugacagggaccauggacaucuugcugguugccccaaaccagaugggaccaacugcccuuuggggcagacuggcacagggugucuggugacuuggagaagcaagaaaauuucagugaaggccagaaugaggaugaaggccccuucccugggcugugaggaugcggaagcccauccuggagugcagguggggaaggggggacccccuggccccgacacagauucuggucuuugacgugacauuuuucuuugcuuguuuucauggccaccaacggaaccggggcaccagagaaauaugcaaaugaguagaaagacagaugguuuuuguaccucugaguucugcguaaaucaugaccucgcuuuauuuggcuucuccagagaaagggaacacgggaaaccuauggaacaugcccagugcauguggcgguggcagaugcccucccauggucagagaaagcaggacagugggacacggaacagcuucucggccaagggggaucccucaccuccccugagauuagcugagagugccugaaaacuaauuugguggcaaaaaucaauggcuucuaauuuugucucccucaacccccauuucucucaucaagucagugccuucgccugugccucagcuucccuagacaaaugggacacaguaaacaggaauggaugcugaaggggccucuugcagaaagggugcacauauuggaagagggcacacacacacacggcagaacacaccccucacacuggccccgccacugcguuucacacuaguucucccucacugcuaccauccggagccuucuauagcccacaucucauaugugagagaagucuguuuguagccaaaacacagcugcacacaggaaaauucacacugaaacuuccuagcaggagcauuaacagaagggcagaauuuaauacauuuaguacaggcccacugccugguaugcuuuagggucauuuuuucugcacuucacagcugaggaaaucaguuugaaguacccacuuucaacacaucacuaaaucauacuuuuuuuucccucaaggaucuacaauaaccuccuauugccucucaaacaaaauccaaauuucuaaggggggcguuuaagggcguccauuaucucguaaucaucuuucauugucagaauaccuacaguuuaacucccacuucauguguauuaucucauuuaaucuuuacagauaagaaagguuaucaucccuaacuuguagaugaggcucagagaggcuaagggacauacccagagcugcacagcuaccgggcucuacggagacuaacuuuguacucaucuagguuuaaagaccaauugucuccacggcugcaucacugugucucccacuguuuggcauagccucgugaaagggggaccgcauuccuuugagaaaugucagucuucaacuuaaaaugacagaauuagaucugaauuuuggagaaaacaccaagaacacuccaaacaguacuuguugcccucuguuauacucaauugcguugucuuuugauguucguauuuguuucauguguauauaugucuugugucuucaaaaaagccaaaugcuucuuucaggcaagggccaggucucuguuucuuuaguaucccuugcagcaucuauacuaggucagggaggcagauugccacaucucuccuccuaauaagaacaacucacaaugaggugucacucaaauuguaccauuuauuccuuuauuaucaucauuuuccccccgacaaccucacagguuaggcagagcaugauuaucugccauucuggaaaugaggcaauuguggccaaggaagcugcaaggauacagaguuuaguggcagugaggaggggaaccucaggcugcagacgccaggccacuggcaugcggcuggccacaguccgccuccugagccguccauccgggguuucugcccaagguucugguuuguuugcuggcucacugcuuuauauuuucagccaugacucuccucccuaauugaucuucccucugacucacgcaccagcucuccaucaugcacucuggucccugcuucaucuaaauccuucaaguacccgcugccauggaccucguaggcaccuaauaaaugagaagcuuguugagucagcgagcaacuugaaucacauuucuguugauuuuuaagaacgaucuagggcagcauuuuccaaaaugugcuuuuagcucaucuaucccaugaaggaggguuuccagagucagaucaaucugggaaaugccacaauggaaaacacaguacacccgagcaauaguaaggguugcgugaugauucgauagguaaagagguggaaucaaccuauuuugucccagaucucuuuaacauuagguauccaggcuuuuuuauuuuauuuuuuuccuccacguaauauauauuguacaacaaaggccgagugaguuccguguguggggucaacauguuagcugagugcaaaagcaacuucuccugcaaagcucugguauaagaggcuguacagugccuggaaagcagauuagacuccggugagaaaaaguugucugagaccaaugaagcccacaucaugccacagagagggccccuccaugcuacgcgggaacauggcauuaccauacuacagugauuuacgugaaacaaauuggcucucaacacacacagccagaaagaacaucuccuacgcaacccagcugagcccaguggguuuucugagugcugggacaugguggggagaauacagggcgccuccuacgcccauagcaggauguuacagcaggggagugaggaacagaggcguucugcuucaaagcagcacaaacuggucugagcagcggaaugugaggugcauggcuaugaagagccugacugucaugugggguucaggaaaaggagucuuacagcucucuguaaggugaccugggccagcuccgccagaccaggcagcacagcuguggaggacacacagggugauguuacuuccugccuuugccauuugcagucugcaaacucauuuucuuucuaaagggugugugugucuguauuauccuuaggaaaaguguuaaaagaacuuuacuuuuauuccaacaaauacauuucuuuccugcagaaagaacgaacgugcagccuggcuaacacaucaccugcugcuucugcaguccucuguguagggaagccaggaauccaaaaccacacauagcaucaggugacuuaaacuuuuaggacugacuccuuuaggaggcucuugccccucuccuuagcgaggggccucugauagcugcuggaagaaaugacaagagccuccuuucaucacccaggaguucaagucuuuguaauuaucucagugacauuuagaaagcauuugcuuaaagcacuuuauaacuguacugcucuuuuuuucuuucuuucuuuuucuuugagacggagucucgcucugucacccaggcuggaguacaguggugugaucuuggcucacugcaaccuccgccuccaggguucaagcgauucuccugccucaggcuccugaggagccgggauuacaggcgcccaccaccacacccagcuaauuuuuguauuuuuaguagacacaugguuuuaccauguuggucaggcuggucuugaacuccugaccucaugauccaccuguucagccucccaaagugcugggauuacaggcaugagccacugcgcccggccaacuguacuggucuuaaaugagguuccagccaacacaggagcucuaggaccuacauuucaggaugaaaauaagccugaacauucaugaauuuaaccugcaaagccacaaggaggagccuggauggaugaucuucacagacacaaacaguuuuuggauauccucacugccugcccuguccuugcacugucccugggacgcaguuauuucuuauaacuaaauauuccagaauuucuccacaaaguauagcauaaagcaggcuuuaaagaagccugcuuaacucuucuacuuuauuuaacuccuguauuuuuuucauuuugaauuauccccauuagaaugucagcucuaugaagauagggacauuuuuugucauauaauuguguauuccagggccaaguacugugugacugaugcucaguaaauauuuguugaaugaauucugaaugaguaaaugaaucaaugaaugaguaaaugaaauuaugcugaaggaauaauaauuuaguuucugggaaaagccaggguuauguuaccauaaggcuuucauagguuaauguugcuaagagccuuccccucauacagagauugauagauggauaaauagauggauagauacagauggacagauggagaggcagagacugaaccucaugggaaggagagcguggagagauggcuugguucaggaugaauggagaguccugagccagggcagaaaggugcugaggagaaaaugaggaguguggggaaacaaaaugucccugauuucacagugcuccugcaaaaagcuuuagccuccugaaagaaguagggaggggaaaaaccugaaggaacugaagagccacucugugaaccugagauggaaccacugcuuucaggugugauaacauccaaggcaccgcuauaaaagcuggacacggggaugcugaucgggcccauuaaggugcuccccucccacugagaugguuuguagaaguggguuuaguuccauuucagagccuauuuaggaauauggcccccccaaaugguacagagggcuguaaguaaaaaauuaaaccugacaaucauuagucaugucaaauguuuacgcacucaagaagaaacucuauuuuacuccuuguuuagaaauuagagucuacccuuagagcucugcagccuggggaaguuucucucagcccucucccaagaaucuucaugcucugaauuacuauuuaauuuuccccuuccuacuuuaaaguagaaacagcaaugguuuuuauugguaccuucuaauguuuuuauaggaggcaccuaaaucuuccacauagauacucaucacagcuauaaaagguuucaucauuuuuuuagggugaugcuaauuuuucuuuuucuauuuucacaaagaaaacacaguuaagaagguuuuauuaauauuuauagcccuucuucuucugauccgugacaaaccgcaaaaagguaagaaucugaccauguccaacccauaaaaccccuuucccugugauuuauggguggucacacuucccaggcggugaguggcucuguccagcgacugcccuggcugaccccaagggagaccugagccauagguuauuuccugucagugauguuuauagcauacuuggaaauuucuggaagucaagagagaaucugggggcaaugaaaguugauguuucuguacuucaaaggaaccugugaaauuaggagacugugaggagggggaaaauguggagcccgaagcccauagccuccuccuucccagcaccuggcuuggggucugcaggagggaggagaccugcagcagugugacagugacaaugcccggacuugcuauccucauagagacagaagugggcagaggagaggccugagccaggcagcgcuuaccucggggcuggagaagugggggggcuugcugcccucacucucgcuggagcugcucucggucuccgagucagauccggagcugcucucugagucgcuggaggagcugcugcugccgcugcugcugcugcugcugcugcccuugcuggaaggcaccgagguucugcaguugggcugcuggaccacggcgcugccagcccgcgaggcccccgggaagcagagggaaggaaagccaagugagcaaacaggaaaacaccaccaagcugucaugcacccuaaagagggaggaggcacgcagccuacacaucugucaaccaugaccuggaacucaaagagcaggcaucgaggucaaagucauccuaaagguuaaagcaacucauauacagaaauaaaauugggggugaaguuggugccccuugguagucgggcacugguuauucguguggccauuuuggaagggaaggugguauaacauccaaauggcuguuuccauuuugcugcuguucugggaauggcuuuucaaaugcauccccaaauccaaucaucuacaaaaaugcaaggaaauccaaaaagcuugaacuauuuugcaaagcaugaaaaugacugcuuuauuuuugcccuagaggaaaaugcagcaugauggcagggauuaggcagagggcugucaggaagggcacggcguucugcucugagcuuucaugaccugcuggaagguuccagagacgaagggacuguccaaguucaugucuugcuuccucccuuuucccaccuguaguugagugcuguagcgauuacaggugcugggauguuguuauaaacuguaaccuuccuuugagcccuuuccuagagaacugaagaucccucacugacacacuuucguauauuccggacuuuaaaauucaaucccggugcugugacuuauaggaacugcauuucacauuuauacuugauguuuauauccaugcugaaauuugccagaaagucauuacauacucaaagauaacaagaaaaauugacugaugcuuuccgauaguaauuaauuaaccauaaaaauucaaauagcauacauccacccagaaaguguuugagcagaaaagaaaauuucaguacucacauaauauucaacaucuucaaaguccuuuauuaacaaaauugaaacacaccauacuguguucuuuugaggucaagcucuaaauaccaaaaaugccggucacucuuguauguugagucagcaaacugcuuccaacugugaccagugcuucuauaggaccgagcaucaaugaaggccaggggccagggagcuuguggggguuuacggucucaagugcaaagcagccuggacaugguaaaggacuuguuucacccaucccuuaaaucuuugauacgugcuuugcccaaagaggacuuucauaaauccuggguauggggguggggauggagguaauacucauuggagcuuuguuucuauaaaaaccaccagacaagaaacugucuugcaggggaucuaaaaauaaaagcaccucuuggaacggcaggguuaggggaaccagagugugaacauaacuuucccuagugggguuuucauuucuuccaccaaugucacgguccacacugauugucugacaaaauucuucagcagcagacaacaucugcacauuuaugccuugccugagcugcagcgauuucuuuuccagccuguuauuugugucuagaauugagugaggaauccuggaucuuaagacagaguagggcaaggcacaguuagagcucaggggcuguaauauuucuuuccuuccuuaugaacaaaaaucugucuuuccuguuggcugaaucgagaugguuacugucauuggaaucauaaaaaaaggacgauugaauucugacugaacaugaacaucugggauccauguuaauagucuguagaaccugacagaaacaagcaauggggaaaggauucccuauuuaauaaacggugcugggagaacuggcuagccauaugcagaagacugaaacuggaccccuuccuuacaccauauacaaaaaucgacucaagauagauuauagacuuaaauuuacaaacuaaaacuauaaaacccuuggaagacaaccuaggcaauaccauucaggacauaugaaugggcaaagauuucacgacaaagacgucaaaagcaauugcaacaaaagcaaaaauugacaagugacaucuaauuaagcuaaagagcuucugcacagcaaaagaaacuaucaacagaguaaacagacaaccuaaagaauaggagaaaauuuuugcaaacuaugcauuugacaaagcucuaauauccaguguuuauaaggaacuuaaacaaauuuacaagaaaaaacaaucccauuaaaaagugggaaaaggacauaaacaaacacuucaaaagaagacauacauguggccaaaaagcauauagaaaaaagcucaauaucacugcucaucagagaaaugcaaaucaaaaccacacugagauaccaucucacaccagucagacuggcuauuacguaaaaauccaaaaauaauagguguuggcgagguuguggagaaaaaggaacccuuauacacugguagaaguguaaauuaguucaaccauuguggaagacaguguggcgauuccucaaagaccuaaagauagaaauaucacucaacccagcaaucccauuacuggguauauacccaaaggaauauagaucacucuaucauaaagacacaugcacgcguauguucacugcaacacuauucacaacagcaaaaacacagaauuaacucaaaugcccaucgaugacagacuggauaaagaaaaugugguacacauauaccaugaaauacaaugcaaccauuuaaaaaaaaaagauuauguccuuugcagggacaugaauggagcuggaggccauuaucuuuaccaaacuaaugcaggaagagaaaaccaaaugccacguguucucacuuauaagugggagcuaaaugaugagaacacauggacacugagaagggaaccacacacacuggggccuauuggaggguggaggaugggaggaggcagagggucaggaaaaauaacuaauggguacaggcuuaauaucugagugaugaaauaaucuguacaacaaacccccaugacacacguuuaccuauggaacaaaccugcacauccugcacaggugccccuuaacuuaaaaaaaucguuuuuugguagaucccaaaacacucaaaacacuggggggaaacacucaaaaauaaaaaagcaaaacaacacauggcucaaaagcuuccuuguuagaaggaugggguugggggacauagauguggaggaaagauauguguuucucugucacccucuggagugacaucugccaaagauuagcaaaugaagaugaauaaagaacauucugauuggugaucaaagccauuggacaucauagaaaaccaaucaguauauucuaucugcuuucacucaacaaaaaacaugcgaugcugguucugugugcucugggcuuugcguguacagcagaggcagcaaggugugugggauuccuuguggcuugcaccacaaagugacugucuuuugaaaacuggcacuuuaauuucugggaaagcgcccauucaacaguuaccaugcugccugccuuuaauggcugcgguccugaagugaugaggcacacuagcccaaggaggcagcaucuccgaucugaauuacauuggcagaaaaaccuuauacguuaauguuuuccuuucuuaaauuacgaaauucacuuaaaaugacaguuuuacuggccuaacuauuauuuguuuuuaaaacagcugagagagccaagaguuuagguuuuucuucauacuuuacuuguaaggguugugaaauuuaugaugucuggauuaaauauauucauguuucaauggucccgguagagcaugcauaauauccagaaacaaucauagcaaagaugggggcagacuuuccuggaagggcgcugguagcuccaguugugggaucaagaucacucuccccacuuccacaaaggcaacuccucuaacccauccuugcauggggccuuggggucagcugaccauucuggccucaguguagugacugcucccaccacgggugcuugcagcugcuuuacccaucguggggcagcugcagcagugaggguggcagagccaagaugaagaagccaggaauggcauucccugcagacgagugcuagugaaaggauggacucggcuaagccacaaacacacacauauacauacgucuauagaauuuguuguugcccaggcuggagugcaguaguggucauagcucacugcagccucgaacuccugggcucaagcaaucaucccuccucagccucccaaguagcuggaacuacaggcauguaccaccauacccggcuaauuuuuguauuuuuuuuuuuauaaagacaggaucuuucuauguugucuaggcuagucuugaacuccuggcuucaagcaauccuuccaccucagccucccaaagugcugggauuacagguaugagccacugcacccagccuaggcuuuauauauuuaaaauugcaaacugaaaauuuuggugugccaauugguugucauguuuacauaccaaagaugcuuuaaaaaaauuaacuuaagccugggcagcauagugaaacccugucucuaccaaaaaaacaaauuagcugggugugcuggcaugugccuguggucccagcuacucaggaggauuacuugagccugggaggucaaggcugcaguaaaccaugauugugccacugcaccccagucugggugacagcaaggcccuguaaaaaaaauauauauauuauaguggauuuuuuccugaaaugauaacacggauugguugacaugaugacauaggcuuggacaauuuuuagcaugcuaccuaccaaguucuuggacccagugccaucucaugaacacggugccauuugacagcagccagaaaacauuauugagaucauggaauaaaagucuuugugucaccaaagcucagcacagugccuggcacauaauaagcguucaugugugauuacuaaaugaaaaaguaaagagaaaaaauccaacacuggguuaaugaguuuuuuuuuuaaaaaagagauugaaucuuucgagaagguuauaaugucacuuuuccaauuaaaaaauauuuaaaaguacuucaggacgggcgcgguggcucacgucuguaaucccagcacuuugggaagccgaggcgggaggaucacgaagucagaucaagaccauccuggcuaacauggugaaaccccgucucuacuaaaaauacaaaaaguuagccagacaugguggcaggcaccuguagucccagcuacucaggaggcugaggcaggagaauggugugaacccgggaggcggagcuugcagugagcugagauugcgccacugcacuccagccugggcgacagagcaagacuccgucucacaaaaaaaaaaaaaaaaaaaaaaaagaguacuucagcaaccuuuaagacagacuucuucccuucugagaauauuucuuuaaauguacucaaguuucaucugcuauaauuuaagcacaguucccucuuggaugguuuguuuacuuuuugcauuuugacuucaugaaauguuuggcugguuuugugaguggucagagccaaauacaccuuugagagggguccagcuuucucuaaaugaucugcuugguguguuucuuccuauggcugugaugacaccuuccuuuuggaaucuggccuuggcuaagucugaaugcagaucauaaaagaaaagaucuggaggcugggugcaguggcucacgccuguaaucccagcacuuugggaggcugaggcaggcagaucacaaggucaagaguuugagaccagcccggccaacauaguaaaaccccgucucuacuaaaaauacaaaaaauuagcugggugugguggugggcgccuauaaucccagcaacucgggaggcugaggcaggagaauugcuugaaccugggaggcggagguuacagugagccgagauugugccacugcacuccagccugggcgacagugugagacucugucucaaaaaaaaaaaaaagaccuggaaccaaaaugacaaaaucuuggaucucacagucaagggugcuccugccugccaaguguauuguggggccugaauacauauccaaaauuguccacacacuuuuaacugacaaguaacuuggagagaggcucucugccugguuguugcuguguggacagcuguggugcccacaucgcaccacacaugcugugggcacuccacugggauugacugaauaacaauguuugcuccuccucuucaacacucuuugagaacacaugcuugauauccaaaccauaaucaguguccuggcaacaguauuccuuuauuaauagcaucacuauugauauuaauucaucuaaaaccauaccacaugguaagugaaaaugguaaaugcgggauugaagagguuugcuauugcuaagaauugucgucuaaaaaaaaacccaacuggcaggacuguugcuucuauccugaaauguaauuguuuguucugcaacacuuccaagaaugauuucucuauacaacuuggcuuuugaagcucuucagggucuggucucaaucagauuuccagcuucaccucaaugggucuaucccuaaaccuuggcaauaauacauuucucagcgucuggacaggcugggucuguuuccagcagggugcccuugcauaugauauuuucugugccagaaaguccuuucucccuuuuuccuuugaguuacuguuaccuccuacucccucugcaggacugaguggcuauguuucccuacucuguaaagguuuucccagcuccccuaggcaucaaugauguuuccuccucugagucccucuagcacacugcccacuucucuauugcagcccuuaccacguuaaggauuggaaucaucuaauuuauccaugcaauguauuuuuuucuguucccuugggaauaugcaggaguucuuaaaacugguaacuuuagaaugcuaucauuuacauacguaucagguugaaaauugagaacccacgggggccacgcaaguagcauccaugagugaaguguucagguauaagcaaaacaaauguguaacauuauaaauggcaguagacccucagcuccccagccgaggggaaggaaccaaacuggagaaucccacuaggucgaaugcugcuucuccaggcuagccuaucucuguaccuggaaacaagagcucauuauuaccaaaucuuuugauuuuuuuucacaugaagccccaaauccuuauguuuauaucaaaucuccugauuuuaaaaugcugguaacuaauuugaaaaguuuuaacaaugaaaaguuucauuguauuuuagcaaugaaacacauuugguaaagaaaacacacguggguaagaagaggccuguggggcaccauucugagaccucugaucuaugucccauuauuacauguuuugagauggcucaauauaaaauagaaaaauauagagaccacaaccagaagaaguuuuacccacucaggaauuuagacuagcagggccagggacaaacaaggggugaaccaaacacucucacuuccucagcccaccuuuuuuuuucuuaaagugaaagcaaguuuauuaagaaaguaaaggaauaaaagaauggcuacuccauagacagagcaguuaccaaacaccauuuuguauuuuuuucuuuauuuuuuuaaccuuaggauuuguuuuuuuaauuuuuuauuuccauagguuuuugggggggaggggaauagguggcauuugguuacaugaguaagcucuuuagcauugauuuaugagauuuuggugcacccaucacccuagcaguauguacugagcccaauuuguagucuuugaucccucacuccccucccaccuuucccccaaauccccaaaguccauuguaucauucuuaugccuuugcauccucacagcuuagcucccacuuaggagugagaacacacgacgcuugauuuuccauuccugagucacuucacuuagaauaauagucuccagacccauccagguugcugcaaaugccauuaauucauucguuuucaugacugaauaguauuccaugguauauauauacaccacauuuucuuuauccacuuguugauugauggaucaguccacuuauuuaaaaaauucuauuuugaaauaaauacagauucacuggaaguugcaagaaaaauaguacagagaucguucuugugccccucacccaguuacucccaagguuaaaucuuauguaacuacaguacaauaccaaaaccagaaaacugacaauggcacaauauacaguuccuuguaauuuuaucacauguauagauugucaggccucugagcccaagccugcauguauacaucuagauggccugaggcaauaaaaaacugcaaaagaagugaaacagccagcuccugucuuaacugauugaccaaccuuacaacauuccaugaugacuuguuccugcccugccccaacugaccgaucgaccucgugacauucuucuucuggacaacgaguuccaucaucuccccaccaugcaccuugugaccccuccucugcugagaauagauaaccaccuuuaacuguaacuuuccacugcuuaccagccuuguugcucacacaaagccuguugguggucucuucacacggacgcgcuugacauagauucauguaaccaccaccacgauuaaaauguagaacugucccaucaccauaaagaucucccucaugacacccuuuuaggagcauucacgccgaccucugcccucuaccauuccuaaucucuggugaccacucaucuguuuuccgucucuaaaaugcugucauuuugagaauguuauagaaacagaaucacauaguuauguguucuuuuuuaaacuaaauuauugagauacaauuuauucauaguaaguguccuuuugagaugggccuuuuuucagucgacacaaugucaugagagccauccaugauuuuuaauauauccauagcuuguuucuuuuuauugccggguaggauuccaugguacagaccuuuaaagguuccucuguuuuuuaaccauucacccaaugagggacauucuggcugcuuccaguuuuggacuguuaagaauaaggcugauaugaauauuucuguauagguuuuuauguggauguaaacguccauuucucugggacacugcuuccgggacuuucaaauuugucuuuugucuucagaauuggacucugaugagucuggguggggauuucuuugaguucaccuuguuugggauuuguuagcuucuugagucuguagguuuaugucuuuuguaaaauuuggcauuuuuaaagccauuaugaguaugaauacuuucuggauaauuuccagccucacucuuucucuuguccuucuggaacucugaugacacccacguaagaucuuuucuuacaguccugcaggucccuggggcucuguccuucucuaccccccagucuguuuauucucuguuguuccuaucaggcaauuucucuuguuccaucuucaaguucaguaauucuucccucuguucucuucauucugcgguugagcucauccauugaguuuuucaaauuuugguuauggaauuuuucaguuauaaaauuucuauuugccuuuuccuuguauuuucuguauuauuguggugagacccccccuacuuuuucaguugucucaagcuuguuuuuaauugcuuacugaagcauuuuaugauggcugcuuuaaaaugcuugucagauaauuacaacaucuguguuggucucaguauuagcaucuguggauugucuuuucucauucaaguugagauuuuccagguucuugguaugaugagugauuuucuauuguauucugagcguuuuugguauuauaauaccuugauuuuuaaaaauuauugcuuguuuuugcaggccuccacuaaugcgauguuggcaggggaagggaggguugucucccuacaguugugcaaagguagaaguuuaagcuccccacucaggcuuugcugauggagagggggccacaguuuuuuuuccccccacgguguuugucuggaauagggugguuauugucuacaaguuucccacgguggcucacaccuguaaucccaacacacuggggaggccgaggcugguggaucacuugaggucaggaguucgagagcagccuggccaacaugguaaaaccccaucucuacuaaaaauacaaaaauuagcugggugugguggcgcgcgccuguaaucccagcuacuuggaaggcugaggcaggagaaucgcuugaacaugaaaggcagagguugcagugagcugagguugcguuacugcacuccagccugggcgacagagugagauaucaucucaaaaaaaaaaaaauuuauucuugcuaggauaugaauuuccugacccuuucacuacagagaacuggcuuuccuguggcuuccgucugugccuacugccagguugccagcuucuccagcauccacucugugcuauacaaggaaaaaaggaaaccuggggaagucaccaccaugucuuuuccucaggcccgaaggcccaagcugauuugccuucuccccgccuuucagccuuauuauguuuguuuuauauguaacauccauggaguuuagcuguacuuagcaggaggaagaggaaaaagugcauuaacaucuugucccagaacaggcaaccacccacuugguauuuagcaaguagaaaggaacccucucucaauacuuccaaccuccagcucuaguuaauuaucucaaaagcugacgaaugaaacaauuacaaaagucucugcuauaguuccugcccauuuuaucaccuagucaaauuaggcauuaauucauucauuuaaaaacugcuauuaugagaauuaagcucagauuuuacaaggguguauaccaaaccugaaaaggacauguuaccaagaauguacacagccucgugagaaaaaugacucaaaugaaaugaggcuguaaaaauguuaaggauagaaaguugagugcuuuaaauguuauguucauagugaaacauucucucaguauaucugugagguaaugggcuuuccaggauuccaguuagcuggggacagagaaauggauuggaauaucuaaguguugacuuugcuuuuucccugggagaggauaggguuuugcugaugcuggguuuugcucaagauugaguuagagccucuuggggcaccuggaaucugagcuggugcacggcacaccuguuccagcucugugggagcaccucugccucagucauuccgugaccuugccuaaauaagccgaggaccucaucuaaacucacaggguguaaguuuguggucuuucccugccagugugugggcuacaaagcagcaugaucacaguuauguaaaaauauacacacagaggaaaaaaaugcuggaaggauauucaaauguuaacuguggauauuuuuggaugguggaauuauggggauuaaaugguuuuugaacuuuucuguauuuucaaaauucucauuuucuuuucaccaauaaaacacaugacaccauuuucaagucuacgugauugugggaaaugacuauucauguauuacugaauuuagcuugcucgcauuuuauuuaggaguuuaggggguugauauucacaggggaacuuaauauuuacauuuacauauuuuacauuuugggggagauuuuuggcagguuuuguaucaugaugguuuuagcuuaaaaguauaaauuggauaguguuuuaccuuuucauaguguucugggaaacguuaaguaauauaaaaguuaucuguuccuugaaaguuuaaaauaauuugucaccaauaaaaccaucuaaucucagaaccuuuuagaauggcaauucuuugauaucuuucacaauuuauuauuugguuauuggccauuaauucuuuugucaauuuuugaauuuuuuucccaaaagauccuauuuaauuuauauuuucaauuuuauuaccacaaaaguuauauaauguucucuuauaauaaaagcaugguaucuauuauauuacuucuuuuuaaauuuuuccucuuucuucauuauauuugccaaaaguuuucuauuuucaaagaaacagcuuuugauugauauaccauaauaacucuaguauuuucuggcuuugcugcuacauuuucauguucauuuauaauacuuuuacaaacuucuuguguugaaugcuuguuucagcuauguuuacucuuccuuaauaauagcagccuuugcgacuaucauucugccucugaguauacccgugguugcaggcgaucauccuuguuauguucuguuuuuauuuuccuuacuuucuaaauagaucauugaaguaguuuuuaagucuuguuugaucaaauagucauuuagaagaaugcuuuucaauaccugaugacauuucagugggauaaacauuacacuuagguccaaaaauaaacaggaugggaauguauaauagcuuagcacauguggaaaccucaguggucagcagcuucagcccggggcaggaaccuuagagcuguuuugagccgauuuggaaaaggugagaggagggacaggcagcacagcucauuaacucugaaccaggagugggaugggaguagagaauggccuggggaagggauuaggccauaaagaagacuuaugcaccacugugauaucccaaagggcccugaaaccuucuauuggccguagggaacaauaaaagucaacagaaccugccacauuuagcagaggagaaacucaguaauacaggagguccauaaacuuggacauaaauuaagucucacauuucacugcugaugcuauuguagcaucuggaacucuuucaguuacaaaccaaagaauucaaagauccuccugaccagcccauuaggcauuuacacagacauaucagggagugaggugcugaggcccaacuuccaauuuaagaacaguguugagacacaaggcuugauccccaauuugagauaccagagagcacagaugucaccuugugggguccuaguuacuuccauaaaaugucauagaugacaauaagccauuaguucuuaaccaggugcuggaucccgugcucucuugcuuagaggggcgcuuuggcuuggggaaucuguucuaacacucgaaacauuucuuaguuuggaauuccugaguuuauagcaucacuaccugacuacugacauuugcuaagaaauacaauuucuuuuguucaggguucagcccugcuuuuggauuuaucagcuuuucuuuuucagaugggugaagaaccuucucuuguagaugaaccaagacaaaaaagcuauugcuuggagcucugggucauauugggaaccaaguuuuacuuucaguugaauaaagacccacguguggccccaccaaagauaaaggcauuucacaaauaaagaaaaaauacaauaauguacagacauucauugguucccaaauauuccugggcuuacugauaguuuuucagaguauaauguaauaauauauuuauuuaauacuaaaaguccaucagagaacaguuucuauacagcugucuucucuggacccagggcuuugaauggggcagagcccucuagccuguccuucagauggaaguguucuuggagaucuguacaugucacugggcagcauggaaauggcugccgaucuuuuuauguacgaacaugaauuaggcugggaguccagaugguagagggcccuggaggacgccaggcuuguccgcuguaaaaggcuucucugaaagcccuguguuggcuuggccagguccccucugcaccacacagcuuggcaagaccaguuugcagcugcacuucccgccuguccugggcacuguuugagagacugugacaagcggcagcugccuucuggugauacaacucgccuccccacuuucaggcgggugguaccacuagagacacugaguugaaaagcccuucuuggcccagagagaaccucaagcagggaauucaacauccuucuucgacaacugggaugggagcugccauguggccugggcccagccaugagaaagcugagaacauccacuuggacaacuccuccccuggcagagggagcugaaagcguggauggagugacugccaucuggugggcgugugggagccagggugcaugggaugggaggcgcugccucuuuggaggcugagauggcuggcuggcgggugggauggccgugccagggguugggggccauugcccuccagcugccaagagugagcaggcugccccagaugagcgaauaaccucagcaguguuucaucuaaccugcuugcaggacacagcuuccauaugcuuccaacuuccucugugugcucucccugccacugcagcugcuggauaugggcagggaagcuccuacucgauggcuuuucaggcaccaggucuauggggaaaugcugggagauucugggcuaccagaauugccugauacucugagcuucuuucuagcccuaaucucagagguuagauucccagggacugcuuauagaggugaaaucauguugagggcaccucuguaaacccaucugcuuccuaccucaauccuggaagagagaggcucuacugugaggaacaccucuuuuaccccaagcaaugggagcguuuuaaggcaauguaacccauuagagauccugccacccaugcacuuauuuguaauaguccuuccauuuauucauauauauuuucaguucgaggaggccuuuuggauagugcggccucaaacuuccauccucauggaaacuccauaauccauauggcaguaacacucuaccagagcucuuugacuuuuuuuuuuuaaaaacaucuuuauuaagauaaaauuuacauaccaccccuuuaaaguauauaauucaauguauuuuauaaucuucauaggauuguacaacuaucaccaugaucuaauuuuaaaacauuuuuuauccucauuuauccuccuuaaaagaaaacagcacuuugggaggcugaggcagguggaucaccugagaucaggaguuugagacuagccugaccaauauggugaaacccugucucuacuaaaaauacaaaaaaauuagcugggugugguggugugcaccuguagucccagcuacucgggaggcugagacaggagaaucgcuugaacccaggagguggagguugcagugagccgagaucgcgccacugcacuccagccugggugacagagugagacugucucaaaaaaaaagaaaagaaacuguguacaucagcagucaauucccauucuucccacuccaagcuccccuugcccccagcccuaagcaagcacuaaucuccuuccuguagcuauaaauuugccuauucuagacauuucauagacauggaaugauguaaguauguggucuucugugacugcuucuuucacuuaguguaauguuuucaagggucaucuauacuguagcguguaucagcacuuugcugcuuuuccugguugaauaauauuccauuguaugaauauaccacauuuugcuuauccuuucauuagcugauggacgucggauuguuuccauuuugggcuacuauggauaaugccacuaugagcauucaugucuaaguuuugugcgaacauacguuuucauuucucuuggguauauacauaaaagaggaauugcuggguccuuuguuaacucuaaguuuaaucuuuugagaacugcaagacuauuuuccaaagcaguugcaccacuuugcauucccaccaggagugcaugggguucuaacuucuccacaugcuugucggcaacuguuauuguccaucuuuuucauucugcccaucauagugggcgugaaguggugucucacugugguuuugauuuggauuuccccagaggaaaaugauguugaguaucuuuucaugugcuuguuagccauuugcauauuuucuuuggagaauguguauucaaauccuuuggccuuuuaaaaacuuauaauugaguuauauuaauuuucuauauauucuggauacaaguuguuuaucugauauacauugugcaauguauaucaguauauaucucugucugugguuuguguuuuuacuuccuugaugguaucauuugcuacaacacaaacauuucuaauuuugcgguaguucagguaaccuguauuuuucuuuugucacuuguccuuacuugacuucgcuuaauaguaacagauguuuaaauauauaggauucuuuaacuguuuucaaggcauuuucuuuucaagucccaccucugagccucacaacaaaccaaaggaguagaaaagucagcuacaguuaugucuacagaaggcagagcagagggguccagugacucacucuagguugcauaucagguuaguggaggagagagguugaagcccagaucucgggcuccuaauacuacccuguguucucucaggagugaaacuuucccaacaaguggggauaaauuaccaggcuucuggucccauuuggacacaucaggucauuuugccccgugaggcaggauggugcauagucagacagacccagguggacguuuuacugccucugcucgcuggcuauaugaccuuugggaaguuauuuacccucucugagccuuggcuaccucguugacauuuaaagggguaacaaaagugacaaccucauaguguugcuaggugguuuagaugagaaaaugcucauaacauucuuuuuuuuuuuuuuuuuuuuuuuuuuuuugagacagagucuugcucugucacccaggcuggaguacaguggcgcuaucuuggcucacugcaaacuccgccuccuggguucauaugauucuccuuccucagcuuccugaguagcugggauuacagacacucgccaucauacccagcuaauuuuuguauuuuuaguaaagacggaguuuugccauguuggccaggcuggucucaaacuccugaccucaggugaucugccugccuuggccucccaaagugcugggaucacaggugugagccaccgcacccagccucauaacauucuuaacauagugccuagcacauagcaaaugcucaauuaauaguuaauauuauucuuuaauuuuuauuaacuguaaugcuucuuccaacaaaguagccuaaccaguaagaauucuuccaguuuaccugcauuauuaacucacauuacccaucuggucauuuugcagaauuauaaauguuuucucaggaaggaauugaagagaucagcuaguccaacuccccagaaaacggaagugguguguacaagauugcacagcaagugaguuuucuaacacgaccucucagaagucuccucuuuuguuuccauaaaccuggcugcuucagugcaaagcuacagauagcucugaucgauucauucauucauucauucauucauucauucauucagagacaggggcuugcuauguuggccaggguugucuagaacuccuggccucaaacaguucucccagcuuggccucccaaaaugcucggauuacacgugugaguuaccaugcccggcccagacagcucugauuuugaacaaggucaaaggaagcucccaagagagacugcaaggacccagagagauggcagugcccagaucuuagucuggaaucacauuuggcuccugaaaacccucuuucuaacccagucucugucugaacaaaccaauuccauuucucuccuguguuuaaagcaaauaaagugagcucugaaugucagcagcaugugguguuuaauuugcaucucaccaaggaauacaagacuuaaggaugaugagcgaaaaagauuuuuauggaaaccaaauuacagcaucugagacacaggcuuguggccauaucagcucaagcugugaucuuguuagcugucauaaaccaagcuggguuuguucccugggugaggacacucagggcaaauguguaaaauauuacucagguguuucugcagggagugcuguucauccuuuucaaaggcugcaccacagagcacagcugauagacugugucuggugacagggaacagggaccacaauuaaaaugagugaaaacacaguaagaacaugcaugucucgccaucagaagccccuaaggaggggcgugcccgggauuggguaauucugaggcucaggggccuuaccaaggacuugggcucugucugucuuuccuuacugacacccuuggcuugucuuuagguggauucgccucacuccucugauggcugcugcgauucucacacacagaugacaguguccagagaaagggauauuacugcccugugucccuugcuaaguagaucaccccucacuggcuugaaugucaccacacgcccaugacuaagccaguuccacagcaaggguaauaaggcaacaaaugcuagcuuaggccaauuaacagucaccccuuaggauggaggacgaccaaccuccccugaagacccuggccacucagaguagagugacccaaacggguucucugugaggaagugauggaugacugcugagcaggcaaucaauggugucucccucaugcagaaggccugcuccaguaaugggauccuggguauuccagacaaaccagauuagcuagacaucugccccagaccaacaggcuggcuuggugggucaucccaacugagacuccgggagagaggcauugggccuaggaaccugcacaccagggcucuagucacagcugugcugauaaccccacugugggucucagugacccacaugaagagaugggcuuggacuagaugauuucugugguccgucacuucuaauacccuucgauaaauguauacuuaauuaaaaagaaaaaaacaggccaggucuggugacucacaccuguauucccagcacuuugcgaggccagggugggaggaucacuuggggccaggaguucgagaccagaaugggcaacauagugagaccccuguuucugcaaaaccaaaaaaauuugccaggggugguggugcacaccuguaguccuaauuacucggaggcugagguggcaggaucacuugagccaaaggaguuagagguuucacugagcuaugauuguacuacugcauuccagccugagugacacagugaggaccugucuccaaaaacaaacaaaaauccccaaagacccucugaaacuuuggauauuuguccuguccaaaucacauaaucugagcugcauuguuggagguggggccuagugggagguguuugggucacgggggaggauugcucaugaauggcuuggugcccucccccagguaaugagugaguucucacuuuauuaguuuaugcaagagcuggcuguuuauaggagccugguaccuccuccucuucucccucuucuugucaugugacacaccugcuuccccuucaccuuccaccaugagugaaagcuuucugaggccucaccagacacagaugcuggugccaugcuuccaguacugccugcagaaccaugagccaaauaaaucucuuuucuuuauaaauuaccuggccucagguauuccuuuacagcaaugcaaauagauuaacacaccguuuuuuaaauuacuaucccuagagaugccuaacccgaauuuccaacuagaagcuguguuaauuucuauuuuaauucuuucuguuccucccauuuaggcugaugagcaauggcgaggccaagaaaagaccagagaacccuggagccagagucacagacaauucacuccugcuaaucuucaguugacuauaacaagcugccugggguuuccucccuaaauucgcacacagcauugcuguguaacagcugagcaagugacagauuccuggcuuugcuaccucuaggagucuagauaauucucaucauaacuaagucugcuaugcugugcuguggguagagauuucuuaacuugcuguauauaaaguggcuucaagggaucugccugcgaccucguccacccagagcauuuuggauuucagguuuaggugggugaggauuuuucugccaugaagaauggucggugcuccuugccugucacuguugcucugcaaccauaugugccugguacuguucugagugugguggggacagaaggcacaagguuaaucauguccuuauaguuggaggaccuagaauaauguuuaagagaaaacaguguaugucaagcgcucaaugcggccauaaaauuccuaguccuaauucuuaguucuaagacuugagaggccagggggaagaacgaggaguagaguuuccaggcaggaauucuuggaggaaguggggccugaaacacugagcaggauuugcuaggaaaagagagaagggggcaagcuccaggcaaagcggguggaauaacaggaggcugggauuugcagggcgaguugugugggggaagcugaaauagacgcaggccacggggaggaaccauuuauccuuccuucaauuuuauagcauccagcaccaggcagcccuucuauuuagauaugugggugauaaggaagagagcugaaaaaacagacugggauugccugguuuccuauagggugugaagcugaaauucuaugagcaaaucuauguaauuuaaauaagacuacaccaacuaggacgugcugagaacaauacaggaccaggggucuccagccccacuuugguacagucacugcuggaguggagggaaaaugagucgagggugggugcguucuccuccaaccauggcaacucauucugaaugcacugcagaggcugugcccccagaggacccucagggaggugguccugaucgaagauggcucccacgugcagacgcugagaaugagcccaacccaugagaggcaaauuaccacgaacacauuuuauucaagggaaggaaugucaaagccaggccuuuguuucuuuaagguuugcugaaaauagaaagguuguuuuaugggcaggcugagcaaagagagagaaggcagagagggagugguaagaaaaagaagggggaaugaaauaaacuagaauguggucaauauaauuuuauuugcuuuauuauuccugaguauggugccaauaagucugaguucugcgacucccagcuccaccaucacagagaaugugagcaaucucgcuuccagaaaugagcugcccacuaaaaggaaaagaaucaccacaucacagaacaggccaauaaaacucucagcucagcccagccugauuggauggaguccucccagcagguucugaaugaccugugcaucagugcuggaggacaaggcaggccugccgggcugcagcccauucuuucauugaacucagaccauggggucaguggaugcagagucaggcccuggcugggcaugggcacaggcaggacgacucagacauguacuggagacaguccuugccgacagggagcucccgguggaagcucugguucaugucuuugaucagaaugacucugcuucaaacaaagguagccuugcuuuuuuccacugcagaaaagaugagugagagaguucccaggagacuuuugguggucgaagggagagaggacaggaggaagguauuuagucagacuucagagcacaccuggcagcacgugccuccguuaacuccaaggagcaaaaugcauuugggaccuccaauuuuuuuuguugaccucugguucuuuuuuuuuuuuuuuuuuuaacuuauaagauaggccuuuccugaugccaaauaagggcaaugaucagcuuccccauuccuggagccaggaccugccacaucauuugcagugcaaaaugcaaaugagagccccuuguucaaagagcaagauaaaagugccauccuaggcgcucaaaauacaaagguuccuccuuucuucuauggucugucaauuggucaaggcauuuuaauuugcuacuuaaugucaugcuugcugggcacuggaauacucaugcggugaguguaggaucccacggguaucuggaggcucgcccugcaauuuagcaugugcaaggagcuccccaccucugccagcccaggaugggcgugugaugcccuggcuggggugagugagguugagccagguaucucugugucucaugggcccaaccgacacgggagagaagacaauccccauggggacugcaaccuuugaacugggacacaugaggccucuggguuagggucggggagaggcucgucccccugcccagccacccacugcaugugcccuugugcugucagcuuggggcaaaacgcgggugccaugucugggccugugagcccuguccugaccuggcaugcacccaugcccuccuggggugcuggguagcagcaguuacuguguaggguggaacaggcaaggccagguggggccagggcagcaggcuggagcuggcagcugagagggacccaugggagccaaggcucugagcccaggcagaugcuccaucaucccauuggacuucacuuaaaaaacacgaauucaaagauaaaguuauuaaggauuucaauaugccaaccacagagcauuaaacuaaguaagaggccaucggcguacagggcccugggaggcugcacaguucacugcuccugccuggagccaccggguugcuucuaccuuugucuuccucuaaaagaaaaugcccaagccacagcuaccuccaagguucuggggauuguugccuucugaaggcauccaguuccugccaaucaucuacccagcuaccuaucugcuugaauuccccuaggugcuugcuaguagaaagguggaagaaaauuucccagacuaucuccagguaaccaaggaggugacaguuugggaagcuuacagaaagcuccauggagacagaauuuuaaauaagcuggagucccauguaauuaaaauaauuuugaauuaaaacuaccacuucaguaauugcuuuuauauuauaauauuuacuaccauugccauuguguaacuuaccucauuagcuacuguuggagaaaagucagucaaugaauaauuaauaggaugugauaaccaagggaguaaugguguuuaaaaacagagcuugaaagaaagugucacccacacgcagccccauuaauaagagccucgcaguccaaugccacuugcaaggaggugaggcccuggcccguugccuccuguuauuagaggucaauagaaaaaucuccucagccucaucacagacgugcacauaggucaggaauucuccuuaauggcagcaagaaaaagcuuccacuuuaucaaagcagacaguccuuggcacaaguaacucagcaaaaauacaaauuagaaauagcacccaaaggccagccaggugcugaggcugccagccaugcuucagagaaaguggcagucucgugucugcccuccggagacgaaggcgggagggcagcaagugggagcuccgccagaugccuccgaccugcauacggcuccacccuaccgauuuccaaacaggcccagugcuugcagcaagcaccacacacacuugacacacacaagauacagucucucguggaaaaucuggaggaacgguugugcacagcuccugcuggaagugagaugcuuauucuacugcuuggaaagagaggagauucauuuucaaggaagcuuucuugaagggcgagauagaauuuugacuuaaguugcauccacuguuuguauauagauggucuuucaagauccugacauuuucuuaugcaauuuccaagaaagaucaaauacuuuuagagaauacuuuuuucuuaacggucuuucaaucaaaauaucguuugcguaggguugccaggcaaaauacagggcaccccgugaaauuugaauuucagauaaacaaugaaaaauaugcaauauuagggacacauuuagacuacagaauuauucauuguuccuggauuuuuacuugcugaaucuggcaaccuuaaguuugcaaucuuucuuauccauccaacauaaagauguguggugcugagcaugucuggugcugagcacagagagggccuuucuuggagggguuguguauggauuacuuaaggaagauaaaugacaccuggaaacagcaucaacauuaaaccaugugcaggagauuuccugcuugaaauuuugcaaagugucuucuggguuguaugacaggauacuagacgaaaugacaagcgagaggauuaauuauaauuaaucacagaaggaaaguuugagggccugggaauucauauuucagguugccaaagcuauuuaaaaagcaauguaauacaacaguuguaauggaagaacagucagaagauaaaaguaaagcacugauaaaauaucauaugagucuauuucaaaguugcaaaauucaagguuaaaauauuucucuuuagagcuuuugaauuaguugaaggggaugaaaggcaagcuuuauguaaccacuuuuccagugaaauaaaaccuguuuacaucuuggugacugaaacaccuuccagcuaauuuagaauucucaaguggccacaugaaaagauuagaauuucuauaaaaagaaaugucccaguugcguuccaguucagguauagagaacgcaguuacugaagggucuucaguucaucugagcuagcugagugccacccaucggaagcugcugcguuuggacacuagaacauuagaagauguuauuuuauucaacagaaccagcuugguagaaauguuggaauuuaauaaagacaagcucucuuugugguguuuuacugaaagaacacaguaucugcaaaccuagaguccauuucccaagcucacguuuguuguugccaguuuuauuuuuacacuacagaaaagguagaaaauuccuuuggaaagucugccucccucccuuccuuccuuccuucccuccucucucuuuccuuccuuccuuccucuuuccucccuuccuuccucccucccuucuuccucccuucccuucccuccccucccuuucucucuccucccucccucuccuucccuuccccuuccuuccuuccucccucccucccucuccuucucuuccccuuccuucccuucccuuuccccuuccucuuccuuccuuccucccucccuucucccuucucccuccccuccccuccccucuccuuuccuuucuuucaccuuuaaggucagggguacaugugcagguuuguuauacagguaaacuuaugucaccggguuugaugugcagauuauuuugucacccagguguuaagccuguuauccauuaguuauuguuucugacuaucucccuccucccagccuccaucaacugacaggccccagugucuguuguucuccucuauguguccauguguuuucaucguuuagcuuucacuuguaagugagaacauacuguaguuaguuuccuuuccuguguucguuugcuaaggauaauggauuccugcuacauccauguuccugcaaggaacaugauuuguucuuuuuuauggccgcauaguagcauaguauuccaugguguguauguaccauauuuucuuuauccaguccaccacugcugggcaucuggguugauuccaugucucugcuauugugaauagugcugcaaugaauauaugcauacaugugucuuauaauaugauuuauauuccuuuggguauauauccaguaauggaauugcuggguugaacaguucuguuuuuaggucuucgaggaaucaccaguguuuuccacaauggcugaaauaaaauuuacauucccaccaacaguguauaacguuccuuuuucuccacaaccucgcuaacaucuguuuuuuuuugacuuuuaaauaauagccauucugauuggugugagaugguaucucagugucguuuugauuugcauuucucuaaugaucagugauguugagcuuuuuuucauaugcuuguuggccgcauguaugucuucuuuuguaaagugucugaccauguccuuugccuacuuuuuaauaggguuguuuuuuucuuguaaauuuguuuaaguuccuuagaaaugcuggauauuagagcuuugucagaugcauaguuugcaaaaauguucucccauuaugaagguugucuguuuacucuguugaugguuucuuuugcugugcagaagcucuuuaguuuaauuggaucccaugugucaauuuuugcuuuuauugcaauugcuuuuggcaucuuugucaugaaaucuuugcccauucauaugaccagaauauugccuacguugucuuccaggguuuuuauaguuuugggguuuuauacuuaagucuuuaaucuaucucgaguugauuuuuguaaaugguauaaggaagggguccaauuucaaucuucugcauauggcuacccaguuuucccagcauuauuuauuaaauagggaauccuuuccccauugcuucuuuugucaaagaucagaugguuauagguguauggccuuuuuucugggcucucuauucuguuccauuggucuaugugucuguuuuuguaccaguacccauguuguuuugguuaccauagcccuguaguauaguuugaaguuggguaguacgaugccuccagcuuuuuguucuuuuugcuuaggauugccuuggcuacuagggcucuuuuuugguuucauaugaacuuuaaaauaguuuauuucuaauucuuugaagaaugucaaugguaguuuaaugggaauaacacugaaucuguaaauuucuuugggcaguauggccauuuucaugacauugauucuuccuauccaaaagcauaaaauguuuauucauuuguguccucucugauuuccuugggcagugguuuguaguucucuuugaagagguccuucacuucccuuguuagcuguauuccuaggcauuuuauucuuuuugugacaauugugaaugggaguucaugauuuggcucucugcuugccuauuguugguguauaggaauacuagugauuuuugcauguugauuuuauauccugagacuuugcugaaguugcucaucagcuuaagaagcuuuugaacugagacaauggggguuuucuagauacaggaucgugucaucugcaaacaaagauaauuugacuuccucucuuccuauuugaauacccuuucuuucuuuuuuuuuuucuuuuuucuugagauggagucucgcucugucacccaugcuggagugcacuggcgugaucuuggcucacugcaacugccacuuccuggguuccagagauucuccugccucagccuccugaguagcugggauuacaggcacgugccaccaugcuugacugauuuuuuuuuuuuuuugagacagagucuuguucuguugccuaggcuggagugcaauggcacaaucuuggcucgcugcaaccucugccucccguguucaagcgauucuccugccucagccuccugacuagcugggauuacaggcgcgugccaccaugcccaguuaauuuuuguuauuuuuaguagagacgggguuucaccauguuggccaggcuggucucaaacuccugaccucaggugaucuaccugccucagccucccaaagugcugggacuacaggugugagcuaccgugcucagccuaauuuuuguauuuuuaguagagaugggguuucaccauguuggccaggcuggucucaaacucuugaccucaagugauccaccugccucggccucccaaagugcugggauuacaagugugagccacugcacccgggcccuuuauuucucuugccugacugcucuggccagaacuuccaguacuuuguugaauaugacugccuuuugaucaguuuugacccaguacugcucucacuagguuaaucagccauuucaguuaaggcuuggcccugagugacuuuugucagugaagucucaggauacaaacucgacauacaaaaaucacuagcauuccuauauaccaacaauagcugagccgagagccacaucaggaaugcaaucucauucacaauugucacagaagaacaaaauaccuaggaauauagcuaaccagggaggugaaggaccucuacaaugagaacuacaaaacacugcucaaagcaaucagagaugaugcaauuccucuguagacccgauuacauagacccuccgacuguacugagugcagcuuuccuuuuuuagaacaggcagguaggauggugucucagucgguuugggcuggcuauaacaaaauaccauagacugggagguuuaaacaacagacauuuauuucucacaauucugaaaucuucaaauccaagaucaaggugccaguggauuuggucccauggggaggcuccucgucccggugugcggauggccaucuucuugcugugugcucacaugaccucuccuuugugaguggucuggucccucuuauucuucuuauaagggcucugaucccaugaugggauccuacccuuaugaccucaccuaaaucuaaucacccccaccaaaggccccaccuccuaauacuaucacauuggggauuagggcuucauugugugaauuuuaagagaacgugaacauuuaguucauaacaggugcugagauagauaagcuagugacaaguaccauguuucacuauagacccccuucugagggcugccuaugggggcaaguguccccacaccucagaaacacuaacaucauggaagggugagcucaggaagacccacauuucuuuuacgagcuuugccuuuucuaagguuuuagcaucaagacuuccaggagaugcucuucaucggaaagcucauggccagaggcaaagauaacacuggaagcaugaugaggaugcgcugcaugaagcuugcaaagggggagguuaacacggaaauguuaaauacuaaccacagugauggcagugguguuagaaaacaucagucuacaauagcuacugaacaccugucucagaauuaaagacaugacuaggauacagucuuuacugcuuccucaauaaauuuacaacaaaaauagagauuaggccagagugggaaggauuacagucccagggagaaucaacaggcaugcuuucacaugguugggguacagcaaaggggccccugccuugguggaaagagaggggccagguauauuaguucauuuucacagugcuauaaagaaacuaccugagagugaguaauuuauaaagaaacaaauuuaauugacucacaguuccacauggcuggggaggccucaggacacuuacaaucauggcggaaggugaaggggaagcaaggcacgucuuacaugguggcaggagagagacagagagugagcaaagagaaagugccacccuuuuaaaaccaucaccuugagugagaacucacucacaagaacagcaugggggaaaccacucccauaauccaaucaccucccaccaggucccucucuugacauguggggaugacaauuccagaugagauuuggguggugacacagagccaaaccauaucaccaggcguguucugggcucaccuuguagaagaagugacguagcagagaacacaggguuucaauggucaguggagcugagacagaggagggcauuucagaaggaagcagcuaccagcuaaggcugaagacagggaaacacugugagcugcugcagggaggcaggcagagcagaacacggaguggggcucaggcagggccuggcuccugggagugccuggacgugugauccuuccccucggccgccaaagucccaggacuagcacucuagaaaugcaugugcucuucuuucccaaagaaccccagccccaggucaaugaaaugguuaagcuggacuucucuccacagguggccugauucuugugugaacugccaccugucaugacacccaauccagacaauguccuuuaaauuuguccccaucugccuaucaagagauuacccauaguaaaauacauacaauauaaaaauaaccauuuuaaccaauuuuaaguguucaguucaguaguguuaaaguacauucacacugcuguacaaccaucaccaacacccaucuccagaacccuuuucauuuucccaaacugaaacucaauaccccuuaaauggcaacucccaucuuccaucaccccaagcccuggcaacaaccauucuaccuccugucucuaugaacuggacuacuccagauacugcauauaaguggaaucauacaauaucuguccuuuugugaccaucuucuaucauuuagcaaaauguccucaagauucauccguguugcagcauugugguagaaucuccuucuuuuguaaugcugaaugauauuccaguguacagauaugccaguuuuguuuauccagucaucugcugauggacacuaggauugcuucuaccuuuuggcuauugugaauaaugcugcuguggacaggguguccagacaucuguucaagucucugcuuucaauucuuuuggguaauaaccaaaaguggaauugcuugaugaugugguaauuuuauuuuuaaucuuuugaggaacugccauacuguuuuccacggugucugcaccauuuuaguucccauaaaaaaugcauaagguuccaauuuauccacaaccuugccaacacuuuuuuuuuuuuuuuuuuuuuuuuuuagauagagucucgcuuugucacccaggcuggagugcaauggcgugaucucagcucacugcagccuccaccucccggguucaagcaauucucccgccuuagccucccgaguagcugggauuacaggcacccaccaucaugccaggcuaauuucuguauuuuuguagagaagggguuucaccguguuggccaggcuggucuugaacuccuggccucaggugaucugcccgcuucggccucccacagugcugggauuacagaagugagccacugcaccuggccucaacacuuuuuaauucuuauuuuaaguagccguccuaaugggugugauaagggguacugaguuucaguuugagaaaauacgauaucucacugugguuuaaaccaggacacuuuuaagagugaaggaggcaccaccuguaauuauacagaggcaugggcgcaagcuggggugacggcagcuaugguccguccagggcaucacacggggaguggugccacuggggccuucugagcuccccggggcugggguuuggaagaccagagcgccaggcuucguuggagagcagaauagccuucuuaggggcccagcuccuaccuaucaucuacccagcugccugucuaccugaauuccccuaguugcucacugaaagauagaagaaaauuucccagacuaucuccagguaaucaagguggagacaguuuuagaagcucaaggaggcuccuguggaaacaggauuuuaaauuaguugaagucucacguaauuaaaaugauuuugauuguaauggucacuucaguaauuccuugucuaugaaaauauuuaccagcauuacuauuguacaccuuaucacaucagucaccauuugaaagaagucaccagccacccuaaccauggaggugaagaguugagagugaaggaggaaacggaguguuugacuuuauccuuuaucacucgucaaggccaauggcgaaucaugucgcuuuuuguuuuuuuagugcgacuguacuaccuagagacacgggcuauuuggaaucagcuuuuuguuuuacacgccucuuuccccaaaaucaucugcuaaggcuugacaacagugcugagaggcggacgggugacuauuacucucuccacuugacagaugggaaaaaagacucagagaaauaaagucagucagucaauagucagggguacaucaggcaccguacacgugccgagauuugacaggcacaagcugggguuugcuguccauggaaggcaggaaaugaggugucucagcacagcagugaugagggucaccaaaaggcaagcagauggugcuguguggacgauggcaaugcauggagggccugcugggggauaggguguuuaagcuguagccuaacguauggguagaagguggccagguaagcuggaggggaggaaagaaaaggagccaggaaaggaaaacagcuccagggagaagguccagcaugugugcuauaguuugaauaugguuuuucugucccccaacaaaaccagcauuggaguuugagccucacugugugguuuugggccuggugggagguguuugggucauggcugugguggaucccucaugaaaggcucggugccguccucccagaagggagugaguucucauccuggcaagaugggauuagcucucauggaauggauuaguccaugaggguggguucuuacaaagcgagugguuccccacuuccuggccccucuuugcaccugcccacuucuccucugaccuucucuaccauguuuggaugcagcacagaagcccucaccagaagccaagcugaugucagugccccacuuccuguacagccugcagaacugugagccaaauaaaccucuuuucuuccuuccuuuuuuuuuuuuuuuuuuuuuuugagauggagucucgcucugucacccaggcuggagugcaguggcaugaucucagcucgcugccuccuccgccuccuggguucaagugauucuccugccucaaccucccgaguagcugggauuacaggcaugugccaccaugcccagcuaauuuuuguauuuuuaguagagacaggguuucaccauguuggccaggcuagcuucugaccucaggugauccaccugcuucggccuuccaaagugcugggauuacaggcgugagccacugucccaggccacaucuuuucuuucuaaaucacccagucucagguaucccuuuauagcaagagaaaacagacaagacaaugugcaugcacaggugagggagaaugaaaccucugugacugucuguagucacaugaggcuauggcagagcuaagcuguggcuuggcagagccaaggcuugaaggggacccaggaaaucacuggugagcccuuccgauuauucagggaaucugcauggucuccacagcccuggaguuucacuuccucauugaggcaagggaguuagaugacugaaggccggugcccagagaaacaauauaugggcaggguucacauuuuaaaaacccauggcauacaaaguugguguagagaagggagcaaaauuuguccuucauuuucaaaugcuagugaauagguaauaguucuccagucagcuggaaugaaggggaaaagcuucaagaaauaugucuuaggaaauaacguuggcuuggcacuccccuccuucauuauaugucuaaacacaaccauugcacuuuucaaguuuuuuuuuuuugucaucuucuauauuuaagugcagaacacagaaggaugguugaaguccccagauccacuuccuuggauagaacagaacuagacgagguguguucuugcaagcagcccccagcagaauccagccaucugggcaggagaacagagcagccccuggccccaugugcagugcucagacuugugcugugagcacgacuugaggcagagcuggauucugucauacacacacacacacacacacacacacacacacacacacauaugguugcuguauaucauguauaugauauauaucucuauguacgugauauauacacaacauaucuaugaauaugauauauacacauaucucuauguauaugauauauacacauaucucuagguauaugauauauacacauaucucuagguauaugauauauacacauaucucuauauaugauauauacacaucucuauguauaugauauauacacauaucuauguauaugauauauauacguaucacaucuauguauaugauauauaucauauauacauaucauacauauacacauaucauauauguauaugacacagggucuugcugcaucacucaggcuggagugcaguagcacaaucauggaucacuguaaccucugccuccugggcucaagcaaucuuuccacuucagccucccaaguagcugagacuacaggugugugccaccaugcuaauuuguguguguguguguguuucugcagagaugaggucuugccauggcacccaggcuggucucaaacuccuagacucaagcgauccucccaccuuggccuuccaaaguacagggauuacaggugugagcuaccacaucuggccaauuuuguucuauuucaagggcacucagguugauggaagagggaucucucaggcaucuagcuccaucugccaggcccucccugcugaaggccacaaugccaccccuaaaccuggcucuacccccuacuguguucauuaaccuugggcaaguggcuccaucucucuaggcuucaguuuccccacauguaaaauaaggauacugacauuuguccccugggcugucuggggaugaaaugggaugauggcagcaaguccccagcacagggccuggggcagcaagcaugcaacccugagagacuacgaggucacauacgccccccacaucugccaggaccacaugccuuugccagagaggggcagguuaucaucuggcuuggugggaaccuuccaacaacagcgaaggccaugaccacaguccuucuguaauuccauuaaauaguuuaguggcuggggccaugauucaaagagaaccuggaccuccuucacguagucccucagaugacuacaccuuaauuugcugugcuugcauuggguccaugguuauuuuucuuggcuucuuagcaccagcauuagccaggcugaauagggguuucugucuccaaaguaagaugaggaacuguggccuaauguggcucccugacucacuggcugggaacagggugaacagggccacagggaggccauguggggagcugccagggcuucagacucuuggccugggcugggcuucaucgaggcccuguccagucggcuggauuggggccagugagcaggcuuacuuugucugugaaauagaaaaaggggccauggacucacccuucacaagcaguugguucacuucaacauuuuaauggaaccgaccugaaauuaaugagcacugucacacugaguaaauacugccucucgggaugagagcggcaauggguagaaggcagugugacaauucaaacccaaggccacggacaauuacauagaggaagucuguucagaauuuggcggaucgaauggcuguccccaaauaacaggcaugcagauggcuggagucugaugcugccuggcgagggcagaggcagaugcugcauucugagggccagcaagaggacacgacguggcagugggccagccagccacagccgggagccagcacaggaaagggaguuggacggagucagaaggucaggccgccccagugaacagggagcacauuaaccuuuccaaagccacgggggagcuuaucaggcuccaaaaugcagucaucaaaggccagccagcccagugcagccaaggcuggcccggggcuaccucugggagcaggucacggggcggcagccugugagcggaggugagggcaggcccugugcccagagugagcagcugcaggguggugugcuccagcuggcucugggagucccaggcuggagaguggaauggucagggugggacuguuccaggggugggaaaaggggggaaauggagaggacgggaguggguagagggugcuggccugaagggcucuuaaagccagagagaacagacuccaugggcuuuggccaguuuucuuuacuaaaaggagaugaaaaacagaacaaaacaaaacagauuugauaucaugacuuuaacucccaugaaaaguaguuaaguaguuugguuuuaaacaaagcaaaacaaagcaaaacaccucagucuaucuauuggcuuuaaaaccacccacucaucacagaugcuuuugcggcacggccuccgcccacugcaggcacaggcaugagugaugaagacaguggcaccuguguucagaaacacauacgggcacugaaaugcaucuuuuuugaaucuuuuuuucucccugucacauauaucauuuguugcguuuggauugcuuuugaggucagaucuggcucaaugagaauggggacgacauaugcaaaauuaaaaaggggggacuaccagguguaccuucacauggcaucaguguaaacauucuaacagaaccgaccaccaauuaaccaaucaccaaccaacacauuccaugcagacagcaagugcuuaauuuaaucuaaguacauucaagaaggaacagguguacuucuacuucagaaauagauauuuuaaaaaaagaaguaggguagacagcagugacaaacacugaaaacuaugcuaauuaagucuucucucucuuaauuccaacuaugagacgucaugcguauuggauacuuaaaauuuuuuuggauguaaauuuaaauauaaguuaaaugaaccauuaugcauuagauacacaguguuauguuguccuuggucuagaagggacagcuacauuggcauucaaaaggagugugacauagugacaaagacucaaguaaaaauaauuuauagcuuagugauuucaauauuuuaccccugguaacuuaauauacuuagucugaggaugaguucagaagagagguagcacaaagugggaugacaacgggccagaaccaguauuuuuuuuuuuuugagauggagucuugcucuguugccuaggcuguagugcaguggcaugcucuuggcucacugcaaccuccgucuuccagguucaaguaauucaacuaccucagccuccugcaggugcacaccaccacacccgacuaauuuuuguauuuuuaguagagaugaaguuuuaccauguuggccaggcuggucucaaacuccugaccucaggugauaugcccaccucgaccucccaaagugcugggauuacaggcaugagccacuggccagaaccaguugucuuuucacugccucuagggacagucugguucccuuuggcccuuuccuguguucgcagacugcagcgaggcugggggacuccgguggugggggugggggacucugguggugcggguuaguuuuucucgucuguggucacagacaccuggcuaaggagcaggggaggggugguggguggggcugugcccagcuguccccccgcccacagaggaucuaaguaacuugcaggaagucuucuccacuagcagagaaggaaaggacgcauguccaggcuaaaacuccagcaccucaaacccaggaaagagaacaugggauucccagcccaggccuaugagaaagggggcaucuggaagaaccugggaaacuggcaucugcaggauguuugcucuuaccccccaccgccuguuuuuccuguuuuuaauucuggaaacauacacauaacaucaaauuggccaaggguguccaguuagguggcauuaaguacauguauguuguugugcagccuagaccacuaucauucuuucugaaagagaucaaaacucuucuaacugugccccagaucaagucaccccauguguuucugcaggcucgugggaauugugaacauugacuugaauggguuaaaacugaauuucacccggaggagccuugggcuguggccuccuuaccagacaucaggcagcgagucuguauuaguccucaggaaucccuggccacuaaaccaucuuaaagggcaauuaguggcuuuauacaacucguuauuuauuuacucaaaagacuguauccucagccugcucucuucuucuauuguguaaaauacauauuugggaccuuuuaaaauguguguuauguaccugauagaacucaauggcuucucuggagccauucuguuuuauuguggaaauuaguacuaggggggcuuuuaaaagcugauuuuuagacccgacagccugcguuuguucacguuaaugcaguggauugagcuaacagccaccaaagggcugugagggacaccucuguggccucucuguuggagcagugaggccaaggggcuccacuuuugugacuauagaugguacuugcugggccuguuagagaggagaggacugcauggagacucaguuggcacuuaucucucuucacacugcccccgacaguucucugccagggcucccccacguuauugaacauuacuguuugcuuuugaaauaauaaguauuauuuacuuugaaauuauaaaaugagaccaauucuuuggagauuagcuggaaaggugucaggauaugacccagggugacuuuuuuauguauuuauuuuuuuaauuaauuuuuuuuuuuuuuugagacagaaucucacucucacccagguuggagugcaauggagugcaaucucggcucacugcaaccucuguuuccuggguucaagugauucuccugccucagccucucgaguagcugugauuacaagggugugccaccgcacccagcuaauuuuuguauuuuuuuuuuaguagagguaggguuucaccauguuggccaggcuggucuugaacuccuggccucgagugaggggaauccuaaagugcugggauuacaggcguuagccacugcacccggcccaggaugacuuuuuuccgugaguaaaguaaaaagacaauguggcagaaacaggugguagccuccucggaggcaugcaggagccucaccugggacccaaagacccacaguuuggcuuuuaggagaaaacaggcucuaguaaaacauauuucaaaauagggauggcgugaguaauagaagggauauuucuuaggauuuguugauacuuguuuuucuauaauaucaauguaaaaacaugccccauacuacuaguuaugaauugcuucagacauuaaacccauacucuguuaucuucuucucuugguuuuuaagccucuugguaggacuuaaaucaaagaacaucuuaugauaccucaugcgugauuuuucuugguggugcgaugagguaauuacuaucauauggagggagaaaggaagcgccucuucuauucaucaccucuuuuaaucuguacauaaaccuaacaaggagggcauuaguagcauccugcuucugcaacugggaaagcugagacuuggauguguaaaugcuuugcccaaaguaaauuccagaccaaguucaaggacucaaaguccugugcuugcuucacgaugucuuguaaaaagaggagagaguagggaaagcugggccagaggguuuuuuuuuuucuuuugcuuucuugucuccuuaaucaugacagcauaaaugaguggcauaauuuguauucuuggucuuacugcauucaauaagucaugauugagcagucauuuuguauaaaguacuacuaauagucaagaugugguucuugcucucaguaguuaagaccagacauaaauaaaggaggcagagacuguaagcugggccuaugccaggaauuacaugaggugcugauggaauaggagcugugggcgcuggggcaguuggcuauuuaagguuuccguagaagaugaggcuugaccccaugcuugagggaugcacugcguaaccgaagaucccucccaugaguucuugcacuggcagcugucuagagcuggcuucagacacuuucuacucagaugcccacagccacagaggggaggccugccacucccuguccacccugcagccuggcccugcccaggccauuccuucuguguucuccucccuucuccacuccugggucacccgaugcuuccuguccuccacaugacaccucauauguguccucccccuucuccuuccccugucagagaguaggguaauauuguaccugugucccuccagugacacugauuucuucauagucugaugcagagggcugcuacugaaguagcuaagagcaccaacucuggagcugcacagaccacucuguggcuuuccagacugggggugaauuaccugaguuuggaaagcaagacucacuaggauuuuagggagaguacuuuagaagaugaaaugaggccaggugugguggcucacgccuguaauuucagcacuuugggaggcugggguggguggaucaccugaggucaggaguuggagaccagccuggccaacauggugaaaccccaucucuacuaaaaauagaaaaaucagcuggguguggagguuuaugccuauaauuccagauacuugggaggcugaggcaugagaaucauuugaacccaggagguggagguugcagugaacugagaucauaccacuguacuccagccugggcaacagagcaagacucugucucaaaacaaaaacaaaaaagaacacgaaaugaaaugaaauggaguuucauggaaaauaucucuuuaaggcccucacauugcauucuuccuuccucaccaagagagucgucgcgaggacuaaaugaaguaagguaugugagaugcucaguacacuaccggaccugcgacuguucuaaggagaucuaugacuacuuauguguaugccagcguugugguauacucaguauuuaugcacaagccuacauguccucuaccacacuguagauucccugcgaguggaauccuuggguaaugaauuuuugugucuucuauagagaccagcagaaucccuaacauuuuagggauucaguacuguaaauauucacugaaugaaugaagaaguacaaaugcaaaacauaaguaugaauaguuggugaagacagcacacuuuaagucaugucaacgguacgaagcacaaaaaugagggggcaggagagggagggaggagccagaggcuaucuggcccaauccccacucgcuacaagagacuucucgauagcaucauauaguucucuuuuguuauugaguucuaaucuaauuccacucuaauuuaauuauacugagugguuuugaucuuuuuuuuuuuuugagacuuucuugccuacuuuuggacugaguuuuuuucucauuuuuccauuucuucccccuguguguuuggauucuauaacauccauacaagcaggcaugaacaccucuuugagccacuaagcgaugagccccucaucaucuaccugugauuccugaggcaucuguugcaaggauggauagccacaguugcaaagaauuauuuccucuuuuaagcccaaaguugccauuauuuuaaccacaaagcauuggucuagcucauccauucauuuaucaaaugacuuacggugucugcuaauugccagguacugugcuaggugcuagagauaaaaagguuaccaagccagaaauauuguuacgaugcaaaacguggcccaaaccuccuaucuccgaccccagccaagcugcucuauuggugcuugaugggaggcaagagaaucauacugaccaggaguccagggaccugggaucuaguccuggcucugccacuuguggcccugggugaguugcaucaccuguucgcggcucaguuuucucaucuguaaaaugggccccaucuaucuuucaggguuguugugaggaucauaaaaugagacaguaaaugugauagugauucuaaacucuaaagcucucaaaguuuuuauucacaacuuaauuguacauuuaaaaauaacuaaaagaguauaacacaagggauaaaugcuugagguaauggauuuuuuaaaaguuuuuuauucauauggcauacuuaaaagauuuuuuuuuuuuuuuuuuuuuugagacagagucucgcucugucauccaggcuggagugcaauggugugaucucggcucacugcaacccccgccuccuggguucaagcgauucuccugccucagccuccugaguagcugggauuacaggugcacgccaccacgcccagcuaauuuuugaauuuuuaguaaagaugggauuucaccauauugaucaugcuggucuugaacuccugaccuugugauccgcccgccuuggccucccaaagugcugggauuacaggcaugagcuaccgagcccagcccuaaaagacuucuuuauaaggagccauauugcuuuggggagaccgaaggcugcugagggccucagggcaggguugauaugcaccugccagcacgccaccauaacaucuucauggaaccuuaacacuuucuuaaaagugcuccaccuccuuuuuuuugacccuuaaagaagagaccaacuauuaguacuguguggcaacugugccuguccucucacauggccaggggacugggugacacauuacccagaaagguacacuucugugcugguggccacuccaacacacuuccuuuguuuggcuggagcucguccacuugacaaggggucaggaagaugaagcugaauccaacccccuacacugccagguggguacccgcugcccuccccaccuugcuauggaccauuucugaucuggcuucuggacacagaccauuucacauucuucuaccuacauggaggugaaacucccuuaguuuuaggcaauuccucauuuacuuaauuucauuauauacucccuaaugggcaacaaggagauuggaugugugagauuuauuugagaaagggcaaaacugagggcagcaaauguguaagccuugugaguccuuucuccuugcaaaggcaacacucgucuggcuggugaagccaagagcacagccacacggcuguuucucauccuggcacccccagccccagcacagcaccccacagagcaugcuggaugcguucaguaaauauuugugaaauaaaugaauaaaucaauggcaguuguuuggauuucaauauaaauggaucuugggccugagauacugccagaugggcagacagguuacagucuggugaugcaucuccaaggcuauaaaaauguagccguugcuggagucgcaggcugacauuucagaugauuauaugcacaauuuaaccacauggcuaucugugcccuccaagugccaucgcuucaacaacuguuuucauguuggcuuuuuugcucguuccucucucuuuuuuuuuaagucaagcauaauuuuuugcagccucucguauuucuagcugaacgugauuuauucauauaaaauuauguuccauuuuuauaaaacccaaguuacugcaaaugaugcuugagguuucacagaaaauauuaauuccugaucugcugcuauaaagcaugccugcucgcugagagcagcgcugucacucugagacagauggaagcaguccaaggguaugauuaacuucuuaguccuggcaauugccuagugcuccucuugcccuagauuucaagauugaccuccagcuucucugcagacgcgcaguugcucagcuugauaaaucacaugaaucccuuuuuugaucagaguuaucuacuauuuacuacucaugaagggaaguuaaucguauucaaggcacuucauaugcugcacacauauccuuccuucuuccuaacggcacuuugcauauuuuccacauuggcggugauguggcuucuuucgcagugcagaggguccacaccaaagauccaccuuuauccuguuuguccuucuucuuugucucuacuaaccagcaucaaauacaccgacccacaagaagaaaaaacacgagaggcacacaauaagcagugaauaagugagacgaauucugucccuuugcaaacugagauuuucuuguaauuggcuucuuuacuuugucaagaacuuugcugggccgagugugguggcuaacaccuguaaucccagcacuuugggaggccaaggcaggcagaucacuugagcccaggaguucgagaccugccugggcaacauggugaagcccccccucuacgaaaaguccaaagauuagccaggcaugguggcuaccauggcacugggcagggcacggggagagcugagauggcuugagccugggaggucgaggcugcagugagcugugaucacaccacugcacuccagccugggugacagagugagacccugucucaaaaaacaaacaaacaaacaaaaccagaaaagaaaaaagaauuuugccaucucuucuugcccuguuugucugcuuuuuucauuucugggggacauaaaugggccucugguaggccaguugacucucagugguauaaaauagauaaaaaaauucuacuguccagaguagaaaagaacagacaacacaccaucccacucucacacaccccuucuugucacugcugggcgggaggcgcaagugaguggggcugaagcccaaacuccccuucugcuugccauggugauccaguuucaaccugaagcacauuuugccuauuuggggugaaccauaaauuaaguccauuggucaggcaaaaccaagcaagggaaaagguuuuuuggggaugaucacaguugauuuuuaaaauuuauguaacggaaauaucacaguuuuaauuuaucaagauguuauauugauuacagaagauucucugaacuuuaaagcauacagucuaaacugucagauauuggauuugugcugaaaugccaauuuagaaaauaaaucaggcgacuggagaaauggaaagacaagacugacuuuccaaagacaucuggacauucucuaaccuccaacaacccagagggaugagacuucuacccacuccuuaggaagggaaagggaaacacaccccuuucuuuuucuuauaacuggucucaucaggucagaucucaaggcuuugaaguugggcuuccuuauagggaaacagauaacaaaaacuggcuuccuacaguguaaacucauguccuuccaccaaccccaagucaaugaaauccuguuucaucaucgauuuguguaucuuggaacaaaauagcuccggccuugucuaaauguccuuguguucacuggacacucaagguugaggcucaguggaagugaaaugagcccauggaugagcaaacuuauaggacacugagguucugaaggaggauaagacccagagugugucacagacaugcuccuccaugaggaaccagugugcauggccagagccaguacgggcuuuucuguccugucccagaauuauagaacucaggaagcaccuuuugaggucugaaaagugcuucucccccaagaacaaagaugaaggcaugagcuaaucauuaugaaauuuuauauaaagaggugauaacaggcugaaagcaaaagguuuagggaaccaggaugguuuguguaaaugaauguauaauagguuaauaccaggcuccaaguagccagagauauugggccuagaaccccacuuugggauauucaggaccuggggagaucuuuacucaauuccuuucccacccugagguuccucuggcagccagaacauuaggcaagucauacaguggucugacuugaggcacucgggucauuuuucuagaaaauauugguuuauucaaaagaauaaguaaugugagagaaaaugacaucugucacuugauaaguuauucucuacuuaaaaacuagaaaauaugaaugcaauuaauucagcaaguguuuuaaaaucauuauuuugaagaaggguuuuaauuuccaucuugaaaugguuacaaaugcuuaucacuuauggggauuacgucuguggcccugaauuaguagagaauagacaauagaaaaagaauggcuguuauugaaaagucaaaaaacaacagaugcuggagagccuguggagaaaaacgaaugcuuguacacuguuggugggaguguaaauuaguucagucauuguggaagacauuguggugauucuucaaagaccuagaggcagaaauaccauuugauccagcaaucccauuaauggguauauacccaaaugaauauaaaucauucuauuauaaagacacaugcacguguacguucacugcagcacuguucacaguagcaaagacauggaaucaacccaaaugcccauuaacgauagacuggguaaagaaaauaugguacacauaugccaugaaauacuauacagccauaaaaaggaacaagaucacguccuuugcagagacauggauggagccauuauccucagcaaacuaaugcaggagcagaaaaacaaacaccacauguuuucacuuguuaagugggagcugaaugaugagacccaugacggggaaacacacacuggguccugccggugaggugucaggggagggauaacaucaagaagaacagcuaauagaugcugggcuuaauaccuaggugauggguugaugggugcagcaaaucaccauugcacauguuuacccauguaacaaaccugcauauccugcacaugugccccugaacuuaaaauacaaguugaagaaaaaaaaagaaagaaagaaaaaagaaaacacacagagaagguagcuuuacacaacugcacugcuagaauagcaaagucagcucgucacuuugaaaugaccaauucugaauagaaaaagugcuacaguaaaguaagggaaaugcccuauuacauuugaggauaaagaaauuuguaagaagaguggugacaaugaaaaccucuguuuuuggguggggaaugggcuugacaagggauuuuuugugaaaauaucagaaaaaaaggaaauggcauuguucaucauuaacauccauggacauuuucucuuuaggacaaaguuguauauguuuugggaagaaaucuucgaauguaucaguccuaguuucugaugaauugucuuuguauuugugaccaugucuucaaaauaaauccuuauuuuccuaaaauagguuuugauucauucuacuaaaggucauaaugaccuuuuuuuuccuguauuuauauguguagcuuuacuaaaauauaauuuacauuccaaaaaguucacccauuuaaagcauacaauucaguggucugguauacuuacaagguugugcaaccaucaccauaaucuauuuuuacaacaucaucaucuccaaaagaaaucuuguacucauuaacaaugaccaaguuucccuugcgucucagugcauuuuguugaaggaacugcuuacuuaagaagaaaagucaaagacagaaaagaaauauguauaggaaagaaaugacuauguuauauucuacauguguuuugaucuagacucuuuccuccuccuacugacacauucagaagcagagcagucaucagcuuuugugaaaaucccaaaagcaauuccagaagaucaugugccagccacucaggacacgcaggcuugugugguugucauggggaagguuuuguaauugaaauaaaaauacucaugcucagucugccaccacacagaaaaugcuuuucacucaugcacaccagauaauucgccuaagugacagguuuuacuuuggaggaagcaccgagcuaagcugguuuacacagucaaugauggcucauuccaugaaaaaggaacugggaaggaaggcaggguggugaagguuagcuagacaauguggagguggcugccagccagucagccaagggcacagcuccuccugcugcuucuaaugcuguggagacacacagggauuucaucuuuaccuccugacaguuccucaaaacacgcgcgcacacacacacacacacacacacacacacacacucucucucucucucucucuccaaucuuaguaagugaaaaaacaaaaaccaaaaccaaccaaaccaaaccaagggucuggucuauucuagaaagugacuuuacauacccacauucaacuaucugucuacagccuuucagacaaagcaggauauaaaauacagccuguguguguuucuugaugagguuuacacaucucauucaguaacacgcgccaggagaaagacgccaaagcaaggaguaaaaagucaagcacgugggaccgugaguuguuggguuaugugcauaaaauauuucaagagagagaaucuuaucaaaagauagauagcucccggugaaaugauauggaaaaagucugaagaaaacaucucaaaauaaaugaaguauuuauugcugaaaaaugagcuuagaucucagccaguuccaaaguucagaauuuaccgcaccacucaggccuuucucucuaaguuucuugucucuuguuucauugcacaacaagggauucuucauacuugcuaugaaauacaacaaggcgauuuuugcagugauaaacuccacacaugcaugauaaauccaagcaugcaaaauguuuaacaucccaguucagagauacuuuagggacaaaauccgauuaugaauuauaugccacaauaaauagggcucaauguuucauaaagcaauuuauaguucauaaaaaugacaaaauguaccugucagagagagcgcggagagccguucucugagcugccugcuggaagaaagaaagggcagagauguuuauuuaauauucugacuuuugaauuacgugcucaaugaacacuuaaaaaaaagaccccugcauuacacacauuuuugccauguggccaaauuuuaaacgacuagcaaugaaguagagagcacuguuguaaaaugugaaaugugugugaugaaaugaaccuucacggacaguuaacugaagcccggcaaugcacaccugcaacuaggggaugaguuugucgggggggcaaaggacuguacccagguaagcuuggacaggccucuggaaauuggcaaagaccagagcuacuucucugaaaucacuuucccauugcuuuauuguccuuuccuauaagaaaacaaaaaggucuguuuugguuucuuuguagcuucuuucccaaugaagguguaauuuuucacucggauuucagauugaaaguuuccacaguuggaauauggaaugccacuagaaaucucaagggauuauugauuugcuuuaggcauaguuaaugauauuaugacaaugguuuuuaaaauucacauugaaauguuaauggauacaauuaucugcuguugggauaugcuuuaagauaauacagugggagggcugggugcgguggcucacaccuguaaucccagcacuuugggaggcugaggcagguggaucaccugaggucaggaguucaagaccagccuggccaacauggugaaauccugucucuacuaaaaauacaaaaauuagcugggugugguggcaugcgccuguagucccagugacucaggaggcugaggcaagagaaucgcuugaaaccagaaggcagagguugcagugagccaagaucaugccacugcacuccagccugggcaacaagaguaaaacuccaucucaaaaauaaauaaauaaaauaaaaaaauuuaaaaaauacagugggagaagggcagagugggugggcacauacauaagacaagauggccuugggcugagaacugcugacguuaggcgaugagcacagggcagguucuuauauuauucuggccauuucccuacaugaaaugaacaaaacuuucauuuuguauugaaaauguauugauuuguuuuuuguuuuuuucuucuacuaaaauuaauguguguguguguguguguguguguguguguguaugcugaaauuucccauaauaaaaaaacuaaaagaaaaaaaucauaaaaaaggcucuauuuuggccgggcaugguggcucacgccuguaaucccagcacuuugggaggcccaggcagguggaucaccugaggucaggaguucgagaccagccugaccaacagggagaaaccccgucucuacuaaaaauacaaaauuagaugggcaugguggcacaugucuguaauuccagcuacucgggaggccaaggcaggagaauugcuugaacuuggggggcggagguugcagugagcugagaucgcgccauuguacuccagccugggcaacaacagcaaaagucugucucaaaaaaaaaaaaaaaaaagggcuccauuucuccaucggauucucccaaguuuuguacuugcuuuccuuuucucuggcuauucuauuuuucacccauuugccuucuaucucugggcccaaugaggccaaggaaggcagauggcacacgaugcucucugucucagaagucaugacuggggaggucaguagaccaggccuacucagcaugcaccgggaaacaaggagugugcaaugguccuuuccucuuugcaugauacacaggucaugguuacuguuuuuuuuuuucugagacagaguaucucuuugucacccaggcuggaguguaguggccugauuucagcucacugcaaccucugccucccagguucaagcgauucuccugccucagccucccaaguagcugagauuacagguguaugccaccacacccagcuaauuuuuguauuuuuaguagagacagggucucaucauguuggccaagcuggucucgaacuccugaccucaaaugauccacccgccucugccccucaaaguguugggauuacaggugugagccaccacgccuggccuauguuuacuguugaccaaggaccucacaauacuucucaugcugauagcccaucacauuuagauaucaggaaaaauagaaucuucagguuagaaaaaaaagucaccucagaaccauuuucucuguuauggaaauaaaauacacccuuggugacaguuccacaucuugggauaaaaauaaaaguagaagcaguuaucgucccagaaaagcuccuuccuaagguaggagcuggaugaccucgguacacuuuuagaauaacauggacaugaaagauuaaggcagggcagugucaggaaggugcagggaugggcggccacuccucaaauggugccuggaaccaugagccggugucaguacauaucugcugaguaaauguuagagggaugaaucagucaggaaagccuucccucugaaaucugagcauaauuuuaaagacaaggaaggauguggucaggagagagaaggcauugauagcacugggcuagacggcacagcaggggccugucccagccucuggcagcagcucucaaccggggcacccaugacucccaaacccugggugucuggaauugaugaggguguuucugugcauuacauucaugagggggaucaauaauggcaguagugucuggggccagggauacuaaagcccuucaaagagcaggaaggucccuuguauaaugaagaauuguccccuuaaaaugacaaagggugccugcagagaaacacugcggcagaguaggaaugaaaggagagcagaaagaagggcuguagggaacaugagcuccagggccuggcaaagauaaggggaauugagacaacuuccauaaguaaugcagcaacacugaauuaggaaaaccaucuaguguguugagccgggguuggagaguccgacauucugggacagguuuugccauucauuugcuauggaccuugcgucuggccuucaaccuccggcuuaguuuccaaaccacccuuuccuucucugaauagggugcugaaagagacagucaguccguguccaggcuacuauggacaauccaagggguuacuguccccuccucauucccuagauucugaaugaagaccccauguccugguauuccauugucauaggauuaccacaacagauaaaagaauacagaucuacugaucuucuugauaaggagagcugagggagcagcgagaggcaggggaagaggaccggagccugaggaacccacgcagacaccuccagggaugggugcuucccucuccccucagucccucuccugugcucuuccauggagccagcgcagagcaugcugauaaaacgcacccagcaggcaacagguggcaucacugcuggcagguuugucuccuggagaguuucccucucacucagcaagauggcuuucgcuuuaggccgcgauacuugaacuuaauuuaacucccuacuccugacuguuuggcugaauauacaagaaguauuuuugaacugccccaaagaaagguggaauguauuauuaguauugucucuuaacaucaucucagcaggagccaugagagacuggcuccuccuggaguaacagaaaucauaagagguguaacuaaaaguucaauagaaaccuucaacauggcaucugaauuucucccuagucauggaaauagaccaaggcugucaauauuuuaaaaggcuauugacucuuuucucucccaccuccaaacaauuccugcugacuucugugauacggaaacagcgcuugcugaugugcagcuggucagaaaaugauuuaaaaagcgaaaggaaaacaaacaaacaaaaagaagaaacacugcugucuggccgccaauggagugccuaggaauugaggcaucccaguggcggcaccuguuggcaaugccacaggacugauguuagccccgucuucuaauacaagcugaguuggaagcuuagagcaagggcugcuuuccuuuagcagacuggugugaugcugggaacaaaagguccuucugggccgagagacagggcacccuacgaggcacuaagcaguguucucuguugauucuucacucuuccaaucugucacaugauguaugcuaccacgcaugcaacagcaugguacuuagcaccaucaauugccugcacugcuuuuuuucuuuuuuuuuuuuuuuuugagauguuguuucacucuuguugcccaggcuggagugcagugaugcggucucagcuuacugcaaccucugccucccugguucaagcgauucuccugcuucaaccuccagaguagcugggauuacaggcaugcgccaccaaacccagcuaauuuuuuuguauuuaguagagacgggguuucacuguguuagucaggcuggucucgaauuccugaccucaagugaucugccugcgucagccucccaaagugcugggguuacaggugugcgccacugcgccuggccugcucugcuauuuuuuaaugacuaauuuucauugugcuauuuaauuugcagucacucuacaucauuaaaaauuuuacaaaaacucaccaucuauuaugaaagaagaggaguauaugucagauguuuuaaauaauuugaggaaaaaacccuucauggcauuauauuaauuguauauauaccagagcaaaggccaccaagauguuuuuacugacuccucucuuuaaaaaaaccuucagcuuuugcacacuauuuuauuuuacuacuggaaaauaaugaaacgaauaaauauuggaauuaaauggcaaagaaaaaauuaggugacucaugauugaaacuugaaaaaguacucauaguaaacuagaugaauugcccaauuucauuccuucaagaguuauacauuacagcaacuauauuuuucucuuccuaaaucucacaucaucucuuccuugcgacuugccuuuuauucaguucucagcaaaauagguugagaggguuaagagaacacgucauugauccuuccugaguucauuauucauuacgaaugauucuaaacuccagucuaugagacaaaacauguucuuuuuuuucugccagaaauugccauuuucagguucuccucaagagaugacauauuuucucugucuuuauuauagcaagcuuguugcuugggaacacaaucaguagauauucagguuucaauguaugcuaaaugaauuacaagucacauucuguuauugaagggaaaucaaagaggaaauuaaaugcccuuauuguaauugggucaagcacugaacaagcucauggauccuggaguggggaggaaaacaaagggagaggcugaaauucagagggcucucagaaugaucucauuucuuacuugauagaaacagaacuuacgccuggagagguuuguaauucagucugaaguaccuacuaugugcaagcacuggacuuggcuuagguggcagucacaacaagcaaagcccuugcaauauugugcuuagugucuagagguggggcagacaugaaaagcuacacacacacacacacacacacacacacacacacacacacacacacacacacagcagucuacauuccaaggggcauggcugaagaggacagggugcucugaaaccaacuaaugaaggaaaccuuguuuggaaugagugucaaggaaggcuuacuaaguaagaaauaacaaagcugaggcuuaaaggauaaagaaaaaugaucacaucagagaaauggggguggguggcgaggggagugcucuaggcagggaagcucuaguuugggagcaaaggccaggagcuggccuagauccuggcucagcugaagaacuacaagaugucacugugcugcgguucggcaagugguagggacagcagcagagcaagaugaggccaaucccaaggguuuuagacaucaagugaaguauguuagguauuaacacaggacaauagaaagucaucgaaggguuuacauuaggggaagcugggugaagcaugcauggggcuugcuuauauguucuuugcacuuccugugaaucuauuauauaauuaaaaaaaauaguacggagggaggcaauaagauuuuucaaacaucuugcuggcuucugcaugaugaauggaauuggguaggaagcgacaaaguuugagguuauugcagugaugugggcaagagaagagcaugguaguagugaagauggagagagcuaguguuacauugugaaggucugauugagggaacaggugacugauuggauguggcaggccagggagaggcaucaggugugagguccagguuucuggcuugggcaccugguauggauggagauccacuuguuaaguggauuaaacugggggcauaagagcagggggcaaaggcagaauugaguguugggugugugaaguuaaaguugccuacaagauguuucaguggagacucugaguagcuagcuggaugcaugcgacugaaguuauuaaaugccaauuaaguaagaaacaucaauaacagucauaaaaaauggauugagguuucuggaucuacauuuugcuacuguucuaagagaaaaagauuuagguuucaacugguugggauauaucuuuguguuuucauuauggaugucaguaaccuccauuuuugcuaucaacaguaucagauuuauucugcugacaauaaaggagguaucucugcacagggauuuuaaucagcuuguugcaccugugauaggacauuguauccauauucaaauacuugaauaaacgcccuugcagccaaucuuaguuuguguuuugcuguuacugaagcacacuguaaaauuuagacccaaucacauauuuuuauagaaguucuauuuguaaagccuuacauuuuugcuguucuuuuucaaguugagacuuguacuuauuaauuuauuucacgguuuaauuuccuuccacaucuauaagcaauuuuauguuucauuaucugaacuuuuaugccauuguuuuccacuucaguccuaguuaaugggucucuuaacuuuuuauguugugggcuuccauuuaguauuuuucaacccguuuaguaauaucugcaagacaaaggaaaaauucuuacuccucucuauuuuuuccucagcaauaaugagucuuuugcauuuucggauuccuagaaauaaaugcugccuaggaagcauuuuguucggucaacuuugaccucaucccauucucuauaggggucaggcagucagggaugauaauauaauuuaucauccaaauaagaacaaauuugagagagaaaggggaugcuaaccagacuggagucagagacaaaacgagaaaaccuggcuguucugggcacauggggcuguacagucgcucuaaugaggacugcucugugcaaauaugacuugcugcuuauaaacccuguuaaauaagaucaugauaagaaggcagaccucagggccugaggagcaugccaauaacgaaagcacagagcugaacggggucagcagaggacgaauccuucuaauuccuaauguugaguccaacugaugcuugugugauuuucuggcucucugucuaucagcuccucccucuguucacagcagacacucugaggucuagcucacccuuuguguuaaguguuaacucuuuuguaaaaguucucaagcuccucuccaugcacuccuagucuguaacaugaaguagcccuggauucuagucauuuuuggggaguaugccgucugccucaugacaauuuuauuuuuggcuucccaaguuccuuaaaagaacauugauggcagagauccuagcucauuuucccuccaccuaaaagagcucucucucaacccauaacacuuacaagaugugagcagguaaccucggggaugacaaauacuacuguuugccacgaucuccaaucuaagagguuuguggaaauacauuuuuuucacaucuguguauuauuucccuauuugcuuuauuuaaauacuuggacacauuuuccucuuugaaaaauauuugacuaucuucugcuuccccacauuacuuagguuuguuuaugucuacuagaaauuugauagacaauaaaaaacauuuauugagcaccuaguauauccugagaaaaaugcugauuaggguugaccauaccagaugaaguuugcacaggcaacauuaucucauaagguggauucuguuaucaacagagugaucugggggccuuacgugaggccagauugucagggacggcucuaauuuggcaagucaaauccgagaggacugagagagacauacuuauuuuuuugagcauuucuaggacauuucacucccuagagauaaacccacgugugacauccacuuccugguucuccuugcuccaaagcacguggcucuucuagacucuggaggcuuuugccaucacaaaugaaaacgaaggcagaugcuaucagucagaagcaagaagagaaaggugugaggacaacaugagagggugccgcagggacugucccuguccagguaaaggcucuauggagggcauagaagauacauggcacccugcagggcaggacauucugaacaccaugaaagcaacauuauaggugagaggggcccugaaggaugccuggaggagggcugggggacacaugccuggugugggggugguaagaggucacucugaagugggaggaugauggcaagaagaccaugaccaugugugagguuauuaguguucaccaugauguggggugggugauaucuagcccuaagccagauucucggggcaacucagccucagccuccugaguagcugggauuacaggugccuguuaccacgccuggcuaauuuuuguaguuguuuuuuaguagagaugggguuucaccacguuggccaggcuuguuuucauaauuuuauacuaacauuuauuuauauucauagaaaauauuuuauauuaaucuacuuuaauauuuuuguccagugcauuuaagauauugaaacagagguccaggaagauuagcuugccuguggucucagagccaguaaguaaaggaaccaggccagugagggcuccacagagcagccccauucugucuuggccucaccauggacuccuguggcuggagguugaaagcaaaggggacuaggugaauucugaacuguggcaguuucagugagaagaggacugcugggacacuggguggaugcuaacagacacugggggaaaccuuuaucuggggaugccagugaaggggaauaauaggagucaccucuuagacaaguguuggcaaaggagaugggaggauuucagguuucugagacuaacuucucuucucaagaggguuauauccuuauuguugaucuuggcccuugucaaaaucuucuggggaagaauucuuuuuaccuccagggcucaccaugacagaacuauguaaaggaaguagcugucuggguuaggucuggguaggagcgaacaucgcugaagauucgccuggcagagcgggcaaaccuacuggugcuguuggaugcugguggaagauccaagcucagcugccuguucucagaaucagguggcugaaaugugguuccugggacugaguuuuggcaaggcaacugugccuucuggaugugcacacaugcauacaugugccugucuagcuacaauuucaaagugacagcaaacaaacaagaguagccaucagacccaacgcuggcugagcugcuaggagauacaaugcagguaguauaugcaucuaaacuucugguucuuaggaauggaaguuuaaauguggagugcagauggugaugcuggucaaagugaggaagugauuuaucuucuggacagcugccuuggcuuccagaucucacuagaaugggcaggucuuuucuagaggucugugacauacaauuuuaggggaaaaaauagaaaguaaaucgccacuaauaagugcuaaguucgaaaagugccaguugacuugucuuuccagauaguuccagccuugguggaauuuaaugcagaagagaugacaugucagagugacuggagcaugaggcgaucguaugcacacgaugaagcuuugcauaaaggugauacugacguagcuccuuaucacagccuagacuauuuagguucugcuuggacaauggaucaaguuuccuagcacaaaaaagaccugugugcgcagaaaccgcugcuucgugguccaaucccuccaccagaugaaagcacuaaguacugcagguuccaucaugacucuguggccugcucaucugggcuuuggucauucacauguuccuggaacucaucucacagggcaauuucaaugcaggccagaccuugagcaaggccaagauggcgauguccauuaauggcuuucaucuuuggcucagcagguggauacugggauuagucauuuccuauuuuguucaguuugccaaauacauucuggaccuuuaaaaaguccuuaugcuaucgcaauaugaugcuuugguagaguccuguccacuuuccacuggccuuggcaggugguugaguaauaugaaagcaacuagcgccuaaauugugaaauacaaauguuacuuuguuuuuguagaaagaccagaugaaaauaacacaaaauguuuugguauuuuuguuaaaaaugcaaucugggcuugaagaacuuaaaucuaagucuggcuuuauguuucauuuaaaccuuuuuuuacuuaggcaaaauagcaauauuugaagguaaaaacagguuuguaaugauuaggaaagauucuccuaauuucuuaauugcacuuugcaaaccaauuauacaagagaaagcugaaccaguucugaauguguuauuauuguuaucaggauuuuuaccucucaagugaacagugcuuuacgauuuauaugugaaagugcuuucgcauguaauguauaauaaucacacagucuucuuugaaaugccuugaacuuuaagaacaaauccagguugaaagaagagguacucagagaaauaaugugaaucagaucucuccagagaaucagaucucucuacuggaauccuugcgugcaggguuuucuagcgugcagaugaccauaucugggggccuaacauucuagccacuaucuggucugcuucuuaaacauggucuuguuuuaauuaacacaaccuuuuggcugcagaucugguggggauggaauugggaagugccaagggaccuugaaugaucacacaugauuuuucuccguguagaaacaacaggcuaagagagucuccugagaaaagcugggcuugugagauaaccagcccuacucggagaagcuuuggaaaaagaaaaacaaaaacucaacuuuacaacuguauaucuggaccaaacaccugagggacugucgguaaauccuuuacuauaugacacugcccaugccuggaaaugagggauagcguauacuccaaggaacaacaucucuuguaggguuucacuuccugaaaagcuacugaagaaaaaaaccauugaagucaugggacaaagggcuauuccucugaguuaaauaacaauguccccuggagggagaauuccacuucuucugccaaccagcaacccugcuggcagcuguguuugagaaaagcgugccuaucaacuaaugaugccuaaccccucuccuggcuccugaauggagagucuguguuggugguauugauacccaccauuaacaaaaacuucgcuuacuuucaaaaauguagauccuuuuaugaauucuucaucauaacaaaggcaaugguuucccauuuuugucuuaauuguauguuugcccaaauuugauggaucauguuuugguuuuuauauaauuuucuuuuuccagauuuccauuuaggguccucaggcugaaacuaggcauaucccauggcccaggcugguuggacacaacuaaaucuacauaaaucuccauugagucuccgaggagauucgaugagaaaauauuuuaggaaacagcguuaugagucucugugcucagugauauuuaaguuggcugaccauuucaauuuuggaaauuauaguccauuaacaugaaaaaaaggcaauuacauguuuguauauuucuaccuaugcuugugcuuuuugcaaauguuuauaaagaguggcaugauaaaauaaaauaauuuuguguuugcuucuggugacaguaaaauuuuauuuauaaaauacaauuacuggccaggcucgcuggcuuaugccuauaaugcuaacacuuuggaaggccaaggcagggggaucaccugaggucagaaguuugagaccauccuggccaacgcggugaaaccccgucucuacuaaaaaugcaaaaaauagcugggcaugguggcacacacuuguagucccaacuacucaggaggcugaggcaggagaaucgcuugaacccgggaggcggagguugcagugggccaagaucgcgccacugaacuucagccuggcaacagaacaagacucugucucaaaaaaaaaaaaggcaauuacuuaacuaaaagcuuuaggaugguuaaacaaacaaaccaacccuucugcugaacauuugaguuucacugauuaugaugggagguucaaauauaugauuacuucauauacggauaugaaaaaggucugauaggcaguuuucaauuagaguuauuguucuguuuccauauuaauagaaaccaauuaguuauuaugaacagauuggguauuuagcucagguacaacauaaaaugcaagacuaaaaagaaaaacgaacauacaguauucuuuuuuucuguguugcuaugagguuuaauauauuuaauauauacuuuuuguaugguccauuggggcaagggauuuccuggcauugaaaauuuacucaaaauaucugugguuaaguuaucauaacgaauauuacuaaugucuaauucauuaagaccaacaagccagcaucuuacaugauguuugguacuuaguagguauuugagacuauacucaguuuuuugcaaaaacugucuagcucuuguuugccuacaaauaacauugacaauacaguucauuucuaauguaggagaaacuucauuuuggagccuugccccucaaaccugguccugauuacugcuucaacuccuguuuauauaauucuacacaauuuuggcaggauucaagagcacauaccaggguguuggcuuuuaugaaucuccugggaugugaaugucacgcugacuggaugaacccuggccacaaaucccagacaagcacaaugauucuauuuauucagacuuggcugccugaaugcagauugacucuguggguaauaaauuuucacaggccaagagcgucaggaucaaccaagcugauccugagaagaaaaaugcaacuaaggaaguagaguugggcugcaaaaaccuccuauguuuuuauuccaugucugcauaucauucagcuaauucauuuaguuacugauugacauguacugucaaugcuuucagacauuuuaaaagcucugcuuuguguuaugcaauugucauauuaaaaagaaacaagggaaaaaaugaagagcuuccauuacaauuggcaaucugcuuuuaagaguacacccaaaacugaugugagucauccaguaaucucugugguaaagagcacagaauugagaugggaauguuucuugugcugcuccauaggaaaccaaaggaaacagcaauaagaacugcaauuuugugcucagagcaaccucaccuacaaucuugguaucuugaugaagcaaggcuuuacauuauuucuaagagacacgacuauuacucuaugcauuauaaauaagaaaauaauuggcucuuuaauuugcagauuuauguuaaugaucuagauaucuauuaaauuaauugcaugcucuccaaauauugauuggggauuaaaaggcagcuuuucauugugcaagaaguaaauuaacgccaauggggaaauuucccucuacagauuagauccaaugauuguugucuguaaaauuaaaauagucaguuaaaggggauaaaccauguucauuuaaagagaaaaauguggcaacagaguuaaaauaaaaagacugcccaauauguuuggauaacguaauuacuggaagcugcaggcauguacauagccauucaauuuagaucccuggucccuuccucucccuaagcuauguauuugucaucuccgaaacacuugucugcaguugacacuaucucagcugcuccuugcugaaagucuuaaucaugugucccuguccucaugccuuagcuauaguaaugccaucuacuuauuugcuuguguccaaccucccaagcuuacccugacuugagaggcagagcucaucuuuuugccaaaugggaagacaugcaauauaauuaaucagucccuuccuaaucuauuaaauuuuuuuaauacuuacugucuuaagucuucuaauuccuucacauuguuucacaaaaacauuggucuuuggaauuguuaaaaccaacaguuacagaaaggagaucaaacaaauuacuccagguaucacauaccuuucauuuacucagauuaaauaagaaagcugauucucagauauuuugugcuauuuccaguuggaaccucauccagugugaaaaucauaggugcaaccauaaggcuaugcuuccauuucauuuauguuuguaaacuuucuaaggaaaccuggucacaaccccagcacuagaggcuacagccaaaauuugguuauucuugaaagggaaggcuguggagaaacucagucucuugguuuugaagacuucuguuugagauaacuuaugaaaacuuguaguuucaauauagcuugauguaagcauccuuaagaaggggcuauagacauuuccauggagaucggauaaaugccuuuuuucucaaauagguuauuuguguauuaaucuauagccaauuuaagauauugggccuuauauuuuugucaucucugucaauacuuuugauguuuggacagaacucauuugaaaaaucauagaguucaggaaaaggaacaaaggcagagcaaaggucaucuuugauauuguacaauggacagugggaaauacucucaauugaaggcaucacuaugcauuuauccacgcauucguucaacaaauauuuagcaguucugcugugccagacacagucccugcccucaggaaacuuccaguuuagcugguguagacagaucuuagaaaaaguaaacauaacauauaacuaaaauuacgaugagauucagguaaaaagaugaaggauacugugagacggacuaacugggaguugauuagauaagagggaggucucccugaggaagugaaaguuaugcugugccuccaacaugaguagguguuagcaaggcaaaagugagggaguagaggccuauggaggcccuaaggcagcagagcucagcuuccugcaggagcugggagaagggccgggccacaaaugagcucagugugaagaugagacguggacaaagccagauggugcaggguagugucggccaugcugagggcuccgaauuugaucccgggugggaugggaaaccuauuuaagauuuuagaccaaggaauuacuugaucugauuuuuaaaagaucacuguggggaggcuguauuacagagggcaggaaauagaaauacaauaguuuauaccagacugguuuugacuagcugggaauggaaagagguagauggaccaauauuuaauuuuggaggcugaguuuauaggacuuagagaugaagugacuaccugagugaggaacagggaaucaucaaggaugagucugaaguuucuaggcuggaacagcugggcaucuggcagugcuaguuuuggaaaugggaacaauaacaagacgaacauguuugugugucuggguagugauggcaaaggccagaaguccaguugggcacagacugaaucugaaaugucugugagacauccaaguggaaaaguaaaguagguuugcgguucagaagagaguucugagcuggggauauaacuuuagaaauugucaguauauaaaaauugaaggucauaggaaugggugagaucacccagagagcagacauggagaagaaaagucaggaauaaacauggaaaguuuccaacauugggcagaaaaucagagucagcaaaagagccugagaagagaagccagaggggcaggacccaaaccaggagagugugguguuagacuccuacagagaagugggugaugaacaguguucaaugcuguaagucuucuaguaagacaggggacugaaaagagcccaguauaauuggcucuacagaggucauugggggcccaaugaggagcauuucugguaaagagauggggucauaaugagaucaaaagaacaagucucuauguagcucugaggaaauggaugaacuuuggauaggagcagggcaguguccucucacaacaggaggacacaggaugagugaagauggaagcaguggugcagaugugguauugagaaguuuagguuucucugcuagaagccagucagccaugguaugagguagggaaauaaagaugaauaagauacacggugaaauucagguuguuuacuuaugaaguugggaagacagaaaacuacauuuguaucaccuauuauuauucauucuguaacaaagguaauuauaggauauuaagggagaaagcaugcaaaaugacaguaccagcgaacuguuauaaguuauguauauauaguguaauaccuagaauagccacuaaaaaagcuguacaaagagauacacauaaaaauguuacagacaaaucaaaacagaauucaaaagguuuaaggaauacacagaaaggcaggaaaaagaaaauuaaaaccaggaagaaacuaaacaaaaaauagagugguagacuuaagcuuuaacaaaucaauaauuacauuaaauguaaauggucuaaauguaucaauuaaaacacagaaauuggcaaagugaauaaaaauaugacaacuauuaauuuaugcuguauauaagaaacucauuucaaauauaaccauauugguaggcugaaaguaaaagaauggaaaaaaguuacauuaugaaagcauuaaucaaaauaaagcaggaguagcugugcuguuaucagaaaaaguagaccucagagcaaagaaaaugaccagagacagagugggacauuacauaaugauagaagggucaaucuaagaaaauauagcaauccuaaauguacacacaccaacuaacagagcugugaaauaugugaaaacaacccgauugaauagaaagaagaaauaaacaaauccacaaugacagccagagacuucaacaccucucucucaacauuagauagagcaaugagacagaaaguccagaaaagauacaaaagaacaucaaauaagauuaauugauauuaauagaacacccuacccaacaacagcagaauacacauucuuuuaagugccuauaaaacauauaccaauacaaaccauaucuugggucauaaaaaauccucaacaaauguauaagaauugaagucauacagacuauguucucugaccauaaaggaaccaaacuagaaaccaauaaaaguuaagauuaagggcgaucucugagcacuuaaaaauuaaacaacacauuucuaaauaauccaugagucaaagaagucuuacugaacugaaugacgaugaaauacaacacaucaauauuugugggauaaaguuuauagcauugcugagagucaaauguauagcacuaaauacuuauaucauaaaaaagaacgaaucucaaaucaauaaucuaaucucccucaagaaacuagaaaaugggcaaaaauguacccaaagcaagcaagaggagggaaauaaagauaagaaaucagugaaacugaaacagaaaaaacaaauagauaauauuaaugaaacaacaagcuaguucuuucaaaagaucaauacaguuaauaaaccucuagcaagacugauauaaaaaagaaagaagacaaaugaugaguaucacuaaugaaacgggcugacacuauagaucuugcagucaucaaaaggauaauaaaggaauauuauaaacaacccuauccacauaaacaugacaacuuaagugacacggauagacuuauuacugaagaacaguguaccacuuauacccaguaugaaacagauaaucuaauagcccuaugacuauuagauaaucugaguagcucuauaacuauuaauauuuuuuuuuuggcugggcgugguggcucacaccuguaaucccagcacuuugggaggccgaggcggguagaucaugaggucaggagaucgagaccauccuggcuaacacagugaaaccccgucucuacuaaaaaaauauaaaaaauuagccaggcaugguggugggcgccuguagucccagcuacucaggaggcugaggcaggcgaauggcgugaacccaggaggcagagcuugcagugagccaagacugcgccacugcacuccagccugggugacacagugagacuccaucucccaaaaaaaaaaauuuguuuuuguuuuucuccccgagauggagucaugcugucacccgggcuggagugcaguggcuugaucauagcucacggcaaucucagccucuuggguucaagcaauacucccgucucagccucccgaguagcugggauuacacgugcacaccacuaugcccaacuaauuuuuguauuuuuaguagagacugguuuucacuauguuggccaggcuggucucgaacuccugaccucaugaucugcucuccucagccucccaaagugcugggauuacaggcaugagccaccacaccccgccgggaaauagaauuuuuaaguuuaaaaaucuccaggcccauaugguuuuacuagagaauucugcuaaauaauuaucaucuuuuuguuuuuguuuuuguuuuguuuuuuuuucgagaaggaaucucacucugucacccaggcuggaguguaguggcacaauuuuggcucacugcaaccuccgccucccagguucaagcgauucuccugccucagcauccuaaguagcuaggauuacaggcacaugcaccacgccuggcuaauuuuuguauuuuugguagagaggggguuucuucauguuggucaggcuggucuugaacuccugaccucagaugauccaccugccuuggccucccaaagugcugggauuacaggccugagccacuguggccgaccuaacaucauuuuuuaaaagcauaaucuuuuugagaaaagggcaggggacccuucuuaauucauuuuauaagaucaguauuacccugauaucaaaacuagccaaagacaguauaaaacagaaaacuuccaacuaauaucccucaugaacauuaaaaagacaaauguguggugaggauguagagcaacugaaauucucuuacacugcuggugggacuuucgacugguacaaccauuuuggaaaaugguuugagauaauuuacuaaaguugaacaugcacauacccuacugcucagcauuuauacuucugggcauagauccaacaaaaauguucccaugugcucaacaaaagaccuguacaaggaugaaaagaccuguacaaggauaaaaagaccuguacaaggaugcugauaagagcacacuauucuacuccccgaccccugccaaaauauccacaugcccauuagcaguggaaugaauaaguaaauuauggcauacacacauaaugaaauaggauacagcaaugaaaaugaacaaacuucaauuacagguaacaacaugggugacucucauaaacaauguugaaugaaagaagcaagacacaaagaguacaugccgaauaauuccauugauacaaagugcaaaaauaagcaaaauuacacuaugguguuagaaaacaggaaagugguuauucuucugcagaguggugacuggugggagcaugggggcaccugggucaugucuguauuuucaucuggauauugguuaugucauacacauauaaaaucauuuuuaaagacauaucauuuuuauaaaucauauacaaacaggcugggcacaguugcucacaccuguaaucccagcacuuugggaggccgaggcggguggaucacuugaggucagaauuuugagaccacucuggccaacauggugaaaccccgucucuagugaaaauacaaaaauuaccuguaaucccagcuacuuaggaggccgaggcagcagaaucacuugaaccugggaggcggagguugcagugagccaaggucaugccacugcacuccagccugggcgacaagagugaaacuccguacacacacaaaauaugccuauuggaucuggugacacgaagaugaugggugaccucaaauuucgaugaaguggcagcuuggggaucuagcauuaauuccaauuuuacaaacagagacacugaagcagagaacaguucagaggcugggccaagguugcaaaacuaaguagcagaguggggauuugaacccuugaaguggggccgcugugcucuuaaccacuaaacuagacugucuuuugaccuucaggaucacaaaggcaauggggagaaaaggaaaccucagauaggaguguucaaaagcauggagucugaggcgaucugaggaagggcaggcagguauagcaacuugaagcucuuguagacaccucuuuauuacaguggcacaugggcugguugaaccaauauucacaaagacagccagauauaaugucagaaaagguuaaggauuuuucauacacuguaguguuuacugaggcaagggauuuuuaaaauauuuuggguuuacggugcaaacucugauuacaucuagaaaaaucauuuauguuaaauguucaauuaucucagaaugccagggaaugaguguaugugucuguguguguguguguguguguucgugcaccggcuaugcugcuuccgggauaaagcauaguuuggucuugaagagaaaaaaauaccauaucauuagucuuguuuaaaaguaugggaauuacaacuuugugauuagaccagguuauaauuauaggccaaagcaggacaacuuaaugcaauuacuguugaagcaauaacuuaaacuaucauacgcaaaaccacugucuggagucuuaauuaggaaaaagggauuaauguauaaaaauuauucauucugucaguuccuuuuauugcaaaaauaggaagguauauucacauaggaauuaaaugcaagaauaaaggaucugaccuguacauucauaacacaauauuaucaaugaguacagaauggaaggggguagcuuaaaaagcaaaaugagucaacuaaaagcucuuacugccuuagagaacauguauaguacgucauuaguaauguuuauuaaaauugaguuuucauuggaaauacuuccuggaaauagcucaggaaauuauuuccaaauuuaaaaagguuugcagauugaaauagucugugaacccuuuuucuaauaaaaagcauacacaauuuacauguuugauaugauuuaauccauaaucuauguauccaggccacuuaaugggaaaaaacacaaagaguugaaaucauuugcuuaucaucauguagauaagaagccaaaauuaggagugaagucauucuacauuucugcuaagauugcuguguggcagauaucuggcugcccuggaaacaaaucaacagaucuguaaaacacucgaagccugaguggccuucuuugcccaguuaaccuucuuccacuggguauucuccaccugccaaucugguuuccagacuccucaagcucuucucccuuuuucgugccucaguuucucccaugacaugaguaaccucuucugugaccucauagcuaugcucugcucacucuuccucgaaauucuccuuugacuuuuauuuaaccucugcuuguucucucuguaaguuauuuguauuugcaugucuagacagcaaaucaucugcauagcauuucaugauaccuuucuauuaauucacuauuccaaaaccaacagaacagcauuauuauuuuguacugcauacaaaaaugacuuauuaaaaaaagccucucugaauugucuuucuacccaucacauguaucuaaacuugacaaaauacaacauaggggaugagaaaaagaaaacagaaguguagaaaaaucugucuuuaguguuuuuaaacuugcuuugaaauacaaacauuucuugaaaugcagaagugaaagugaugaauguuaaguggauauuuuuucaccuuaacugacugaucagaagaguauuuauaacccccuaacugaugucucgagcugauaaaucaacaccaggggagaauauuucaagcacauuuaucauuuaagacaaacagccuauacugagcauaauuacuuuuuauucaucauuuuggcucaccucuacauuugcuccuucucaauguuaauaauaucuguguaagacuucucaauauuuaauguuacggauugccuguugcaugcugaugagguuaaggucauauguuugaucuccagaaggccaguuagcuucucacacacacacacacacacacacacacacacacacacacacacacacacacacaugaauaaauaaaaaagaaaaaaaaaaggcucugucuacuucugagggaagccugaucuuagcuuccuuguaauacccauugcuggucucaauaucauaaaaaauuacagaauucaaggcuuaagggaaauuaugggcaagcuauuuuaauauacugacccaacugcauagaagcucacacuuagcagacaaaagaccagcagccuggagugccaccauucagcuugguuaacacccggcacaguccaccagguaacuguuaccagugucaccuccaaaggaugaugacauaaaagagaaucuuaccuguucauucuccucuucaucacugcuuagcuuaaggucaucuuccagcauucugaaagaaggaacaaagagguacaaagagguacagauaguuaguggauucagaauaauucagcaccaaaauaucaccuuaauguuguuauuagagcaacauuuuggaaauaagucuauuugauuuccuauuuuuuuucuuuccuucuuaugcacuuuuccucuggugcacuuaggaaauaguagacagccccaucauaaaaauuaacccucacaacagucaucagcuaagacgggcagcuuucagaagaugcuguguuagcagggaaauaauacuuaacaauaacguauuguauauuucgaaauagcuagaagggaagaauuggaauguucccaacaggaagaaaagauaaauauuugaggugacgaauauccuaguuacccugauuugaucauuacacauugaaucccuguaucaaaauaucacacguaccugaaaauagcaauaaaaaagaagaugcuuuuuuuuuuuuucucucaaauacauaggggcuuuuccccugggcaguuugcauuccacaauuacuuguuuaguguuuuccaagcucccagugcugggcugugucuccgugccugccccaggggcuuucaugguaaagagagaugagaaaaagagccauaaagccauaaacuugaguugugagcgaagcuucuuaggccauccaucagucaaagagcuggaaaagauguuguccccaagauccuaccuaguggggaaaaccaagcaggagggcgcuuucugaaaagccugugaaggugauuccccagcccacccagguccccccauucauccugaggagacagcggggaagcacgagguuaaaagugaaaaaaagaaacagaacuucagacucuguuauuuguuaugauaacacuguauucuuuucagcauggcuaaauuuuucuuuauaguaguuuucagauuaauucauuucaaaagaaaucuuacucagaagugcacuguauaaaagcgugcucuccacgcagagacgcucugagggagcaggggagagcccacuucugagggacccuggggcuccauacaucagugugaagcccgcugagcccuugugcucaaaggccucauugaagccagcuuccaaaggcuguccccuaaaauguaccuaguguccuuuaaaagccgguuguaggccuaucacugauacaugccucugaacauucguaggagucauuucagucacuuuuggggcgaacugggggguaaagaacuggcaggauaaggcauggcccaggcucugccccaccugucuaugcauguggggugagucgcuucacgcacccugaccccauuucccuauuugugcagugacguguuauagagggcaauccuaagguugaauccugcuuuagauuccguugugagucuacaaaauaaauaugcuccccaguuucgucaaggagaaaaacccuucuauuugcucuagagaauacaacggagaaacuucuaaguaguuuuuaggguacuauuuaaggcauugccaucagggcaccaaaucugcuuccucacaggcuccugcucaucucccagugccgagaggugucguucuucuauuauuuaaaccacaagugaacaaaugaacacgucagcagaggcuguaaagcggcacccccaauuccucugcaugucuggcacgccauucauuuccuucaccucacagacacauacgcuuggcuucaaagagaagagaccucuuggugauuuauuagagcacuguuugggaguagccuagggaagugggcuguguuuccuuuguccuugaguccccagugaccagcacagugcggcacagaacacaacgccaguuugcuggcugggaugaggccccuuccccaagacuguuuuccuacccaaaggcacagauuucuuccuaaugaaaaagaccagagaaggggacagguccuugccuccacucccaugcccucuuuuggguaaaccaccacugcagugugguuuaaucucuaggacugcccagcaagcacugggucuuuaaagggugggugguccugcugguggggguggaaagaguggggaggacucacacaaucaugguuaacaacccccuugcugucagauggaggcuguguggcugggaaauuuaauguuuaaauggacaauacugugcguggauuggaaggccaucaucccccagagcaggaaagcccaacauggcccgaagugagggagcuuggguuggcugcaaacuagccgugcaacucagucaccacaugagccuggcauggcugaaagucaccacaacggucaaaaugcugcugugugaggcucucuuucaagguagggaaugcagcuuacuucuguuuauuucaaacaugugcuaaacgcguccacacguaaacacgcaucuguuugaaucucagagccccuugcaccacaaucuugugugaggugcaccucuggggcugagcauuugugcuucuauaaugagacucaucuaucucaucaucauuuccagaagaaaagcagucagaguucaaccuugcuuugugaauaaucaucacucugucacugacuuuaccucucuuauauuaaaaaaaugaauuuauuguguuuccggcuggguucuaaauacaacaaaucacauguaaaaauacacugccuucaagagagacuucaagagaaguucaaaucuaacuaaacuucagaauauuucgaaauaugagaaaguggccauggaaacacaaacucacacagcuuauacaacauucccggagcaauccugggugaugcuauucccaaaacaugaaaucacagaccugggagagacgaccacggccauaccgcaucccagccccgacaggcacagagguacacccugaggagacccaggcuccccgcggucugagagcaggaacccuuugcuuuauucugauggucaugagcaggcccuuggcucaacucccuagcaaacggcgcuuguucuugucugugaccacugcaucuucaaguccgguuuaacauucacaaacaacuccauguugaaugcugaacauauccaaguggccucuuagagagccuaaggaggggcugaaguuuauagcugaacaaugaaacaugguuaggagaagagaaaacccgugacacucacaggaucauaggaacugucuguacuugguguauggccagcagacagcaggcauggccgccuucaccaaacacacaaauggcaccgugguggucaugggcccaacccacucccaaacccuggggaacauuuuuaucauuugucuguuucccuguggaaacauagguauaucaaacaauaaauaaacaaacaaaaguguucaaccaagaguaaaaggaagaugcaaauuaagugcugauuaggcuacuggggagggguggagaucuccuacuguuuuuuuuuuuuuuuaaagggaaggcaaagacccugcugcucuaaggggcuccugagggcuaagucaucugcacggaaggacuagccaucugcauggaagcacagggccugugcauccauccacagcacccugguuacaccccuacuccuggguuccuccaggcccuaccccagcugauggggcccccaaccagggccaccccuuucacguucccuuagccccuccccuucauagcucuucagaucccucccaggggaugaagcccucaacucacagcagcagcucucauuguuuaagggauguccguccguagcagaccagcuaaguacuuucuagauguuacuuugucaaucccugcagcaacuccuccaaggugggaggugggugcuacagggggcuguggaccgugguagucagagcagggacuccagcgucacacugcccaggaagaaugcuagcucugccuuucaucuagcccagggcccugggaccugccucagagggcuuccuggagaacuuacuccacaauccuuggauagugcuaagcacgggaccuuacgccagggagccuccaaucaaugcucauuuuuaucaaugcucauuuuuaccaauauucccuuuucccuaggagggaagugggccucagagcauuuaagaaacucauguggauaaacaaguugagacuuugagaugucuuuguaaugaugccuuaaaacagggccauuugcucuauuuucaggccauuuugaaaagaaagggucauguuccugagagaugguggaggggaauauauuuuggccuguaacugcugucagcuggucugaguggcuuuaugucgacaggacaguaaacacgccuaucagccccagugcacggagaggucugcccugggagcuagcggguggccacgaggccaggagucccuccacgaggagccaaggggguguugccagaugacaauggggaaguugaaauaaaauagguacuaaaauugaacuuuuuggcugcacgcgguggcuuguuccuguaaucccaguauuuugggaggccaaggcuggcggaucauugagcccaagaguucgagaucagcccgggcaauauagcaaaauacugucucuauaaaaaauauauaaaaauuagacagacauggugguauggaccuguaaacccagcuacuagggaggcugagguaggaggaucaccugagcccuggaggucaaggcuagagugagccgagguuguaccacugcacuccagccugggcauaagacccugucucaaaaaaaaaaaaaaaaaaaaauugaacuuuuugaauugagaacagaccuggacuucauggccuuaacacuugaagaguuaucaaacuacugucagggauacuccacguuagcaccucauggugacuuuacaguagagucugaaccagcuacaugagaacugugacacuuuaaggacagaagcaagauuuuuuuuaacgugcgauuaagcgauugagauuccaccuauuuuuacuugggaacuuguccuuacaaugauuguugggcauguuguaacacccuuccugacacgcagacaaggagucgaaggguuaugagcccccagcugcacucgcucacgcuuucaugcagggagagcgggccuugcaggagcuccguagaggaaaggacacaaugggacuuucauucagaacucuaaagagggagccaaagauaaacaggcccauuugcaguuugccgagcacuacccuggaggaccuuuuucuuucugaaagggaaagaugaauggaaacaugccucaucaccaccagcggaaccaguauccaaacucccaauuguuguuuuguuuuguuuuagagacagggucuugcucugucaucuaggcuggagugcaguggcccaaucauagcucacugcagccuugaacuccuaggcucaagcaaucgucccaccucagccucccauguaucugggacuacagacgccggcuaccacgccuggccaaacccccaacuguugacucauucaauuacuucuguguccacuguguggcaggcaccuauccacagaagguguacugucucccaggggugguuccccucacacacgacauucaaaucagcauugucauuuuacguauuuuuaaaugccuucgaauugugaagcucuggcaaauacaacuuuugcagaacccaacugugucauuugaagguaaacucaguacuuuucagaaaagggaguaauucaguacaaccuuugcaauuuuaacauuugauuaccauaacuucccuguguguauuguuuucuuaauugagcaagugauaaauuuauguuguagcuggcgccugcauuuuugaggccuaaaauuucuugggaagcagaaauagcagccuacacuuaacagauggccaacugcuuccaaagcucaucuauaucuuccacagguauugcaaacgggcacguuaacuaccugcaaauguaauggcagccauuucacagaguagugguuuuuaauuaauaggauuuucccugaauuaguugucauuuggggcccuuaacagaucggaauccuuuaguccuuuaaagucauuucauuuugcuuuguuuuaaugguuuuuuaaaaaaucugaguuuuaauugggcuguuugauuuucagauuuguuucuauagcuggugcugcuacuaucuccaccuacgugagauuuaaagccuaagacaaauguuuaugaaucuccauuaaacauauucauauaugcaaaugucuauucuaacaauuagcauugccugagagccuauucauuaugcaagugcaucucucugcaguuauuccccaagccaucaucuccacugcuuggaacacgggagggaaaguuauacaacucauuucauucuuucugaagucuacugcuuugucagggucagugcuaccaucugccugugguuauuuucauuaacaaguaaccaccuucuucucagcguuuguucggaagaacuuagcucaugccaucccagcuaacugggaacagggaaggcuagcaugggcucacucuagggguuggcaauuuagugcauccaaggcacaggugaacucacuuagucuggaggcaaauggagaaaucaggaacaagaugaaggggugcucuacuugaccuaaguguuuccaacucugauguuuuaaaacccagggaucucuacaucuuuugaagcaauuuugguccauagcaaggugguauuugcucacacauaucuccuuccuggacucccucccucccggggagggauugucagugaaaucauccaugauccuguaacucugccauguugaaccuggggugaaggugcacugucucgcuuaaguuuaugaccuuauuuuuaguuagggacagcaacuucugaugguccuuuucuccacugacaugcugaauccacuugccaccuucucugcaggcccaucuucccugggggacggcaucucaucuccuacccuagaagaaccucacaaaagccagucucauuugggaaaccugccaaauccuggugagaugcuggaugaugugugucuucaaaaucucaaucagucaacugucuuucccaacaguaagcauaucuauaguaauagaaaauaagcagaaauaaaaggaaaauggaaaucaacagucauaagaagaaacagucagugguacagagucugggguggugaaauaaauuuugaaauggcagcuuggaggcuagccagcauuagccugaauucugucccuaacuagcucugugaacuuaggcaaaucacccacuuccccuagacauuguuuccacaucuccaaagugagaguuggauaaaacaaccacuauauauccucuuauuggucugaauuccuugguucugugccuuuaccaauggguagaauguccaggaagacugcuggagaaugagaugaucugauacuacucagcacauucuaggugcuagagauauaaaacuggagaagucuuccuuuucaagugucucacuguuuacugggagcagcagcaguuccuugaacaucccaugaugcuuuccagcuagaaauauguaagugccacacacgguuugugugauugugaaaauauaaaaaugcuccaucuuuuccacuuagggcaaucuaggccacaguuaugaaguagcauucuccaaauauauuagacuuuaaaauugcuuccuccuaaaagaauuacagggaaagagggcuggauauacucuaucauuucuaucaaaaaacugaggcuuuagaaagagcacuuuaacccggagugcuuucucccugaagauggguuuaaauccugucuuugucuguuuuaaggacuucuagaaaauuaguuucugagcucgauguucucaguauuaaagaauugaguuucuaaggcuaaaugaaugcaaguagugugugaaagaacaugauccuuucccgggcagacagcagaggacaggucagaggauucugacugggaacauaaaguuucuguggcuguacagauuuggugguggacauuacuuaaaccucuuugaagggggaugugcaccuaaccagaggggaaaugagauauguacguauuuauauggcucaaaucugauguugaauauugauaaucaguaaauaaguaaguuagcugccuauucuguuugcuagcuaauggugugcuuauuuaauaacuucugacaauaagaaugcauugaaucuguaagggucauaacauacaucagguuaagauuuguucuuugguuggaaacaucaguuuuugcauuuuuauggcugcuguuauugauaaguuaauugcuaaaagagucccuaauuaagagauuugaacagauaaacuguuagaauuagaaaagagaaccaagcauaaucuccuaauuagcaaauccaugcacuuuaagcuauaccagcguucacacauuaccugaggauggcauaacacagugguuuccaaacuuuauugcacauuggcaucacuugggaaucuuuaaaaauuauugaugcccagcuccacuccaaccccauauucugacgggauagguuuggggugcaaucugggcaucagguuuuuuuuucuuuucuuuuuuuaaagcucccuagggagcugauucaugggccucagccccagauauucugauucacagcaauguugggacccacuauauaacacagagcuggacugacucauaagagcugaaggucaugaauagcucugcaccuuggaucaagucccauacucuaaguuuuaguuuguucauuaauauaaggggaugauaguugagauucaaaugagacaauaaaggugaaagcccauuguaaacuguaaagcuucauaggaguuuucaguaauggguuuagcauuaccugggauguuuugaaagauacuggucuaugggccuuacccccugggauucugauuuaauugguuuuggauuggccacaggcaucaggacuucugacaagcugcuauggucugaauguuccguguucccucaaaauucacauauugaaaccuaaccuuaaaugugauaguauucagagauggggccuuugggaggugauuagcucaugauggcagagcuuucaugaaugggauuagugccccuguaagagagaccucaaagagcucuuucgacuuuguguccuuuccaccguaugaggacccagcucguaggugcuguugaugaaccagaaagcaguuucucaacagacaccacaucucguuccuugaucuuggacuccccgucccccagaacugugaggaauaaauuacugucauucagcagcuucccaauuuauuuuguuacuuuagccugagguauuuuuuuuuuuacaguagccugaauaaacuaagacaugaacauccuaagugaaucuucuauucagccaggguugagaaccacugccuuaauucuauuuuuuuuuuuuuuuugagacggagucucguucugucauccaggcuggagugcaauggugcaucuuggcucacugcaaccucugccucccggguucaagcaaugcucccuaccucagccuccugaguaguugggacuacaggugccugccaccacacccggcucauuuuuguauuuuuaguagagacaggguuuugccauguugaccaggcuggucucgaacuccugaccucaggugaucugcccgccuuggccucccaaagugcugggauuacaggugugagccaccacaccuggccacugccuuaauucuaacggaacuaucaccuuccuauuaaaaucaucuccaauccauaggacagaauuagucacuucuuaucuaagugaauaauuuguacauaacuaaugcauuauguuggaauuuucuaacuuaucuggcuucacucuccccccaucuuccauuggaauaagaaugcuugaagggaagggguguguuuccucaacgccuaggauaaggcauaagcccaucauuacuaaggaauuaccacgaggcauuuuagaauucuucaguaguuguuuugagaaaccacaaggcagcgcuggggaaucugagauuccagcuuguucuucagccuuggggaggaaacagaaaauuuuaugaaugccacaccuuucaagcucccuggagaaguccccacacuuucgucaagacugcauaggauagugugcuggguuuucugucuaguggcaacuuggcaucaucuccccuuugaagcacuccuuucuaucacaggggcuggaggccugggaacuacauuuccccagaaucccugccgauaggguuuuugguuaaauguugccagugagaggcaccugaauagggcuuggaaaaucaaagauuaacagaagccuuuacuacucccaggacagugaagcaggugcagaagcuucagcagauggcagauacgagguucugugaguggcuuccaggcacccuucugugaauaaugccugcuggagacaucugagauuacuguuagcaguuuucuguuauucuugcauuuauugauuucuugaaaugacuuucugaacugauggcugauuuccuguuggucccccuucccuggcccuccugauggguuuggaaggcacuaauucccuauguuaagugucuacuugaaauaccuagagugguuucucuucuccagaucaaacugacugauguguauaguaauuaagagcaugagcucugcagucagaaagccugguuuauugauuucuauccagaugcuguaccucaugcuaguuguguccuuaugcaaagaacuuaaaguugcucugccuucuguuuccucaucuguaaaauggaaaaacgagaguguuuaccuccuaggaauguuguagaaaauguagaaaacauuuuauacagugucugguauguaguaauuaauaaauauucaguauucuaacuggaauuuuauuacccauuccaucucgugacaacaacuauguuacaauuuaaguccauuuuuccuuuucuuuuucuuucuuuuuuuuugagacagagucucacuuuguugcccacgcuggagugcaguggugugauaucacagcucacugcagccuugaccucccaggcucaagugauccuccugccucagccccccaaguagcuggaacuauagguggcccaccaugccuggcuaauuuuuguagggacgagagguuuuguuauguugcccaggcuggucucaaaccccugggcucaagugauccaccugccucagccucccaaagugcugggauuauagccauuuacuuucucuaacagagaagauaaacuucuuaauuucucgaccaccuccgacgagcacauucuaggugccagagauauaaaacugaagaagucuuccuuuucaagugucucacugcuuauugggagcagaagcagaaaagaaagccagcgaggugauaaauacuaugggagcacagaugaccaucuuuuuuccuugucagacaaucccggcccuuuuauuuuuccuuguaguuuuauucuucagucuguaguucucuucuguaucuccuacaaguuccccaguguccuuccaaauuuauagucacgugugggacacaguccacucuacaggcucuaucggcauggacuguagggggagaaugacccgcuuuauguuggaagucaacagcucugagaauuaaggccuaagacucauaacuuaaagcuuucuccaccuaagcucauuuagucucuccuuccccaaaugucuugaggaaaaaagccaucugccuccuuguucaggacagccauggggucauuuaagacucaucauggaauuuuaacaaccuuauccuacgcuguguggaccaagaugaccaucuggcuccugugauugcaguggggaccacauuguaccuggguauuacagaggugcagccaucuccccucccccugcagcuguccaguuccuggaaaacgugcucccaggaccuucagcugcuugugacuagauggaggcuuucacacuaauccacuaauccucucugccacaaacaucauaagcagaucguauaaacgugaagaggagaaaaagacuucaauguuccauauuaaagaaaaagcauccuaugagcuauuuauuggcuggagauugguagaugauccucacacuaaggcauuuccaugaauucauuuuuuuuuuuuuuugagacaggaucucacuuugucauccaggcuggagugcaguggugugaucacagcucacuguagccucaaccuccugguuuccagugauccucccaccucggccucccaaagugcugcgauuacaggccugagccaccgugcccagcccaugaauucagcuuuaauacuaccacuuuugcagcacuuugcauauuuucucugauacuuccagaauuuuucauuauaaaaugaauccaggugguuugaauauagaaaucaaauaacucuaaucucaaaaaaacucacuauauaccaggacuuuuucuuucuuucuuuuuuuuuuuuuuggagacugagucuugcuuuauugcccaggcugaggugcaguggugcuaucuuggcucaccacaaccuccgccucccauguucaagugacucucgugcuucagccucccaaguagcugggauuacaggugcccgccaccacaccuggcuaauuuuuguaauuuuaauagagaccgguuuucaccaugguguggccaggcuggucucaaacuacugaccucaagugaucugccugccucagacucccaaagugcugggauuacaggccugagccaccccccuggccuuucuuuuuuaaaaauagaguugaaaauuaggccaaguauauugagaguucuaaauccauugucagguacauacaacuggcuuuugcaaugagaaaccugauuacccugccaacaugccucucuauacaccaauuacauucuacugggaguuguucaacucauggugacacagaaugugucaaauaauccauguaaauuaagccuugccauauccauugcagaagaggggugcauuuacuggguuggaaguggugucaccaggaccagucaaggccacuccuuaagaaagguucagcauuucgucaugguuuuauaucagguauauuucgaguuuauauaaaaaaagaguaaaacugcagaaucaaguccuuuguugccuuccuaacuuuuuaaacauauucaucuauuucucuuucagcuggaagaaacgaaucuuaagugcaagaaaaaaaauuccugugaaaaacucuaagugggaauguacacuucugagauaggaucagacuacagaaucguguugcuucugcuuagugcuuaagaaaauaaccaggaaaauaacgaucuauuuaguuacuauccuggaagucaugguguccauacugcuaaagugggucuauucacugauggaggacaggagaguagggauaaaaacagacaggauccaggccgggcaugguggcucaaaccuguaaucccaguaggcugugggaggcggaggcgggcggaucaugaggucaggagaucgagaccauccuggcuaacacagugaaacccugucuccacuaaaaauacaaaaaaaauuagccgggcuugguggugggugccuguggucccagcuacucaggaggcugaagcaggagaauggcaugaacccaggagguggagguugcuaugagccgagauugcgccacugcacuccagccugggcgacacagcgagacuccaucuaaaaaagaaagcagacaggaucccaguccaaugcagacuuucugacuuuccuauuuuagaugagucaagaguccugauccacaguuucaauuaaaaugacagaaagucaacugauuucagagccaacaccaaauaacacugugaaggaaguugaguuuaccuuugaaaaccccuaccacuucaggugcacacucccucuccaggacucauacucccauguagacuauuccuuucugaccaaggaacuggagcuauucucauggucuggaaugggucuccuuuccugccuacuugcuaaaguguuucucuucucagucccauacccuuuggauuaguugugagccagccauauugcauauugaagaguugguaagauuugacuccuucuaacagguucccaagcucuauugaccuguaauugcaaaaaaauacaaauaaacaaaaccccaacagcaacaaagauccugagggagugacauuaaugguagaauuuuuaagguacagcgguagcccccaaaugggccauuuuuccuucgucuaaucuuauugcauggcaaauauagacagcagcaggcauuccugacugagaacccuggugauggccugauggaagcagagaugagacugucugauccacuccaggcagcauggucccuaaagggcccucuacagcugggagccuacccuguucuguaauaacagcacaucagcaaccucuaucauuguggcaaugguaaucaauuauuuaagucauauuucauugauugccuuuaugugccaggcauguugccagccaaugcaaaccaaugaugaauaagaaaugguuccucccuuagggagcuccagucuggaagggaacucaggcucacugaauuuucuuauccaggcaacaaacugucccaggaucuuuuaaacaguuuccugagugcaaugaguauguaacauuaaacucagaacaaagagaaggaucuaggaaugcaauuuccuauguggccaagagauguguuccuaccacaaacguauuccuggcuucugaggcacuuugaucauugucacccaugcagccauuuuuaauaguaaauagcuaaauauucagaaauaggcacuucacaauuauuuauuugauuuggguagugucaggcuagggaaacacuaccaggacaccaagacaagaagagaaaugucccgguauggcaggggccagaugcgggagaaggaggaccaguuuuaucaaaugagccagguggguaaugggagugagugggagcuucaagucauggagaacagacggaguguucuaagaacucagcgaggacacucuucaagccacgaggcugagcuccuagaacucuaggagacaggagcuagaggagaggugggcucucacuggccuguggaauaaagaggcugaugaaccuucccaagcgagggucucauaagcagggaggaaaguauggggcuuagagggagaaucaggcugguggccagucagcuguuguuauuuauaaauaugcuuuuauaguaguuuuagauuuacagaaaaguuaccaagagaacacagaggguucucgaauacuccguguccaguuuuccuuguccuuaggaucucacagcagaaugauaccuuugucacaaugaauacaccuauauugcuaugauaacguaaguccauuugaaauggagucuugcugucacccaggcuggagugcagcggcgugaucucagcuuacugcgaccuccgccucccagguucaagcuguucuccugccucagcuuccugaguagcuggaacuacaggugcccgccaccacgcccggcuaauuuuuuguauuuuuaguagagacaggguuucaccauguuagccaggauggucuugaucuccugaccucgugauccgcccgccucggccucccaaaaugcugggauuacaggugugagccacugcgcccggccccagucauuuauuucuaucaguauggacucuugcaugcuuucuugcuuuggauuauaauccaauacuagucaacuguuccugaaucacauauaagguacuacacuauaguggugcaggcacucuguacauacagcaaaggggcagaauuaccaugugcugcccaugguagugauggacacaaaucaaaggcuuaucauuaccugugcaaagugguuaaaauucuggccaaaaagacauuuucagucccaacaaugcaaucagaugcuugaccagcaaaagcaguauacuuuccaaauuauagguaucugcauauccacacauauaccuuaaaacuacugggggcauucaauugccaaaucaaauggacaccuuggucuccuugucuugcuuggucacucugauuuaugugacauuucguguauuccuucauugagcuguucuugugcagcuucucugauucucgaggcgcucuuucuuuuccuuugaugauucuaccccuuucuggccacccuucagagcugcugucacccuaggauccagccucaguuuucuucugaggucucucauguccucauccacucccaaccaugacauccaugacugcuuccuccaagugccacccccucaggccacugcgccugggcaucucugcacuguggcuuccuggaggcucgagcucauauuuuaucucacgggcaucuucagcaucuaggaaaaugcccggcaugcaaucaccacacaauacauguuuguugagccaauaaguuaaucccuacuuggaugugccuccaccuugacuggccucaaaccagaaccuauuaccuccccaccuggaauccaacgagcacccaccugguccucugcacguggguuuugacuuccucucucuccucccuacagacaacaaaacuccuagcaguguccaucuuauuucucaagcuuuucuuggaauuccucccuuucuccaucccuugugacgcugcuucgguuuacauuucauuucucacuggcauaacuaacuccucucuucagucccuucuccaggcucuauuucccaccuugcugcagucccccuaugauuuaaauuccuaacacuggcugcuucuuaggguagacaaggcucuucaugguuggccucagcugacugcagcugcugccuggucccagcccuguaacucaauacuggaaugaugcaaagucuuuauaguuccacuucucugagucucggccugggcugcccuuccugccugaugcccuucucccuguucucauuuauuacucacuccucaaagaccaccccaaagggcacagcuuuuuggugcucagugaccuuauugaauuacccucugcuguacccaugucuauuagugcacuugccacuccacacuggaaugauuagucuucaugucugucucaucugccuacucaugugcuucucaguugacaguacugucugagccuuacuccuuucuguaucuccagugccuuggagacacagguauuuauuuaauugcaaaaaaaaaaaaaaaaaaaaaaaaaaagagcauucaccccuucaaaauaggagacaagaccugcaaagagcacagucgauccacgacuccaaauggaauggaauacauuuaaaauacaucuggagugggcagaaaaagaaaaaugagcucaaaauaaguuauaaaagcuuacuuuaaaaaacaacacuuagaggccaaggcagguggaucaccugaggucaggaguucgagaccagcaugaccaauauggugagaccccaucucuaccaaaaauacaaaaauuagcugggcaugaugguaugugccuguagucccagcuacuugggaggcugggacaggagaauugcuugaaccugggagguggagguugcagugagccgagaucacacgacugcacuccagccugggugacagagcgagacucugucucagaaaacaaacaaacccccccacccccaaaaaaaccccacaacaccuaaauuuauaauaaccacaaucuuuauuauuauuauuauuauuauuauuauuauuauuauuauuauuugagacagucucgcucugucgcccaggcuggagugcaguggcgcgaucucggcucacugcaagcuccgccucccggguucacgccauuuuccugccucagccucccgaguagcugggacuacaggcacccgccaccacgcccggcuaauuuuuuuguauuuuuaguagagaugggguuucaccguguuagccaggauggucucgaucuccugaccucgugauccgcccgccucggccucccaaagugcugggauuacaggcgugagccaccacgcucggccaauaaccacaaucuuuaaaguucauugucuauuaacuuuaaaaacaaaggaaugguugggcagauuugucuauuauggaaucagaccagcagcaggaagggcucaauuggaaagugcugagaaucccacggcuucgaucgguuguaugggugcuuaugaaauaaaaguugcaagaaugagugaacauguacuccuguuagaauccauguacgacuuuuuagccagagcuucucccagaaaaaaucagacuuuucacaaauauauuuugguuaaaaguauacuaacccaagguaagaauuuuuuuuuuuucaaaaaaagaaaaucuaauguguauuuugaagaguuuauacucaggcauaguggagaucccuucuuucuguuuucuuggugggaaaggcagaagcagagaggucaggagaaaggagauggggacggauaacagcauggugggcagugccaggcaugcuggguguguuucuguuugaauguccaggcugugacaaagggaaguaaggaaugcauguuggagggacccauuucucauuugcccucaugucuagggcccagaggaccagucacuuaggacagcugaagccaagcaacuguugacauuucuggccuugucuccucuucucccucaccaaaaugauauuagcugggacuuccucaccuccuauccacaaugcauucccuguuccagaaacaucucaggcugcuggauuaccaaggcuggacccaaaccaggcugugcucagucacugcucauuccgcccauguggaggaaaagguucaaggggauacuuagagucucauuuguucacugagggcuccauaauaaaguucugcuaaaaaugcauguugcuccugaacuccugcagccugcgguuugggacagaguguuauuuuggagcauucagaguugcugaugcuauugugcccuuguccccgcuugguguccaaacuggagcauuuccuugcuuucuuagagcugccuucacuugaggccacaaaggacucgcacuauuaaugagcuugugcaccagaccaacugcugccucauaauccucaaaacaaccuagagaauuuuuuagaggugaagaggcuuuagugauuaucaagaccagcaguuuaucaacuuuggucuuguuuuuggcaccgcaaccuuuucuucaaaagagucuuaaguaaaguuguaucacuuauccuuccuguggggauagaguugcaaaaaugcaagugucacucugaugucucuugagucaacugcucaccugcugucagugacagggugugggguaaugggaugagcccugcagagcccaugaucauaggauuaggucaggaggaagacgaacuccaggaaaaagcucccacaauaguagggcucuuagcuagaagguggaaauucauucuaacagaggucuuguucacaagcauauuuaauuaguggcaagagcccaggaaaggacuaaauucuuguaauuuaggauggucuaaaguauggaaggcuuuauguacauuucugaacagccuucucccccuucuuggaggcagcuguuucaaguagcgacuggugcucagccucuggagcuggcagcggagcccguggguguggcgaggucagaagagcuuugcucaaagccaggguggguguggcugccucugcagcccuggcccacacccuuccucuguggacugaggccuccuccugcccaaauccagagaggacucuuaacucuuccuccugcaagacucagucccaaggcccaggaaagccccaguugcuaacucugauuuggcccuuguugagcucuccauggacaugguggccccuguggacagggagacaggagaguggauucugcucucccccuucuucagcaucacguuccucauucucacucucucaucuuauuaauggcggcaagaguugggaagaugucacagcauaugggggcaggaggcaggggcuaugcuucagacaggugagugauugcaaaggacaggcugaugaagggccuggaagaagguuaggaggggaguggggagggagcagugagccucaucccauggugcugcaugcugggcucccaccugcaaugccuggccuccuuccucugccaauucaaauccuacacacuuuugagaguccaucccaaguaucacuccucuagaaguccaccagacauuccugccuuccccgaccuucccucuucucugaacccuauggaggauauguugucuuggacugagcccuggcagaucuuccuucaccagacuucuggacugagaugaugcauuaaacuccucuguauccuccagagagccagguuaucaggcacuaaccuaaugcagaaggaggugacuuagucuuaagcuguaucagcuuccugaaggcucaagugccuuccugggacagguggcucuguagggcucugagacucucugaacagguaccucuaucacagcuccugucaccuuauauugaagugaccauucucacuccagccucgcccucugcagggcaaacugcugcagucaccaauccauacucccauaugcauuuuguuauuuccagggcauugcauagaauuaacagggcaggaacucaacaaauggacagauucccaacaaaccaaauggaaauuaagagacuacugugaagacacagaaaaaagaacuggcugaugaauaaggagaagugggauuuuaaaaaguugugaugcaaauuccauuauaaacuggaaucaaagucagcauuaacuaauaguaacauuaaaauuauugccccaaaauggguaauuuuaaaugugacuguacaagaaaaaucuuauuuuuucuuguguacguuuaaucagauucuuggaaauaaacuuucuuucuacucuuggauacugcaaaaacuggauaugcccaaaucuaauuuucauauggaaauaguugauauacuauuaggauuuuuaaucuaguaucaccauuuauagaaauuuuaaauuuuuuucuauuaaagaaaaaugcauaauuuuuugagaagucuagaugauuucagccaaagaaaaaugaaagaguugaugaguauuaauauagaaauggccuccuggauacugcaauuuguaagucuuagauuuauggccgguuccuuaagagcagggaaauggcuauugcaugcucccaggcaugauucuuuuuauccaaugauucuaauacuuuuucuaucuuucccuuauuaccaaaaaauaaugucauuaaaaucuuuuuuaaggaauaaaagugaaagccaguagguuuugguuccuuauucauacacucagguuuguaaauaagaaaaacaccccaaacacuucuuuuauuucccacugcaucauuauuuccaauguuaaguuaucccaucuaaaaucuagccuuuucacuguagaaauccacauuucucauuccuuaauacuuuuuuuuuuuuugagacagagucucacucugucacccagggugcagugcagcggcaccaucucggcucacugcaaccgcugccucccggguucaagugauccuccugccucagccucccgaguagcugggauuacaggcaugcaccaccacacucggcuaauuuuuguauuuuuaguaguggccagcuggucucgaacucuugcucucaggugauccgccugccucggccucccaaaguacuggaauuacaagugugagccaccgcgucuggccucauuccuuaauccuuuguuagaacuuucuagucaauacauuagagauaggugcuuuagacguucaaaggauuuuaugcacauuaaggucaaauucugacugaagggaagacccacugggcacucuugacccacuagccagacaacagguguaaagacaggggcacauuuggugugagcuaugagcaguaggccacaguggcaggcagaggaagcugggugcccuagacaugagugagggugcugggugugugcugaggucacccaggcgccagggagaagccaggguggcugagggcuuuuaagaacauggacgccuacuaaucagugugacauuuuuugcauugcucuccguaaguccuuucccugucccaccccacacgcugaaucauucucuagaacaauguucucuaacagaaauaugugagucgcuauguaguuuuaaauuuucuaggagcuauguuaaaaaagccaacaaaaacaaaaacaaaaacaaaaacccaacgaauuuuuuuguuuguuuguuuugagacggagucuugcucugucacucaggcuggaguacagcgguacauucuuggcucacugaaaccucagccuccuggguucaagcgacucuccugacucagccuccuaaguagcugggauuacaggcgcgugccacauccuggcuaauuuuuguauuuuuaguagagacaggguuucacuauguucgucgggcuagucucaaaauccugaccucgugauccacccauauuggccucccagagugcugagauuacaggugugagccacugugccuggaguuaauuuuaauaaugauuuaauuauuaauuuaaauaauauaauuaguaaauuuuaauaauauauuucacucaauccaauauguuguccaaauacugccauuuaaacauaugaaaauuacuuaugauacugcuuacauuauuuuagugcaaaguguucacaaucaucuguguauuucauacuuaagccuaccucagcucagacuccccauuucaaguguuugacagccgcgugugccugguaguuccuggaguggacagcaccaguggcccuggcugggccaguccuucguaucuuggguguuucuggccccacgcucaguucuucacugggcgagucucccagggugggacccucauauacucaaggacuucacugcugacagcuugauucauuuaauucauuagcuucccaacaaccaggggauauacugcuggcuccuacaucuaugggcacacguguauucuuuuuagucgggucucuugaaauagccuggaaaugugcccuuaaacugcaggggaaaaaaaucugggaaaugccuuuuccuguaaaagcucugauuuuacaugcaugcccacagccaccacagucagggcugccacacaggacagacagggaggggccgcccuucccuacuuugcuguguuauaaaugaacauguucaguuccaacaaccuuaauaagcagaagauuucucaaaugcacaacacaguacuccauuucuacuuuuuuauugguaagcgaugggauuucauuuguaauguauaauucugagaacucgugggcacuuacaagcacuuuaaugcucuaagaugauugaggugaugaagagacugcaauaaaauaucucugaaaccaaagaugaucaaucacagggucguuuucccuagccagagagcucucuagaaucuaugaaaagauuacuuacuggaaaaaugaaaaaaaaaaaaaaaaaaaaaaccaaaagaaaaaaccaaaaaaaaaaaaacuaaaaacaaagccccaaccacuccaacagggcucuuuaacugaacauuagucaucccuuucccaagaaagacauucacuccucacagccugacagccucagacaacaguuagcuguccaaacccauucagacaaaauugauuauuuuuuuuuuucaugaggggugcagauaaaauucucaaaugaauugccugagaagucaguuugacauaauaucccauaaaaucuuugcugcuuggaagaacuauaaaaaguuucauuaacauagagcuucauuccacuccaacucuuugcaccaacuucauggcacguuagagcaucaaggcucaggugauuuacacacagggagcagaaaucauugcaucucagccaaagagugugcaauuuuaagucgguuuaucuaacacuucuauuacucaaacucugcauuuaauauuugcaaaaggucuaaugcagggugugcaucggcauccuacacaguuauaucugcacccaugugguuuucuacgaagagaagagaaucaggucaaacuuauuauuacacuuguauugcucuuucuuccuucuguauuagacauggucucuggaagcccagagcauggacuaacaagcucugccacaucuuauagcacagcaugugcuuucuaacuauguaauaaugaaauucuuuuuuuuuuuucuucuuugagucaggcucuuaauuuguugcccaggcuggagugcaguggcucacugcagccucaaacuccugggcuaaagcgauccucccgccauagccuaguguagcuaggacuacaggcacgcgccaccaugcccagcuaauuuuaaaauuuuuuuuguagagauggagucuugcuauguugcccagcuuggucaccaacuccuggcuucaagugauccugcuaccuuggcgucccaaagcacugagguuacagaugugaaccagcaugccuggccugaugaaauucuugauggcuauaggcagggaccugccagccuugcaguuuccuuugcuuuccucuucuaucacccauuucuuucuaagggagugaggcccuugucauacccugaacguuuugaaggcaucaagucucuuaauccaacuucucuucccaccucggaaucucaguccagggcaaaaaguccaccuagcucuugauaagcagagacuagaagaaguaggagaaagcuggcgagggcguguuuuacaagaguuccauucaguuuccugcagcuuugagaauccuaaaugccacauggaguccugccgcccauucagcugggcagcacggcagguggggcgagauggccuuccugcccaaauucugcccaacuucugcccaucacuguccugggugugggagauugggaggguguguauguaugguugagauuguagauaucuuacuuugaaaaggacuuuccaacccaaagagcaacugugaagaguccagaguuuuuacagagaaaaaaaugcaaguuucaggacuacagagcaaauauagugaggaagagcaauuuguaaaauacuaaacuagguuucuggacauaccucuacuguuaacaguaauucuuuauuuaaauaggcaagacauucugcucuugcagaaaggcccuugcgaucagaauaagaggaaaauagauccugguaaggacccagguucugagaacaccuuuuagggucugacaucucugccaggugugaagagcugagaaucaguggaucugaguucuagcccuaguucugguguuaacuccucagccauaacuuccuugugcuuucuuuacaaugaggauaauaaaaccagcuuugucuucuucacaggcuauugcugaagacaacaugauauaacagaauuggaagugcuuucacaaacauuguuuuaugaacacaagguaagguagugaacaaauaccugacuuugugaauuugcaugcugccaauauaugcacaccugcaucauaaggucucauuuaugaugcucuauguuuguuuuuuuuccuuuaaaaauuuucuguguauucccagcuguucaaaauauaauuccaaguguguaucaucuguagaauugggccacugcagagcacuauguuguuccugaaccuaauccaaaguuucaagagcuagcccaucucugaacuucccaccagcaugaaaacccuaaucuaaucugugcaacaauaaucucuagauaggcaucucucacacuugcuuuuggaguacuguuuuaguagcuuacuuguguuuuuuaaaguucauuucuccacccacaggauagcuccauaucuuccagcaccacuaaugaguaaguauuagggccaagcugguaucugcagagugcugacuggccaagagucugccugugacucaugccuuaggcuguccagcauuggggugcuggggggcuguagccauaacauuugcaggauuuggaaauuccaccucaagcuccaaucccaggguguugauucuggcuaaccauguuuaugcaaagcaauccaagcacuuugacucacuuugggaaucuggcauucuugggcuuuugauauugagacaguggaacacuuuuguaucaguuuagguucugccaauaauugcuauccauuuaagcacuugauuuuuuacauauuuaccagcaauuuccaaggcuuuaauggauagaguuagcacucuucugcaaggagaaauugcuccacagugcuaauagucguggauucacaggcacucagugagaauauuuuaggcauaagcuuaguuuuauuauuguaccuuagagaaaccuuguauuuuuaacuaggugguaacuuuuuacuguauuaguuaaucaaaagaaacauaaauauaaccaaaauguuauuuuuaguuuguacuggauucuauaaaaauaugauuacccauucuagcuuuauuuugauguuaauauuuacauuuaaauagaagaaaaacaguaaagggagcacaucaauguaagaaguguauggcuuuaguaaaauauauaagaaacuuugguaaacagggauuuaaaaaacucuaaucccuucaccaacucagaaugccaguuccuuacaaagcugcauaccugagcaaccacacaugugguuucuguggaugagacauuuaaaugaugcaaucauuuugggauaacaguuauauaauauaaagguuucacaugagugucuagcugaaaaaccacugcguuuuccuaugaaugcaaagaaaccucugcucagguguuggaagcugugccucuccagcugccugccaccuuccaccccuucaccuguggcuuccgcugguuucugaugggcacccuuugaucacuggggucaguucaauuuccugggccacugggucaugggcaggacaugaaaauguaagaagagggaccaugcgguucaccuaaaugacacucauuuaauaacaacaucaaaauccuugaugugacaggaccuaucgccuggcauacuaaaaguggggagagcaauucucucaucuucugcuguaguuaaugauaucuuccuaaaccugcauuaaucaucaagugaacuucuagggauaacguaacuucugggagaauuuaaacugagauugaauuuguaucucagacgguagugcccacagaggugggcaguggcacaggcuuccuucagcuugugucccagguuuaugggagaacucuucucccugucccucaauucacacacaaaagugcaaaacaggauuaugggcauagggcaugggcaauuucaucuacagcagugccgaucucugccucacucuuugaggucaccacaaugcuuuccuucuguucagaaccauaaugguuucuguguaucaauuguuugugggcaacugcugaaagggaaucgagggauaaacaugauucuaaccaaucgcauucuguggugucuaugggcuuccaccuguuaacaugggaaacuuucugaauuuagguucauccccaucuuguggaauuggauuuccaccaaggguuccugcuccucauuuagcguggaagaaaguggauuuugcaaauaacauucaugauguuuugggcaguaucuacucugccugcaagguaagaaugagucugugggagaacauccagcugcugcaacuugcuucaaagccuccuuuuuuuuuuuuuuugagacgaagucucgcucugucgcccaggcuggagugcaguggugcgaucucagcucaaugcaaccuccgccugccggguucaugcgauucuccugccucagccucccaaauagcugggauuauaggcgugugccaccaugcccggcuaauuuuuguauuuuugauagagacaggguuucaccaucuuggccaggcuggucuugaacuccuggccuugugauccaccugccuuggccuccuacagugcugggauuacaggcgugagccaccgugccuggccaaagccucuguuuuauuggcuucucuuuggugcucaaaauucccacguucacauuaccuuguuuauuugagguaaaggcuuucaucaaaaucuucaguuaagauaaaaauggcaggaagauaaagguggggacuuacaaauuacauucuuaaaagccacccacauuuugguuuauaucucuuauuaaaucugcaguacaaauugguuugucagcucuguuuaccugaaaguguccugagggaacagaacacauggcagagaagccugucuggcagaauuaaggacuaggagcugggaaguuccagagcuuagaacaacguccagaagacagacuugcaauugugcugcagaaggacaaacuguugccuguuggcagaagauggggacagggggaaggaggaagcacagaaggaggaacagaaagggccaaagacaaugucugucuguugugagguccacuggggcuggccuuggucaccugccugaccuccucggagugagcgugagacggucacguguacucagggauugaggaggcccaaugcuuucacacuucguaaauucccggggaacacuccacacucauacugaaagggacaguguggcccugacugacagcauguccaggaccagaguacuaggcaugcuggacuccauaggauuuagaaugccacaguggccggagcagcaagcuggcacacuggguuagauggcaaagugaggauguguggguguggacgugggugugugcgcaagguggcggcaggauagacugguaacacucacucccaugcauuuucagcuuaggcuacaaaugacaaauggcacaccaaagugagguguggucgugcagacagaaaaagcaagggccuccuaaugcccaggaagcaaaaaggaaagaacgucucuucgguaccucaugacuuccugcuagaggccugaagucacuggcacacuggaggauucuguuaguauucucaucagguaugcuguuuauuagacagauuaagacuaaaagaaaauacacaaaaauagaaagcugcuucuuugagaaugaugaguauguuuucaaaaacuuuaaauuuuaaauauuuauagauucacaugaaggugucacaaaauguacagggaaguccugaacacucuucacccagccucugccaagguuagugucaugaguaacuguaguaaaaugucgaaaccaggaaacugacauuagaacaauccacagagcuuauucagauuucaacaguuaugcauggacucauuugugcaugugugugcacguagcuauauguaauuuuaucacacguguagcuacacguaacagucuaccacaaucaaaguauuuaaccacaccaucaccacaaacgucuuucaugccagcccuguauagccaccccucaaccccaacccuaaccacagguaaccacugaucuguucuccgucucuauaguuaugcuauuucacaaagguuacauacguggaaugugaaguaucuauccuuuugaaauuggcuuuuuuuccacucagcauaaauucccugagauccauccaaguuguauguauuaaccguucauuccuuuuauugcuggguagcauucaauggacuuuuagguaguuucugguucuuggcuauugcaaauaaagcugcuaugagccuucacguacaaguugcugugugaaaauauauuuuuauuucucugggauauaugcccaagagugcaaccgcuggguccauuuucagcuauaaaaggaacuaccaaauuauuuucuggagugucuauaccauuuuacauuuucaccagcaauauguuagugagccaguuacuccacauccuugccaguguuugguguuaucauuauuuuagacauucugguagguauguacugguaucucaucucauugugguuuuaauaugcauuuucuuuucuuuuuugagacagagucucacucugucacucagcuggagugcaguggcgccaucccagcucaccacaaccuccgccucccagguucaagugauucuccugccucagccuccugaguagcugggauuacaggugugggccaccacacucagcuaauuuuuguauuuuuaguagagacaggguuucaccauguuagccaggcuggucucgaaccccugacucaagugaucugccugccucagccuccugaagugcugggauuacaggugugagccaccaugccuggccuuaaguuguauuugcuaauggcuaaugaaguucaguaucuuuucaugugcuuauuugccaucuguauauucacuucaaugaaaugucuguguaugucuuucauccauuguuguaacuggaugguuucuuuaaugcuaaggucugggaguucuuuauauauuccacauacaagcccuuuguugaauaugugguuuacaaauaguuucucccaggccauaauuucucuugacauccucuuaguaggucuuucacagagcaaaagguuuuuaauauugaugaaguccaauuuaccaguuuuuccuuuuauggaucaagcuuuuugugucaagucagagaacucuucauccauuuccaggucccaaagauauuuucuuauguuuucauauuaguuuccuauugcugcuauaagaaauuacacaaauuugguagcuuaaaacaccacaaguauauuuaccauucugcaggugagaaguccaaaaucaguaucacugggcuaacauuaagaugaugcagggcuguguuccuucugaggccucuaggagagaauccauuucccuguuuuuuccaguuucuagaggcggccugccuuucuggacucauggccccuuuuuccaucuucaaagccagcagcauuuccaaaucugucacuggcucugcaaaguuccuucugccacguaagguaacacaaucacagguuuuggggaugagcaugugaaugauacgguggggggcauuauucuaucacaguuuuuuucuagaaguucgaaugcauuuugaguuaauuuuuggauacgaugugaaguuuggauugaaguucauuuuauuuuagccuaugaauguccgauuguuucaacaccauucauugaaaacguuccacuccaccaaucuccgucuuuuaauugauguauuuagaccauuuacauuaaaaguaauuauugacguguuaggauugaagucugccauuuucuucguuuacuguuuuauuccuuuuguuucucauuucucucuuuuuuuuuuucuuuucuugccuucauguggguacuugaacauuuuucuucuuuuuucuuuuuguuuagagacagagucucacucugucacccaggcuggagugcaguggcaugaucauagcucacuacauccucacacaucuggccucaagcaaugcuuuugccuuggccucccagagcacugggauuacaggcaugagucacugcaacuggccuugaacauuucuuagaguugcauuuugauuuacuuauaauguuucugaguacacugcuuuguacacaguuuccuuagggguuguucuaaguauugccauacacauagguaacuuaucacagcuuacuggugucaauguuuuaccacuuccagugagguguagagaccuuaccuccauuuagaucucuguauccccuccaguuuuaaaauacaauuaucuuaaguauuucuuccacaugcacugaccagcaccaucagaugucauuauaacuucugcaucaccauuucuuucauaugaugaaagaagcucaugagauaaagaauagucuaguauguuuacuucuauuuuuacucauccuguucucccugcucugaaaaucucagcuuugggcuuuuaccauuuucuuucugguggagaaguuccuuuagcuauucuuuaaggguagaucuacuagaaacaaguucucuuaguuuuccugcagccaugcuggagaccugcaugccuuaaagucaucaguggcugagccuccuggaagaccuagcacuacccacguggcacucuguagacacuaacaugugccacuucagcuccuggcacccugauaauggccaacaccagguggcaaggugcaggcuaggcuccccuugcccacucuuggucuugggcccaaggaaauuagaguugaggccuauucucaagagagacagaucccuuaggaggucaaucaaggauagcagugccgugaaaacuaucuucaauagcucagcugggucagaacaguguucuagaaguuugagucuaaaauaugugagcccugaaauccuucaacuucuagggugaccuugaggugucagagcuauuccuauauccaguaauacucuauuggcacaggccccaggccugaagguaccacauauaacacacccucauucaugaccagggguguaccuuacaggaacaagaauauaaccauucauuagggcucagaccucagaugucaaaaacucuuagcagaaggauuggcuaagagcuccaggaagacaucagaguuagagaucucgaucugggaggcaucuggacagagaugaaaauugcagcuauaggaaugcaugagaucaccaugagaagaagguagaggaaaaaaaccaaaacagacccaaggcugaacccugguaggaauaucaagaggauauaguaggauggcagcaaagaauagacgguucgaagaaggccuugucaaugggguuccaugcugcaaagaggucaaggaaguuaaagacugggaagaugucagaggcuuggcccaggggcaacuaaaccauggaggcccacaaugcacagaugcugggaaccagcugugagggaggaagggcuggugagaaauuaaaggaugggaaaggagagagugcucaguagucacaaugguugauggauuugccuguguuuguauuguuugggaaaauauggaaauguuauaagccugaguaggaagaacaauuaagaaaacaacaagagaggggcugggagaggagggggagagaaagaaugaggucaacggcaccagaggagaaaaggaucaggcauuucuuccugaaaugggagagaagcaggcaugaaucaagcuagaaauaaguuuaaggugaaaaaaaaauagaaauuuaggaugcugcuccaaaugaacuacacagcugacuagcuuauuuuucuuuugcauuaaaaaaccuuuggguuggcugggcaugguggcucacgucugcauucccagcacuuugggaggccaagguggguggaucaccugaggucacgaguuugagaucagccuggccaacauggugaaacccugucucuacuaaaaauacaaaaauuagcagggcauggugacgggcaccuguaaugccaguuacucaggaggcugaggcaggaggaucacuugaacccaggaggcggagguugcagugagccgagaucgugucauuguacuccagccugggugacaagagcaaaacugcgccucaaaaaaaaaaaaaaaaaaaaaaaaaacacgcccuuuggguugcugaaauuaaugugauccuguuggggcaauggugguuuccaaaucugaccaaacaucaaaaucgauuaagaaacuuugcaaaaauacagcuucccaggccccaacccagccacacuuaagcagaaucccugguagagggggcccaggaagcagcauuuuaaaguuucuucagugauuuagaggguuaaaccagguuugggaccucucgaguuacgauguucaaccauguauguauauuagaaucauaaggcagguauugguagacccagacucuccagauuacagguauuaauauuuuuaaaaagcuccacaagugcucugauguacacccugguuauaaaccauagucaggggacugguuuggaaaaauaaacuaucuggauaggauacuugacuuuaccauaccgauugguccucugucauucagauugccugacaauuaacuuuacacuuuucuccuauuaaaacagcaccugcuucuauccgggcugucacuggugggcugaugguucccuguggcuucucagcggauuucuccaggcagccaggcuugugggcuuaccaucucuggcccucuggaaagagccuggcuuuggaaguuuuuguaguaucuuuaauguaaaguauacaaaauuucauuguucuuuaucugaacuaaccacacaaugcaccuuauaaaagaaacaguaagacacagaauggaggaaggacuauagaaaaggcaauaauaguucauauuucacugauuagaaaaaaauauuaucaggcagacccauaauuaauuuggugagaaaauuccuugcaccauuaggccgauuuuuuguuuuaaagcagcaguaacaucaccaaacaacuacagaaaugagagucucgcauauagcuguuuggcuuugagggaagcuguaagcccagcccucuaaaugccucucaaagaaauacaaauucuucuuuuaucuaaaaugauggugugauccaauuccugcuccagcagccccaacauaucaucuguuggacucuuuaaaguuuacggcacagacagaaacugucaguuccucuccucuuuuauaggacauucacauuugcauauucagcagacagcacaagccucaaaggccauauuccccagaauguaaucauccuacuuuugaaauaccgaagauauaauaguacaaugaaaauauucuuaccccgaugaaggcuggcuccaguuguggcuuagcaagucaaaaacuaguaaacuugccuguaacaacauccuaaaauuccaaagguuauucuuccccauccacaguuaaaaagccaucuccuacagaacagugucauaucugugacauguccaagauuaaaggaagagccuucuugcuuuuaguaauuugucugguuagagauuaaagaaaaaaaaaucaaucuugaagcugucaguuaauauuuuuaaauuaaaaaagccaucuucaugcuucaugggagaaaugugugauuuuuaaacagagguaaauuccucuucguaucaaguaucagauaauuuuuuugcauuucagcacgaggcaaacaaacaaaagguuauccacgaaguuucaaacgcgucuuaguaacauaaacugaaguuagguagccuucuuugauauugaauuaccaaaguaucucgcugaaaaaaaaaucccccuugcaauuaauaaacaaguugugguauuuuaacaaaguuccaaagcuaagaaucuucacauuccaaaucuuuccauuccuggaagagcuuugguauuuagauguuaauaggaugccugccuuuuuuuuuuuuuucuuuuuuuggccaaucuucaggcuaaagagucugugaagcagacuuuuuccauccuaugaccucaguuuuaggauuucuuucuugcaaaauuuaguuauuuugguuggcagauugccagaauucauucuuauuuucuuucuccuucugguacuuucucccuuuacccccuucuguuucucucccuucuucaccuaucuuguauuauucucugaauugaauuaagaauuuaaaguccgguugguggacuggacuacagucucuaugauguuugguaggguuguuagaauuagcaaaugaaaauacaggaugccuaguuaaauuugaauuucagguaaacaacaaacaaauuuuuagcauaaguaugucccaaauauugcaugagacacauuuacacuacaaauuauuuucaaguauugcaugggacauacauauuguaaaaaauuacuguuuaucugaaauucaaauuuaacugggcgucuuauauuuuaucuggcaacacuacuuuggagguucaauggaagggauuuuaaaaaaaacaaaggcauccauuuacaacuccuggaagaagagaaauuuccacuccuauccucuugaacgcuuuuugucuagauguaauguucuugauuaccucauuuuaguuuauuuuugacccaguaaguuguacuaaaagcuccacagagcaugucacauccuuauauuaaagaaguccaucccagguuucaggucucacucggugucaggccaggccagagcuugcaaaauuggucccccaggcaacaugggaccuuggcgcaguaacagaacaaugcaaaugcuccaguuuuaauuuuuuccuucaaaaucugaacaccaaauuuaguacuuuugaaggcacugauauaguuuucucuccucagugcucacuuuggggcaauuuagcaugauuaguaauagugauuauuagaaaacccaauagaauucacaugaauguugaaauguaauaaaaugaucacuuuuugggcauuuugaaagggcagauaaaaauauugauaugcuucugacauuuaaagauaagaugaagaucuuaauuacauuaauuauuaauucagguguauuucugaacaucuaaagaaacccaggagggcgacacauaauuccaaaaugccguucucuuauuuagagacacauugauauucaguauuuuggaacuauuuugaaguuuaauagcugaaauggaggcuguacuuuaaauucuuaaacuggacuuuaaauucuuaauucaauucaaagaauaauacaagauaggugaagaaggaagagaaacagaaggggguaaagggagaaaguaccagaaggagaaacaaaauaaucacacagaggugugagaaaaaguaugggcucuaggcgggugcagagucaggugcucuagcaccuguuugugaacccagcuacucaggaggcugagcagggaggaucacuuaagcccaggaguucaaggccagcccaggcaaauagggagaucucuuuuuugaaaaaaguaugaguucaggagucaaacuggguucaaacccuagcucugucacaaacuagcugugugaggcugguccaguuuccuaaccuuucugugcacauauuccuuaucugaaaauggggauaaccaccccagagagccguaagaguaugagacaagcacucagaacagugccaagaacacaguaaaugcucaguaaguuuuaggggugaagaucacgugaucuagcccaaacuaucaauagaaagauaaaacucaccaagucagagaaugucuccacuuugauaacugggucaugagagaaaagauuuuucucuugcagucaaauggguauuuuaaaaaaauuauaaauagcaauauuuuauguauuuacucauuaaaaagaaacuucucuuuauuuucagaggauacaacuuccaagguugugugaaauuagcaugauacuacuguuccaagaagugaagcuauaugguuaucaguucuauccaacuacugguuauucuuguuucacccuacuuauuauucuauuuacucccagaaacuccacaagcaaauaaaugacacucuuucucaucccuacccccaaagccaauuaaucgaacuugaucgucuagcuuuacuguuaagcagauuuucaaaugaaauagucccaaaucacuggguuuccagccaucuggaaaccacuuugaacuucauuuguuuauccauguuuuuaaugcagcucaggugucuguagucugaggcagugaggaaaacaagugcuucugagucaaacaccucugggguaaaauccuggcuuggccaugcugccuaccugggugagcucucucugccuugguuucuuaucuauacaaugggauauucuaauguugucuccuuucugaguugcuauaaagauucgaagagcugauucauguauagggugauccuauguuucagcuuacacuuauugucccugcagaauuguuacacuauuacccuuauuuuuauaaaguauuuaauacagagccuggcacacaguauucaguauuuguuuuuuguuucuuuuuuugagacagagucucuauuguccaggcuggagugcaguguugcgaucuugggucauugcaaccucugcuuccccaguucaagggauuaucaugccucagcuucuucccaaguagcugggauuacaggcgugcgcuaccaugcccgacuaauuuuuguauuuuuaguagagaugggguuucaccauguugguaaaguuggucucgaacuccugaccucaagugaucagccuuccaaaguguugguauuacaggugugaggcacugugccuggccaguauucaguauuuguuaccucuuaaucaugauauaccaacaccugcaguauucuaacuaaauccuugaaaucccauggaauccuuauuuuuaaagcaagaauagccuuuuuugacacaaaaaggugagugccugccugaaugugaaaguuuggucaccugcccauuaucuccacauucccugucccuuuggauauuucagucauuuaagaaguuaaaaguggggguggaauucucugcgguagaaccuuggaggcagaggcuaacauauuuuacaugcuuuggcaggaucaugugagcacagcuuuacuaaaauacacucugccaacagcagaaggcccucugaggugagcaggugggacgaggcugggaagcugucacuugacuucugccagcuacucggaaugucagaugaaucccagacugcagccccugcgguuuccaaggcccccaucacugcacagaaauaccaggcucacucagcgacaggagccaggcuuccuccugucgcuccuccccagccuccucacagccucaagaugcaauucucuugacaguagggagggagggcagauauuaagggcuuuuagggaaauaccagcccuuucuucagaaaugggguuucuuccuuaacaucucucccguuucaugugcccucugugccaggccgcguguggugucuccaagaggaucuggagcaggcggacccagucggaaucuuggcucugcggcucaugacugcaaaccccuccaggagccaacucacuucucugagaccucguuuuucucuucuguaauaugagauguaauaauguaauaauacaucucauuggauuguuaugaggauuaaaugagacaacauguccaguagacugccugguacaaaauaggcaucuaaggcaugccaaguaucuuuauggucccaggcugccugagaaggggucagcauuagaggcaugcgggugcaaagagaaccugcgaucuagggguggaaggugggcgggcuucagugugcaaauaugcaagcuuggcauuuaggagguuuuacaucucaacuagaauccaaggaagagggagaacaaauccagcugaugguauuucugaaagaagacgcacagcgaauguauguguuccagccauccuuuguaguauccugcauuccuucauuuauucauacuguacuugcuuauugaauaaguacuauguucucaaugcuagaaacacuucaacacaagagcaugaagauucauuaaagauaacauugggaggaagcacaggcagucuguuaaugucaggcaauauuuauugauugcuugcugcagucaauaaauaugguaauaccagccacaaucucccacagcccgggcgacuccucagaaaaacguuggcaccuguuaaagccacagugaguauggaguagcugaaguuucuuaacucaugucucuguggacugaagagcucauugcaaaagggccaaacucgcuuccagagacuguuccccaccuuaaucauaacugaaguaaaccauugcuuauguggucuaacuggagucacugaaaacuucccuucucccaugacauauauuccaaaugccuacuuguugaaccuaugaauggguccuaaaauauucuggguugucaguucuuuggguuaaaacuuuccuagguccuacuggaaugcucuuggguucuccaaggggaauacuucagggagccauauauucuagucgccucuuggcagcgugcaccagaggaaaggccuguguaggaagacacucacuggcugagcucuuucagccucaguuuccucaucuguaaauugaggaaagacgagcccagcuuucagagcuacugggaagacugaagagaucauuuacacaaagugacuaggccagggcuagaaacauggcaggggcccagugcaugccauuuccuucuccuuccucacuccuuuggcacaaagcaucucagaaguuggucaguaaccucuacuguguuuugugaacaggggcugacaaaagugaacaugugcaauugugaccugcauuuaaaaagaugaggaauagaaaaugucagaguaaugguaggugaucuuugcgacacuuuugcuucaguacacacauucacaaaggauacgguauaaaauguacuucugacuguguagguuauagucauaaaguuuugagguggguauauacccccaaaaauuaagaacaggggcucaaagagauaauguaaacccacguuccuggcagccuuauucacaauggccaaaagguggagccaacccaaguguccauugacggauaaauggauaaacaaaauguggucuguacauauaauggaauauuacucagccuuaaaaaggaagaaaauucugacacaugcugcaacauggaugaacccuguggacauuacacuuuggaaaauaagccagacacgcaaggacaaauacuguaugauuccacuuauaugagguccccagaguagucaaauguaaagagacagcaauggugauuaccagaaauggggaggagcagggaacagggaguuauuguuuaaugggcacagaguuucaguuugggaagauaaaaagaguucuaaggagaggguggugacggccgcucaacauguaaauguauuaauccuugaugccacugaacugcacacuugaaaaugguuaagaugguacauuuuauguuauguguauucugccagaguuaauuuuuuuuuuuuuuuuuuugagacagagucucgcucugucgcuaggcugcagugcaguggcacaaucucggcucacugcaaccucugacucccugguucaagcgauucuccugccucagccucccgaguagcugggauuacaggcacgugccaccacgcucagcuaauuuuuguauuuuuaguagagaugggguuucacccuguuggccagguuggucucaaucuccugaccucaugauccgcccgccucagccucccaaagugcuaggauuacagacaauuaaaauuuuaaaaaauuaaauuaaaaaauauuugaggaaccuugaccuagauaaccccccgaggaaagguacauuuggaaggagccuggguguagaagacaaagggugggcccugggcaauuaaacaggagacaggggaauauagacucccuauuuuuuuuuuuucuagagagagucuuguucuguugcucuggcuagaguggcaauggugugaccucagcucacugcagccucuaccucccagguucaagcaauucuccugccucagccuccugaguagcugggauuacaggcgcccgcuaccaugcccggcuaauuuucuuguauuuuuaguagagaugggguuucaccauguuggcgaggcuggucuugaacuccugaccucaggugaucugccugccucagccucccaaagugcugggauuacaggggugagccaccaugcccagccagacucccuaauuuuauaaacucucuuuuacgaccucugggaacccggaccuuccaaugucgugccagaacacagaaaaugggguucgcagucuuuuucuaugaugguaucauuuccaacagacauuccuguguuuuaguguuuuauucugagagcaaaacaaauacaacagcaaugccuaaucgcccucucaggugaaacugaccuuuccuccucaccucuucuccuucaguaacucuccccagcccaaagcugacuccuugguaggcaaaggcuggucagucuuccuuccuuauucacugaauaagccaugccccuuugcaggccuccagucuaauuugugauucuaacuaaugagguggggucugaggaacuugaagaggcccuuucuauuuuauuuuuuauucuugguuuccaauaguuggagaaacaggaucuggccaacuuucucuagacaaaggcuguaugcuagguuuuucauuuucuuagcugaaaugauuguggcaaaucacuuaaacagauacaaaaaggaggucucuguggacggacaccucauagacuaaaagaucagccacaguucaucauuuuagacauauauugcuagagccaaaauaaguaucaggaagguuucaaguuucucuggaaaagaaaaucuuuugguaacaauucucaaaucgaccuugaucucucaacuuccagacacuacucuaugaucaguuuguguaaccuuauuguuaaaugcacuugcauaaaugauagauuucuuuauauguuuagcacacaauuguuccucuguauuuuuucccuccauauuuaauguuuucuaagauagugcuacaaugagcuaauuaaaaaauuuuaaugaauauuauaucaaugcagggacacugacaugaacauguugcacuuugcauguuucuauaugacuccaaguugcacauuauguaccugaaagagccucugggcaucauccagaccugcuccaccaaucuguggugcucacgucuuccaagacauuuugaaauagaagucagugguggaggugaauucuucagccuccugcaggaccugcauccuucacucuggggagagguaaagccacacgcuucuugcugaugguccuacucuuggagaagguccuguccuuggagaagagcucacucuggcuggcaucucuggaguagaccacucagucuuucuccuccucagcccuagcuucaugagaucuuuuaaaacuuucuauuaauuuuuguuuuuaccacccuuaacaucuucuuaguuuuccacguuuuaguuuuaaaaaagaagagaaaaauucuaguaaagcucugaucaguaucaacugcagacacgaggcuguuuuauagcuuuuauaaguuaugaauauuguuauaacaggaggaacaaugauuuauuuagugccuauuacgaaacaggcacuuuccauauaugaauuccaacuaauauauuaauuuuugaagaaggaacauuucaugggucugagcuuauaacaguuauaagacuuauaaugcggucugagcuuauaauaguuuccaagucuuuuacuguacaccuggcuggaucauuuuccuucugccucauuuuguuuauuuuuuccuccgaggaguucaacacucucuguuuauuucugauuuauguaggucauuucaaaucuuuuuuuuuuuuuuugagauggagucucacugugucacccaggcuggagugcaguggugugauuucagcucacugcaagcuccgccucccagguucacgccguucuucugccucagccucccgaguagcugggacuacagguacaugccaccaugcccggcuaauuuuuuuguauuuuuaguagagacaggguuucaccguguuagccaggauggucucgaucuccugaccucgugauccgccugccucggccucccaaagugcugggauuacaggugugagccacugcgcucagccucaaaucuucauuuauucuuuaaggcuacaguuacuuuguacgauugaggguuaucuacaaauguagaaggauaugcucuugggaucugucuacaagccuguguaauugacccuugacuugagaguggauuuucaguggugguaaauguggauugagcaagcacagugauccugccaaauuguggccuucauggaaucuuggaaaucuucaucugcucauuauuccuagaauuuuucuaguauaggcaacagucuagcaggauguugaccuacugcuuuucaggcauuauuucaauuacuugaucuucuugagaugguuauugucucuagagaaacaauauaagagcucugggauaguagcagaaugggacagugguuaagagcuuggcuucuaggaucugaaucuuggguucaaaucuuggcuuugccacuuuaaguuaauaaacacagggacauuaguucgccucuuucuacugguaaaacaggaguauuacuggauugcuguaaggguuagagaggauaacacaugucaagugccaagaguuguaccuuguuaagguaaguguucaaaacagguuaauuauuaucagguaaaaaagcugucacauaacuauauauauauauauauaggcugggugugguggcucaugucuguaaucccagcacuuugggaggccaaggugggcggaucacuagaucaggaguucgagaccagccuggccaacauggugaaaccccaucucuacuaaaaauacaaaaauuaucugggcguuguggugcuucccuguaaucgcagcuacuuugggggggcugaggcaggagaaucguuugaacccaggaggcagaggcugcagugagcugagaucacaccacugcacuccagccugggugacagagugagacuccgucucaaaaaaaaaauauauauauauauaucccaucauggcaacucccaaucaauccccagccucucacagcaaccccuguugccuuuuucuugaacuucacauaaagcaaauuuuacaguauacacucuuaugugucuggcuucuuucauuuaacauaagcuucugugauugauccaugcuauagcgugagcaguuuguugcuauuugauuagaaguauuccauuguaugaauauaccacaacuguuuauucacgaguugauggacauugggguucaguuuugcacaguuaugaaucaaguagcuacgaauauucuugcacgaaucuuuuuaaugaauauguuuuucauuuuucuuguacuaaugccuacaaaugcaauggcuaggucaugcaauaaauguguguucauuuauaagaaacaaacaguuuucaaaaauuguuaggccauuuuacacuccuacuagcaacgcaugagaguuuaaauugcuccauacacuuaccaugauuuagugguauugguauuuuuaauuugagccauucuaguggguguauacugguaucucauuguggcuuuaauuuguauuucccuaaaauaaacguuauuagugaaaagcaccuuuucaucugcuuauuggccaauuuguguaucuucuuuugucuguucaaagcuuuuguccauuuaagaaauuuauaauuuugucauugaauugucagaauaucuuauauauucuagacacaaauuauuugucagauacacguauugcgaauauauucucccgguucgcagcuugacuuuucauuuugaugagcaguuaucuuuaaauuuugaugaaguccaauccauuagaacuuucuuucauguugugugguuuugugaccucuguaagacaucucugucuguuccuaguuguaaagauacugucuucuguuuuccucuagaaacuuuguuguuuuagcguuuauauugagaucugugcucccucucaauugugugugguaugagauucauuuuuccccugagaaguugcucuggcaucauuuguugaaaagacccggcuuuccccacuggacugcuuuggugucucugaggaaaaucaaaugaccauauccauauggauccacuucuagacuauuuuuucuauugauuuauuugucugcccuuauaucagugccacacugucuuaaauuacuuuaguuuuacaguaagucuugaagucagguacuguaaggccucuaacucuguuguucuuaaagacuguuuuggcuaccucuuuugguuuucuauaaagauuuuagaaucuguaaaaccauuuucuauaaaaauguccugcaggucuuuugaucaagauuguguugaaucuauagaucaagaugagaaaaaucgagaugucaacacuaucaaguuuuccaauucaugaacgucucuccauuuaguuagguuuuaaauuucucucaaagauguuuuguaauuuucauuauacaagucuuacacuucuuuggcuacauuuacucaguuuuuauguuuuuuaugucaguuuaaauggaauugcuuuuuaaaucucauuuuccaauuguuuauuguugauaaauggaaacacaauagauuuuugguuauugaccuuuauaaguuuacuuacugauucuaguacuuguuuaguaguaguccuuagauucuuaggacuuuguccauaaacaguaauuauuuucaaucuuuaugucuacuacuuccuuuccuugccuuauugccugaccaaaaccuccaggacaauguugaauagaggugauaaggguagauaucauugcuguauuccugaucuuaggaagaagugcuuggaaauucacuauugaauaugaauuuagcaguagguuuuucaauuuuuuuuuuuuuuucagaaggagucucacucuguuggccaggcuggacugcaguggcacgaucucagcccacugcaagcucugccucccggguucaugccauucuccugccucagccucccgaguagcugggacuacaggugcccgccaccaugcccggcuaauuuuuuguauuuuuaguagagacggguuuucaccguguuaagccaggauggucuugaucuccugaccucaugauccacccgccuuggccucccaaagugcugggauuauaggugugagccaacgcgcccggccuuuuuuuuuuuuuuuuuuuuccugauggccaucauuagaauaaauaaguuuccuucuaguccuaguuggcugggaguguuuuuuuuuucuuuuuaaaucaugaauggaugcuccauuuugccagaagcuuuuucugcaucuauuuagaugaccaugugguuuuucuuccuuauucuauucauauaguggaauacauuaagugauuuucuaaugguaaaccaaccaugcacuccugugauaaauccugcuuagucauagugaauuacauuauuuucaugcgucacugaaucagauaugcuaauauguugugaauaauuuuugcaucaguguuugugcaaacauugaugggauauuguaugauauuuuucuuuucuuaucaaguuuaugucagguuuugguaucaggguuguacugaccuuauacaauaaauuggguaguuuuccuucucccuuuauuuucugaaaguuuguauaagaguguuaguucauuuguugguguuccauugauauaaauauaucuuaaaguuuucauagaauuuaccagugaccuuuugaguauuauaaaauguccuuuuuugccucuuauacucuuugucuugaagucuaugugguagcauuaauauggucacgaaucagcuuucuuaugcuuauuauuuacauaguuuaucuuuucugucuucuggcuucaaccuacuuguguuuuauuuaaaguacguauuggccgggcacgguggcucacgccuuaaucccagcacuuugugaggccgaggaggguggaucacaaggucaggagauggagaccacggugaaaccccaucucuacuaaaaauacaaaaaauuagccgggcaugguggcgggcgccuguagucccagcuacucaggaggcugaggcaggagaauggcgugaacccgggaggcggagcuugcagugagcugagaucgcgccaaugcacuccagccugggugacagagcgagacuccguaucaaaaauaaauaaauaaacaaacaaacaaauaaauaaaguacguaucauguagaccgcaggcagucuuaauuuuguagcuggucugacaaucuuuuccuuuuaauuggaguuuuuucaguccaugcuauaguuuggauaugguuugucugucuccaucaaaucucauguuggaauuugauccccaguguggugguauugggagcuggggcccagaggguggugucugggucaugggcauggaugccucauaaacagauuaauguccucccugaaggugagugaguucucacucuugagauaauaaauuagcucuagaggagaugaaagaguuccuggaagaguagguuguuauaaagccagaccaucucuuagguuucccucuucgcaccugcccauuuccccuuugcccuucucuaucauguuuugaugcagcauagaaguccucaccagaagccaagcagaugcugaugcccugcuucccauacagccugcagaaccgcgagcuaaggaugccucuuuucuucauaaaccacccaggaucagguauucuguaauagcaacacuaaauggacuaugacaguccauuuguauuuaaugcaguuacuaauaugacuggguucagguuuacuauuuuucaauuuguuuucuauugauaccuucuguuuuucauuucuggucuuucuuucccgccaucuuuuauguuaaucuauuuuuuaguauuuuauuuuaauuccuacaaugacuucuuagcucugcugcuuuuggauauuuguuuuuagugguuucucuggguauuauaccacacaucuuuaucuuauccccagucuauuuagauuuaaugucauaucacuucacauaaaauguaaaaacuuugcaguuguguagaauuccacuugccuucccuuauuguuugugcuauuuuguuauauauuuuacaucugcauacaucacaaaucccacaaaauaauauuuugauucuuacauuaauuaaaaaaagauuuacccacauauuuauuauuuccuauaaauauuuucuucuuguagguuugagcuuccaucucauauuauuacccuguggccugacaaauuuucuuugucaauuuauuguaguguaggccuacuggaaaugaauucucucauauuuuguacaucccaacaugucuuuauuuuacugucaauucugaaggauauuuuugauuauuuagaauucuggguugggugugguggcucaugccuguaaccccagcacuuucggaggccaaggugggcggaucaugagaucaggagauugagaucauccuggccaacauggugaaauccugucucuacuaaaaauacaaaaauuagcugggcaugguggcacgcaccuguagucccagcuacucaggaagcugaggcaggacaaucgcuugaaccugggaggcagagguugcagugagcugagauagcaccacuacacuccagccuggggacagagugagacucugucucaaaaaaaaaaagaaaaaaaaaaagaauucuggcuugacaguucuuccuuuuucucuuuugucuuucagcaccuuaaagaugccuuugcacuguauuacauauuugugaugagaauucuucaguuaauuguaucuguguuccccuguguauaagauauuauuuuucucuggcugucuuaaagauuuucuuuuucuguuuaguuucccauaauguuccacgguguaguuuuauuuguguuuaucuugcuugcagcuugcugagcuucuugaaucuauaaauuaauguuuucauccaauuugggaaguuuucagcuauuauuccuucagauauuuuuucaggucuauuuugucucuccucuccuccuggcaucacaaugcauguauaucagacuacuugauauuauccuacaauucacugaggcucuguugauuguuuuuuaaucuuuauucuguuuuucacauugaacaauucuuacugauaugaguuuaaguuuacugauuauuuuuucauuucuaugcuucauuuauuucaaauguuacauuuuucaguuccagaguuuucauuugguuauucuuauugguuuccauuauccugcugagauucuccuucuuuucagucaugaugacuauguuuuccuuuacauccuuggacauauuauaguaguugcuuuauaauucuugucugaaaauucuaauaucuaggucaccucaagaucuauuacaguggcuauuuuuucucuugauuaugggucacauuuucccacucauaugucuuuuaaguuuugguuagauaaugaacacuguaaauuuuguuuuagagauuccaaacucucuucuuuuaaacaauguugauuguuuuuuguucuaucaggcaauaaaaucucuagcugauuagcuugagcuuuuggguacuuaguguuauacuuuguuaggaaggaucuguuucgguuuugcccuuaauguuacggugacuccuuuacacugaaagcacacaccccuucugggguuucaauagaaaaucugaggcauuuaccaagccccucuaacuugggugggauucagauucugaacuuuguaggcaguagcuguaggcaguaggcagcagcugaaaagagucucugcucagcauuuuuggcuuucuaguuauuguuuuccacuacgcucauuggcauauuccccacacauaugcaguuuagggguuauucaaggauugauggaaauuuauauacagaauggagggcucucuucuuuauggcucuuuucuuucugugacuuacucaauucccagccacucuggcagcccuaaacucuauccccugacaccucaagccauuacagcuguggcuuucuccuugaguucuaauuguucuuuguggacuggggcaugccuucaugggagaagcuauauaaacauaguucucacucuuucaaggaucaaaugacccucuuucaaggaucaaauuuccuacauucucugccuucuuuuaguuagacuaugaauaguuuuuuuaacaaaaguauuuuguccagaguuuguaacagcuaucugcaggagaguuagucuaagauagguucuuccaucauuaauauaacuggaagucugucacagacauuuuaauuugugcuuuugugugugcacgcauguuaagauuaaaucgcuccuuucauugcccugaaugcucauaggaucacuaaauaauauauauugaaggauuacucggguguuguccagacugugucauacugccaagcauugaccaucugaaaccaaucaugaucgaucucccguuuuuaaaggaggccaugaagaaagaugcuuccuuaggaaauaagcucuucuguuuggagacucccaaccuuguauuacaauuuaaguccauauaauggcuuuaaugacucagggucauagaguuauacagacagagggauguauaggccuuacugaagccacacugguuccaccacaccaugaauaugagagaggcaucuuucccagugccccaugcuugcuagcccuguuuucuucgcucugcuccacuccugcagcugccauggagccuauuauguuucauguuuuacuuaggcugucuccccuuuucccauuuucagaaaucuguguaccccugguucuguuuaccugacuucugaaucacucugauuacucugccccuuaauguuacaggccaaacuacuucuucccaaaauuuauauguugaaauccuaacuuccagugccucagaaugugacuuuauuuagugacagggucuuuacagagguaaucaaguuaaaaugacgucauuagggugggcccuaauccaauaugacugcugacuauauaaacagacacagagauagacaugcacagagagacgaugacgugaggacacguugggaggagacggucaccuacaagcgaaggagagaggccggggauaacuccucucuuuacaucucccagaagcaaccaacccugcugacacccugacugggacuuccagccuccagaaccaugagaaaauaaauuucuguuacuuucgccaccuacuugcugguacuuugcucuggcagcccuaccagaucaguaugcuugccacuuaacaaauccucugcucccaauuuuccuacuugauugugacucauggcuuuaguuugucucuugagacccacacccccucuugguauggaaaaugggcaaaaaucagaagguuuaugcucuaacuccucacuucaguggaaugaccuuucuuuuuuuuuuuuuuuuuuugagacacagucucaugcuguugcccaggcuggagugcaguggugcaaucuuggcucacugcaaccuucgccuccuagguucaagcaauucuccugccucagccuccccaguagcugggauuacaggcgcaugccaccacacucagcuaauuuuuguguuuuuaguagaggugggguuucgccauguuggccaggcugguuucaaacuucugacuucaggugauccacccaccugggccucccaaagugcugggauuacaagugugagacaccgcaccuggccuggagugaccuuucugauccucagauuccuuauccauaauauggggauauuguuucuauccuaccuaccuaaaaaagcucagauagaugcugcacauaagaauguaaaauacuacacaaaucaaaggcauccugaaucucacucuuuauccguaauguacuguaccucauacccaauuauaacagaaccucuguuagaggucucuugagcgguuucaaguucagaauucuccauucauaggagagaugcuugcaaccuguuauuucuaguuuaagaggcaggugccuaagaaaccguuuugcucaaagaggcaggaauauggggugaugcuucaagcucccauuguuuuuauauuuccagaggguuuaaaaguaauuccucagacaacuuaccuauuuuuuuucuuuuuuuuuucugagauagaaucucccucugucacccaggcuggagugcaguggugcgaucucugcucacugcaaccuccgccucccggguucaagugauucuccugacucagccaccugaguagcugagauuacaggcacgcgccaccaugcccagcuaauuuuuuuuuguauuuuugguagagaugggguuucagcaugauggucaggcuaguuucgaacuccugaccucgugauccgccccccuuggccucccaaagugcugggauuacaggugugagccaccgugccuggccaacuuaccuauuuucauagauguuauaagaaauaagguacagaguaaagcaaaccagugcuuuuaggcaauaaacuuuuuauuuuuuuauuuauuauuuuugagacagucuuacuuugucacccaggcuggagcacaguggcaugauccuggguuuaagcuauucuugugccucagccucccguguagcugggauuacaggugucugccaccacacccagcuaauuuuuguauuuuuaguagagacgagguuuugccauuuuggccaggcuggucucaaauuccuggucucaagugaucugccugccucggccucccaaaguguugggauuacaagcgugagccacugagccuggcugggaacggacauuuuagaaauacguaagggaaggagaacuuuagaagcacauccaacugccuuaaccaaaugggugccuacugaaugugauuuuuaacuauguaaaauuaaauguaggaugcuagucacuuuccaacauacuuuguauauucuuugucagucuuuaaaauaauuucauuauugagaauuugaaaaaauuguuucuacaauuaaaacuuuuauaaaauaauuuauuaaaaaauacaacuucccccaaauagcuuacauucugguugcaugaauuuuuaugcaguuucuacuguuacucaaaagaacugaauuuucaaugauucuacccuuuucaguucucuagaaugccuccagauggcauuaaaagccuuucccauuauauuuuacaacacaaaaaaauuaaaaauuaguaacauuuuaaccauuuaagaccagucacauucauuauaacaucugaaagcaggacaauggaacuauuuaaacuuuuagggaaguaucuuaagaaagacaaacauauaaucauaucucuuaugaaauacacagcucuccuauucaagccaaaggaucuuucuagacaaagaaacagauuuuggacaaaauaagacacucaguauuuuaccacaaacugauuuccaaucaacagcacuuaaaaaaugcuguuuuuuaaaauccugauccccauacagauaaauucacaaagccuaucuuauaauaagaaaacacaugccacugcucauaagugauaaaaauaaagauuuuuaaggagcaaaccuguuauugacucuuauggaacuaaaauaaagucacuuguuagcucaugaauuuuuuaauuuaaauguugguauaucaauuuggcaucaaauuaaucaguaaaaauauauuuggauuccuugaauauugagaagaaacagacaaaacauagagugaggagcacauguuuuauaagggccuuuucuuauguuuuuaaaacugcuuuuguuaauucaaaaaagaaacucuugagauuccagagauaucgauaauugugcuuuucacauaauuccaaggugagguugcagauggcaagcuucugaaaugaccuuguuacugcacagcugugugggacagcauaccucccaguuuaagugugaaaaguucugcaauucuuaagaugaugcugaaagucuccaaccaaauccccccagcauacaugcucaaaucucauuacauuucuacuucauaaagagaagcauuugcauuuuucaagauuccucuuacucugcuaaagcauaaaaaaugcaucugcacccaaagcauuuagaaagacauuaucaugagaaaagagaaccaugggcuuccuuccaucaucauuauuacuauuacaagauacuugcacuaucucauuuuaugaggcauauuuaagaacaggcaucucugauagaaaaugaaagaaacuuacgauguauucgaugugccacugucuggacucucuggcucugcaucaccuuucucuuaaaaaggaagcagaaaaaaauaccgacauaugagucuuacagucuuuaagauuuaagagagauuaaauauauuuccaugcuccuauuaacaaucuuucaaaauguguagcaggaggcuuuuaaaacaucuuuuauugucugagaaccggauuugcaaaauaauuucuuuucugcaaugcaacugcccaggcacaaaucugugaguagguacugaggagcuauuugcaaacaaccagaggcuuggaguggagacuuugccagaagaugaauaucuuacagauggaaccuguuuccuuccacuucacuuuacagaaaauuucaggaaauaaauccauuggcauucuauauccaaggcacuuugaacuuugauugcuucugcuaacauaagccaaaccaggucaggcugaaucagaacuuggaggaaagaauuuuuuuuuuuuuuuuuuuugaggcagagucucacucugucacccaggcuggagugcaguggcacaaucucggcucacugcaaccuccaccucccggguucaagcaauucuccagucucagccucccgaguagcugggacuacaggugccugccaccacaccuggcugauuuuuauauuuuuuguagagacaggguuucaccauguuggccaggcuggucucgaacuccugaccucaagugaucugcccgccucggccucucaaaguguuggaauuacaggcgugaaccaccacguccggccaggaggagagaauuuuuacugaacacugagguugcacuguaggucccaagaucccccuauuuuauaccccauagagagcccugguggcagguuuuggggccccuagcuuaaagcagaaugagauguaaaccagaaauccuuucugaccaucugaaaggcuaguuaaggaaaugcuucugugggcugugaucacugaggaauuaacgaguuguacguaguugggggagcuuggaaccaguucacuucuuguaguuuacaguaggcuuaauguaauuccuaauccuuaaucaauuggugguuugaaccaugcauccucauucuguaaggaguuucuuuguauuuccuugaggcuuggagauggaagaagucacugauaacugagagcgugggcucguguguuuccugaugguugugcagagccaauacaccccagagaaggcugugaguugcaagaaauaggacugugguaguaacuugguuugcuaugcucuuucaagucaggccuggagaucucuagaaucccuuggucuacugcucacguccuugggcccacacauuguaccauaccccuuuugucagcugucaacauuagcuugucgucaccuagucccaggaaugacucccuaaauuacauaaugaacauaucccaaagguauugcccaaacugaacucaaaagcaaacuuuauauguccuucucuuuuucuuauaggaauaaacaguugugagaaaaagaagacacaguuucuacaguucguacaucuaucucagacauuuauccagugccagaacagcuaugagggacuuuggcuaaaagcuggucagaugagggggaaaaacaaaaaagccacaaaaucuauuuuaacugccuugauaacaaacauugauuaggcagggccucaauacauauaaaaccauguuggaauaaaggcuaaaguagcaaauuaauaaauuugcuuuaaagcucauucuuguauauuuucuuuugucuuccaggcaaggucuguggugcacucauuuaggaggcaaauaaggccuguucaacugguuucagugcuggaaaauaauuuaguacuuugcagaaacauuuuuuccauggacuaaccacaaucccucuuguaauccuaaaauagagaguuauaacaccugcauuauauaagacaaaacuaaauggaaguauauuuuuuuucucaaauauauggauccuuucccccaaccugcuuuaauuuggugaaacugguuacuuuccccagucucuagccugcaguaguuaccacauuccaucuuaaugaagaauguaaaacagcaggcuuggaagcagcaggcaaugguaaaauucccaaacaauuuaugucagaaaacaggaaauugaaaauaaaaacgaaggcauuguuuggauguuugaagaaauauguuuugccuugaccaaucaugcugcccaagucuucagcauggggacagaugcgcagcugauuaucuuugcucuuagcagcacuuauguuguggcaacagggcaaacagaauagguucuggcaaauaggaaggauauaguggggccaaacaggacauggugaacagucugagagggaguguucucagcaaauucagugcugauaaugaauuugccuuucuggggggaaaaguaagcuggucaggaacgagaugggauuaaaacuauuuuuguccuucagaaagaauaaaacacaaagcuucccccacaucuugaaauuuuaggugaugaaauuucugaaguuaacuugaaauguuuaaguguauacaccacugagaauuauggucucuuuauuaggacccaagggaaaaugaugaauguaauggaacauucuagaacauuaguacaaauuuuuuuuuuuuuaguugggugugcaggagauguuucccaccccgcccccugcccgccccaccauccaaagacagcugucuccaggguccuccuguuugugucagcuguuuucaugauggauauuucaugauggaccaauguuucacacuggucucuuugggagggaaucugcauuggucauuaauaagcugggugcagggaagccauuuuacaugcggaaauacaauuacagagaggaagaggggaaaaaaugagccacggaaagaacuauauaugcaaauauauaugcauauauguaaauauauguaaaaucuauguaucuauguguauuauacacuuucaauuugacaguccauauuugucuggcugggccuuccacauugccuaacauacacuaggugcucaguaugugucuucuguucugaugcccugucacuaauacagaauuccaugcugcagugggaaaagaugcuuaagguacccucgccagugagacgaaauauacaguuugagauaugaaacagcuugcugacuccaauaggucacuuaaaaaauuauaacaguuaccuuuuuaacgcaauguacagaggacuucuauguugggugcucuugugagcauaaagauaaauaauguggaauucaugcucuuuaaacauuuaaauggacugcacugcuggaguaucuuacuuuccaucaauagugucauauagggacuaaauauguuuuuugaaaagaaaaucaaaauaauccugcauuaaacugaauucugcacagggaaguuuugcuauacugcaacuuuuuuuuuuuuuuuuugagauggggucucacucuguugcccaggcuggagugcaguggugcacucucuucacugcaaccucugccuccuggguucaaagcgauucuccugccucagccucccgaguagcugggacuacaggugccugccaccaugcccggcuaauguuuuuauuuuuaguagagacgagguuucaccauauuggccaggcuggucuccaacuccugaccuugugaucugccugacuuagccucccaaagugcugagauuacaggugugagccaccgugcucggccauauacugccacauuucuacacaguuauaucaaaagcaauccauguuuaugguuuuaaaaaaaugaacagaaaagaaaagguaaugacuuugcuuacuuuuauuuuaaauucuguuagcccuucaaugauuagucuaagugauguguuuuucuuugcuugagauggagucccagucuguugcccagacuggagugcaguggugcaaucuuggcuuacugcaaucucugccucccggguaaucucaagugauucuccugccucagccuccugagcagcugggauuacagcugcaugccaaaacaccuggcuaauuuuuauauuuuuaguagagaugggguuucaccauguuggccaggcugcucucgaaauccuggccucaaguaaucugcccuccuuggcuucccaaagugcugggauuacagguguaagcuaccgugcccagccaaugcguuuuuauuucuagauguaccaacuuuagacagugccuaaugauuucugauaugaaagacaagaggcaagguauuuaauagucuccccucccuuauaauuuuuauuaguucuguuauuauuuuuagugccucuagugggcauuuguaacuuuaaauauauuuaaucuuauuucucuugauuaaucaccuucugacaguaucuuuucuuucauaccauguaaaaugaggaaacucacccaucuauccuucccucccaccuccccgcucacagcuaugucuuuccuuuuauaucaccaagauuuaaaauauucauacucuguucaguaauuauugagucauccuccuuaauacuaauuuaguuaauaauuuaauuuuuggucuugccuauaggucaaguaaaaaaucauaaaccaauaaugagaauuugcaauauugugacaauauaaauauuagucacuaaagaagaaagcagcuugaguagaccugaacaggaggcaaugucacuaagguagaaugagugcaaauguucccgacauuuaugucaaaugaauucucauuguuauguucuaccacgucacagguuugucucaagcuaagguuauguucucccuaaaauacuguuaaauagagcacgcauuuagugaacauaaaauguauauuuacaugaaauguauauagacacuuucaaagcauuaaaaugaaugaacugugaaaacaccuuccaggccagggauggaacaucaucgaaagugccuucacuggcucccaucucuucccacccuucccaccagcuauugguaaaagaauuguggcugggcacaguggcucacgccuguaaucccagcacuuugggaggcugaggcaggcagaucacgaggucaggagauugagaccauccuggcuaacauggugaaaccccgucucuacuaaaaauacaaaaaaauuagccaggcgugguggugggcgccuguaguccuagcuacucgggaggcugaggcaggagaauggcaugaaccuggagcuugcagugagccgagauugugccacugcacuccagccugggcaacagagcgagacucugucucaaaaaaaaaaaaaaaaagaauuguguguuaaucauucucuuuguuuucuggagaguuuuuuuuuucuuuuuaaccgccuauguauguauuaauaaauuaacucuguuuugguaguuguuguuucuaaacuucauacgacucuaaucauaccuaggcauucuucugagacucacuucuaucaugcaguguuaugaauuuuagauuuagccaucauccugcauguagcuacaguuuguucauccucacugcugugcaauacuuuauuguauaaauauaccaguuucuuauuuguucuucuccugauggacauuuagauuuuugccaucaugaacaauagaacugcaaacauucaugaacacccuuccucaugcacauguuaggaguucugggccuuaagacuuccauauggccaacuuuagcagggaauccaaaacugauuuccaaauuaacacuccccagacaguauaugagacuucaaacugauucacauccauaccaacacuuguuaugaucaagguuuuaaaguuuuuucuaauuuaauaauguagaauauaauuuuguuguggugucugcauuucucugagcacuaaugagguaaauauuuuguacuugcucuucugugucauuucuuaaaaauuauuuuuuaguauuaauuucuuauucauagaaacauuuuauugucucaauaagagucauacauauagucgugugugugugcguguauaacuuuucaauacauauauaaaacuuggccgggcgcgguaguucaugccuguaauccuagcacuuugggaggccgaggcaggcggaucaugaggucaggagauugagaccauccuggcuaacacagugaaacccuguuucuacuaaaaauauaaaaaauuagccgggugugguggcgggcgccuuguagucccagcuacuagaaaggcugaggcaggagaauugcuugaaccugggagguggagguugcagugagccaagaucgcgccacugcacuccagccugggcgacagagcgagacuccguccaaaaaaaaaaaaaaccaaaacaacaacaacaacaacaacaaaacuuuucccaguguuagccuuuuuauuuuuucuauuaucuuuggauaauguuaaguucuuaauuuuaauguacucaaauuuauagauaauuuucuuuauuugacacuuuuugugauuuaagaaaaacaucagaaaaauguuuuauacugucuucuaaaaguauauacuuuuacugauuuuuaaaaaauaccuggauugguuuuuguauauggcgugggguaggaguuaaguuucguuuuucucccuagaaauaaccaguuauuaugguacuugaaguccauucuuucucuauuaaucuauaucaucaucucugccaugaguccaguuuucauacgccuguggaucugcuucugggucucuacucacucacuuucauugcucaauuugucuauuacugcccucauuacuuagcuuuaauauauauuuaaaaauauucguaaggcaaagcuccaaccuugcuauuuaggaacaucuuggcuauucuuagcccuuugaucuauuguauaaauuugaguaucaucaguuugucaauuuccacauacccaaaaguuggaaauuugauuggagcuguauuaaaucuauagauaucugaagagaacuuguaucuuuacaacacugcaucuuccaauucauguacuugguauuaggcgucuccauuuauuuugauauuucuuaacguauuucaauaguuuguuaauuuucuccauagaggucuuaacacaucucuugacaggguuauugcuuaguaacuuauauuuuuauacuaauauuaaaaguuuuaaacuauaauuuucaguuguuaguguagggaaaugaaauuaauuguguauacagcaaucuugcuaaauuuucuuauuaauccuaauaaucuguagauucuuuugaguuuucugcauaaacaauauaauuugagaaaaugaauguucuucuccuuucuaacagguacuuuuuuuucuuaauuuauugccucgaccaaggauguccauccaguauaauguugcauaaaaguggaacucaugucuuguuccucaucuugaggggaacgcugcaaauguuucaacacuaaauaggauucuuguuuugaguuuuuuuggcagauacuguuauuguguuaaugaagugggcuucuauuccugauuugcuauuuuuccuuuaaaucauguauagugaauuuuaucaaaugcuuuuucuuaauuuauugaaacaauccuauuuuucuuuuaauauuuuaauauaauuaaucauguuaauauuauaaaaaggauccaauuuugaauuccuaaaauaaguacaguuucuuaauuaugaguuauauuuuaaaauauauuuuguacuuggcuggauggaauuuacaaauauuugaccuagaauuuuuacauuuaugaucaugaaugauaccugugaauucuuuuucuuguacuggcuugucaaguuuugauaucaagguuauacugccuugauauaaugaguugagaacugcuggcuuuuucuaauucucugaagaaggguguagguuuggaauuaccucuuccugugaguuugguagaauucuuaguaaaaaugucuagccuugaaauugugugguggaaugauuuuuaaaaaauuacugggccaauuguuaaaacggcuauaggauuauucagguuauauuuauauguaaauuucauauaaaacauauacauauauacauguaauaccugaaaaaucauuuuaaucauagucauuucgucuaguuuugaaaaaauuuugguauaauuuugcacauaacauauuuuuguucuugaucugcaucacaguuuauucccuuuuugauuccuaauauuauuuauuugugccuuuucucuuuuuguccugaucaaucucucugcaaaguuugucaacuguauuauaacuucauugaauaaacuuuuggcuccauugacauuuaaaauuuuaucucugcuauuuuauuaauuucugcuuuuguuuuuuuuuuguaaaucucuuuuccauuuguuuuggguuuauuuucucuucuuucagcucuuaagauagaugcuuaguucauuaauuuuuuguuugcuaguaugagucauuuccuuauuuauuuagagacggagucucacucugucauccaggcuggagugcagaggugagaucucggcucacagcaaccuccgccucccaggcucaagcgauucuccugccucagucucccgaguagcugggacuacaggcgccugccaccacacccagcuaaauuuuguauuuuuaguagagaugggguuucaccacguuggccagacuggucucgaauuccugaccucaauggauccgcccaccucagccuccuaaagcacugggauuacaggcgugagccacugcacccagcuucuaguaugaguauuucagaugcaaagcugcaacuuucccucuaauuuaguuucuuccuccaguuuuaauauuagguauuucuauuaccuuucagucccaaauauuuacuaauaucuagagugauucuuaauuucuaaacauguguuuucccuccuagucauauuuucauuaucaauuucuaauuuaaucauacugugguuggagaccaugguaaauauaauauuuaucuuuuaaaaucuguugaaacuugcuuuaugguccaguaguugucaauuuucauaacuguucccugucugcuugaaaauaaugcauauucugcagcuguuggguaauguacucuugcucauuguguuguuuaaaucuuauguauccuuacuaauuuuucuguuugcauuauacaacaguuacgaauuucuguuuacaucuuccauuaagauaauacauuuccccuuguaauuugugacuuuuacuuuuaaaaauuugaagcuuugcuauuuggaauuuacauauaucaaauuauuuuguccauaugguaaguuguaucuuuccuuggguagugacccuuuuuaacuguaguaaugcuuuuugcuuaaaguuuauuuuucugguaucagaauaaacauaucaugcuuuuuuaucaccaguauuuggcuggcauauauuuuccuaaccuuuuuccuuucaaauuuucugaaucuuuaauuucuaaaugugucauuguaaauagcacagagcuagaguuuuauuuuuuaaaucaauuuggucaauauuuguuauugaaucauugcaucuaauccauuuguuuaaauuacugauuuuuuuuuuuuuuuuuuugagacggagucucacucuguugcccaggcuggagugcaguggcacaaucuuggcucacugcaaccuccaccucccagguucaagcgauucuccugccucagccuccugaguagcuaggacuacaggcauacgccaccacgcccggcuaauuuuuguauuuuuaguagagaugggguuucaccauguuggccaggcuugucucgaacuccuggccucaagugaucugcccaccucggucucccaaacugcugggauuacaggcgugagccaccacgcccggccuuuaaauuacugauuuaauuuaugcuaccauauuuuuccauauacucuguuucauuuucucuucuucaauucuuuuggauuaacuaauaauauucauauucuauuuuuagcuugguuuguaagauguucuccacauuuaguuuguagguuaaauaccuuuuaguauaguuuaguggguacccuacaaauugcaaauauuuacuuaauuuaucaaagcccaaaguuaaaauuuuuauccuucuccaaaauaauuacaggaacuuagaagauuuuaauuccacauucucaucuuauuuuaugcuauuguuuuguggauuccaauuguauuuauuuugauuacuuaacaauauauuauuacuggugcaugcaaucaacauuguuuaaauuuuccccauauuuacuuucacugcauuuaaucuuucucgcaccucacauuccuucugaacaaaguaugucuuuuaaaauuucuuuugugaggauuuacugguggcauacuuucccagcuuuugucugaaaaugucuugacucauuaaauuuuuuuuuugcaagauacacaauccuaagcugauaguuauuuuuucccaacucagugaugcuucagcuucucuguuugcaggcucccacugaugcuguugugaagucagguguaaguugguugaguuguugaagauauuaaaggguauuuuaauuuuuaugugcacuuuagcuauaauguguguaguguggacuuuuuuuuuuuucauuuauccuugguauucacuggguuucuugacucuguggauuaaugucuuucaagucuggaaaauucucagccaucaaucaucuucaguacugucucgcuucccuuucccuuucugaaauucuaguuagaugcauguuagacuuccccacuuuaucuccaugucucuuaacuaauuuccuguuuuccauuucugucucucuaggcugcauucuagauaauuucuuaaauucaacuuuccaauucauuaauucuuucucagcuaugucuaaugugcuguuacaucugcccauggaaauucuaauuccuauuauauuauuuuauuccuagaauucuguuuaacacuccuccaaguuuucuugcucuuuaccacauuuccaauccucucuuuuauuuccagaaauuaaagcaagggcucuaauuucacauucuaggcuugauaaccccaguuucugaauuaggagucugauucuccgcuguccuguuuguucuugcucuugcucguggucucguuuccuuuuuuguaagggguucuuuucugauuguaaguugcucauuucccuuagugcucuauuucuguuauuauucauuccucuccauuuucuuuuucugccaccuugacuggcuguguaucuucaaucccuuucauauuuuccaucuguguuuugcuuuauacucagaaaaaaaaaguuuucaacuuuauauucaacguuucagacuucagcuauuaucaucccuucuauuguuugucaaucauauuuuuaauucucaaguguucauuuguucuguaauuaccucuuuuucauaccaaucuguucucuuuuuauuuaacacaaauaauuucaaaucuuucuaaggacugcaauuauacuugaaacuuuuuucuucuuuaccuugaauuagauuuccuagauuuccuuugggacuagucuuucuuuuuggcgucacugguuauauauucauauuuuuaaauaaaaaauugguuaacaaagguaguuggcguggcuuuccuguaucaguauuccgaucaauuuuucuaacacaccuauccuuuguagggaagagcugauuuauggcucuuuguaagugggcaggguaugcugaugugaaggauucauuuagggcucaagagaagagaagccuccaggcaagcuguaagcccaagcccuuccuccacccacuccucuaagaaaaauauaaagcacuguacuuuagguguauagaauuuuuguuuauuucccuugagaaauaguugacucuucugccauuacuccaugucaucuauuuuuaaggucugguacuaucuuagaauguauucuguuucucucuuugguauuaguucucagugaggagugaacuguucaauuuuuuuuuuuuuuagcaaauauuaugguacuuuuuguuuuuggggguuuuugagaaaaaaucauccugaaagcucugugugggaauccgugaggauggggguggagggguaaugguugaaggauggccagguguucccaucacugcaagcaauucgcacuuguucucucuugggguccaguggaaauguggucuuuccuggggcuccugggggcuguucccaccaccacuaaaacuuguuccugucugauucuuccuuugcugugucacgaccuucccuguucagggguauuuuucaguaggguuuuauuacuuucggcuuuccagaacacaacuaaauuucugguuugcugauggcacuuauucugauggugcuauuuuggauuuauuuccauuucuacagcuucauggcuauuagguggggauucugaaggaaggggaaggauugcuuaaaugcagucacucaacugaacaggacguucucauaauuuuuaaaaauguagacauaaaucauccauguuaauauucaaguaucucaaugcuuaauaagcuuccauuuuauaauaucaaguucaauugaucaguaauucagcaaacgaucuaccuuuuaaaagauuuguauugaaagucauuuucuguuuauacaaucuuuccuuuaguaucuauaauacagucuuucucacuucaaagagaauagaagcacuggccuaaaauaaugaguuaguaaucaauccacacagauauuuuguuuuugguuucucugaagcucaguauuucucuauuucuuuuuuuuaauuuuuauuuuauuauuauuauacuuuaaguuuuaggguacaugugcacaaugugcagguuaguuacauauguauacaugugccaugcuggugugcugcacccauuaacucaucauuuaacauuagguauaucuccuaaagcuaucccuccccccuccccccaccccacaacaguccccagaguguaauguuccccuuccuguguccauguguucucauuguucaauucccaucuaugagugagaauaugcgguguuugguuuuuuguucuugcgauaguuuacugagaaugaugaguuccaauuucaucuaugucccuacaaaggacgugaacucaucauuuuuuauggcugcauaguauuccaugguguauaugugccacauuuucuuaauccagucugucauuguuggacauuuggguugguuccaagucuuugcuauugugaauagugccgcaauaaacauacgugugcaugugucuuuauagcagcaugauuuauaguccuuuggguauauacccaguaaugggauggcugcgucaaaugguauuucuaguucuagaucccugaggaaucgccacaccgacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuuugcucacuuuuugaugggguuguuuguuuuuuuucuuguaaauuuguuugaguucauuguagguucuggauauuagcccuuugucagaugaguagguugugaaaauuuucucccauuuuguagguugccuguucacucugaugguaguuucuuuugcugugcagaagcucuuuaguuuaauuagaugccauuugucaauuuuggcuuuuguugccauuuugacaugaaguccuugccaaugccuauguccugaauaguaaugccuagguuuucuucuaggguuuuuaugguuuuaggucuaacguuuaagucuuuaauccaucuugaauuaauuuuuguauaagguguaaggaaggcauccaguuucagcuuucuacauaugguuagccaguuuucccagcaccauuuauuaaauagggaauccuuuccccauugcuuguuuuucucagguuugucaaagaucagauaguuguagacaugcggcguuauuucuggaagcauucccuuugaaaacuggcacaagacagggaugcccucucucaucacuccuauucaacauaguguuggaaguucuggccagggcaauuaggcaggagaaggaaacaaaggguauucaauuaggaaaagaggaagucaaauugucucuguuugcagaugacaugauuguauaucuagaaaaccccauugucucagcccaaaaucuccuuaagcugagaggcaacuucagcaaagucucaggauacaaaaucaacguacaaaaaucacaagcauucuuauacaccaacaacagacaaacagagagccaaaucaugagugaacucccauucacaauugcuugaaagagaauaaaauaccuaggaauccaacuuacaagggacgugaaggaccucuucaaggagaacuacaagccacugcucaaugaaauaaaagaagauacaaacaaacggaagaacauuccaugcucauggguaggaagaaucaauaucaugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuguaggcaucacacuaccugacuucaaacuauacuacaaggcuacaguaaccaaaacagcaugguacugguaccaaaacagaguauuucuccauuucuuacauguuuacuggaaucaugauuccuaaccauauacaaaaacagcaagggaaaugcugguggggucaguucuccuaaaguuucaaaugugcuguaaauugcagagaauucucagacuuaauaggaauauuauuuuuguauacaugugcugggguuuuggagaaagauuuauuuaaaaaugaaaaaaggccaggugugguggcucacaccuauaaucucagcacuuuuggaggccaaggcaagaggaccgcuugaggccaggaguucaagaccagccugugcaacauagugaaaugcugucuauaagaaaaauuuuaaaaagugguaugugccuguaguccuggcuacuugggaagcuaaugugggaggauugcuugagcccaggaauucaagguuauagugagcuauaauugugucacuguacucuagccugggcaacagagcaagaccuugucucaagaaaaugaaauuaaaaaaaaaauccccuuacuccuagaaaagaaaaagccaaucaaaaaccuuucuuggacaaugaaaugccagaggguuuuauaccacacagggauagugccacaucaugucuuguagaagaagcauccguuuuuauagaaucuaaauugcagugaauauuauagcaugccauaaaaauaugccgggugcacacagaaaucacagcagacaguccuuggacaauaauucaaucucacggugaagugauagcagcagcuuucugggaaucaacagagugggaugaaaagcucgugucuuuggggcagagagcccugaauucaaauucuagcugucauuuuuuuagccaggugauuaaaaaaugacucguuauuagccucagaaacucaucuucuucaugugaacacugagaucaugcagcucaugcagcuauuguaaagauuaagugaaauacuguaagucaggacgcuagcgcagaauagacacucaacaagaauuuccuuugcucuucugucugucaaaaaugccaagcuggcagaaggugcauuuauucaucugugggauucccccuuuacccugaacauuuaaauucaauggugagacacagggaggaaagcaaggguaacucuucaagacacucuagucuguggugugcgaugcugacgucuguauaccacgacguggacuuaaccaaguguuucuucugaucucuuuucuuaggacuaaauucaucauuuucuucagauuucaugucuuuugucauuuugccucaucgcuggugccuguacccacagcaaaucccaacagagggugggauaauuaagugauauugccuccgcaccacugugccaucacccccuccaccggccuuucucuagcugcgcaugaaaauucugcugcuucccagugcauuugccaggacaucuuuucucuccggcccauuugccucacagaugcccagugguugagccucaguuccacagacagaucuacagcucagaggauguucagucuucaaaugcagcuuuguaauuggcaaggggugcucuuagcuugcuggcuggucgugaaacuaacaaagcccagucuuugugagugugcuuuuaggacacgagcaggguagcuuaugaauuuuuaaugcucaagccaacguuaauaccaauuaguagugccaaagaagagaauuaaaacacuacuucauggaaugauagcauccucucuuugacaaaaaagcccauguguuuuaauagccaccaauucaauaaggaaacugcuucuuagauaguugagucugucuauuucuggaagagggcacaguacauauacccagccgguugugacuuuucuucauggauucuaaggucaauuaucuuaaggucuacugauugauuuucuuugcccacucauuuuccuuuaauuuagacaaccaauuaugugccuuuuaaguuuuuuucucccuccacauauacuaggaacagccauaauaaagcaugaaguuccuuucucuugggauggcuuugaaauucaccauuuucuguuuuggccuuccuuuccuugaauaugcacacuuaaggucaucauaaaucuuauucauuugggcagcacuugaacaaauggccccuuuccccaguuuuuuagugaauuucuuugaaaccuacuguccaaugugugcucauccucccuccccuucugcccucugcccccacccccugcuccccagaugaaacuccagagcgaagucuuucuuacuuggauuauuguguccagaggauacaagcugagaguccugaaagaacaagaaauaucaauuaauuuucuuauuuugacuuucaaaauccaaguuaaacaugagaucauguuuaaaacuggucauucagaaccgauucauugcucucaaucucuaucagcuacuuuaaugagaaacauauacaugaagguggacacauacauguuaagcaguucugggaauauacuucacaaucauuuuucuuuuguauuaaugacuuucuguuuuguuuauugaggugaaguucacauaacauuaaaauuaaccauuuuaaagugaacaauucaguggcauuugguacuuucauaagguugugcaaccacuaccucuaucuaguuacaaaauauuuccaucacucugaagucaaaucccuuacccauuaagcagggucucccauaccccugcccucccaaugccccagccccucacaaccaccaauuuccaucugucucuuggauuuaucuauucuggauauuucauauaaauggaaucauacaauaugugaccuuugugacuggcuuuuuacuuaacauaauguuuuugagguucauccacucuguagcauguaucgguucuucauucuuuuuauggcugaauaauauugcgucacauggauauacaacaauguguuuauccauucaucuguuaauggguauuugggcuguuucuaccuuuuggauauuguaaauaauacugccacgaauaugcagguauguacacuaguucgaguccauguuuucaauccuuuuguguauauacuuaggagcagaauuucuggguuauauaacucuauguuaaacuuuuuaaggaacugccaaacgauuuuccacagcagugaaaccauuuugcaauccaacaauguuugaggguuccaauuuaucuacacccuugucaaugcuuguuauuuuccauuaaaaaaugauagcuauccuuguguguaugaagugguaucucacugcaguuuugauuuguauuucccuaauaacuaaugauguugagcaucuuuucauguguuuguuggccauuuguacaucuuuggagaaauaucuauucaaguccuuugccauuuuuuaauugguuugucuuuuuguuguugaguugaaugaguucuugauauaguuuggauacuagacuguuaccacauuuaugauuugcaguauuuccucccauccugucaauugucuuuucauuuuaucaguaauguucuuugaugcacaaaaguucuaaauuuucuaaauuuaaaguucuaaaaauuuuuaauaaaguuuaguuuaccuaauuuuucuuuuguugcucaugcuuuuggugucaucgcuaagaauccauugccaaauccaaggucaugaagauuuaaaccuauguuuuccucccugauacuuaugguuuggguucuuauacucaugccacugaccuauuaucauauugacuuuuaaucuaacuuuucuuugaaugaaccuuuacugccacccauuuccuguagauggguuuggcaaucaucccaccaguaacacucuauuaaacaacuguugucaaucucacgaugguggauaaaaagauuaguaugguaucuacuuaucugcaauggaauaaagccaguacuacacaguauuuuaaguuuaguuauugcucagguaaauagagauugaauuugauuuuacuugcauuaaaacaaaauguuaaaaucuguuuugaggauuuacauccucuuucuuugcaaaauucucauuuaauagaaaguaaaccacauaccauauguucuuauaagugggaguuaagcuauggguaugcaaaggcacauagagugauaugaugaacuauggagacucagaagugggaggauaggagugggacaugagauaaaaaaacuacauacuggguacaauguacacuacucaggugauggguacacuaaacucucagacuucaccacuauauaauuuauccauguaaccaaaaaccacuuguaccccaaaagcuauuaaaauaaaaaaaauuuaaauaugaaagacuuacacaagaaugcgugaauaggaauguaaaaaaaaaaaaagguagcaggacauaaaauccagcaaaacuccuuuaaaauuuuggcacauggaacaaaaauccauugaaauugaaugaacuucuauuacguggcuuaauguauuuuaccagaauuuuguuccacgaguauagcuguuaugggguaaagggugucauuugaugugacuuguguuauauucaaauccaaguacuaaugucugcuuuaaaaagaaauucuacugaaacaguauaaaaugagccagucggugggcagagguuggguaggaaaauugagacgggaagggauucccacucuauuaaacagccugagucauaugcagaugccuaauaaaccucuuucaauuaugguaauaaugagcuauucaacugaagaaaaagaacaagcucaacucucacccugagauucaguuuuuggaaaugauuauaugaagaugaaauaucguuccugaaauggacuaaaauaucaucuguaagaaugauuuuggccuauuuuggauagaugcugucacuaagaagacauccacaauuaaaucccccauguagauugguacguuuuccuucucuucaagggaauucaagaguuuauaucuggacauaaguuaguuuuaacuuuggcacgugaaaauacuuugagucccauuuaguuaacucugcugucuguagaucugggccauuugguggcaucuguacuagggaggggaaauacacaccaucaaauggacaagaaugguaauugacauaguuuccagcauuaagcuuauuuaaaaaaaaaaaaagaaaggaaaaaaagaacagaauuuuuucuaagacuguuaacacaaaauauaauuauuuuauuuacuuauuuauuuauuuagagauggaguuuugcucuuguugccuagucuggagugcaacggcacgaucucagcucacugcagccuccgccucccagguucaagcaauucuuuugccucagcaucccgaguagcugggauuacaggcaccugccaccaggcccugcuaacuuuuuguauuuuuaguagagaugggguuucaccauguuggccaggcuggucucaaacuccuggccucaagugauccaccugccucggccucccaaagugcugggauuacaggcuugagccacugcgcccggccuaucuuauuuauuuuuuagagacagggccacauucuguuacccagucuggagugcaguggcacgaucauggcucacugcagccucaaacuccuaggcucaagcgauccuccugccuucguagcugguacuacaggcacgcgccgccaugccuagcugaaauuguuaauuucuugguauguccuaaaacccacaggaugauuguugaucacaagcagagaaccagagaugagcuuacagaugaccugaauuaggauuacaaaccauaagaucauguaucccauagauaguaaacuuuaaauuuuaacuaaaacaccugugugauuaauaaccauuauuauuucuguuuugugugauagggagugaagagagacuucaaaaugguugaaauaauugguauaaaaaaaaucucuguggaagucuucuguaggagaggcaagaauaaaaucaaagacuuugucccuaauauauacucucauguugcuagcugauguuuucuuggugguacauugaaacaacaacugcuagugccaaaguaauuggcuauaaacccaguguucuaaacugugccacucugcggguacaaauaaugucccauuaucauucuuaccggcauuuggccagccugcuuguggaggggucagcuaccuuaccaggccacucccacauuuuagguccucuuaucagacacccugauaaggugucugcuggcaaaccucggguccuggggcugcagcuuuugaaggaggacuguucuucccagccagcugcaaaaccccaggggccccacaggcuaugcagcucucuuauucuucacagagccagagcaaggcuggguccagaacagagggagaccaaaguuccuuucuccaaagggaccacacacugaaguccuuuccacuuuugugucuccugccaccccauccagauaccuacauauguguagcuucugucucaccagccuucucuccccuugcaaaugucuucuguagguaggugccuggggagguccagccccaucugugcauugguauugucccccucugggagcacucuacuaggccugcaagauucucuacuaggcuuuuuaaggguuacagaagugaguccagcaaguuagcgguggaggugacauguguacaaaucauuagagcccaaggcugaaagugauguggugacugccacucccaauacuuccagcuguguauccuguucugauccccucccccuggaaugcucauccugcugcuuucuguuuccugccuggcaaauuucauucuuccuucgaggcucugcacagguaaacucaaggguuacccugugcuuugaaaccuucuugacucuaauguuuuugcuacacugugucauacuuccauuacaguaauuauuuuuucaacaaugacuuuaaaaaaaaguauaagugacaauaacacaaaccguacauauuuaaaguuaacaauuugauaacaagucucacaugaggaaggcuaccauuauuacuuucuugacccaaggauggcucuguaacaccuauucauugacgaaaaaucagcaaaaguguuagcugccagccccuggaaaccacgauucuccucacugcuucugugugucgauuuuagauucuacauauagguaaugacaucuaguacuuggcuuucugugucuggcuuaguucacgcaguacaaugucuaugcuguguguguguguacacauauguguguguaugaauaauauaugauguaucagaaaugugacuauaguuaacaaugaggguagaucuuuagaaauuuauuaggagguaauguucucaucaccaaaaagagaaaagaaaaugguaacuaugugauauauaacuugguaacuauugauauauuaauuagcuugauuguggugauuauuucacaauaucaaaacaucaaguuguuuaccuuaaauacauacaauuuuugucaauuacaccucaauagagcuaaaaaaugaaauuuuuguacuaaugauuuaaagucuuaauuuuaccucagaagucaagucauuacuugcacuuaagcaucuacaugaaacaaaacagaacaaacugguacaauauuuuuggaaaagucguaauaaacugugcuuugguaugugcccaguuauaucaaaaguuguacuuauaccaugauaccuacacauaacaaaaaugucuaugauucuauuuugggucuggauuaucuuggcuagauuacgugcaaagauucuaagcauugugcauuuuauucuaaggauggcagggugccacuggaaguacacacugaauaaacuguucaguuaaauuccccuguacucaauggaagggcuagaagccugggaacuucacauggguucugaugucaauuccaccaaugagaugccacauuucauucacugagguguugccuacaaagccuuaacuauuuacuauaugauccuucacugaaaaagcuucuugaccucugauucgaacaaugaauucuugggaaagaauuagauaaacaugucgaaaaacagaauagacaguccggagacaaauccauguauuuaugagaagcucaacuauugacauaggguauuucaaaccagugauggggugaaugggcuauuacacugauaguauuauaauaacuuacugaccauugaaaagaagaaaacaagaauccuacaucguaacauccacaacuaaaacaaaguauaagagaauuagaauaaaauagaggacacuuagaauauuggagcaggaaagaucuuuuuucucugacauaaaaauuaaacacuuugcuaguguaaaagcacauaaaaaagguuugcaagaaaguaguuguaucauauauaauagauaaaugaauaagaguuaaggaguuccuacaaauuaguuuuuaaaaagugguaauggguaaugaacaggcaauuugcaaaggaaaaacagucaaugcucaagcuuagaaguaacugggaaaaugcaaaugaaaacaacaagauaucaacuuuucauucaucauacagacacacugauaaaaaacccagaugauaauaaucauuggcaaagauauguaaaaaguacuuuuuuuuuuucuuuucuuuuuuuuuuuuuugagacagcgucgugcucugucacccaggcgagagugcaguggcgugaucauagcucacuguagccucgaccuccugggcuuaagugauccuccugcuaccucagcgucccaaguagcugggacuacaggugugccaccaugccuggcuaauuuuuucauauuuuuguugagauggugucucacuauguugcccaagcuggucuugaacuccagaccucaagcaauccuccugccuuggccucccaaaaugcuaggauuacagguuugggccaacacgccuggccaaaaguacucuugaaacacaauccaaaguaacuguggcuucugaugcccagaaccacaauuccuacucaagguauccuuauuagaggcauucaaagaggcauuugaucuaacaguguuuguaauaauaacaagccauacauaaucucaguguccacugaaaggaaucugauuaaauuaugguaaauuuauacaaaauauuuugcugcuguuuugaagaaugaagaaaaucucuauauauucacuugaaaaggucuucaaauacguuuuauuguaagaaaaaucaacucuuagaauggaauuuaucuuugugauaacagcaugaacaauucuuucaauaauucaccuuagaaagcggugauauugacaguuauuuacuuuuuuguuuuguuuguuuuugaaacagucuccaucugucacccaggcuggagugcaguggcacaaucucagcuuacugcaagcuccaccucucagguucaagugauccuccugccucagccucucaaguagcugggauuacaugcaugcaccaccaugccuggcuaauuuuguauuuuuaguagagauuggguuucagcauguuggccaggcuggucuucaacucuugaccucaacugagccaccugcuuuggccucccaaagugcugggauuacaggaaugagucaucaugccugaccagaaagcugugauauugauauuuaguaacgauacauauuguugaaaaaaaucaacuuuuggaaaaaaugcucuuacuauacaacuuaggaauuggaaaaauauacauauuuucuauauauaaugcacagggaaaaugaaauggcacauaaacuccugauaguaaucucuggguagggaaauaaucucuggcuuggagugccagggauguugagauuuuggucucuucccauuuguauaauuugauccuucauaaugaguauguaguaugugucaguuauucaaaucaaagaaagccuauuagacucauguauauagucauuuauuuuguggccaauuuuuuggugugcuuuuccuuagaaaauauagauaucuuuuuuuaaguccuagaaaauaucuuaagcuuuaaaaaagauauucagggaaauuaaauaccacacgucuucaauacuaagacauugauuuuaagauacaucauuaauuuaauaauagcuuuucagaaaaauccaggacauacaauuuuauacaucacauugaauguuuaaaaugauuauaagaugcauuucaacuucaugaauguuuuuuagacaaaaugauaauuacaguaguaucacauuuugcagagaaguguagguaaguaagauuggaggcuugauucucccccuuucauaaaugaauaaguaugcgcuugcaaauugugaaggaucagauucacgugccucuggcaggaauauuuacagaagaaaagacaaucacggguaaagcccacugcccacuagaaaugccugcaugagugaaacauauuccuccugagggaugcaagaucucaccuuauuuggaaauggaaauuugguugguuccacuuugccaggugcuugaauagcagaaagugguggaagccaggucaucuccugaaggacgggauaaaaacaaacaauauugugauacagacaguauuuaaaaucagcgguauguaaagcagcuguacaagugggccuucauaaggcagggaaggguuaaaaaauguacaaaggcugaaagaauuuuaaaaaaagaugugaaauccacuuuuaugauuucauuuccuaauuuuaccaauucuugacuccuuggcucuccccaugcucccuuuauaccuuaaaaaaguuugcaaggcuguccuauuuucacuucauuuaagguccugaguaaagggacaaucuaguagcaaaaguucuauggaaaaugccacaugaaggggacucggacuugaucccacagaauucacagggugucuccaaagaaaugcauaagguacuuuuaacuuuaugaaucuuuauuagaggaguuauuuauacaauuagaaauaaaguaucaguucucaauaaggcccacacaucacuuuggucuucauaaaaugucauucacggagagugaaaaaacaaaucacgccuaugaaauacagagacagaaugaugucauuucuuauaacacaguauuaagaacacaacaugagcuuaacauggaauaauuucucauccacuuuuugacacacuuucucuaagccuugggaaagggagagagggguuguuuuauucacuuccaguauucaccuucaguuucaucucuggaagggaguuccaaucaauaaaugauuacagaauuacauugauuucugaugaccaggacgccaacuuggaguuuacgaauuagaugugaacccuauuauuauuauuauuauuauuuuuugagauggagucucacucuguugcucagguuggagugcaguggcgugaucuggcucacugcaaccucugccucccagguucaagugauucuccugccucagccuccuguauagcugggauuacaggugcgugccaccaugccuggcuaauuuuuguauuuucaguagagaugggguuucaccauguuggccaggcuggucucaaacuccugaccucgggugacccgcccaccuugggcucccaaagugcugggauuacaggcauaagcuacugcgccuggccgaacccuauuucuugauuugccugcacuuccaaaccuaagcaagcacagaagcaguggucgauccauuuucagaaaagugagaaauucucucgcucgaggugaggacauuuccuuaccucccuuuggcggguggguguugaaaagcgauucugucaggcuuuuggaaggaaagagcucuugggaauggucgggcaccuucuuuucuugggucauucaccucccccagcaccucagauagugcagaacccacacaggaagccgugggagggcgaguguguucaaagccaugugggaaggauuuacugaccccauaucaucucucccacaccacgacacgugacacagacaguagguggguuaggcacauacgcauucuaggugucccuucuccauucugguguuaccaaccaauuguauacaauuuuauacaucacaaagcaaagcaaagguggauccagugacccuuuaaacugucccucucuccucccaucucugcccugcuggugccuuggucucccuuugaggaggcugauaagcaggacugucaaguuugcguccacaguggcaucuuuguccauggagucaaggaacuauucgucauucucagaguugggccaccuugucuaggaccuggucagcucuuacccagaguguuacuacccgauuaagaaagccaugaagacacaaguggguuuuccauaccuuggcucccccauagggccaucucuccucuacaagguuucugauuuuauccuuccauuuucauuacuggagaggauaugugauuuugcuauaaguggcuucaaaucuucuguagagaaauuauucaucaauuacaaacuauuaaaccaauuguccuuuuccucuuuuguugacugucugaugugucccugaguccaucccacugcuaaucagccacucaauagcuuccuuugcaaucacucuuucgcuuacacaauuuacauugucugauccucaggggacaacauugcgaaguacaaacuaauuacucaugauuaaacaucagacuuacacauaccaccccgguaugucuauguuaacuuugcauacagacucccucuguguaucagaaugccucacauuugugcaauuuuucucugacuguagcuaaaauccaaaaagauaaacuauuauuucagcguguccuccagcaacucaagaauaaauaaaaugaaaaguccauaaaaaaugaguaacaguacuuucaaaagaacacuuccuagaccaacagcuucuuacaacugacacuuucagguucaaaucuguuuaauacaccguuuauccaagaguggaauagcagacaaacuuugagauaccacuaagcugugauucuuaaggguggaaacuguccuccugaucuucguaccuuaaucaggguccaucccugagcacccacucauccccugaacauuuccugaaaacuuaccauuggcaggcacuguaacugugucuuauguacacgaagugcucaguucagcaucuacugaauuugaaaguuaggguaucggcucuggcugugucuauuaucagucuuucuucucuaauuccagcuaugcuuguaaucaaucuuuccauuucuuucuuucuuccuucccuccaacucaccuauucauuaauccaauaaccacccaaccucaaaagcaauauccacagaaggcagaugacacauucucuuagcuugcuguccucaugcaaauaccccuucuccuuugaagcucuugccaggugguuuuggacccucacuaaagaugagcugcaucuuuuucuguccacuccacuccuuuaaaucagacuaacggcucccuccaaaauugccuccugcccucccuaccuucaugauauuuuccuauuuuuuuuuuuuuuugagcuggaguuuugcucuuguugccuaggcuggagugcaauggcgcgaucucagcucaccgcgaccucugccuuccaguucaagcaauucuccugccucagccucccgaguagcugggauuacaggcaugcgucaccacaccuggcuaauucuguauuuuuaguagagaugggguuucuccauguuggucaggcuggucucgaacuuccgaccucaggugauccgccugccuuggccugccaaagugcugggauuacaggagugagucaccgcgcccggccccuauugguuuuuuaaaggcaacugggcaaucuuaugggcacccccaagcauuucuuuucaccuucuugacauguucuucuucugaguccaucucugcuccccucaaauuuuuggcuucacaacccugacuuuaacucugaucuuuggacuucgucuugaagauucggaaucuuggcuuuucccagucuacucugagccagcucauuccagggaaucgccaggcccuauuucucauccgguaaaaaucggcauaucaaauugcucuugaaauucaacacccaacacuagccaccuugcagacaucuuagcuggcuucuccuacacaaggggagaaucaaugguagguccauacaaaucuggaucaagcccucaugucuccauuuuuggaccaagcucucauucuggcuucucugauucuauacuugggcuccuuaggaaagguaacugugcacaauggugggauacagaaguaggacacggacuucucuaaacuugggcccuccuuuccuucuccuuugaggcucuugccaggugguucuggauccucauuaaagaugaucugcaucuuucucuguccacuccaccccuuuaaaucagccuaauggcucccuccaaaaucgccuccugcccucccuaccuucaugucuuucuauugguuuuuaaaggcaauugggcaaucuggugguggcuugggccauguggcuugggcaauccuugaauucauuccuagucuguuccuuuuucugaguuccucaaacauucuuuccacauuggugauuuuucuugagccucacuuugaucccugcuuucucacaacaggugacccugccuccuauggcacugaauaaacaaaggcucuuaaguguaaauguuucccaaggacagaccuguggguguucaugccugaccccguugccuuccuucuggucugacuggaagaggcaugaguuccaagcuaauaccugccugcacccucugucuguuacucuguccuuggggauccaguuccaucaguaucucacugguauugguuuaacaucaaucuuuccuucuccacuggcuuuuucccccaagacugacaaaugaucucaggccucagcccuuccugacacuguauuccuccuccagcugaucuucauuucucuauuucucuugauagcuaacacucucaaagaagucuuuauacuugcuguuuugacauccucaccuaccauuucuauuuuugacuuaagauuuuuuguugcagauuauacacauaagaguccauauaauauugugcauguguguguguaagcuuaagauuaaugaaacgaauaccugugaacucaugacccaccuucacauuuccaagaccuuagcaaccacuuucaauagaagcagcccugacauaacuccuucuguugucaagggcauuggauuuccuugaaugcucauuucccccugacucucuucccccguggcucccacgcuguccuccuggcccagcuccacucucggagaucucaugcucauucuuuuuugcugaaacuucuuuucucucacuguuccuuggguguuuuguguucagccuuccucucacuacccuucuuucccuggcugaucuugcuacuguggcuuuaaaaaccaugugguaugcuggugaugccuaaaagcacauccaggucuaacgugcccacucuagaugucuacugagccacucaaccugggugcucaugagcgauucaaacucaccauguuuaaagcuaaacuuacacgccacacaaacuuuucuucuucuuguacuuuauaugcugguuaauggcagcaacaucuauuaacucuucaagucagcauaccuggaguuaugccagauuccuucucuuucacucccucucucauaauaauaacaauaauucucauuuauuaagcauuuaaaauauauuaugcacgauuuuaaacgcuuuaugugauuugcuuaauucucauacccacccugaaagguaggcuuuauuauuuucuuacuuuauagaugaggaaacuaagucacuaaaagguuaagugauuugcugaaguucacccagcagcuggacuuaaccauauccugggcuaccucuaaguggauccaagaccuuguauauucuagccaacuccuaacuccagccucucaagcugagauccccugaauauaccacgcuuugcacaugcugguagcaccucccaaccuccuauuguuugcuggguuguuuacucaucagucaagacccagcuccauuuccuccuuugcuaugaagucuucuuuggccaaaccaagccaccguugacucaaccuuccuuugugccacauuucccacguacaggucucuuuuagaacacuuguccccucuauugugguuacuuguuuauacaucagugccuccccucuaaccugugaugaaccccucaaggcuguguauuuuuugucugguggcccagcaccuaauacagagccuggagcagaaugggugcucacuucauuucugaacaaauacugaauugaacauucagcagugaaucucugcagugugucuaccuuucucuccuuucuguuaccugaacugccauccuaaucacaccuucauuaucuuuaaccugaaguacucuuauagcauccugauugguucucugucuucuguuagcaguccacccuccacacugcugcaaacucaauuuucguaauucagaaaaacuucacugcucuaaaaaucuucacaugcggucgggcagaguggcucaugccuguaaucccagcacuaugggaggccaaggcgggagggaggaucaccugaaguuaggaguugggagaccagcuuggccaacauagugaaacccuguuucuacuaaaaauacgaaauuagccaggcgugauggcgcgcgccuguaaucacagcuacucgggcagcugaggcacaagaaucgcuugaaccugggaggcagagguugcagugagccgaaaucaugccacugcacuccaggcugggugacagagcgagacuccaucucaaaaaaaaaaaaaaaaaagcuucauaugcaucaucacaucacaaugaugaugaugauggcaauggugacgcugaagaugaugauggcuccuauuaaguuuuaguuuucaaaauacuuccccaugcauuuugucacuuaugcccaaucuuuaacgcaacaauugccaucuccauaguacagcaaggaaguuaaagcucaaaaagauuaacugauuaguccaaggucacucaguuucuagguuuggccagauaacucuuuacucccaguccaguauuuguuuuccaaucuauugaauuuacccucagaauccucacccuaguacucaagaccuucuacaauaaggucccagucuucagcuucaugccuuuuuauugcucuacaaauacucuaccuacaagaaaaacuagccucugcuuuuacuuacaccauccccuuagugugugaauacccuuccucauaugucucugagucucuuuuuauccauuaaggcucaucucaaacaucauuugugucuugaggcuuuugcagauuucccuucuaugccaauauaauaggauaguucucugcucaugcuccuccaaagcacuuauuucuuuuucucuuacauucuguuuuguguuauaguuuuaugaauauguacuucaaucuacacccaaccauuuaucucucuuugaaugcucuuucuccaaugugaaauaaaagcaauacuuaggaauccuaauaaucucuuuuaagagcauucaguuuuacuaggcauaauccccaaauaggaauucuaauaaucccuuucaagagcauuuggauuuacuaaacauaaucgccuaaagaaguaauauaaauuuccucugagagggauauuuacuuaucuuuguggagacuggaacaucuuacauaguaagugcucuauauaaacuuguugaauugaacugaacauccacauuucaaugcaaacuugcuugcuaauuuugcuuuaauuauagcuaaguauuuccgugugauuuuuccaucuaacaaauucuacuaacuacaugaaggaauaguaaagaaaauaugguuacuuaaagcauucaggucuguaagaauuuccaaaaccuaagaauuauuucuaugauuuuaauacauuuauaauguaaugcaaauacaaaauauguaauauacauacaaaauguaauuuaugagguacaaugcuuuuauaagauugauuauccauuacauuaaaauuucacacuagaauugcaugggaaaaucaagggcgaauggacuauccugauuuccucuucuaucacuugcuagccuccugagcuuagguaagucacaugcucaguaaacuaccgugauuucaagcuguggacuuuacgaucaaucagaucucaguuugugguaccuuacaaccagaggaaauggggauauaacuaucccaugguuuagucauaaagauuaaaugagaucauacauacauacauauauaaagaaacuaguauaguuccccucccauuuaagcauucaauaaaagacaguacugauuaauaucaagcugaguuucugaauugucucuaaaaugagaaauauaacuucacucugagcuuuaguuguugggagucugagaugagagaauauauggggaagaguuuuuuaaauaaaagaauaaguaucaugcaaauguagccuguaauuaagcuaggauuauuaaugcaaacuauguauuacuaaaacagaaagauauuuaaagagauuauuauuauuccuaaguaugaucuguacuuuuuauuggagaaaaugucccuaaguuuuuucauagaaacagauuucugacaaaauaauagucagugggauaauacgauuugauaaaaauguauuucauuugcaccucauuucugguaaugauuuaaaauauaagcaaagguaaaauuuaucauuccugcuaaaauugcacuuagcuugcuccacauuauuuuaucacugagaaacaaugcuauuucauuacaaggacacugaucccacgucacuguagccaugguccucaccccugccuguguuccccacuucacccccaaccacccuuucauugcugcuuugccucuauugaccuacuuuggccauccuuuaaccacuucccagaccauauguaagacaggaagagaaauguaauguuuaaagccacuuacuccaaagucuagcuggcgaccuucggaucuuauaaacuccccugcccuuucuuugcuuugucugccuucucuccuuuuucauuuucuugucacucaggaauaagccuguacccuauuccccuacucuugagagguccucaguuuugcccuugggguuucuuagucaccugcccuuuuuuuuccuuuuuuuuuuugagauaaagucucacuaaguugcccgggcuggccucaaacuccggggcucauaugauccuccugcuuuggccucccgaguagcuggaacacaggugcaggcugccaugucccacuccuuagccuuuuagauacuccaggugauggaacugagaauccacguaucugccucaacacagcaucgccagucccuucucccuacacagaugucuaguuacucaagggauacguucaggugacuucuuuuuuuuuuuuuuguauaggcuuauaaugccaagacucuuuauauuaaauauacucacuuuucuccuaaaaugaaagaauagaugguuaaaugauaaggacacagaauauugcucuucauaacuggcuaacguuuucucuauccuccauaucccaauuuucaggaggucaugggcacaugggccaguuuccauuuucacgucuacucuacagcaagacugacgccagucuccaagaacccacacacugauggugcauagacuuucaugugcuccaucugcacaaugcccuccauguagcugaccacucuucugaugccagcugccucugccuguuuuaggacaagugacaggaggccuugggcauccccaccucacguagcagcucuuuguuaccaaaggagagaagaaacaaaaauagaauuuuagccucaaguuaaaucuucgaguucagagugugcagcuaugaagaccugcaaagucuguuuagcuuacaauagguucaacuagaaaaaauuuaagccauguuuucauuucccuauuaaaacaagugaggagaaaaacacuuuuccuggucucucucccuugucugucacugccacaggagaguuccaucucgaacacuuacuaugucaccuuuguuccaaaguuuccagugaccccgguccaauuguucaagaugcucugucacauggcaccaucaaggaccacuguggcauuaccgccugcugcuuuucuauacacugucuuccccaagccugaugucuuacuucuuguccugccccaggcuuuccugcccccaucuuguuucucuuuuccuuucacguuauuccaucucacuuaccucugcauucuuucucauccuggccugucugugaaggugaccugugcuacccugagcgagcccucucuacccuccacuuauauauaaucaaugccacuuuuuuuuuuuuuuuuucagauggagucucgcucugucacccaggcuagaaugcaauggcgugaucucagcucacugcaaccucugccuccccuguucaagcgauucucccgccucagccuccugaguccugggacuacaggcacaugcuaccaugcccagcuaauuuuuguauuuuuuaguagagacgggguuucaccauguuggccaggcuggucucaaacuccugaccucaggcgauccaccugccuuggccucccaaagugcugggauuacagguaucagccaccgugcccggccaaugccacuuauuuagcaacuacaugcuacucagugcugugagcuuucuugucauguguuaccacuaucagaauauuuuuaaaaucccuacuagauuacaaacucuucgagggaagggaucaugucuaauaaugcucuuguaacuccucaaaggccuagcacaauggucagaauaauaggaauuaauugaacuucucuguaagucucuuuucuugccugugaaauaaugguagcaagaaauuacacugguuucaccaagcguaugugacuguugccaggauugaaggaucugccuggcagaugaccgcaguuaacuccagaauucuuugugcucagaaacuuacuguuuucuaaacaagacacgggaugaauucugcgacuugggaauaaaaaugcaagaugcucacguugauguuuauguguggcaguggcugcugaucacagugugauuucauuuucaguuucuguaucagaauaaucauucagcuuuucaguucuucucacacguauuauucguguuaugacacucuuaucagauaagugcugccaacaacagacauggugauuuuuacaacacugcaucucaucuaaaugcuggcagcuaaugccacuguaccuggugaagaggaaaacaccccuacgggccuguaccugggacaccaggcaguagcccuggaguaagaucaagugggagacacauauuccuccccuaaugggacugcagugugcauucugccugucaauccauuccuagcauuugugggcaaagacccaacaucccccuuuaaacacagauuccagggucaggcuggaaggcucagaacuaggaagucacacuuaaaaccuuuaaguuggccucuaaaucaacaaaaauucacaaacaaccuuauuuuaccacucuacaguaaaaaacaaacaaaccuguauaguuugaaaaauaauaaauauaaugcauucauaucgauuaauauuaacaggccaggaacaguagcucacgccuguaaucccagcacuuugggaugcugaggugggaggaucucuugagccuaggaauucuagguuuccgugaacuaugauugcaccacugcacuccagccggggugacagagggagacccugucuuuaaucacaacaacaacaacaauaauuagcauuuugauggaaauacuacugauugaaaacuuuuaggaaaaugguagcugcugaaaaaagugccuuuaaaaaauaucuauuucucauaguauagcauaggcugcuaaaaugccagaaaccaaaauugcaacugauucaaacacagauacaaaccagcaaauaaccaaaaagacugcaaaaaagaggguuaacaaaaaucguagcaaaaucuuguuucuucaaucugaaaacccaggaauauguccaguuugaacugaaacaggccugagaaggggauuccugggagcuguacacguguuuucuggucuuauaccgacccacuggaugacaggaucucagaaugggacgcugauuaaucuacuucauugcagugccugagcuucugaacucugccccugccugcgaugagguuaaucaucaaaggauaaaauggggguaacaaucaauagaaucaguuugagaggcagcuuucaguucagguuuugcagacugacaaguacgaaaguagccauucaaacuggaaacacugaggguaacucagaccugugcaucccacuugcuccuuggucuguagauucucacuuaucuaaaagcagaggccacagggcaucuggccuuucauuacuuccuuugcaucaucaaaagcacuccuuauugcagggaagucaauuccaugccacuggagacccuaccuuucaccuccuugacuucagcuucccuggaaacugaacucuccacagagaggauuagaacauugagaaaagucaagauacagucuucaccuuaaaaguuuguuucaugcuagaucccuuaauuuuggaccuuucuggagaauucuuguucucguuuugcauuuuuccagcuuucuuuuggggcagaggaugagagucaccugucuuauuaucucucugugucaaguacauuccuguucuauuuauuuacuugaaacuuuuuugaacaauaaaaaugaaacauuaaaaaaauuuauucuucgauccaccugguuuucaauguucauuuuauuacuuguguuuaaaaaauaauaugauucucauucuuuaacuugcagauuguucuuagaacugagcauugcauuaaaauauucaaaguaguaacauuuagauugggucuucagaauuuuaggaagaugguuuugcugcugaguauacagcugcauggacugagugacucuuguuaaacccaggugacuccaacuucaccacggagucccugcugcaauauacagacaccugcuaguuucuggcacuccuucaaaucucgugcucaugaugagaagcaauaauuggccugauuuuaaauuuuaaaaaugcuuuuuuugacaagcaaaaaaaaaauuaaaacauuugaggggcacugagagaauuucccaaauucugaaucuggggcugacacaucacugcgucauuucugagccaaaucuugucaaaucguguuaacucgagguuuauaaaaagugagccaaauuucugaucagcucaggagaaaaugcacguuacuaacuaugccacugacacuuuauuucugacucacauaauacuuuuuagugguagcacaaacacccagaagugagccuuccuaacagacaaauagaugaucguugaacuaacuguggcuugcaacaaucaaaccacucuuucauauauacuuaaaggaaaaaauggcauuauuugggacagacuggaagacuguggaggcuggaaggagaagggggugaaaauuacauucuuggccacguuuuccacacaacccauuccugaaccccuuuccacagacaauuuggaaaugugcauucaauaaaaccccugucgcaauugcagagaagcagaggguagaagagaucgggcuuggagucagcaucugggaaaccuuguauaauuuuggccuugccauaaaccagcagaaugaccucgggcaaguuuacuuuuccgauuauuaguguccuuaucuguaaauugguaucaaucauucuaucuugcaggauuaccugagugguuagugauaaauauacaaagaaccuagcguaauagcuggcacauaguaggugcucauaaaaaauaauuauugcuguauugcuaccuuuauaacuaguguugacagcuucuggauucgaccuggugaggaaaggggauaaauauagaagacguuuaugaauuuguuuuuuaaucuauuuuacucuuuaauuauuuaauauuuaacugguuaauuauucauagucaaacagaaggcuuaauaaaaaugugcuuauuaaacaauaauuugcuuccuuaacucccuucaccacuaaagcagcauguccauaaagggaaggaagaaugcuaucucagggucuggaauuuuucuucaaagggauaguuacuagaaaucagcauacauccucuuucuaguuuggggcucuacagauuagaagcuuugcccucaugcuauagacuacccuugcaggcaccagcuuggguaguauaggagguguuaggcaagcugggaguguagcgggaggcuaccuggcuaugaugacagggcagugauuacuguccaggcagguggcugagcaaggugacaagccugggcaagaauaaacccuggaaacuacuggggccaggaucaaaguucccggucaggugggacuucugguuuaccagagggaagguuaggacaauccugccgaaggcacaugccuuucucccuuucaaauguuucccagcuaaaccacuuccaaaugagcaggcuucuacuaacuuuaugcaaguauuuuucucaguuuugagaggugauuuauaaaucacugaauggcauugcccuaggacagcagggaugucucugggucuuaaggaugaaugugaaggcaggaugacuuuauaggaaacagaaaaugucuacuaacaugcuccagauauugacaguaaaauccagaggcuggaggaaagcugguuagccuuggaaaaaccaucuuuucuuuuucuuuucuuucuccuuuuucagaaauaagguuaaacuauccuuaagaauaagaaggaaaauauuaaaacauucccccccaaaaguucauagaucuucaagaaaagagaaguuaggaccaaaauauaaacaggaugacaacugcuuuuauuugaagaaaauagaguuuucuagaagacugaaucaguauagccugauaaagugcuuauccauugggaaaagauauucuaugggagcaaacaaauaaagauaaaagaggaagacauuaaauuaauaauggcuaaagaaggugagagccugaacucacuugcuaaaugugucuuuaaagagggagccaacaugaucucacaagagucucuaugagaaggugagaaggaagguucuuaguacucaagggcgaauaggcaaucuacaaauuucagaccaauguuuuuaucccuugauguucacugacaacacagacacaguucccuguuuugaaaagaggucuaacaaucaugcugaacagucugagacuuaauagagccaaucaguucaguuucuauuagugcaccuguacacucaggcaugcguucaaccaaacacacauuuagacacucagacuacucuaggucuugggaaacaaagcagaauacaacagacauggccccugcucucaggagguguaagcaccaugagaggagagaagcaauaaacaaugaacaaauacauguaaacgcaacagaucuauauucgaacaguugcugcaugguucugaugggucuaauuagcauuuuggcaaagaagaagcaugagaagggcauggauucugugucagacauuugaggggcuggcuuguggaaaugacauuaugugugguuuaaagcuacagggaagauuuugguuuuaauaaacuuccuaacaauuucugucacuaaacauuccacagguguuuugugcuaagcacuguuccagguggcuacauucugguaaaaugagguagacaguaaacauguauaugacacuauguaacaucacacguuguaacccaaagcagcauaauuuggcauaauguaauauaacauaguaaccauuaaagcugugcaucaguaaacuggccaucaccaucagugaaauggugagcugcagcugggugcgguggcucacgccugucaucucagcacuuugggaggccgaggcgggcggaucacgaggucaggagauugagaccacggugaaaccccaucucuacuaaaaauacaaaaaauuagcugggugcgguggcaggcaccuguagucccagcuacucaggaggcugaggcaggagaauagcaugaacccgggaggcggagcuugcagugagcugagauugcgccauugcacuccucgaggcauuugggaucacaagcagagugggaugucucugggaauccccagccuggagcagcuuccucugacuuugguggagccacaugcagggcucagggcaacuucugcucucuauucuuaaccuuccuuaauuguugugucucaauauuuucagucucaauuccugacucaaugaaguucuuaauuucauaugugaucccugguggguuugggacacaugauuucauuuuaguuuuuaauugaaaaaguauuuauugaaaaaguauuuccauaauauuuucugcuuaaauaacauaugcuucugguuaaaaaguuaaacauugcaaaaaaaauagcaaaugcaggagagugaaaccccccaggauccuaacaccugcagauaaugucaauggugaccaguguuaagcacuggguacuuaucugauuuuuauauacaugcacuaagauggggauuauauuaauauauguauauuuaaugaggucauacuguuuggugauauacucuuuuucacugagcaucuuucccaacacaacauacaaaugggucuucuuuuuugcaguuauuauuuuggauugguucaucuuaaaagucuuucuaccuaagaauaguuuacacaccauaguuacaguguugcaauauucuguuuuucuguguacuuacuguuaccagugaguuuuaugccuucaguugauuucuggcucauuaaugucuuuuucuuucagauuaaauaucucccuucagcauuucuuauacgacaggucugguguugaggaaauuccucagcuuuuguuugucuuagaaaguuuuaauuucuucuuccuguuugaaggauauuuucaccagauacacuauucugggguaaaaguuuuuuuuccuuuagcacuuuaaauaugucacgccacucucuccuggccugcaagguuuccgcugaaaagucugcggccagauguacuggagcaccauaguauguuacuuguuucuuuucucuuguugcuuuuaggauuuuguaucuauccuugaccuuugggaguuugauuauuaaauuucuugagguagccuucuuuggguuaaaucuccuugguggucucuaaccuucuuguccuuggauauugauaccuuucucuagguuccguuauuauaccuuugaauacacuuucucccuaucuauuucucucucugccuccucuuuaaggccaacaauucuuagacuugcccuuuagaggcuauuuucuacaucuuauaccugugccucacuguuuuuuauucuuuuuuucuuuugucuuugccgaucauacauuuucaaacagccugucuucaagcucacuaauucauucuccugcuugaucuguuuggcuauuaagagacucugaugcauucuucaguaugucagcugcauuuuucaacuccagaauuucugcuugauucuguuuaauuauuucaaucucuuuguuaaauuuaucugauagaauucugaauuccuuuucuguguuaccuugaauuucuuugaguuuccucagaacagccauuuugaauucucugucacauaccucuguuucuccagaauuagucccugacaccuuaugccuuaucuaguucauuuggugaggcuguuuuccuggaugauguugaugcuugcagaugucaccgguguuugggcacugaauaauuagguccuuauuguagucuuugcagucugggcuuguuuguagcuguccuucuugggaaggcuuuccagguauuugaaaugacuuggguguugugacugacacuguaucugcauuagggggcaccccaaguccaguaacauuguaguucaugcagacucacagaaguacugccuugguggucucggauaagaucaggaagaauucucuggaauaccagacagaaacucuuguucucuucccuuacuuucucccaaacaaauggagucucucuuucucccugugcugagcagccuggggcuggggguggggugacauaagcaccccuguggcuaccacgacugggacugugcugggucacaccugaagccagcacaacacuaagucuuacccaaggccacucccuggcuacagccuguauuugcucaaggcccuagggcucuaugaucggcagacggugaagccagcuggguuugugucuuucccuucagggcagcgaguucccccagcuggguccagagaugcugucuaggagccagggacugaagauaaaaaccuuagaaaucuacguggccuucuauuccacucuggcugagcuggcacuccaacuguaagccacaguccuucccaugguccccucuccuuuccacaggcagaagagccucaucccaaggccacgaccacgacaggcccacagggauuacugccaggccacugccgauguuaacuuaaugcccaaaggccccucagucaagucguggugagugcugccuggccugggacucacccuucagggcaguagacuccccucuggcccagggaaggcccagagaugguauccaacagccaaggccuggaaucagggacaccaagagccugcuuagugcucuacccugcuguggccaagcugguaccuaaggugcaagaccaagucccuuuuacuuuuccuucugcuuuucuaagcagaaggagucucucacuauagccaccacaguugggaauguggugggucucaccugcagccagcagucucagagucucaccaaggcccauggcauaugaccuggguaucacugcugguuauucagggaccaagggcucuuuaagucagcaagagauggaucuugccaggacuugguccuucccuucaaggcagugucuccuucuggcccagggugucucucuagaaauguuuucugagagguacggccugaaaauggggccucacagcucugacugguacccuaucccucuguggcugagcugauaaccaagaugcaagacaaaguccucuuuacucuugccccuccuguccuuaagcagaaggaaggggucucuuuugaagcugggagcuuuguugccuggguuuggaggagggguaguguaagcacucccuauucacaauagcaaagacaugagaucaacccaaaggaccaucagugguagacuggauaaagaaaauguguacauauauaccacagaauacuacgcaaccauaaaaaggaacaagaucacguccuuugcaggagcauggauggaacuggaagcuguucuccucagcaaacuaaugcaggaacagaaaaccaaacacugcauguuuucacuuauaagugggaguugaacaaugagaacacauggacacauggaugguggggaaaaacacauacugaggccugccaugggggaucaucaggaagaacagcuaauggauacugggcuuaauaucugggugaugaguugaucugugcagcaaaccaccgagguacacguuaccuauguaauaagccugcauauccugcauauguaucccagaacuuaaaaaaugaagaagaaaaaaaaaaaaaaaccagagcaauucacacucaacagcaugccagggaagaugucucagcccugguguccugacaagagcaguuucugaauaggaagaaggcuggcacaaauggauacagcaacacauucuagagaugcaaaguuccaacaaaagcauuuuaaaggucaccuuguuuauauaauauuuauguuuuaagaccuuaugauucccccaauauuucaaagcucucagagacaaaagaauaacaugguauaaagaaguggaacucggaaugaggagacguggacucugguuucagagccacaggaaacuguggaaucuggaggugaagacaaccccaggaagugacguauuucuaaauuuucugaugaggacacccggccccaagaaguucugugagcugcccaaggccucucagucacuugugauacagccagaaugcagggcaggggccacuguguccuucuauguuccuucagucugcaaaacagcgauaagaauagcuaauugggguuuucugagaaguuacuguauuggaaaccauaaauaugucauuuaaugaagaacaaugagcuucggcaggauuucuuaagugugaaugcaaucgacaugcgguauuccugccuucuugguucucucgucucauacucaacucugguccccuuucccauccuccaccucagaaaacaagaagugggacaaaauaggaaaggagagaagaggaagaauaaacaagaagugggacaaaauagggaaggagagaagaggaagaaaagagugacgaugagccccgggcgagguggcaggggccugagaggcagggaaggcaaauggggagcuuuguucugaccaggccgugugcuuggucuguggggccucuggcuucccaugggugaguccugugagaagaacugugauagucuaagugucugccaaaagaagggagugaauuagaugcaacccauuccacccugccucaggaacaauguacacacaaauacaugucaggauucucucugaacuuuacacagaaauugccuggcuauguucagcucuucucagggagagaaacagaaaguauuugcucuggaaaucuuguaucaauauauaaccaagaucuuaauguuuucagacuugccccuuccuuuuucuagcauuuguuuuuucuucuguaucuccucaggaagauaugguggcaauuaaaagaaaaauuauucugaacagccugaagugauauggcuaagccuagcaccacuuuuauuucagaguuaaacaaccaugacuuaauucucaaauugcuucccaacccugggaaguuaagguccuagucuccggcuaauucuagaaccaucuaucauuaaaugaaguugaacacaaagaaggggcgacugcagcuaagggaaaggccgucaauccugacaccagauuaaucuuccccaaaugccuuuccugccugagaggguuuguggcugcuuguuagacuagauccaaguucucagccuugucucaggccugccuggccauugagugucucacaugcuucccaccauuccucaugggagccuggguucagaccggccagguucccacucccguucacaggaaggaggcucugcgacuuucaccugcaggcucugcucacccguugucacuuccccauccacauccuacccuucuaucacaucuuccuucaagaagacucacacuguucaggaaacaccugcucacugccuccuuaaguuccuuucucuaaaugucuacaguguuaauaguuuauagcacucagcccacugauugagaccacagcuaaguuucugagggcagagacccccucuguuuaguucacugcuccuuccccagugucaagcuuagccaggugcucauuaaagaauuacaaaaugagcaaaugguuacuugacucgugagguaggauaagacaaugagacugauucuuaaacuacuugcuguaauauaaacucauauaauuuuuuuuguugcuacaaagcugucaucuaggcaggugagucuuuuauuacuaaaaugcuuggagugcucaaacguuuugggaauucuucuuuggaaacugugcuacgucaauuccugggguugggguugaggugguggggguggagguuggugugauggggguggggaaucucagaguuaagacuggauaugaauuaacaaagagacaaaagucacucagggccaagccuuaacugaaguggcugauuaagcuagugagagcaguucuggaucaaaacugaucaaaagucaguccuauucaacauaguauuggaaguucuggccagggcaaucaggcaagagaaagaauuaaaggguauucaaauaggaaaagaggaagucaaauuaucuuuguuugcagaugacaugauccuauaucuagaaaaccccaucgucucagcccaaaagcuucuuaagcugauaagcaauuucagcaaagucucagcauauaaaaucaaugugcagaaaucacaaggauuccuauacaccaacaacaggcaagcugagaaccaaaucaugaaagaauucccauucccauucacaacugccacaaagagaauaaaauaccuaggaauauagcuaacaggggaagugaaggaccucuucaagaagaacuacaaaccacuguucaaagaaaucagagaugacacaaacaaauggaaaaacauuccaugcucaugcacaggaagaaucgauaucaugaaaauggccacacugcccaaagcaauuuauagauucaaugcuauucccauuaaacuaccauugacauucuucacagaauuagaaaaaacuauuuuaaaauucauauggaaccaaaaaagagcccaaauagccaaggcaauccuaauccuaagcaaaaagaauaaagcuggaggcaucacacugcccaacuuuaaacuauaauacaagacuacaguaaccaaaacagcaugguacugguacaagaacagacauacagaccaauggaacagaauagagaacccagaaauaagaccacacacccacaaucaucugaucuuugacaaaccugacaaaaacaagcaacggagaaaggauucccuauuuaauaaauugugcugagagaacugacuagcgauaugcagaaaacugaaacuggaccccuuccuuacaccauauacaaaaaaucaacucaagauggauuaaagacuuaaaugcaaaacccaaaacuaaaaaagcucuagaaaaaaaccuaagcaauaccauucaggacauaggcaugagcaaaaauuucaugacaaagaugccaaaagcaauugcaacaaaagcaaaaauugacaaacgggaucuaauuaaacuaaaaagcuucuguacagcaaaagaaacuaccaacagaguaaacagacaaccuacagaaugggagaaaauuuuugcaaucuaugccucugacaaagguuuaacauccagcaucuauaaagaacuuaaacaaauuuacaagaaaaaaaauaaaccgcuccaugaaaaaguaggcaaaggacaugaacagacacuucucaaaagacauacaugcagccaacaaacacaugaaaaaagcucaacaucauugaucauuagagaaaugcaaaucaaaaccacaaugagauaucaucucacgucagucagaauggcuauuauuaaaaaaucaaaaaacaacaugcuggcaaugucguggagaagaaggaaugcuuuuauacuguuggugggaguguaaauucaaccaucguggaagacaguguggcaauuccucaaagaccuagaagcagaaacaccauuugacccagcaaucccauuacuggguauuacccaaaggaauagaaauuguucuauuguagugcuauuagcaauagaaaagacaugggaucaaccuaaaugcccaucaaugauagacugaauaaagaaaaugugguacauauacaccauggaauacuaugcagccauacaaaagaaugagaucauguccuuuguagggaccuggauggagcuggaggccuuuauccuuagcaaacuaacacaggaacagaaaaccaaauacugcauguucucacuuauaagugggagcuaaaugaugagaacacauggacacaugugugggaaagacacacaguggggccugucagagggcaggaggagguaggaggagggaaaaaucagggugaugggcugauaggugcagcaaaccaccauggcacacauuuaacuauguagcaaacucgcacauccugcacauauaccccagaacuuaaaauaaaaguuggaaaaaaaaaaacccaagucaggaugccauuccucauggcucauccucgcucucaagaagaaagccauuauaggaauuccugaaagacgacaacaucauuagaaugaguauuuagauucucaagaugacuauuucaaaggacaguaguuccuugcaugcacuaaaaauaccccgaaacaugaauacuucuuuuuuaaaaugaaucuagcaacuagcacacagaaggaaacaagucaauacccacugaccuaguugugguagaacacuaguuuaguucugggcaaauauaaacuuuaaaauaaacccgaugcuuuaaaaauaccaagcuucuacaguagaacgauaaaauaauacaacaguaggagacaugugaaaaugcaugacuaucucucaggaggaaacaaaguguggggaacuuuuaaaauacaacucucaaagggguuucaaauggcaucgggggaaaaaaggaaugcacuugauguuccuggaguuccuuauaauugugucucuuuggcuccuaacaaagaaccagcagcagagucaaaauuauuuugggcaaauuucaagaaauuaaaacaaagguuuaaaaaaucacagaagaguaggggucaguuuguuuaccuagcacagacagaugguuguauuucuguaguuagaggagcaaugcagaaagacuuccaaaguuccagaugaggcacauuugccaagaaaaugcuucagguuggcagaagguagaaacccuguauuggcuaaauauuuagcaacacugaagaauuuuuaacacuaauaucucauuuggaguggaauaugcuuuauggucugaauucuuuccccacucuguuuuauaagugaugauaaaaaucaaaacauaaucaccugucgaggaugaauccugcaccugugaaauuauauuucaaacaagccaacuuccuaauuacaauggagagggaacuggcaugaggaagcaaguuauuuccaccauuccggcagugggcuccaggcucccagaugaagagcuguugguacaaccacaaaaaaacugcuaaaaucaucuuuuauuauuccugucugcacaacaaauagcuccaucuggggcucaaugguagacuccagccaaaauuuguaagggcucggcucugaggcaucugauagcagcccugcauaaggcagaaaaucagaccaccaucagcaccaggaucacugucuacaugaguugaugaagaguuuguggggggcacugggccgagcaugucaaggggcacagaaaauuggaagcauggacccugcuuuaaagaagcuuacagggcaguuggggagauaggaaucuacaaacacacauaugcuaaagcacaacagucccucaguuauguguggcaaauuccaaaugagggacaggcggugaugcuuggaauugagcaaagucagagcccgcugugaguggcaguagccagugccacacaaagcaggcagggugugagcaucuucugagaacuuccuacauguaagucuccacgcugaguuccuacccagguccucucauuuaccugauuccuucccaggagcauccugggagagugccacuaggagaccacaguucuuccugcacagaggaaaccuuccauuucuccacaacguuugcuugauccuacuugacuccaggcccuuccugcugggcuuuaagccaguugauaccacaguggcuggcgcaacucugaagugugcauguucagaguccugagucccuagacccugggcaucugcagacugaaugcugcugcaucccagggcucagaugcugagucauggggaguggucuuugggcuuuucucaaaggaguacaccgcacuggauauuuauguccuuaguuggguuggguuaagcauucccaucugcgugcccugguaagcuucuccaauagauguuauguacaaggcucuucauucauaacucuuucaaauaucucagguaaggauugcuagcucuucgccuccaacaucuggcaggcuuucuaccugguuccuuugcuuucugccucuaugaaaaugcucugaagugcuggucuuggccaggcaagcuaccuguaggccaugucuucaugcacacagacaaguuggcugccuucuaccagcucccgguggucccacagagcagaugcgccacaggcuguguccuguacacccuggcccugggagcgcaggcucaguuugcacagcauuacugaagcagacccugggguacuuaaaaaaagcaaaagcaaaaaaaaaaaaaaaaaaaaaaaacaaaaugcaaaaauuaguuccagcacuaucaguucaaaugggcaaugugcauguccauauggcugggcuccuccaggucugacugugcaauaaagacagguuucaguugguuuguuccaggccugagagccagaaggcagagcagucucugaagcacugaagccagagugaccccugcacaucgcaucccuucuggauccugccuggagcucugucugcccggaacacccuucuccuccuccuuccucuggucuccuccuccuucuccuucucaucucuuaucuccuucaggucuguggcuuuccccagcaguuuacacaguaccuggcacuaggugaagcucaaaaauauuuguucaaaacaugaaguaauguacaauugauacaaggaagggaugacacaaggugccucagacaggcagaaacagaggggauuaacagcacgcauagaaagcaauagauguauucaugcauaagcacaccagcaggaugccacccaacucccaccauaacuggcugggacaaugcuugguagccugucucuccccacucccaucucuagaugcucuuucaugugaauaucaaugugaucuaugucaucggucugccaaucuaucuuaacaauauuaagucuuccuauccaugagcacagaacauuuuucuacuuuuuuaaguuuuaauuucuuucaacaauguuuuauaguguucaguguacaaguauugcacuuucuugguuaacuuuauugcuaaguguuuuauucuuuggaugcuauuguaaaugaaauuuccuuaauuucauuuuuuugauugcucauugcuaguguauagacacaaaacugauuuuuguauauugaucuuauauucugcaacuuugccaaacuuguuuauuaccuauaauuuugugugugugugugugugugugugcgcguguguguguguguguguguguguguguguguguggcgggguuggcucuuuaggguuuucuauauggaagauaauguuaucugugaauuagagauaguuuuacuucuuccuaauuuggaugccuuuucuuuucuugccuaauugcucuggcuaguacuucuaggauaauacugacuggaaguagugagcagacacccuugucuagcucccgaucuuagggggaaagcaucugcucuuuuaucauuaagcaugauguuagcuguggguuuuccauggguaucuguucuagcuggaggagggcugccucuguuccugguuuguuggguguuuuuaucauggaugguuguugggauuuugucaaaugcuuuuucuguaucuauugagauggccauguggcuguuaucauuuauuuauaguuagaguauguuauauuaauuucaauauauaaaaucaacuuugaauucuuggcauaaaucccuaagaaauaaauucuuaaaacaacagcaagaugauaaauaugcucauaauauuacauagcagugugguguuucacauuuuucagggaauuuucacaaacaaaaaacccuggguaagugaccacacagucacaguuauuauucuuauuagucaguuacguauuuuuguguauuuagaggguacaaguccagguuucuuacaugcauauacugcguaguggugaagucugggcauuuagugaccccaucacccgaagcguaaacacuguacccaguagauaguuuuucagccuucacuccccucccaccuuucacggucuauuauuccacuuuguauguccauguguacccauugauuagcuuccacuuguaaaugagaacaugugguauuugauuuucuguuucugagcacacaguuauuauuauuagucuucauuuuacaaggaaagaaacaaaagcucagaaacuucuccaaggauacaacauuggcaaauggcagagccacgaccuggauucaggucuucucauuuguggucuaaauagucacaugcacggagagaguguuacaguuauacugaaaagauagccgcacaucauuauaagaaaagauaaagaacacaucucauucaaaacuagaaucccagcaucugaaggacuacugaagugucuaaugagcauguguucauaauccuuuucuauggguuguucugaucacuguaggaggagcaggacuuaucucccaucuccaaacacucucccuugaccucacagcagacuagagcaacuaucccauuucucugcuccucuuuauagcaaaacucuccaucuaaacucccuguccugauuccagucugugcuucaagcugacgcuggucuggcauuccuggggcugauucucaguuucccgccuacugaaccucucagcgcucugucugaguaaauaauucucuccuagauggaucacuuuccuccuggccaucaaaacaucuacucuuagcuucuccuucccagguuccuuuguaagauccuucucaccuuccugauuuuuauaugacugugcaacccaggguuuggcucuacaaucacuucccuuuuccagauauacuuauguucuggaugaucucauccuggccacguuuacccugccaaacuacaccuuucgccugaaugccaaacuugugcaucuaacugcuucccagcuaccuccacucugauaucugaauagaacccuaaguguacacauuuaaaacucaacucucgaguuccaccacaaaccugcuuuuuccauugucuuccccaucuuagugaauggcaacuucauucuuccauuuguucagauccaaacccuggacucaucuugacuucucucuuucuuucacccugagcaugccauauauuacugaauccugauagcccaacccucaaaauguauccuggaucuagucaccugcgaccuccaaggcugcccaccuuaguauacaacacugucaucucucauuugacuuuuccugaggucucuugcuuccacccuuguucccugacaagccucuucucccuauagcagccagagggaucauuuaaaacacaaaacagaucaugucagucuucugcugaaaaacuuccaguggcuucuuaucuuauggagaaugaaacccaagguucuuggaucuggcccugguucccuccaugacucaguacucaucauucuccccuuacuuacucuacuuuaguuacaaugauuuucuccaaacaaaccaaacagguuccugccucaggaccuuugcaccuacuguucccuuggccuguccacccuucuccaugucagcaaugccacucccucccuuacuugauagaucucugcucaaccacgacuucagcagagagggcuuccccgucugcccuaucuuaaauaacaccagcccagucauucucuauucccucaccuugccuuauuuuucuucuuagcacuuaucacugccuaccauuuauauauuuauugguuuaucuguuuauuaucuccccuugcuaacauguaaacaucaugagaauaggaaaccuucucuguuuguucauugcuauaucuuagggcugggucagcaaaacaauggcugccaggccaaacuggccugccacauuauuuuaaacgauguuuuacuggaacacagccacaccacuucacucacugcuguuauccaugggugcuucugugcuacagaagcauaauugaguugucacaucagagacuggauggcccucaaagccuaaaauguugaccauuugguccuuuccagaaaacguuugcuggcucguuuuggggucuagaagacaaugcuggcacacaguagaggcaccaaacacauuugcucgaugaauaaaugaaugaaugaaugaaauaaaagaagaaaccaagaagcggauuaagaaauauuauaccaaaagggcauuugcauuuguuaccagauuaaccaaguauagcaaaauauuagaaagagugauuuaaacuuaacagaaauccaaauaaagaaaaaaaaaaucuuauaauucuguuuucuauaaauuaagaauuauaugaggugagggaaaugcuggggugaauacugcuagccugugugacauucaagcuuauacagaacuuuauuaucugggggacuucaguucaaauaaaugaacccacacacacuaaaaacgaucgcuucagaaaccugaaaggguuuuuucuuuuucuucuuuacagaucuucuuuacauucaggccaauguuuugauuuuccauuuccccuugggcaugaagacaguuuucuuuuggaguugggguccccacauuguaauaacuguuaacagagugcaccugaaaggcuuaaagguagacccuaccaaaagcccuuuggcccaaacaucuguaaaugcuagugaacauuaucagauaaagaagcaggauucccuuuuuauguuuuuaagguaccaauucugccagcaugagagagaguagaaggaacagaacucaaaaaguacaaggucagaguuaaaauuuuaaaagaugguacaaaguccccagugaacaguugcaggacacacugccugagcugugcugccgccauaggaagaggggccugccauaguccugcaaagcuuuuccgcggcaauccaucugaaacugcuccugaaacuuugucaacuuugaccugcaacacugguucucaagaaagccagucaacaagcauuugcucaaguccuucuaugcuuuacuuugaguuuaacaucaaaggcucaggccucucuucugauauuugaccacuuugacugguaauuagguuuguggaugaacaaacaccuccaucucaacacacguacaaaugcaguguucauggcaaacucagagacaagacuucugcagguaacauuaguguucuaaaacccacaacaacacacaaaguauuuuaaacuaauggcauuuagaaauccagaagcaaaaaagacacaaauucuuauuuuggcacaugaguguguagaggaucuguuuucucaagcacaaauauuuuccaaacaaauaguuuuaaacauccaaaaagucugucuuuccuugcuguuuuagaaaaguuccuagggcuucugagaauuuuaugagagauuaaagacagucaauggcugcuugguaccuggcgcccaggcuggacuuaucuuuucuucgcauaucuuuggcagaggauagcgguagauaaaauccauuauugacagaaggaaaacagacaaugagcagagaaguaaaugagaaagcuucauuauuuacccaacuuugaaaugguaauaaagcuuuugcucuaucccaaaguuugacaauugccaugcacugccaaccccuaccucucaaguccccuuuaauauccuccuccaaacuugagggguuccaacuguggagauucugaaaagcuguugcacaccaccuccucuucuagagccugccuaucccaaggggcugacgcacugucagugucuggggacgcuggguagacaaugcaaacgagaggguguaaauguaaauucugcauuuggguaccaguggcugugcugcagugugagggaacucauccaucucaggaacucuggccucucucacgagagaagaaagaugcccugugagagcagaggaauacacggcacaggaggauucacuucugccucacacuguccuaaggacuaagccaugcuggccacugacgaaauacguguucuuuuauuaaccaaacaacaucuuugcucaaaucaucuguagcaaaucauuuagccugacugcuuuucuggaauccagagcugucuuucuaaaauuugugauguggaagcugucauuugcagaaacuuccagaaaaagaaagaauggucaggagaccauacugaagguauauauccagccacuuuucuaaaauauuuuauucuugcugugguacaugacagggccccccuggaaagggaaagugauucaagagggucuccuauaccugacuugagcgguaaaucaacaaacccuuucagcaccuacuaugugcuaaacauagauauuguauuucaucaauuauauauugcccguugcaaguacuuuuugaagcugcauuaacucucuuugaucaaaaacuuacuuuuuaagcacauccaaguguuucugaaaaguauucaaagaaaacacuaagguaaccucugcagaugccuugccgagaggccagucugcauuccccuugccaguggcucuagcauaagugauuagcagggggguuaagacccaaagccccucagggaaucuggauacagcaucugucaaucagaaccaagcccagauagcccaguuaccagaacuuuguccucuuggauaguuucccaucuagaaacaagauuugggugagucuccacaagucugccguuuucagcacccucguggauggucuggaggcauucuuuggguuguugcggagcauguguguauauuucaguguaguaguauccugccaaaccucugcaggcucuaaauaugauagagcacgguagucucgcaaagggaaugugcugcacagcacagaaaggagaugaaagguacaaggccuuggaguuagucccucuagaggccugaaacaagcccagagcaaagggugaccggauggcaaauaaaagugcacagcucaguaaauuaugcaaguucacauuacaugcuaguaugauauuggaacggcauaaagcuuugcgcaguauuaagacauucuguuucucaacuuuaaaaucuuaggcuaucggcauuugagagaagaagcucuaucaggcauuucgcugcaagagcaauuuuauucuacugaauaauguggacuuacuuucucuuagccacuuuuuauuuuaggauaugaaguauuaauagguauauaccaaauguaacuguauuguccuaucauucaguccauaccuuucaggugaucucuauaggcugaucuugaggugaguacauuuuaaguuauuagaguuuaaaaacucaugauaaccugaucaggagguuguguucagcuuccucuuugcaaauaugucuuugcuaccguggcuggcguguucccucacuccuuaacuccagcucugcaauuauccugacuuguuuuuaaaccauugcauguugcugaguguuugcauacagcagcgauguugcgcccucugagguuuuagucacuuauccucauuuauaucccugcuugugucccgguagccaggagagaaugcagauguggaaagagcaggagagugaguuccaguuacugcaggucagccugaauuggcuugucuguucuuaaucgaacucuggcaaagccacuccagguucuaaucuauguggaccucuauaacagaaagcaagugaaaucgagaauuacagucaugcaguccacgacaaaugaaaaucuauguuacuaccuuagugccacacucacauuaaacggccauuuccaaauuuaaaguaauagcacagaaguggcuucuaccugccuuuauaaggacagcgcuaguucgaaaauuauauccaaaucuccaaaaauuaccuguaaagguuacaacuaccagagacaggaagauuagcuuagaaauaauaaaacuuuacucucuccuuauuccucuucucuuuuuacaaugcaaucucaucacagguucuacaugaacaauaaaagggggacauuuuuauuuccccuuagauuucuuuuacuuaaaaguucuaaaaacuguuguagauaacaggcuuuucugcugucuccuuccagugaauauguggaagaguuuagaacucuucagaaaacuuccuacuuuucacauacacucaagaaauucugagaguuugaaucagcaugaaccuuuaagugauuuuuuuauuuuuauuuuuagacagagucacgcccugucacccaggcuggagugcaauggcgcaaucucagcucacugcaaccucagccucccggguucaagcgauucugcugccucagccucccggguagcugggauuacaggcacgugucaccaugccuggcuaauuuuuuguauuuuuaguacagaugggguuucaccauguuggccaggcuggucucgaacucuugaccucaagugaucugccugccuugaccucccaaagugcuuuaagugauuuaagaagaacuugaguucacuuagugccugugccccauugacauagucucugccugaugccccauggccauucguugagugcggacucucaaaucuugcacaauuacgggugcuuucugcaaaaggaugguagggagaugaaggguuugggcuuuuuauucugacugccauuucuucucuguacucuugggaauguuguuuaaucccucaggcucaguuuccucaucuguaaauggggacuggagauugauaacgguauuugacucaugaggccaaugugaggcuccaugagauauuggcacuaaagccaccaucaguccgcacacacuagcucaguguacauccguuaaugucaguuguggcuauugcaaugauuaaagauuaacacggccauaaagcgaaagguagaauauugaauguucagauaaaauaaaguucaccuuuaaaacaacagauguuuaaaaaaaucaagauuuuccaccuuuuacuucuugaucuuacaugguaauaaugcaaguaugacagcgcaaugcaguaagcguaagguugauaauuguggcucugcccagaaaucaggggugugggggccaguaaauagaacagauacugaaaaacauuuguggguuuuaugccguagugcuauaaaguugcauaguaaaaaaaaaauaaacuauaacuucaaacuaauccuuuuaugccagcaugcuguaaaauauuuagaggauucgggcuggcuuuagugauggauucaaugugccguggaguuuuguccuuucccaaacuuuagcugcaauggcugaauucccaccacaccaucuguuccugacacuuggucucauuaguacgaguauuuuuauugauacacacaguaaugcuucucauaccaucuuagcuaagcauuauuuauuguaucuauauauacaacaauauuaacacagucaagcaccaggaucgguacuugagggcaucauuaaaaucagccaguguucagugagagacuuaaugauggauuuaauaguauuaaaugggcaaaaaugcccuuggccuuuacaugcucauuuaaaaacauauaaaagagcaguaauucaggcaguuauacuucucucaaagauuuugcucuaaaucacagauggcagcgggaggccacggcugugugcuggcucacaccccacucacuccaaccgaagccagaagugcucguugggucauaauuagcaaaccacccgcaaacucgacucuuuaaaucagaggccagugacugccaggcuggggcauagacgggagaaaacaagcagaaauggucaaggugcucucuggagccugccuucggauagcugugacccccacguuaggcaucaagacaggguuccacaccugcgccgccaccccugcagugugagcgcuguauuuugcuuucugagaaagccucacgguuuggcucuuuggugcaugaggcuuuaaggcgaugugcccccugcccagcuguugcccagcucccagcccuugccacagacagcauacaucucuguuuuagaaacaaaucauuuagucacuuaaucaugaauucccgaugauguacguccugcagaggucugagcuggggcugcuggucugaaagucuacguacuucugacuggagacuuaggcuaggcuggguuucaaauuuggaugaagacgguuuuggcugagcagggagaagaaaacaaacaaacgaacaaacaaacaaacaaacaacaauccgggagccuggaguuugcugagaggcucagcuuuggggagaucuggggcuggccauccuuggagucugcuuccuuaucagcaaacgccuccuaaaguuguuaugauacuucucagaacuagacagcauauaugaaaucagauaaugcacaguugugcacuacuuggugacauuuugguuaaugacagacugcauauaugagggcaguccuguaagauuauaauggagcugacguccuaucaccuagugaugcaauagccauuguaaugucacaguguaacacauuacucaccauuguggugaugcuggcguaaauaaaccuaaugcgaugccagucauauaaaaguauggcacauacaaaauuauguacaguacauacuauuucauaaugauaauaaacaaugaugucacagguuuauguauuuacuacauuacacuauacuuuuauuauuuuagagugcacuccuucuacucauuaaaaaaaaguuaacuguaaaacagcuucaagcaguuccucaugagguauccagaagaaggcacugcuaucagaggagaggacagcuccacgcauguuaccaccccugaagaccucccagugggacaagauguggagguggagggcugugaugucgaugauccugacccugugcaggccuacacuaaugugcugugccuuugauuuuagcccaaaaaaauuaaaaagaaaagcauuuuuaaugaaaaaagcuuacagaauaaggauguaaagaaacuauuuuugaauagucguacaguguuguuugugcuuaaacuaaguguuauuacaaaagagucaaaaauuacacaacuuuaaaaauguauaaaguaaaaagguuacaguaagaauaggcuaagguuaauuuauuacugaagaaacagaaguuuuuuaaaaauaaauuuaguauagucuaaguucacaguguacaguaguguacgauaauguccuaggccuucacauucacucagcacucacucacugacucacccagagcaacuuccaguccuguaagcuccuuucgugguaaggguccuaugcaaguauacuauuuuuaaaaaaucuuuuaugcuguauuuuuacucuaccuuuucuguguuuagauacauauauaguuaucauuguggcacgauugccuauagcauucaguauaguagcaugcugugcagguuucuggccuaggagcaacagaccauaccauauagcuugaguguauaguaggcuauaccaucuuaguuugugaagugugauguucacaaaacaaugaaauggccuaacgacacauuucucagaacauauccauauuguuauaccaugcaugacugcauaugaaaugcuucauacaaagcuuggcauucauaauuuuaauaaguuguuggccaggugcggugccaugccuguaauuccaacucuuugggaggccaaguugggaggacugcuugaggccaggagcucgagaccauccugggcaacacagugagaccugucucuacaaaaaauuaucugggcauggcagugcauguagcugggcaaggugguacaugccuguagucaaagcuacuugggaggcuggggcgggaggauugcuugaguucaagaguucgaggcugcagugagcuaacuaugccacugcacuucagacuagguaacagagugaggcccugucaccaaaaaaaaaaaaaaaaaaaaaaaaguaguugaggauucaggccacugguucugccuucuuuuccagacacccuagaaaucaugaaaauggaaccagaaugacaguauggcugcccucucccagaacuuccaccaggccucucugcauccccccugggauuaaccugcauggauggcagcccagccucuuccugccucuggccucaggagagacuuucauuuuggaacugcugacaaucacaucaagaacaggucaugucaggagaggcugggaaugauauugcucgaggauucggaggcugcuuccaugggaaguuacagaccuaacugaguccuucucacacuucuuaaaggcuuucaggaaaaauaaacaucaguggcauaagcgcaagcucugcaaauuaaaagauggcuacaaaaugaucuucuuugcauuuuaagcaaauuacagaaucauucaacuaauuucaacaaugaaaggaauguagauccagugaaaauuacacaugcauggacccuggugaugauaccuaaaauuagauuguugauggcagcuccugcaaaaauaaaugcaaagugauugcucaucagaaaauacauacugaguucccaugugaaacuccugccugugauaaauucuuccaacgaaaugacuacucaagcauuuaccaaccugccuuagaaaauagugcaagcuaauguuucuuguccaaaaauguguauacagcacagauaagaaaagaaaugugacaguaacagcagagucuugaacuggcugaaaagcccauacaguaagugcuauaaggacaucaacuaggaacugggcuaacgugguaacuagugucugacagcagcacccacagcaagacaacucaaaauuuauuaauaaaacuaccacaggcuuucaacaucuacauacaaugggccuaaggcuuuguaaucuuugaaugaaauacacuacagagaaccuccuagugaaugaaugaaagaucuaagauuuucuucucuuugcaaaggaacccugagcuguauucaugcauuugaggauaagauguuuccuuuauggaggaguuugcuuuuacaauuuuauuaucaauauccauuaaguagcaacugaauuuuauagcagguuucaaacaggggcaaugucuggagauauguuugguugucauaacagagugggugcuacuggcaucaaguggguagaugccagggguacugcuaaacauccuacagugcauaggagagucccacaaccaaaaauuaucuggccuaaaauguccauaguccuaaggcaaagaaacccugauaaauauacaacaaucuacaacucugauaaauguacggugauuguacucuggguauuuacucaagauaaaugacaacacacguccacacaaaaacuugcacacggcauagcuuuauguacaacaacccaaaccgaaaacucgaaauauccauggcaaauaaacaauggauaaagaaauuaugauauacccauagaauggaacgcuucucagcaacagaaagaacgaagcgaguacacaaaacaugaguaaaucucaaaaacaguuugguaaguaaaagaaaccaggcacaaagaguauauuccaucuuuuucuagacaggugauguucuagaacuggccaugccgaacuaggcuauacagaccacaggcacuucagugaucauguuggccuggggauaggagaguaaggguugagguuccucuucuuuuucuuuauucaagauggaaauguguugaaaauuaguugguaacauacaguugucccucgcuacccuuggcggauugguucuaggaccccuguggauaccaaaaucuacggaugcuuauauaaaaugauauacaaugguguguuuccauguaauucuccuauguacuuuaauaaauaaucccuagguuacuuacaacaccuaaugucauguaaauaccauguagauacuugcuuuauugcacuguucggggaauaaugacaagaaagauagucugugccuguucaguacggaugcaccauucuuucccuggcgccugaacguuuuugaucugcgguucauuuaaccugugaauguggaacccacaaauacagagagccgacuguacagucaaccuucauuauucacggauucuuuauuucugaauuugcccccucauuaaauuuacugaugccccaaauuucauacucacagugcuuuccuggucauucauggacacgcacagaauggugaaaaccaugacuggcccaaugugcauguuuccagacaaggcugaaaaaggugacacgcugucuucuuguuucagcuuuccuacuguccuuuuugugguauauuuagugccauauuuuuugcaauuuuguguuuuucuuuuuuuuuuuuuuaauuuugcuguuuaaaauggaccccaggcaucgugcucagugcugucuagugaucccaagugcaaaaaaguugugaugucccuuauggaggaaauaagugcaucagauaugcuucauuugggcauggguuauagugcuguuagcugugaguucaguguuagugaaucaacaauauauguuaaauaaggugucuuuaaacagaaacacacauacaacaagguuauauacugauuggcugaugugugaucgaaggcucacagcaacuuaacuuugcauuuucccuagguucaguauuugcuaauucaguaugacucuguaaaacauaauaccaugaauaaugagaauggacagcauaugugagucuuuuucuagacacuauuacacagaacucugggacugaggcuagaggaucacucgaagccaggaguucaagaccagccuggguaagaagacucugccucuacaaaauauaaaaaaauuagcugggcgcacuagcagugcauguguguagucccagcuacuuggaaggcugaggugggaggaucuccugagcccaggagauugagguuacagugagccgugauugagcugcugcacuccaaccugccugagugacagagugagacucugucuuaaaaaacaaaacaaaacaaaaacaaacaaaacaacaaaaacucaaacaaaaugaaauuggcaagaguauaucuuugccuuagcaucuucggagcaaagcaauuuguuccuuuaucauuaguuaagcuacuauaggcuuuuuguggauacccuuuaucaagcugaggaaguuuccauauauuccuaguuuguucagaguuaaauauaucuuaaauuuugccaaaugcuuuuucugcaccgauugaaauauucauauaauuuuauccuuuauucugcuaauacagaaaauuauacugacugauuuuuguacguuaaaccuucuuggcauuccuggaauacuuuacuuauuauauauuucugaauuuaacuagcuaaguuuugugaaagguugauaucagacuaauguuagccucaugaaaaauauaucugggacauguuuccuccucauuuguuuucugaguaauuuuguacaugguuaauauuucuuccucaaccgguaacaucugagugacaccaucugaucacggugauaugguuuggauauuuguccccuucaaaucucauguugaaaugcgaugaccccugguguuggagguggggccuauugagagguauuugggucaugaagguggaucucucaugaauggccuggugcccuccccaugguaaugggugaguuucuagcucuauuaguucccgcaagaacuggauguuaaaaaaagaaccauggcacuuccuuuuucuccagcucccucucaaugugacacgccugcuccccuuucgccuuccauccugacuauaagcuucgugaggccucgccagaagcgaaugcuagcacuguccuucuuaaacagccugcagaaccccgagcccaaacaaacaucuuuucuuuguaaauuucccagucucaggcauuccuuuacagcaacacaaaacagacuaacacacauggaauuugggggaauuacaaauucaauuucauuaacacagauaggacuacacagauucuauuuuuugggguagauuuggucauuuuuaucuuuaaauaaauuuguacauuuccccuaagcuguugaaucuauuggcauaaaguuguuaacagcagcccuuuauuuauucuucuaauguuuguaauaccuguggugauguccucucuuucauugcucauauuaaucauucgcguuuucucuuuucuguuguuuagcccacuuagaacuuuauuaauuuuauugaucuuuucaaaggagcagcuuuagauuucauaaauuuucaguaucuuuguccauuuucuauuuuuaaugaguucugcuccuaucuuuauuauuucuuccuucuacuuccuuuggguuuaauuuacucuuuguacuugagauucuuaagguggaaacucaaggaaccugacguucaaccuuucuucuuuuucuguuaugaacauuuaaagcuauaagauuuccuugaagaacugcucuaacuacauuuuacauacacaucuucauuagggucaauauuuguucuaauuucucugaugauuucuucuuugacacauggauuuagaaauauguuguuucauuuccccauauugggggauuuuccagauaucucuuuuauuucuaaauuaauuuuguuuuggccagaaaacauauucuguauuucaguccuucuaauuuauugagauugguuuuauacccagaacauggucuauuuuccuuuugcuaugggucacauuugcugcuucuuuuucuuacaauuuuggaauggaugcuuaacauuuuggauguugguaaauguuuuucuuuucuuucuucagagacugaugaaguuuguuuugucgagaaauuagguuacuuguguaucaaagcuuauuuuuaaauuguguuaggguguagccaaucccuuuauucuagagauacuuuagcuguauuacuaagacauagcuaguaucucuacuuaaugcucuggguuguuaacagggucuuuccauuaaggcuugugagaauuuaaauguaucuuugcuguaugugaguucuggggauuguucaucuaguagcuccauggcaauuuuuauuugcauagccuuguggaauuucauauuaugcaugcaaggauuaguauucagcuaaagacucaagggguccccuauguagauuucuggaacucuuccucugaguaucuccacuuuaguauucugucuugcaaacuccagcugccuaggccuuuucauagucuauuuucccucaacucagugagacuucuaguucuguuuaaagcucugucucuucacuacagucuagaaagcagcucugaauauaaaucugagaugacuacaguagucaccuaauuuauuucccuucaugggaucaugauucuguacugacuguuuuccaaugucugaaaacagugauuucauauauuuuggguaguuuucuaguuguuuauggcaggagggcaaauucuauaccauuuauuacuucauaagaagaacuagaguaaucacucaaaaguacgaaccugaugauaucacucuccagcuuaaaacccuuccaugcugacuauauaauuugcugucuauacugguauauuucugaagugcuaaaaugcuaaccagaagaagugcuggugauucacaauagcaaugauauggaaucaaccuaagugcccaucaauggaugauuggacagagaaaaaguagugugcauauaaacacacacacacacaccauggaacacuacucagccaugaaaaagaaugaaaucaugucuuuugcagcaacaucccuggcugcacuggaggccauuaucuuaagugaaacaauacagaaagucaaauacugauagucucacuuauaagugggaacuaaauaaugugcacacauggacacaguauguggaaugacagacacuggggacucagaagggcaauggcuggggggcaggugggagggcagugagggaugcgaaauuacuaaugggcauaaucuacauuauucagaugguggauacacuaaacgcccagauuuuaccacuacacaauauacucccauaacaaaacagcacuuguaguccuuaaauuuauccaagaaaaagguguggggauaaugagcauaaaccaggaugaucacaggaaaacuagcacuucugucacugcuaaacuccucggcucggcuucuaggcucucauuacuuccccuccucauuucccucccaccuucauuccuuuagcuugaaugccucuacagugcuguauuucuuacguguagcaacucuccucuccuguucaucuaguaaacuccucuucugcccuccaggugguugaaacauuaacuuccucuaggucuacacggugcuuugcaccugauuuggcuugcaccucaugcuauucuauuaauuuauuugcauguugccuccucuucuagacuagguuuuugagaaagugagagaaaaaucaagaaaucuguuuuagaaaaauuaauccagaaacaauauuugugaaaaauuggauaaaggaugaggaacaggggcaauuuagaagauuguuuaguaucuauauucuuauuuaacagcagccuucagagcuaaagaagcccaaaggccucuuaacaccuaaucacccauuuauuccucuuaaacucucaccugcaaucaaaaccuauucagaaaaccagaauuuuaauguaaagaucucaguaugaagguuuuugguauuuuaugaucuaaacaaaccuuccaaagucuggugaggcucaaguuggcaaaccaccugcaaucuucccacuaaacuauauuuaguaucccacuguagcacccacugcaacugacauaugaauacacugugcuaacaaauacauuacuuaauacaaaacucuucaauuuauuacauugugucauaaauuuguuuugcuuuauaagaaaauagauuuuaacucaaaaaguuucuuauuuggaacaaaugcaugaagcaaagguuuucaagcacuggacaucaagcaaccaacaacuuaauucccaggaaaugaaaaacugaugaggcaagcuguaugacugccccagcuuacugcacuaagaacuucugggcuauagcacagggaggggaaaccaugagaaagcccagugaacacacugagcugagagucuggggagaacaaguugacuugaguuugcugcucaggacacaagagcggagauugcuguacagagagaaucuugaauaucugcaggucuuccuugaguauucagcagaguucugaguggcacaaguacaugaaaaaauaaccugaggcuagggaaagaaucaucugaaaggauuacagaaaaaaauaccaggugcuuacaaggccaggaacagaaauugugcucaccagccagacuguaaaaccuuauaauuaacagggcauuggauagagcacucaaaagaaucuugccucagaacuaggcaauaauuagccauagacuaaaugaugcucuuucucaccugacaaacuguggagacaaaacccaaaacaaucacacuauuuccaaguaacuuaacuacaucccagaacaaagcacagggagaucuguagaaacacaaaaaagcaaaacucugucuggguccaaccaaagauuaccagauagacagaucaccauacgugcaaagaagcaagaaagugcaacccauagugagaaaaaaauaagacaacccagaaaggccacaggugucagacuuauuggacaaagauauuaaacaguuacuauuuguaauauguauguccaaaaaguuaaguagagacauagaagauauaccaaagacccaaacugaguuuucaucuagagaugaaaacuauaugaaaugcaaauauacauugaaugcaauuaaugguagaauagagauuguaaaagaaaacauuagugagcuugaagacauaacaacagaaacuacacaaaaugaaauacagagagaaaaaagagcauaaguaaacugcagaaugacuucaugugugaucuaauguacauaaaauuggagucccuacaggagaaaggggaggguagaaaauauauuuaaauaaauaaugaaggaacaaaacuguaacauuugauaaaaaacauaaaucuacagauguaagagacucaguuaugauagguacaguaaacaugaagaaagcuacaaaaggacaaaguauaaucaaauugcucaaaaccagugguaaaagagaaacauuuaaaagcagccagagaaagacgaaacagagauuaggauuacaacagauuuacuguuggaaacaaugcaaguaagaagacaguggaacaacaucuccaaaacauggaaagaaaauaaauaacuccaaaauauauauaugacaaaaauauuugucaaaaacuaagguaaaauacagacauuuucagauaugcaacagcuggaaaaguucauaaccagcagauccgcacuauggaaaauguuaaaggaagcccuugaggcagaaggaaagugcuaacagacggaaauauaaauauacccaaagcaauaaagagaacugaaaaaugguaagucuauuaaacauauuuuauaauuugaauauguuuaaaauauaauugauuaguuaagaaaaaaauuauauuuuuggaguugauaacauauacaaguaaaauguuugacaacaauaggaaaaagguggcuggggaaggaguaaugaagaauugcaagguucuuacacugaacaugaagugguaaaauauuacuugacaguaagcuaaagaugucuacuauaauuccuaaagcaaccacuaaaauaacaaagcaaagaguaauagcuaauaagacaacaaaugagauuaaaugaaaacaaaaaaauaacucaaugcaaaagaagacaggacaagaggaaagggcaauaauuauucaauuacauuaaauaauugcauucaaugcuaacugcauugaauuacauugaauguaauuauugauacgguuaggauugucuauuuuccauccuguuuuuauuuauccaaucagauaaauaauaaauaauauauguaaacacuauaaaaucccaguuaaaagacagaaaugagcagacugcauuaaaagaucaagacccaauuauaugcuauuuauaagaaauauacuguaaguauaagaaaaaccaaauagauuaaaauaaaaugauagaaauauauauuacaugcuaacauuaaucaaaagaaagcugaauuggcuauauuaauauuaagguagaucuuaacgcagccagggauaaagaaguuuauaucacauugucuaacggaccaaucaauaugacguaaaaaucuaaaugcuuaugugccuaacagcagagcuucaaaauacacgaagcaaaagugaauacaacuucaaggagaaauagacagucccuuaauuauagucagagauuucaguauccugcccuaguaauugauagaauacauaggaagaaaauuagucagacuuuucugacuaauguagccuugaacaacacuaugacaccauggucuagguagaaaauguaaugaaaucuacagaaaaagcuacuaaaauuaauaaguuaguuucacaaaguugcaggauacaagaucaguaaacaaauauaaauuacauaucuauaugccagcaacuaguaaauauaaccugaaauuuaaagauaaaugccauguauacuaguaucaaaaauaaaacauacuuaggaauaaaucugacaaaagauguucaaguccuguauauuaaaaacuauaaaacacugcagagagaaauuaaagagaucuaaaucucuaaugguagaacagagauuauaaaagaagcacuagugagcuucaaggcauaauaauacaaacuacauaaaaugaaacacagagagaaaagaauagugaaaagagaaaaaaagaauauaagugaacgguggaaugacuacauguguggucucacauaaaauuggaguucccuaaaggagaagggggaggguagaaaauauacuugaauaaauaaugaaagaaaaaaagacccuuaacauuugaugagaagcaaauagagagacauaccauguucaugauuuggaagaaucgauauuguuaagaugccaauucuuucuaaauucauuuguagauucaaugcaaucauaauaaaaauccuaauaggcuuuuuauuuguguggaaauugacaaguugguucuaaaauuuacacagaaaagguguuaaaauaaccaaaauaacuugaaaaacaagaauaaaaucgaaagauuauacuauuugauagaaaaucauacagcuauagugaccaagacagugugauaccaguguaaggacugacaagaaccaaacagagaauccagaaauacaccacauaucuacaaacaacugauuuucagcaaaagugcaaaggcaauuaaguggagaaaggacaguauuucaacaaaugguacuggaauaacuggauacucaugugcaaaaguugaauuuccauccacacuucacaaugaaucuuaaacccaaauguaaagucuaaaacugcaaaguguucugaaccuaacauagaaaaaaauccauugugacuuuagauuauaccaagauuucuuagccacaacuccaaaaacaagaaccauaaauuaaaaaauguaaaacagaacuucauagaaauuaauuuuuuaacaaaguuugaaagacaugucuuuacaaucucuaaagacaagccccauacuuagagaagauauuugcaaaguauguaaauaacuugaauguagaacauauaaaaaagacuuuucaaaaaucaacaaugagaacaaaacaaccuaguaaaaaaggccaaaguuuuuugaacacaucaccacagaagauacauggauggaaaauaaguguaugaaaagaugcucaauacaaccaaucaugaaggcaaugcacauuaaaaccacaaugagauaccacuacauaccuauuagaauguuuaggauuaaaaagaucaaguguuggcaaggauguggagaaacaacaacucuccuccauugcugguagagauguaaaaugauauaagcacuuuggagaacaguuuaguggguuuuuaagaaaauguuaaacauacuccuauuauuugauccaaacauuccacuccuagguauuuaccccagagaagagaaagcacaaagacauuuuguguguuauaaacaugugcacaaauauuuauaauagcuuuuauguauaacugcccccaaauggauacaacccaaacguccucugacagguuaagggauaaacaaauuuuguuauguccauacaauggaauacggcucagcaaugaaaaguaaugaacaauugauccaugcaacaacauggauaaauuucagaauaauuacacagagugacagaagccaaacaagaaaguacaugcuauaugauucuacauauauaaaacucuaggaaaaugcagacucacccauagugacagaaagcagagcagugguggccuggggaugagugggguguguggagaaggguaggagggaucaauuacaaggggucugagaaugaauuuggcaaugauggauacauucauuaucuuaucaaaacaauaauaaugcaaauucuauagcaugaguuacuuacauauaauuauacauaugugauauuuucaccgguauauaccaaugugaaagcuuaccaaauuaucuaaauaugugcaauuuacaugucgauuauaucucaauaaagaaaugugaaaaugauacuuccuauuucuuccuaauuccaugcaauuuagacuucauacauguaauacuuucuguaagcucccagcaagguuucuuucaucaacaucagcuaaauaauuuggagaaauuuaucagaaauuucaaaguaugucaacuucaauuucuucuuguaauuucauagguuaacuuucuucucuaaccuuaguccaaaugcacuacaaaauauuuucucaugcuuucauuaaccuggucuucagugcuucaacagauuuuggugauuguaauauuuacagagucaacaaagugaagccaauagcacuacugauuggaaaggcaggggugggccccuaagcaagguaacccgcagaccaagcaggagacuguccugagcagauacuuccccacucugaagggagucucaaguucccacuacugaagcacagaacuuguacuucccauuuccuucgggacaaucuggaugcaggaggcugcugugcuaaaaaguuuucaccaugucacuagcuugacaucuacuuuuacgaccucucauucuuaauuaugucccugaaucccagcuccugagcucauguauuuaucuuuguccagaaaagcggaaauuguaaaaacaaauucuauagcaugaguuacuuauauauaauuguuauguggggucucuauuauuucaagucauuaaucagccaaguuccauuauuuucuguaagucaauccuuuugccacucuucccauaagcaccucccaauagaacuauuuccuuuguuaaaugcaugcauaugcagguuuuuacauguauauuauguaucaauuaucauauaauuacauaauuacuguaaucggauuuaacuguauaauuagaauguguaauuacauaauuaaaacauguaauuaccaaguuuaaaaaguuauggaaauuauuucuuuuaaaugaauaaugcauguaugggagacaaacuuucaaagcucacuacuuaggccuucuaaaagucauuuuaacuaaaaacacaauuuaaaauccacuaagccaguuauuucacaugacauguugaauaccuuaaacuuuuuuaauggauuuuuaucuuaagagaauauuagaaaccuucaagggcucagcaucuggauguaggaaaaggagacaaaaaggcagcucucuucaagugaucaugaagucugacugcauuuuuaaccuauucccacuuacauuaaaaguuuucuuggcugggcgcggugccuguaaucccagcacuuugggaggcugaggugggaggacuguuugagcccaggaguuugagaccugccugggcaagauggugagacccugucucuacaaaaaauuuugaaaacuuagccaggugcaguggugugcgccuguaguccuagcuacucaggaggcugaggcaagagggucacuugagcccaguaguuugagguggcagugagcuaugaucaugccacugcacuccagccuggccaauaaagugagacucugucucuaaaaaauaaaaaguauuuuccuagggugucuuuuuuuuuuuuuuuuuuugcagcuauuguaaaagggauucaguuuuugauuugacucucagcuuggucacuguugguguauagcagugcuacugauuuguguacaugaauuuuguaaccuaagacuuuacugaauucauuuaucaaaucuagaggucuuuugguggagucuuuaggguuuucuagguguacaaucauauuaccagcaaaaagagauaguuugacuuccucuuuuccaauuugaaugcccuuuaguuccuucucuugcuugauugccccagcuacgacuuccagugcuauccugaauagaaguggugaaaguggguauccuugucuuauuccaguucuuauggggaaugcuuucaacuuuuccccauucaguauguguggguuugucauauguggcuuuuauuauuuugagguauguuccuucuaugccuaguuuguugaggguuuauaugauaaaguguugcuggauuuuaucacaugcuuauucuguuucuauuaucauaugguuuuuguuuauaauuauguuggugugauguaucacauuuauugauuuguguaugacgaaccaucccugcaucccuagugaucauggugaauuaucuuuuugaugugcuguuggauucuguuugguaguauuucauugaggauuuuugcacuuauguucaucagggauaggaagugaaagaucucuacaaggggagcuacaaaacacuacugaaagaaauaauagaugacacaaagaaauggaaauacaucccaugcucauggauuggaagaaucaacaucauaaaaaugaccauguggcucaaagcaaucuacagauucaaugcaacucuuuucaaaauaccaacaucauuuucacagaacaauaaaaaaaauccuaauauucauaaggagccaaaaaagaggcugaagagccaaagcaauccuaagcaaaaagaacaaagccagaggcaucacacgacaugacuucaaacuauacuauaagguuauaguaaccaaaacagcaugguacugguauaaauguagauacacggaccaauggagcagaauaaagaacccagaaauaaagccaaauacuuacaaccaacugaucuuugacaaagcacacaaaaacauaaauuggaaaaaggacacccuauucaauaaauggugcuaggaaaacuggacagccacauguagaggaaugaaacuggauucuuaucucuaaccaucuacaaaaaucaacuccagacggaucaaacacuuaaaucuaagaacugaaaccagaaaaaaaucuagaagaaaaccuaggaaaaacacugcuggauacuggccuaggcaaagaauuuaugacuaagaacccaaaagcaaauguaacaaaaacaaacaaacaaaaaauaaaugagaccuaauuaacugagaagcuucugcauagcaaaagaaauaaucaucagagcaaacagacaacccacagaaugagagaaauauuugcaaacuauucaugugacaaagaacuaauaucuagaaucuacaaacaacucaaacaagucagcaagaaaaaccaaauaaucccaucaaaacauaggcaaaugacaugaauagacauuuuucaaaagaagauacacaaauggccaaaaaauauaugaaaaaauguucaacaucaguaaucaucagggaaaugcaaauuacaaccacaauagauaccaacuuaccacagccagaauggcaguuauuaaaaagucaaaaaacaauuaauguuaguguggauguggugaaaagagaagacuuauacacugcuagugagaauguaaauuaguaccaccuguauggaaaacaguauggugauuucucaaagaacuaaaaguagaucaacuguucaauucagcaaucccacuacaggguaucuauccaaaggaaaauaagucacuauguuaaaaagacaucugcacacauguuuaucgcagcacaauucacaauugcaaauauauggaaccaaucuaagugcucaucaacugaugaguggauaaagaaaaugugauauauacaccacaggauacuauuuaaccaugaaaaagaaugaaauaaugucuuuuguagcaauguggauggagcugggggccauuauucuaagugaaguggcucaggaauggaaaaccaaguacccuauauucucauuuagaaguggagguaagcuauggauaugcaaagguauacagagugggaaaauggacuuuggagacucagaggagggaaagaugaaaugcgggcaagggauaaaaaacaacacauuggguacaauauacacuacuuggaugacaaguucacuaagaucucagacuccaucacuacacaaugcaucuuguaaccaaaaaccacuuguacccuaaaagcuauuaaaauaaaauauauguauuuuaacaaguuuucuuaguguaauugacagcaaauaaugagcagugaugacuaguacaaaagucaucacccagcugauguuuugguaaauccaggaaaugguauaucugauucaaucccaugcuugguuucaaaggcaaaauguuacuuaaaaaaauaaauguugacuauauaccugcuugauaauaagaaacauucaccucucuucguuuaaguucaacuuaaagaagaaacauuuuugaaaagugagaaguguguuacauuggugguauuaugauaauaauucaagugugcuugaugcuggggauaaaaugacaaaucagauguguucucuggccuugcguuguucagacaaacacaugagccaauaaauaaaacacaaagagaauauggacaguaauggcuuucaaaacuuaaaaaaaucuaauaauaaaucauuacaauuuguugccugaggaaauaauccucaucauguaaaccagaagucaauuauugauuuuucugaccacaaucaacaccacagccgaguaugcucugugcaggaaaaucccuacuccucuucagaccugccuguaacacucuauacauauuuaaucauuaauaacauaacacuuauccuauugcuucacaauuauguauaugucuauuucuucuuuugaaugugaguuccaggagggcaaaugcuuagcgcaggaaacaucugccugcaggagucuuacacacacacacacacacacacacacacacacacacacgaugaaggaacauuugcccgcucuuuucauggaacaggaugcuuuuguuuuugucucuucacaucacaaguaaccagcacaucuuugaaaacucaacaguuuaaccuggaaauguucauaaagaucauucucaaaugacaacuuauucuuggacaaaauaagaaaugcaaaugcaaaauaaaagaaugugucccacagagaugauagaaaaaaaaaagagcagaacaguuauaguaaaccacaggcuaaacccucauauuaugcauugcaucagccaugauaaauaagguucgcauuugucagauccgaucaacuugguuucuaggguaguccaauuucagcagacugcucuagcacuaaucaucuugugaauucaucugugguagguuaauguucaauucauuaauuaauuacucccaucaacauucauugagcuucugucuacuacaugugaagcagcaugugggguaugggauaugcaacacagagcggaaaauagccccugcucucauggaauucauguuccaggaaaagggcagacacguaaacaagccuaacacugcaaaugcucagcucugcgaugggagugugugccaggaccccaggagcauggaggaggaugaggaccccugaacaaauucaaugcgaugcaccaggaaucucgcucccuauggcucccuauuuguuuccucuggggaaccacuccagacuugauggggggaaaucccaguugaacuugauaugacagagcaaguaacuuagaacaacacugauucugcagaaccuggacuagcagaccuacuagucacaggaguccuaucccuucuucauauaccugucuccacgcccccacccucauucaagauaaaacauucaccagcauuccucuuaaugcaucuuuguugggaagaugacuggagcccagcacaguguauggcaaacaguaggcgcucuguguugaaugcugaauacuuacaugaauaccacugagaauccacaguaaaauacauuuguguguuuugguuuuguuccaacagauuuucaucauuucugaagaaagagacauacuccuggaauguggcacauggaaacuuccugguuuaucaggaguugaucaugaccucuaagagcucaaagcucagcugaggcuuuugcagaacugggaagcauggcauucgucucagccuaaccccccacauucccuguguugcuugugugguguuacuggcgccaccagggcuaucccuugcauucaucaacagauaccgagagaaaguugcuguucccauguucaugaauugaaccugucacccaugaaugcacuuuuggcucaucagauuagcugguugucaccucauaaaugaggaaacaggguccuggauggaagaggauggugcauaggacaaggcagagaaaacggagugguggguggguugcugcauggucuguuggcucccgaagucuaauaagaugacagaaucuggaguuuggaaaggauccuggacucaccauguaccuaaugcaugaauuccuaccaacgcacccaguuucuguucuuccugggauggagaacugucacauccccuaauugaccauuuggcuuucugauaucucagcugguggaaaggucuuuuugauauugagucccaauucauaaauucuacuccgugguccugguuuuucacucugaggucaaaagaaccaaucuagucaccugaugcugugaucuuaguccugaaauuaagagucaauauuacuugcugccuugacaucugguaaaauaaggcaggccucaauuggccuaacugcaaguucuccccacacugccccuauggauaaagucuuguagcaaaacacccucuuuagcagggggaccaggcacaguuccugcuuaucgcugaguggcggguuuagcucccugccagccuguggaauuagucaaacaagccaaucacauccuacugugagaaccaggggucaaccuacccucuuguuacuacaaagcuggccucuggcaguccccgcuggcucacucuguuccugaauacaaccccucugugccccugagccccuucccaggcugugaguauauguaauuaauaagugccugucaaucucaucuguucauugucaggggcuguguguucagccauacccaucaccauaggguaggaaucccucccucgccaauggggugaaggggaggcaaccaaaauagcuacgucuuagaacgaggcucugggaaccuuagaagaguggguuaaagagaggccggaagaacucuguuugauuagaauuuaaaauucccauuuccucccucuuuccaccuuuccuaaacaccacucucaagguuuucucaagugacuguggguauggaagcugauguaacacaauggcaggaaacaagaacaagaacaagugaacaaggcagaaucaagagagccauacuuuaggaaaagguauacaaagaaauauucugggaucccaggaccaucaaugacaguaaacuuacucuagaaaauaagugucauuauucacuggauucaccagcacacucuauuguucuuacuguaguucuuuggcuaccagaugcccagguaccagaacucuauuugucucuguaugaaaauacagagugaugaacaagaaaacuagugauuacaacuaaugcauguguucuaguuacaaacacaaaccugccccucccccuccucugagcuaauggaugaaccucaaucaauacacucaggaaagacugcagaaucaauaacaaggcuuauuuaacagaauuaagaaguggcuuuuuaaaaaacaaaagaaaaaaaaacaagaaaguagacacaauugcaauaacugcauucuuauguugccuggcaacaagauauaaaaaugauguacaaugucagugacuuauuuucacauagagaagcagcccccugccuuggcaaugcuauaauguacuuucccccaacuagaacuccacagagacuauuaaugcuaccauuuuccauaauacacuguuaaacaaucauguguuuuuguuagugcauuaaaacacugaauuuacuuaaugacuacucagugaggcagcggcuacagaaaagggaggaguuuuuguuuccuuugcaagcacaggaguucguucccugggcaggagaauuuaacagguagcaauggauaugaaucaaagcacuggaauucacauaccuagagaggaaggugcacucuuacgucuuuucaagggaaagcagaaaaugaagucgaagugcaguauuaguguuccuugacuuuaaaaaauuuucuuuagaauaugaaagaaguuucuggaaggcagaaagccuuugagguuccaagacauauacuuggacaugggagugaagguucaauagaaaaggaaagugacagcagagcgcuuuagcugagaagaagagaagaacaaggagcggcuacagaggcacccagcucucagggucuacggggcaagcccucaacgcggggggcuggcgcuccuacugcagccugcaccucuggcaguggggagggggcacagguuugcacccugcugggggucacacauacauuagcucauuucauccuucuaugaaagcccauucaauagaagcagaaaauagauucaaugggauuaggugauuacccagugucugucggcuagugaauuggaaagcuggaauuuaacacuaagccugucuguccucagagccaccacacaccuuugccuccauuggcugucacuaauuuccagcuguaggggauguucugggauugcugccauuuagugcccauggagcacaaguaaggaggaaagcuauuuccuccaaagaagcaauaaaacaaauaaaaaacaagaaaccacuuuccugaugagucccacaucccacugcgcuguauuuaugugcacauuuguuaacuugcacacuuccaugauuuuuugcaagcuucuuacucauuguucacuaacuccuuugguacagggccagguguuauauuuuuauaagaaauaguuuuaaaacaacuguuuucugcugaauagagcauuuuauucaggagaccuccaguaaauacugauggacaacuuguggguaagggaaaggucacuuuguuuuacaaaaucuuugggaaaaggaaucugucuuauucacagugcuaucuucaacaccugcacuggacuacaguaagugcucaauaaauagguacaaaaucaacaucaugcacucaggaauuucaaagucuuccugauaugcugauggaccagugauuuuuacucaggauccuugggggcuugaaccaauacugguaccucacagccuaacugaaaugagcaaaaaagauggauaacgugaaguggaaugcugugguuauggaaagggcagacaauuauaggcaaagacaacuugaugucagcucagcauccucccgguugcuaugcaaccccagagaagucccuugucuuaccuggccgcuuuaaccucaccacaccuguucccccaucugagagauaauuacaacacuuacugugucaggcagucaacaaguauuuauggaaugcccacagggcacagagcaauaaaccuauugcuuacuuaagccaggaaaucaagcuacagcaaagcagaggauuaguacaaauaccugggcaaacgugccacccgcagaagcauuagguucuuaaauccuccagguaauuguggucacacauuagucuuggcuuuagggccuuuuaaaguaguaucugaaauaucuugucuauccacuuuaguucaagugugugaguguguguguguguguguuggcuuuccaucuccgcuuaacaaaucaccucaaacuuaguggcugaaaacaacacagauauaugaucuuagaguuugaccgcuaaaaguuuaaaaugcaugaaaaccaaggugcuagcaagaccacguucuguucuggaggcucuaggggaaacucuguucuugcuccuugcaauuucucagggccaucacauucuuugguuuguggccccuuuuuccaucuucaaagccagcgacacuggacaagucuuucugaugcucucaucuuuggaauucucuuuccucugucuuccucccccacaucuaagggccuuuaugauuacauuguacccauccagauaauccaggauaaccuccccaacucaagguggaugauuagcaacuuuaauucccucuugccauguuaccuaacauauucacauggucugcggauuaggacaugggagggacgugcuuuucugccuaccacaugugugucuggcuguaauuauuuaucuauugagagcaaugaaaggucauucauucuauggguacaacucaggaccuuauguaagaucaucuauugccuucagaacuuuaugcucucaggaaggugauaaguauguaaaauauuaacaaccaaaaccaacccuguaguuugcaaagcacuuugacauucauccuuuugguuagaaccucucagcuacuuugcaagacaaguaaggaaacuauuauuaucucugaaucacagaugaguaaacugaggcacagagguuuuuugguuuuuuuuucccuuaaggacagaaaacagcauauucaaaccgaggcauguggguuucuggucuggugcucuuuauccuccccguacugcaaacaccuuuacaguaugugucauauugacauauguugccaaaagaagagauccugcuccuauuucaugaaaggaaaacagaugugagguuguucagaaacucaauaaagugcauaaaguaugccccuugcagagcugaggcaccagauucucccuccauuaauucagucuuaucccugauccaugcuugcaaagcaagagacaagggaacgaaaggacagaaagaauuucuacagguugagucaccauuuggacgcagaacaacguggcaaugugggcacuucaugcacacaguuaaaauaagucacacgcuuuaugucugcauauuuucuuuguaugaauaaaagaaugcagcuguacgauggccuuggccuuguguggacagugguagcuacguaccugaacacagacaaugagagaaguugagaacuuucauuaaaauauuucagucauguaagccaaugagcauuauuuuagucuccauaaagcugcauuguuucaauagagaauccaaggccagaaaugugcucauucuaggcacaaucucacaguuuguccugaugucuuaccuugagggggugugggcaaugauucuugugcccaaugcaaagagaugcccugaugauuaguguaagguggccaauccugaugaccagguucagacauccagagccugccagccagcaaaucaggcccuacauuuucucccucuccauuuuuuccuuuccuuuccagaagcggucagcuucuagaagccacccacaguggccucuacaaauaagauguuacuucugaaguaagaucauugucuuccuuccgauacccucugacgaaaccucugaaggugaaacacuagcagaggcugaaaagucaugaucaccugcugguaaugccccacaaaggcacggaggacacacgugcugagcaguaccugaugcagcagccucuggagauaagacuuuccccagaauccccaaauucucacguacacggcaucguccaugacucugacagucauauugaugacagauacgaaaaaacauggucguugguaucauagaggaaacuacauaaauguaaaugcauaaagggaagucgagugugacucccuuucuuaauugucuaacgcaauucccacuagaugcauaaauugcaguuccuauuaacggcacuaugaauaauaaucgguuuacuuucugacuuguaucuaaauauacuuucuauaugauuucaucuuuuauucagcuguuuaaaagcagaacaucuaauuacaguuccuauuagucaacauuaauuuuuuuucuuuuugccauggagcaugugugaugacugauuuucuaaaaacagaauucuuuagcauauggaacaaaucguguuauuauuaaugcauucccagaugacucugcauaucaauucucuuaauuauuuagucauugcugauuaugucuuuuuauaauucauuacccuauuucucgcagugcaggcauuuuauucauuaagugucaaaaugaagggcuugaccuccaaaaaaaaaaagauaaucaggaaauaccgacacaguuuuacaagucugcgcuucccuucuggaacauuuucaugcugugugauaacaugcuuuaaacaacuuuuccaaggacaucaguagguacacaugacaggguugcaggcagagguuggagggacgucgagcaggggaggcuguggaguugcucacacgagguuuuucuaaagaugagacggcaccaguuccaacuacagcucaaucacacugccauguucucauucuaaacaaaaaugccauuuguguaauagauuuuuauaccaguuuuauucaaaagcuaacaggaugcuuccaaaagagcucuuuaaguaguaguacugggaagucuaggauaagaaacauuuacuaaauuaaaagaggacuaggucuuaauaagaauucacuuugccuucaggcugauccuacugaaguuaugaaaccugaccuggaguacauaacaaggccuguguacuacgauccucaugcucauguuggcucauuauuucagugaggucugugcaccuugucugagaccaaauucauuacuuagaaaaggcaaauaaaaaauaugaaaaagaaucaaggaagcugagacugugaggagauuaaaggagaacaaacacaccuacuucuaccugguuagagccuucucuguaucuaagaugucagcuucacacagauggaauuuugggaagaaucuccccaggcuuccucaacaacucugcuuuauuuguaaccuagaugguagccacuacaguagcaaagaucacagucacauagaacaaaacaguucaccuguuuauaaagugcaccuuccagcuaaacacauggcugcugacccuaccaaguugaguacuacugagcaaguuguucuaaugaaacccauucugucuguuuucugacuaagagcaaacaauagaugccaaauacucaaagaagggguguaccuaggcacagccaaccuugcaauggagggguccaagaagaguguuaugaccuucagcucaauacccaccugagggucuacaaggguugaagcugaagaggccaagaaagaaacuuucuugggggaaaguugcuguaguauguggcauuuuuccuccccuaucuguaguggguaaggggaugacagauauuucuuucucaccucuagccuaaguaaaagagcuucuaaucacacaaaccaccaccaccaccaccaccaccacccucaaaggacuuuauauuuguucugggggcuuggggauaacuaacugaagccugaaaaagcccacaggggaaaggcaacugaauggccugagauauagcacagaaggguauacuggaugugaacugcacucccaccuacagagagacaaaauauacuacugcaugcagaagcugaguuggagcacgcauagggaaggaagggcagguccuggggaagauugaaagggaggcacuaccuucaucaagggagcuacagcuugacauucacauggggaaaaucuuucuggaaccaugaaaacaucccacaagaaaaagaacccuccaaucuccaaugccagcucacaggaauagccaaguaagauuguuccagccccuuaccacucuuuuaucacacuagcuccggcuccuggaggagccagggccccagcuaaaaaauaaaagaaggagaaauacaaggcaguggaagagagaaggggcaaccaugucccuccaccccucccaggauuacagcccaaagaaggcccaagguggaggaaggaaaaacuugaaguuuagagcuuugacuaugccauaugauuuggcauuuuaauuauacuuuuuuuuuuuuuugagauggagucucacucugucacccaggauggagugcaguggcgugaucuuggcucacugcaaccucugucucccagguucaagugauucucaugccuuagccucccaaguagcugggauuacaggcguguaccaucccccccggcugauuuuuguauuaaaaugacacauuuuugucacuaagagugacuggagaacuuuuuuauuauauaacaaugucuagaaacaccauggaagcuaugagauuucauccaggggcaggggaggaaguagcccacaaaaaaggucuagagagacaaugagaagaaaaauagaguugcuuuaugaucaugaauuguucagucuuauuccuuggauguaucaguugcauuuuuuauuauagcaaaauauaacaaaauuuuaccacuguaaccauuucuagguguacaguucaguuuaaguauguucacacuguuguacgaccagcaccaccauccaucuguagaacuucuccaucuucccaaacugaaacuccauacucauuaaacaauauguaaugauugcauuuuaaugagcaaauagaagaauucagcacaagucccggcuccugccuuuggcacuuacuccaugcugcugcugcuguuuuacuuuuacuuauucaauuucugaugcucuuauuuucuuuguguagaucugacuuucugacuauaucauauuccuucugccuaaaaaauugccuccaacauuacuuguagaguauguccacuagcaauuaauucccucaguuuuuguuugagaaaguauuucuccuuaacgucugaagcauauuuuugcugugcauagaauucuggguugagaguuuuuuuuuuuuuuccucuuucagcauguuaaagaugucaccccacuguuuucuugcuuguuaguuucugacaagaaguccgcuguacuacuuauccugguuccuucucucucucucucucucucuguguguguguguguacauggauauuuaccuugcaagguauccucuugaguuugagcuucugggguaugugguuuggugucugucacuaauuuuggaaaauucuuggcccuuauuucuucugcccugcugucuuuauuuuccccucugugauuccaguuacaugaauguuaccauuugauauuauccaauaggucuuggaugaucuguucuuuuuuuuuuuuuuuaaaucucauugcauuucaguuuggguaacuuugguugacuuaucuucaugcucacugauuguucaaugauguccagucuauugaugaacucauuaaaugcauucuuuaucucuguuuuccauuuuaaaaauuuuuuauuuggcucucucuuguaguuuccaucucuuuggcgacauggccuauauaaucuugcaugcuguuuaccuucuccauaagagccauuaacauauugauuguagccauuuaaauucuuugucugagaguucuaacaucugugucaaaucuaauucuacuucugaugacugcuuuaucccuucagacuguuauuucuugcuguuuuguaagucuuguaauuuuuuguugaaagccaaacaugucaucuaggacaguggauuccagguaagcacauugcaugcuuggagaugaggaugccuuccuccucuguuaguucuucaguguggagguuucuguuaauguggucaggagucuaguuguuugugaagacugcuaucugcuuggcuaugagugucccuccuuggcuuugggucucccuuugcaugguucuccaaguuguauuccacuguuauucuucucaaagcuuguuaguguggugguuggagaguggaggagagaagaugguaucugauguuccgauuaagccucagccucagguaggcacucugaacaagagucuuggugguguguccuucacaaguguuccugagcuuucuccagauauaccguaauguuagguagcacacauuccugccccuuccccauggguagaguuuuuuguguucuucuuuucuccuccucuggguacagugaguuuccaccaggaaccucaggauacauuuugguugcccuuccuccuguagauuagggcauuuguuucuuaggaaugacagggaauaugauucugaguugaauauugcuagugguugccauucuucuuccccuucucuagagggauccaccagugcccucaggcugcaguucuguauccuuccugaagauuaauguucuagucaguaggagagaugaaggacauggguucagcuagagguucugcaguggcugcuguucaacuuccucggucaagaccacaggaaaggcuucucgagauucucccaggucuucccuuggggcaccuggcagaggagacgccuacaacaaaguacaaaccuccccgggucugccacccucuccugcgagcccauguucagccuuuagcaauuuguuuaaaguuucuagccagaucuucuuacuggcucauacggucuugugugguguuccccauguaagcaaauguccaaguccugcuucuuccugacacgucuaucucucuucauauuucagacuguuguuuuccaugcuauuucagaucucccaaaggaguuuucuguuucuuuggcuuuuuuuccuguucuaagagggggauuacugcuccuuccagauuacugccuuuagcucugaguugaaauauugcugaguuuuuauuuuguuuuguuuuuagagauggagucuuacuauguugcucaggcuggcuuugaacuccuagguucaagcaaucuuuccaccuaagccucccgaguagcugggacuacaggugcaugccacggugcccagccuguugcuguuuuaucagcacuuuaccaaguugugugcaaucuuuaaucucugagcuaaacaacuagccugggucaagcacauguugcagcuuccauugucggagaagaaaaugaguuagaaaacuuauuacuguauuuacuacauugaauaugcaugaccaauccuucauuuucaaguaaucacagugucauuauaaacucuaaauucacucagaagugacuucuuaucagaaguaaaaaaacaaaguuuauaauuuuagaugccuuugccuucuuaugaagacauaugcagaauuccaucucugacucguuucuggacccuggaaauaacuggcuuuuuauagcaauaacucaagggacugaauauaauuuaaaaguaauauacccaauacagguugagcauaccaaauuccaaauuucaaaauccaaaaucugaaauacuccaaaaucugaaaguuuuugagcaccaacaugaugcucaaaggaaauguuuauuguagcauuuaggauuuuagauuugggauguucaacugguauaaugcaaauauuccaaaauccaaaaucuaaaacacuuacacucccaagcauuucagauaagagauacucaaaucauuaaaguacuuauugagacuauuaggugggugcuacaaaaucauuucccgacagaaauguagggaaucucauucuaaucaaauuaaaacuguacaucaaugaaaaauacaacguugaaaccgacaauccuucauccaugguaaaugaaugucaaucaauuuccccuccugugucuuuguuuaaacgucuauguaaagucuggagauuuucugagccuaucucuuuggcaacucccacuauuuuaauucacaguccuuucaaguccaagcaaauuucugaguuucacauugcucuccuaguuggauaaaucuuuauauagaaagcacuuacauuucaguaggaggguuuagucauuugucaauaaaugagauagcugguucaagcaaucuaccaaguuuauuucuaugugaaaauacugcuagaaguuagcagguauacaugaucuacaugauuuuaaauucuuugugaauucucaaaauaaaucuuuagaaauauaguauacuagaacauguauuauaaaaauuacuuugccuggguaaucuaauucaucauugggcauacuuaguauagccauauauacauacuuauaaacacaacuuacagguauaaguugacauaaaugaacauaaacugacaaucaacuaagaaggcaaagacauuuaaauaagcacauuguauuuaaagagauaaaaagcuaucaacuaccuaucaaaugaauguuccaccaggggguguaguaugcauuuauuaugucugcagccaauuuaccuggcguaugcaccuaaaaacaguugaacaaaaaguauauuuuuguagaaugauuuaugacgucccacuggcuuucauuuuuauuccaaggaagcuuugucuguauauuuuauugcuuuucaauuaaauccaaaguuauuuccaacacuuuugguuuucaaauuaaagcuaaguuguaaagaaaacuguaaacaaauaucuagauucuucagggaagucugcuauuaaugcuagauuaauucuuuccuauagccaagaaucuuuuagcaaagcaauuguuucuuagcguuaaauacaaucucacaaauauucuacaaauggauuuuauagguugagauuuccuuuaaguaaagcucgucgcuaaugaaucuggaaauauucaguuauuuuaacaagaauaauagcagcuaacagucauuagucccaaaauaaaguguuuccuucaaucucagauuuacaaaauugguuuaccuccacaaccacauuugaugaaugaaaacauuuuauuagauauguugauucacuaagaugugcguauucacaaauuuauccagcaauagauguaacaagcauaugaaauaauaaaugagaacaguagcuuuuuuccuugcaaaauguacacucuacugacaucuauauugggucagcaucacccagccacuaagcaccaaagcuguuguugaacgcaggaguggcugaugcuaaggcucaagcucuggugaaaacccacacuguguggucaggggagccggagcuucugccacugggaaacucuugguuucuccugacucuccaucuuuaccuucccccuccuggggaagaggacagccuugccuguuguugcucuuacuggggguaaugugggaaggaugccuccaccaggaggugccagucaucauagagcuccauggaaggcagcacagcacaggcggaugcaaaaagaauccaacauuucgagaugcauuauucaguaacuagguuacacaugaauacacacucaagaucaauuuguaaggaacuaucaaaggcacagucaugcaucgcuugacaacagggauucauucugagaaaugcguuguugggugaauucgucguugugcaagcaucauagagugcacuuacacaaaccuggguggcacagccugcuacacaccuagccuauaugguauggccuauugcucauagccuacaaaacugugcagcauguuacuguacucaauacuguaggcaacuguaacaccccugcaacacacggguaaguauguuguguaucugaacauaccgaaacauagaaaaggugcaguaaaaauacagcauaaaagguugaaaaugguccaucuguauagggcuuuuuccaugaauggaguuugaaaaacuggaaggugcucugggugagucagugagugagugcugagugaaaugugaaggccuaggacauuaccguacacuacuguagacuuuauaaacacuaugcacuuaagcuacacuaaauuaauaaaaauauuuuucuuucuucaauaauaaguuaaccuuagcuugcugcaccauuuuuacuuuaugaacuuuuaaaguuucuuaacuuuuugacucuuuuguaauaacacuuaaaacacaaacacauuguacaacacauuguacaaaaaagucuauauccucuucugugaccuuuuuccuauuuuuaagguuuuuaaauuuuuuucuuacuuuuaaaacuuuuuugucaaaauuaagucacaaacauacauauuagccuaggcccacacagggccaggaucaucaauaucacugucuucuccuccacaucuuuuuuuuuuuuuuuuuuuuuggauagagucucacuccgucccccagacuggaguccaguggcgcaaucuuggcucacugcaaccucugccucccagguucaagcaauucuccugccucagccuccugaguagcugggauuacaggugcacgccaccaugccugucugauuuuuguauuuuuaguacagacggcguuuccucauguuggccaggcuggucuccagcuccugaugucaagugaucugcccgucuuggccucccaaagugcugcaaucacaggcuugagccacuacaucuggccuccccuacaucuuuucccacuggaaggucuucaagggcaauuauaugcaugaaguugucaucuccuaggacaacaaugccaucuucuggaacaccucuggaaggaucugccugaggcuguuuuacagguaacuuuuuaauauauaagcagaaggaauaugcucuaaaauaacaauaaaaauuauaguauaguccagggguauccaauguuuuggcuucccuggguauacuggaagaagaacaaaauugucuugggucacauauaaaauacacuaacacuaacaauagcugaugagcuaaaaaaaagaaaaaaagaaaaaaagaaaauaaaaagguccgugcauaaaacucauguuuuaaaaaaguuuacgaauuuuuguugggccgcauucaaagccguccugggcugcaugcagcccgcagauuggaccagcuugguauagucaauacauaaaccagugacacaaucgcuccuugucauucucaacuguucuguauuggacauaccuguaugugcugggcuuuuauccgacuggaagcacaguagguuugccgacacuaacaucaccacaggcagugaguaaugccuugugcuaugaccucgugaugaccaaaacauuguuaugcggcacaugacuauuucuaagcucacuagggccccucgugucacacaacaggcauuugagagccucagucuaacuucucacaagcaaucugcagcuucucaccaaugaagaaacaaaggcagccagggcacaaccuuucauuuccccaaggcugugagaaagaggugguauaaacacaagucuuguguccccaaaagaagaauuuauuccuucuuacauuuuggaaauauugauauuuuaaaaaaauuacucugugugauuuuaggaaugugagcugggcucugggaggccugaguuuaaacuccgucucuuacucgcuguguuaaccucucugcaucucaguuuccuucucuguaagacaagaugacgucacaagacgcuucauaucccugcgccucaaagaaaggcagucaucacgcaauacugacuuaaugggcccuucaucauuuuuuggggauaagagguccaagacacaucuuuugugggaagaugaguuuucccagugaugcuaagacacugggggauggggguggaggucagguuggggguggguuugggguagggagguggaggcacacauuaaaaaaaauugccaaaccaaauuuauugcugaucucauuuucucagcauuucuucuacauucaucaaauauuuuagccacugccuuuucauuucauuuuccuccaguugcacgugcuuugcuuuugauguggcacacacuuugaaaauacauuauuaaacagaugagccugucaccccuggagcuggcacucuguccccugcuuauucuuaacaaaucucucuuuguguucuuuugugcugaagugauuaaucauuuccacuauccaagggcugcugacaaucuuucuagauggcuccgcugccaugaccccuccccgcauccacacaguuugaaacaugcuaggaaucugcugcuguucccggggcuuuauucccaucacagugggcuccucauccauacgguaacuagccaaccuccaaaagagcuccgcuuuuauuucuugccuuuuuccagaguucggggugggggugugcgugaaggggcuccuggcgacuucagcaggaaaacaaggaaacuguaaguuaaaaagucagaaugauaaaugcuuauuuuguagaccagacaggagguuuuuaucucacugucuggacagaaccugcugcaccucauuuuucugggcaguauccuccucuucacugcacuguggcuggguuuucuucuccccuucaugcuuucccucugguuaucuguaacaaaguuuucaaauggcuccauauugaaagcccaggcuuugacucaccaggcucucaaucuguaaucugguuuccagagcugcagccuagguagguuuugggaaguugaucuuuuuuuaauaaguguuuacaaacauuuuuaaacuaacuuuaaagguacuauuuuaaaagccuauccuuccccaaccccccgcccgccccaagcaugcacuguuaaacugaauucaaaaacauguucaaagaacugaccaaaaauaccauuaggucacaaguuacugccagagaagggaaagcuacaaugauucagaaaguauuaauaaaugugcagaaauaaguauucugauaauguuaagguaauuagcauagaaucccagggugauuuuuaaaaauaauauguacuuuacauguagaaauaaaucuauauuugagacuauugaaaagauauuuacaagcacuugaggaauaguuuuaaauuaauacauuauaaguguaaaauaagcaugcugaucauaugauuuuaacuagguuucagaaauguaauuacuguucauagaaagauacuuaaaaaaaugaguagucauauguucuuugcagugcuauucacaguagcaaagacauggaaucagucuccaugcccuucaacaguggacuggagaaagaaaacguggcacguguacaccauggaauacuacgcagccacacaaaagaaugaaauucugucccuugcggcaacguggauggagcuggaggccauuauccuuagugaauuaaugcaggaacagaaaauaaaauaccagguucucacucauaaguaggugcuagacacugacuacacagagacaucaggaugggagcgauagacaccggggacuaccaaacggcaggggcugaaaaaccaccgaucggauauacccaggcucacuaccuagaugaggggaucacuuguaccccaaaccucagcaucaugcaauauacccauguaacaaacaugccauguaccccccaaucuaaaauaagauuaaaauuauuaaaaaagaauauaaaauccuuuuuuuuuuuugagauggaguuucacucuuguugcccaggcuggagugcaguggugcgaucucggcucgccgcaaccuccacauccaggguucaagugauucuccugccucagccuccccaguagcugggauuacaggcaugcaccaccaugcccagcuaauuuuguguguuuaguagagacaggguuucuccauguuggucaggcuggucuuaaacucccaaccucaggugauccaccugccuuggccucccaaagugcugggauuacaggugugagccacagcacccagcccaaaauccuuaauauuuuuaauuccacagaaccacagaucucuaauuguuugaagucacaauaaaaaaggcacuaaaauaaaaacuuacuaaccaaaaacugcaauaauaaagaaugaacugcccauaggauauaacuuuuauaacuuucuaaggaauccaggggagagagaaauacacacacuugcauacauagguguaccuuauuaguguguguaugggaguuaugauaaauaaaauauaucagcuagugcuagcauaugauaauuccuuucaaaccuaguaucuggagacacaugaagagguccaccuacccugagcugucaucagaaacugaagcugcuuaggaacguagugcuggcagagggagggucucuagaguguggaggugcugcacacggcacuuuucuagaauuucugagguacaagugggcccaggaauggaguucugggccaaugaaauaauggcucauguucaaaaaacaguuaauuuaggagucuaaacaaccccagcgguggguuagcgauugugaaauuaugggcuguguggacugcuuccaaaaucagaacaaaacaacaugcaaauaaauaugggagcaugcuggaagaguucuggaaauaggucugaguuccaacccugcauuuucccaauacuuacauuccacugaauccaaugagcauaaaaacaaagaauggcacauccacacaucagauuuaucagaacguauaaaacgauggauaaaugcaauggcaaaggagaaauuagguuucugagguuuuuuagguuauaaugaacuaaaugauuacaagacuauaaaaagguaauuaugucuuauuuaaaauauaugauuauuaucuagauagauguucuaauuuuucaaggcuuauauugcuuucauccucaaaugaucauuuucuaccuuagaaauuauuuucuaagaucuguguguguacaauaguaauuugcagcaaaucaguguaauuucacaacccuuaauuugaaaaaauaacagaggacacuguaugugauuuucaugauaauaaauacaaauuuaaaauguauguuucgaguugaucacuuuggauagauguguuuuaauuguuccaagaacugcuuuacacagagcauauuagcaguggaaacaguuuugacuuccagcccuugauucuaccagcagcaacaugguaauuaaccaaauuaucccugcaaauguauuagcuugauuucuucaacuuguaaaaauucauuaccuaucaaaaugaaaggcuuagucucaugaaagauacucaggauaaaaguggcagacacaaaaagucugaguuuucugacacacacuuuagcaggagcugcugcacucccuccuguuucuagcccucagggguuagcaugugaauuuucuucucucuugcauuugugccaauuguacaauguguucuaaugcuuccagguagcacaacagucuuggcaguccuuggagagcucauguuuuaggggaugguaccuugaaccauuugcuucaggacuagaaggacaaaagggugaagagcaagaggucaaaaucauucauucauuauucuucauccauuuauucacuuaaaaaauuuuuuuuuaauuuuuugagauggagucucacucucuuacccaggcugcagugcaguggugugauuucggcuuacuacaaccucugccucccagguucaggugacucucaugccucagccuccugaguagcugggauuacagucccccgccaccaugcccagcuaauuuuuguauuuuuaguagugacgggguuucaccauguuggccaggcuggucucgaccuccugaccacaggugauccaccugccucggccucccaaaugcugggauuacaggcgugagccaccccaucuggccauuuauucacuuuuuauuaaacaucaacuaagugccggucaucgugcucaccccuggagguagauaacaacagcccaggagaaaauaagaaagaccauuacauauuaaguauuguaauaagaauaaaguguaacuggcagacauggaagaggaaccucuaacucagacuuugggaaucacaaaggcuuccuggagggagugacaucucuagugaggcuuggaagauaugcaggagucggucagcuaaauguguggucagggguaggcagagcaugugccgggguggggaagagcaugaguugcgcccagaggugauggugagagcagugguuacgccugcagaagugcagcauggagugugaggggcaacguggugaaagaugagucuggaagcauacgcacggccacagcaugugcgacucugcaaaccacgucugggggucucuggccugacucuauccugaacucaggggagagccacgaacagguuuccagcaaaccuaugcuuuggaaaguggauucugccuccauuguggagacuagugggaggcagagggcuggcaagcaggucucuggagucauguaggaaaaggaugguggaugaacaaggagauagcuggagguaaagagaaguggacccaccggagggagacagagcugacaggcuuggugaggaacugaacauggugagugugagggagaagaagaacccaacagcauggacagccggggaaugaagauaauccaagcugcaggaaaagccggcagaggugugagaugaguuaaggugcagguguccaugacacaucuaaguggagcaaucugguggccgcugggcaggugacagaaguucaggaaacagagcuguguuugagacacacuugagacccauccccacacagauguuaccagacaccauggaaguacagcaucuaaguagagaagagucaggaugggacccugaggaacaccaacaucaagggggacuuacaggaagacagguccacguaggagacccaggagaaaggaccacaaagugggugaacccaggagggugugacagagacaccaagggcaugagcauuuucacguggauccugcagucagcaacaucaaaugccugccagagaucacauggggaaaugcucucuguacuucugauaagcaagccuggggugguaaccucaguaaaagccauuucaggaaggaagguggugggagagauggcaguugguugaaggggaaaugaaagugaagacacagagagacuuuggucuggagagucuaguuaggaaggaagaaagagcugcaagcaauguagcacugaagauauauauauauauauguauauauauacacacacauacauauauacacauauauauauguacacacacauacgauggaaagaaucuguauguguuuacugagaaugagaugccagcagagaggcagagguuagaagagggcagagagaggaggugcucacuccugugcuggcuucaguagugccuguuucacucacccuuguacccccagcgccgagaacagagccuggaacagugacugucugaugccacuggcccaggggugcucauuggauggcauccaucucucuggggacagagaaggugaagcgucugcggagggugacgaggacagugacaaggaggugcuggugucacaggugugcagcaagcagggauggucuaagccaggcauucccaaugggcaccuuacaaaauugguucuuggggaugagaaaaccuuacucuguguauaaagcacagacucacauaccauguacaaacagacaugcgguaucucugugguauuagaauuucauuugggaacaauugggagaaaagugucuuaaagguuccugaggggguugauaaagucaaugguaaaaugacugaaggauacucuucaagucaguaaugcuggugaacauugcauugauggugagcuccagcggggaauaaguuacccuucaaggaagagagcauaguuugguuacugugauccugcccuggcagugagauccagcauaaagcagacgucgcaaccggcuggcugccuggagggguccgcgauccagaccuccagcacuggcugcuggagagaagcagccuggacuccaaccugucaguccuggagcaagucaggagcagugcagaccagaaaguggacaagcaaggcagcaagcacgaacguguagcgagcuagcagagaccgccacgagacggacccacuuccaaagggggccaugacucaguauaacgaucccagccacaggcugaaaccagcaaggcuuuuggggagaaacacuguagugcccuuagggaauuugauggaggcaguaaugggacugaaaggucuuugguggcuuacacucgaggaccuguuugcaagaaccagcugccugauggaauuccuaggucagagugaaaaguuaaaaauguuggguagagcugaaguucacagagcccuucaugcuagggauuuuauggcacaagaauuacacacacacaucacacacguacacacauucacauuccaaaaauacuuuuaguagaaucuuauuugccuucauauuuuaaguacuaauaucacuucagcagauauuuuggugucucuacacuaaguccucacuuaaugucaucaauagggucuuugaaacugaggcuucuaagugaaaugcuauauaauaaaaccaguuuuaccauaggcuaauuuugauauaaacaagaguuaaguuccuacagcacauuucugaucacaaaaacaucaccgaacuucuccauaagguccaaacacuuuuaauauuaaacacugaaaaaaugugagcuaugcauacauuaagaaagauuaauaaaaccagaaaaauaccauucaggacauaggcaugggcaaagacuucaugacuaaaacaccaaaagcaauuguaacaaaagccaaaauugacaaaugggaucuaauuaaacuaaaaagcuucugcacagcaaaagaaacuaucaucagagugaacaggcaaccuacaaaaugggagaaaauuuuugcaagcuacccaucugacaaaggucuaacauccagaaucuacaaggaacugaaacguauuuacaagaaaaaaacaaccccaucaaaaagugggcgaaggauaugaacagacacuucucaaaagaagacauuuaugcagccaacaaacauaugaaaaaaagcucaucaucacuggucauuagagaaaugcaaaucaaaacuacaaugugauaucaucuuaggccaguuagaauggagaucauuaaaaagucaggcaacagacgcuggcaaggcuguggagaaagaggaaugcuuuuacacuguugcugggaguauaaauuauuucaaccauuguggaagacauuguggcgauuccucaaggaucuagaaccagaaauaccauuugacccagcaaucccauuacaggguauauacucaaaggauuauaaaucacucuacuauaaggacacaugcacaaguauguuuacugcagcacuauuuacaauagcaaagacuuggaaccaacccaaaugcucaucaaugauagacuggauaaagaaaauguggcauauauacaccauggaauacuaugcagccauaaaaaggaugaguucauguccuuugcagggacauagaugaagccaccauucucagcaaacuaacacaagaacagaaaaccaaacacugcauguucucacuuauaagugggaguugaacaaugagaacacauggacacaaggaggggaacaucacacaccagggccuaucagaggguggagggcaagggagggagagcauuaggacaaauaccuagugcaugcagggcucaaaaccuagaugaccaguugauuggugcagcaaaccaacaugguacaugcauaccuauguaacaaaccugcacauucugcacauguaucccagagcuuaaaguaaaaaaaaaauaaaaauaaaaauaaaaaaacaagaaaccaaguaagauaauuacuuacaccauucuaggugaaucagugagugacugcaguugcagugguggugguuuccaucaaagaauaaaugucugcaaagcaaaaauuguaaggagcaccuccuccugccacgaaguuuaaagauaaucacgggccaggcccgguggcucaugccuguaaucccagcacuuugggaggccgagacagguggaucaugugaggucaggaguucaagaacagccuggccaacauggugaaaacccuucuguacuaaaaauacaaaaauuagcugggugugguggcgggugacuguaacccagcuacucgggaggcugaggcaggagaauugcuugaaccaaggaggccgagauugugccacuguacaccagccugggugacagagugagacuuugucucaaaaaagacaaaaacaaaaacaaaaacaaaauaaaacaaagacaaucacaacaggaccugcucaccuagugcuuucauaccaugcuguuuauuguugugcaucuguaugacuauuguagacuugaagauuuguauguuagaaucauuucuauucauucauucauuuucaggccacuuauccuaguucagugggguggguggcuggagaaaggcaggcaccagcccuggccaggaugccagacagccccuggcaaggcacgcucacacacacccacacucacugacacuaggacugugaagacaugccagugaaccuaaagggcacaucuuugggaugugagaggaaacuggagucccagagaaaacccgcacagacuuggggacaauguacaggcuccacacaugguggccccggaugggaauuggguuuuuuucucaucaaccuuauaacaaaacaaaguugaaugaaaugauguuauuugagcaucugcuguaugcuucuuaauuagcauucuaaaaauccuuuuaaaugccuuaaaauacaauaacuauaaaaguaaucuucaguucucaucuccaguaaguuuucaaagucugaugaauacguauggugauauuaaguaugggaacaagaaagaaaaaauaaaauugcauugguucucuuaaauaaaguuaacaaaugacauaaaccagguuagcuggcuaguacugaacacuagcauuucacugucggagaagaacacucaaaugaaacccagauugaaaauaaguuaaguguuuggggaauuuacacauuugaagguacugauagauacuaugauuugacauguauuaaccuuuucaacucuguacaauuaaaaaacacugcaaucgaaaaccucauucauggauaaagauaagaauuugcacuuauuguucuaugugauucacauuuaagcccuuauuuuuugaaaaugcucacuaaaauauaaagaagaaaaaacuauaaagauguuaugaaaaugugaacggacuauauggaugacaauguguaguccaauggcccacacacauacgaggccaguaagguuguuaucucucagcuccaaucccacccuucuacccucuuguuuuguguugcuggggcuggacucucugcaaaccaccuuucaaggacauacugcuguugaaagaagcacaccucuauuuguuuucuccucugcauuccuccuguaacucacuaaucccacccgcucagugccuucugcauguggcagcuguucaaagguacugaguacaucuacauuugacguacuugcgucaguccucuaguguagugcugaaguucuccaaguaucuccaagaaacuaugaaaccuuugcauaaaauauugacaaacgccccgugaaaagauauugacugcaguaucagaacccgcuuuuuacuguuagggcagaaguuauaaucucacagacuuuuagaugcuugggcugcuaacaugcccuucaucuucuaggcauaugguucugcaaacaacuuugugauuucuaaugacgugcaucaaaaugaaacagguaaguaucaaagggcgaagcuguucauucucaacaggagcuucuggacuuccaguauuccuuuacccaucaccccaaagccuccgggcucagaacagauucugaauuaagguggucucuugucccaccucugcuagaaaaugaacaccuccagagucacugccaaguccacagauuguagucacagggcccugcaacauaguggcaagcuguuggccacagcuugcaggcaccagggugcccuuagcagguagaaguggagcccuuuaggaagggcuuuugguuucaccccaaaggauuagcauaauagcauuuaugaacaauuaaucucacagauauaaaaugagauauaaaagugugguauuucugucccuaaccguucagauggcuaaaugcaaaacgaaaacacaggacuaccaagucaacuaacuuaucuuggcuagacuuauuguagguuuuucucagugaauuucucuagcccuccaucgggcugacuuuuguuuugaguuuauuuugcuacagcaaguaaugggauauauuaauggcgcaccucuacaguuacaccuggauugauuuugccauuggugggcuucauuucaucacuaaugaugaaaucuuugcucuuggaaacaaaugaaauaacuuauaaaggaaacaguaugagcuagaaaaaaaagccugccuggucugaagcagggaagauuugaccuagguccagcucugcaaaugacccaaauaggucacugaaaacaaguuaucucuuuguucucuaccuuccaguaggcagagaauggcaaguauguuuucauuugauugacauuugugagcacaaggcuucucuugucccaccauccggggucuguacaugugaggggcuaucaugaugugcauuucccaagucagugcccucaacucacaaaucucccaggaccacaacuggaaaucaucccauccaggaugcuccugaguuucuggaaaaccaaggaaaaaaugaguucccuuuauuugccucaaguuuguuccacuauaaugucaggaaacuggcugaggucuccaaaauuuaaacaaguacuacuuacccccuucagauaaacagaaaaugcaacucuauguaaauauuccuuaagaauauuuugcagcacacuggaauuaaauuagugcuaaagaugaugagagcaagaaaguaaucugcucagauguuacacugaaauugucucuaaauucauuccuuaaguccaaaccagaaucucaaacacugaucucuuauuacaaaggcacucuauguuaugagugucuucaacaaaugccauguaaagcugucuugcauaaaaacuguacauccuagauuccagcccagcacccccacccauuaaguuauaaaccaauuuuauuugcugaacaaauguuaaugccauucuacguuaauggauaaugcuaugaaaagcaccuaaguauuacagcacuggaacauuuaaggauaaaauagaguguaacuuggaaaacugccuguuacaaacauaugucagccaugaagccuucuagcccugaucgcccauccucacagaacucuguuuuaauuucucccucaguuaagagaauuuugcaauaacacacagauuuauuaggucccaggaauaaaacucucggaguaaggauaaaaaauaauuauauguuagaacacaacguaauauucaaaugacuugaaaacagucaccucagcaaaaauaaggagagaggaagaaguuaaagaugagguugauaacacuggcuauaaaaccucugaauuuaagugcauaaaugcaugaucuggcacuuccgaaucauaaacagguagaaacgggaaaccucccauucacaaugaauugccugacugguuucguuaaugagccagggggacgucuucaucuaguaagucaguacaauguuaagagagguugcugugcaaggcgucuucauuagaaucccagcucuaccacuugcuagcugugugaccuugggcaaguuguguuuaacuucucuucacuucaguuuccucaucuguaaaaugggaauguuaccaaugccuaccucaugaagcagcugugaggguuaaaucacagcuuagaacugugccucacacauaaugcauccucagucaacgucagcucuucaucacuuggugguuguuauuguaugagggacguauugcaauuggaaagggagcugaagggaaguuacagccuuuccucccaagaagucucuaaauucacugacugcauuuucuguuuucucgaguuuggcuucugcccccucuacuccaccaaaagggcacuugcaaaggucaccagcaacguuucuguggucuaauccauugugugguuuuagauccucaucuuucucguccucucagaaacucugaacaccacugagcuugaaucucauuccuuggauuccaugacuuuucacugucauaauuuucccuucacuuuucuugucacucucucucacuuccacuugccagcggcuauuccuucccuuagucucuaaaagucagaauuuagauucucaauguuccucggucuccagucucucuccagaaaaauuuaccuauuucuacgguguuauuaccaauggcaugcuaauuaauccaaaauguugguccaacaccucagaccucugcucugaccuccugaccuccaauauguuguucuauguucucuguguuuacuugaaugucccaaaggcacgccaaacucaccaugcucaaaaaugaauuuaugauuuccgcccuucccgcaaaccaggaucuucccuaauguuucccauggccguaagcgcaccaccaagcaucucugggcuggacuccugcaauagccucccacucccucuugcuucuccuuuucccgguggaucccucuccauagcagccagaguggugcauuuaaacugcuaaugugaucacaucacucugcucaaaugcucagcugauccgcaucuuauaggaucuacgaccuagcucugucugccucuccugcuuagcuuuaucuaccugcucaccaacuauucugccuuucccucuccuuggagccacaaucuuggaggaagccuggugugucacagauacacaauaaauacuaugggcgguaaccaagaguccuggugcuugcguuuggaggugaagagggguagaggaucuuggagaaugacuaaugucagugaggcaggcauagacagaaagccauuccaggaaacacugggaacacuaaugcgauccccuaggagcuccccaaauaccaacuacuacuacuaacgccuuaggcugacaaguagggagagagaguaaaaagcuccaggcucaacuagcgccaccaucaucucucuuuccuccucguccaucccaccuccccuccugacugcugcucauaggcuaggaagaguggaauuuggagcucaguugccuccuaauccagccaccaccuccacugcccucucgcacacacaugcagacuucagccuugcauauggacacaaaucugugauccgguggguccacguucucucuuuguuucaggccucauccaaagaguguuguggcacaggugcagcacuggcggugggagggaggggaggacuggggcgagaggggcaugaggcucucaucagcucucuuuagaaaacaauaacuauaaagcugaaugagcuuuugauugugacacucaguuuuauucaaauugaauuuugcuuuaccuaaacucuauccuuuuggugugugaauuacucaagucuuuauucaaacuucaagccuuguauggagaacagaauaggaaggucaaaggauggauuucuuccauauccucagaagggccaagagagaauaagaagguagacuuuuucuacuuagggaaaccaaagaggggauugguguguucuaguauuauccuuuuguggacauaaacacuauaaccaguuaaaggaagauggcuuaaaaauggaauaugugaacugcaaauaugaaaguauguugaaagagaaaaauaggaaaaguuauaucagcaucuuagguugauuguucuuuaacuggaaacaaagccccagaauagagacaauauagauauaaaauauacuauguauuuuauuuaacauauacuuauauaccagaaaugaagcugccuguuuugacaauugcuuucucuauaaaucucugccagaaaaaaaaucauuaugaauucaacaaaucacaucucaauuaguuauucuggucaacuugagacuuagauuuauuuaugaaauaaugcuuuccagaaagaaaaacaucuggccuuuuaaaauaguuguuaauguaaaauuuuaacccaaguaauuguauuacuguaacucacuagcaauuaaaaaaaaguguguaggauauccaaaagaaaggaccauauuaaauuaaaauaaaguguuuuuuuuuuuacaguaaaauucauaccaucuggccuaauuugucuugguguuuugcccaguguaguaucagcuuuuugagaacuauaaauuauuagguaacuccccugaaaaaauaugagugaagaaaaaauauggguugaugacgacauccugauuauaugucugaauauuugggaaaacacugaugugguggaacagcccaaccuaagucaaucugggcacgaaacugguucagggagggaacccacacuagacacaacggugaugaaaaggacgggcucacagagggugacagggaaaauaacaugugaaacaauagagaaauaacaguuccagauccugaacauuaccucuuugucaagugcuucugauuccaauuaaguuuacaggaaaaauaaccaggcaaccccugccugacucaaaaaaauguacagacuauuaaaggaugcuuuuaaauagcagggugauaaauggggcauccacaugugagcaccagcauauuuuucaucuaaauucuguucuucugucuuccagcugaucacuuuaauagggugucaccucagccugugcagaggugcccagagggggugcagcuccuagauuguuaacagaaguguuguuucaaaaacuuaugugacuacucucagaaaagguaaaugucaaaccacagacuaugggcuccuuuaucauggagccgcagguuuccuuucuauuuagagucuaugucccacagauugauaagacuguuuaaagaauaaucuuacccggauuauuucuucaacacagcuguugguuucuccagaucuacucuccugaaagcaaagaaaaaaaaauuaagccugauggaauagauugaugaccacacagaagacaugcaagguuccaaauuagucccccccaacaaaaaaauucagcgaguuacagguugaggggaugccugaccugggacuggcagacaggcuccuuucccuaacagccggcucccauuguggcugcugcucccccuucucuggcuggagcaccacacacgcaccccagaggcucaacuguggccccuccaaccacccuacuuuaaguggggugggcuccuagggguacagaacgugaccugcagguaugagcuccauccaccuugggugccauuaacguguggaaacuguggccuccgcuacaacaguggauccaauuuauccaccaaauauaugccgugggccuaccaaguaccacaaugguugcuacggcuuaaguaaaagucugguaguuccaccguccucaaagccuugguuuacugguuugauaggcagaaaacugaaagaccaaaaagagaaacauccucuggauguuggacuggcauguggggcgucacgcucaagucacuuguucugucacucagccugcccugugcugugcagauguuccgaggugcaguggcuucaggucacagccgacucuggggagcauuuuaaguuccagagaugcuguguggguccugcuggcuacacagccaagagugcaggauguggguuuguggggacacagaagcaguggacgcuggugaaagugccuaccuguggucucagggagaucacuucucuucguccugcaauucaaggaugucaaccugagaguagaugucacugugacauccuggaaugaggcuuuucuccacagucucuucuccaaggccacucucccuuccuccucacuguucucucucuaccaagaaugcuaucugcaccuuuccugguuuuucuaguuaauuuccuaguuaauuccuaguuaagucauccuucgaacagcagcuuauccacagcuuccuccgagcagccacccugacccuagagugcuugcccccagcagccuccacuucuucaaagcccucaccacgacggcaauucaauagugaagucuccagcaauaucuccucccucuaaaacaucagcucccuggauuccagggcucccugucuuccagcaccgugcuccacacagcauggggcacccccaauaacuauuggcuggugguagguguaugaauaaaugaaugaguuuacuuccugcaguucugaggggcaugaggcucaucagaaucagcacuaggacuuuaaaaaauauuaugaaggcucuaccagugaccguuccaucacacucuccaugcccugugucugccagcucauuccuuguccugggguagagcauuuccuuugaaacacucuacccuucacuugaguuaggcgccaggcugaaggaagguaugugaggcuugaaaaggucacacacaugauugagaccuucuccuacccagaauuaggggauuuauccaagucucccaccugaggcccagaaaguuuacacaacuugccgaaggccacacagaguuaccauaugguaaucucuguuuuaacuuuuuuuuuugagaccgaguuucgcucuuguugcccaggcuggagugcaauggcgcgaccuuggauuacugcaaccucuaccuccuggguucaggcgauucuucugccucagccucucgaguagcugggauuacaggcucccaccaccaugcccagcuaauuuuuguauuuuuaguagagaugggguuucaccaucuuggccaggcuggucucaaacuccugacuucaggugauccccucgccucggccucccaaagugcugggauuacaggcaugagccaccgugccuggccuguuuuaacuuuuugaggaacugucaaauuguuuuccacauuggcuguaccauuuuacauucccaccaucaaugcaugaggauucuaauuucuccacauuuucaccaauacuugcuauuuuacucuacuuuauaauagcuauccuaguggauaagaaaugaugucucauuguggcuuugaucugcauuuucuuuuuuuucuuucuuucuuuuuuuuuuuugagacggagccucgcucugucacccaggcuggagugcaguggcgcgauauuggcucacugcaagcuccgccucccagguucaagugauucucuggccucagucacccgaguagcugaaacuacaggcauguaucaccaugcccggcuaauuuuuuuauuuuuaguagaguugggguuucacuauguuagccaggcuggucuugaacuccugaccuugugaucuguccgccucagccucccaaagugcugggauuacaggcgugagccaccagaucugcauuuucuuaaugacuaaugaugcugagcaucuuguguuuacugaacauuuguuuaucuucuuuggagaaauguuuauucaagcacuuugcccauguuguaauuggguugccuuuuuauuguuuuauuauaggagugcuuuguauauucuggauaucagaagacucuuagcagauauaugauuuacaaauauuuuguuccauucuuuggguuguuuuuucacgcucuugguaguguucauggaugcacaaaacuuuaauuuugaugaaguccaauuuacccguuuuuuucuucugcuguuugagcuuuugaguaucauaucuaagaaaccauugcuaaauucaagccaugaaaauuucccuuuauguuuguuuucuuucaagaguuuuacagacaguuuuagcucuuuuguauaggucuuugauacaaucgucugggaacuuuuaggugaaguuuauuuucuuguggauuauuuggugaauuuucguuaaaacaggaauguuaucuuuuugcuucauucuagucucaucauuaaaagaccaacaacaaaaugugcaaggcacagccacugcuacuaguagugcaugaagacaacaugcacuacuuggcuuauccuuauaagccaagaaaaauaguguucaauaucaugacaccaaugcuuucacuaauacuucacacccuuuccuauacucauccuuccuucuguuuucccaaaagcuucaguuggccacauacuuauuacaagcuuucacucccauucccaauuccuuaccacaggacugcucuggaaacaucaccauucugacacucugauacaacuggaucagagagcucuuuuggaaccugauccuuuuccagggaagccugaggugaccaucacaaagguuauauaggaaagucucagucgggccggggggcuugauggucacuuggaaggauuuccuuuggcguucauggugggaaugaguggucugaauuagaaaauguaccgucaaaccuacagaauaucauuaaucaugacucuuauccuacuucuaagucccaaccauuuccuacugcauaauaugcuggcagggcaaaugcugaauucucaaugugcuuucuguuuucuaccacaaaacaauuaaucaagaaaaacuugaccucagguccuccugguggaaucacccagauauaacagcacacuacaaauacucuuaaaauuaaacuucggguuuaauuccuuaaagcuaagcuucccugaauaucacacuuuaauuuccuuugauguaguuuauauaaaugacagguugcuuuuauaacuaucucccuuauaauccuauacauuucaacuauucuacucugauaaggaaaugcgcugagagagaaaugcaggauagaugcccuauuagauacuucucucaucacuggagacauagauguaggaucuuuacacuaagucaucucuaaggcagcuccaaccagaagccuugauggucuggacagacaucaggucauucccuacuaggaaggcccuuuguaaagcuaaggaggcggcagaggugaggccagggugagggacuucuaacaacagucucaggaaguccuggccuuaaauuacagcauggacagucuuuggcagaggaaccucuugagucuuuucagaacacugagaaauguucuggggacucaagaagaguaccacauugguuugaaucuccaggaccccauuuagauuggagugaauccaugggccacaguaucguagaaaaucugaaugggaaagaacuuuggagcuccuuucagcccaagucaaugacuuuaacagauggagaugccauggcucagagaagugaagggcucuguccaaaaaucauucugacagcaagacacaguugaggcagaauccacucacauuucaacaccagcucauugaguucucuacuaucucaugcugucuuccugcagcucaaucccuagagcuggcucaugcugagguaacuugcaugcucacaguaugaaaauaaaagaaugcagauaguauugggguaaauuuccuccuccuuuuccacguggcacauuacucagcgcuugaucauugccucucacuagcuaaucuccaacacuacacguguagaccaaagggggaagagaggagaggggaaguagagagaaaaagucaaaucuacuaccccuucugugacauuaaaaaauaagggguaaggguuuguguccuuagaaguaggaggauggaauuccaccuuaucuuuuccaaauuacagaaagcguagguagauagguaggguugggguugggggaucugggguacguuuaccuucuugaggucuuucucaaaucugguuucagcugcaguugugugcuuacuuugauuauauuuacauuuugaaaacuuuccauguuuaucaacaagauuaaaauaugcauguaauuuacaucuccaaauucguguuuauauuuuucacaauaaaguuauugcuuuccuuggaaagguacccacugagaaggaaggcugcacaaugcacauuuuaauuacucuguauuuuuugacgguuuguagcuguuguuucaugcugaguugcugagcuguugcuccguauuuacuccaacuuugaggaacccaccucauuuuccuaucauuacauuuugaaaucugucauaacagucucaccucauugaaccuccaacuaaacuucaauuaagagcuagcaaccccagcugauucuccucuucuacagcacugucuagcaugugauuucccuaaauccuaccauuuaaauguacaugccgcacacugccaagaaauguacagaacuaugcuguggguaaguguagcucggggaauagccaggagcaucccaucccugaugguggaagucccuaauuaccaugccaagcacagaauauggggagaagcagggcuuaaggaaaaagagugugaucaaaucagugggaaaugguauuucauugcagagaugggcugcacaaguccucauuuuugaaaauaguuuaacucuuuaucacacacauuucagguggaacuugcauucuaaaauacuacuacuuucaaaucacaaugccuuuguuuaucuucaagcacucaaaagacccucaagcauuuagaaauuguguaucccauguacacucuuaaacacuccugcagaaauauuuuuaaaucaaucuauucuugauuuaucacaaaccugacauacaaaaaguuagguaugcugucaauaccacaaaagcauuggugagaaucugagcucagaugcagggaccaucauaauuccaugggaaguccaucccuacaacugugucuccugccuuaucuuuaaggauagggccaccugugaacagaggcagacagccaguucucucccaaauucagccugucucacaccuaaccuguaccauccccugucaggggcuucacucugcucccaauccccaagcuagaagcccagcugccucugagccuccucugauccuccugucuccaccaucaucuauauauguagaugaggaaaaugcaaaggaaaaauacacaaacagccagggcuuuaacagagcaucaaaaugagauaugcuaggaaaaaggaagagaaauauaauuauuauaguuagaaguauuuaauccaucccuauuuuuccuaacagacaaaggauacaaaagcucagcuucaauacucaauuuuaggguccuuuuaauguauuguaucaccaagggaaaauaagucaacuguauuuauaucagcuuacagaguguuuaucauaaauccagaaaaacugaaacucacuguuauuuuaaaaucguuaauaauuauauuaguugacuauaaacuaaacagucaaaucucaauagcucuucuguguagcaguaaacaauuuaaaaauauuuaaaaaucccauccauaauuuaagaaaaauaaauaaggauaaccucaacaagaaauguuugagauuuguuuuuaaaacuucagaguuagccaggugugauggugucuguagucucagcuacucuggaggcugaggcaggagaaucacuugaacccgggagguggagguugcagugagccaagagugcaccacugcacuccagccuggaugacacagugagacuccaucucaaaaacaagaacaacaacaaccaaaaagaccaaacaaaaaaaaggaaaauaaaaaacuucugcguuuuacugaaagauacaaaaaaagaccugaaagggacugagcuagacuucucagauaccucccaauucugguauaugauauaaagccaaaucaauguacgaagaggagcaaaccacaaacuacauuaauuuuaaaaaaauuauugaggcaaaauucaaguaacauaaaaucuaccauuuuaaaguaaacaauucaggggcauuucguacauucacaauguuguaaaccauuaucaccucuauuuggcucuguaauauuuccacuguuucaaaguaaaacccuguaaccaaugcguaauuucuccccauuccccaucaauacgagaacuauuuuuucuuuucuuuuuuuuuuuuuuuuuuuuugagacagagucuugcucugucucccaggcuagagcacaguggcgccaucucggcucacugcaaccucugccucccggguucaagugauucuccugccucagccuccugagcaguugggauuacaggcaugcaccaccacacccuaauuuuuguauuuuuaguagagaugauguuucaccauguuggccaggcuggucucaaacuccugaccucaggugaucugcccaccucggccucccaaagugcugggauuacaggcaugagccagcaugccuggcuuacuuuuuacaaugauuuuacuguauuaaaacauuuuacacugcacugaaaagaagaacaugagaaaauguucauggguaccauuugcuuguacugguagauuuuccaguggaugugcugccucucauuuacguguuucugaccaguuccuagcagagaacucaguacaacagagcaggcauucgauuauauuuguugaaugaauaaauuaaugaccaauacacuaaaaaaaaaaagacuauuuacaaaaugaaaguccuaaacuuuauaagaauaaugccgguuaucuacauuacaaagaaaugucuuugcuuuauccaaaaacuacuacaacagcagcaaaccaccaauguucuaaauucuuagaacaucaacauuuauuuacuucauuaaaauuaggcuuauauccauuaaguacagaaaccauuaacaagucauuugacuucccuaauucccacauugguaccuguaaauuagagaguaaguaucagucuucuauuagcagacaauauuguuaaagagcuaauaauuuucugucagauauuuagcacuaggacaagguauuucaauuauguuauuauuuuuaugaacagaaauuagcgaucugaaucagagccuauaguuaaaagcauauuugguuuucagaaaguuaaguggucugucagugugcugacgaugucaagaaccuauugauggcaugaagagaugggagaugagaagcagacagugauuucauauccugaugacuaauugauauugagugcuuauccauggggucaugucucaaaaaaguaccacaguacugucuacuggggucgucuuucacacugcucugucaacacugggugaagaaaccauguuacagggcuucccacuugcaacuugacauugauaagaauacuuuaagauuucuguguucuuucaccuaaaacccuacgucguuaauuuuaccaagaagaagaucacacagguucaggcaggagugacaaugcugaagucauuuaauccucacauuacaggcaaacuucagugagauuuugcaaauguaccauuuccucuugaacauuuuccugaaucuuuauuuuaauuaaauuaauuaauuaauuucuuuauuuugagacggagucuugcucuguugccuaggcuggagugcaguggugcgaucucagcucacugcaagcuccaccuccuggguucacaccauucuccugccucagccucccgaguagcugggacuacaggugcccaccaucacacccggcuaauuuuuuguauuuuuaguagagacgggguuucaccacguuagccaggauggucucgaucuccugaccucgugauccaccugccucagccucccaaagugcugggauuacaggcgugagccaccauacucagccuauguauuuacuuuugagacggaguuuggcucuuguugcccaggcuggagugcaacggggugaucuuggcucacugcaaccuccaccuuccagguucaagugauucuccugucccagccucccgaguagcugggauuauaggcacccaccaccaugccugguuaguuuuuguauuuuuaguagagacaagguuucaccauguuggccagguuggucucgaacuccugaccucaggugaucugcccgccuuggccucccaaagugcugggauuauaggcgugagccacugcgccuggccgaacauuuuccugaaucuuuauacaauuccauuuauaugaucuaauauucuuuuuuuaagggauggcaggaaauguacacgaaaacacaucugauuaucacuuauagucaguuuucuaaucauaaaauucugaacacaaaagcuugcaagacaaacagaguaaucuaauguggcugaagaaacuaaccacuuaaagauccuacuuagcaccacucuaauuugugucccacaguaagauggauaaucaauucccuuuuagccaugaauggaaaugaccauuguaaauggcaaaagugcugcugcguauuugacgauauucuauuuggcacauucuauuaauuuuauuuaagcauuuugcuaaaagagcagacucacaaaucacccuuccuaugucauguucuuuauggaucuuucucuccauuaucaucugaccuuccccacggggucucagcucuuccugacccucagaacaggguucauucugcauacucaacaucagccauuucuauguaugcucucugaggugauacgcuagaaauaaaugcugaauaaauaaauacagcuaaaaucagccagagcacaggagagaaggcuuaucugagaggugggagcagguagcacuggaaaacaugagugagaaacuggcacuuuuuuuguuggcugcugaggaauuuuucaauacuccaaguuuuauauuuuuaaaucgaucuaccuacaacacccuauuuuaaauuuaugaacauuuauagcauuuucauucuuuuugagacagaguuucgcucguuggccaggcuggagugcaauggcgcuaucuuggcucacugcaaccuccgccuccuggguuccagcaauucucccgccucagccuccagaguagcugggauuacaggcaccugccaccacgcccagauaauuuuuguauuuucaggagaaacgggguuucgccauguuggccaggcuggucucgaacuccugaccuuuaguucgugccuguaaucccagcacuuugggaggcugaggugggugcauuuucauucuuuauucuacugguguugcuuuacuguuagucuuggaaaauauuugcaggauaugaagagagcuauuauaguggcaaucuauuuuaucuuuucccuucuacucccauaaaauguucagagccuugaaaaacaaggugcgugucccaguaaaaggcagagugaguccuucugcuuguagaacuugggguaucuggggcugaacucagauauuaauccucacauguguccccucucguuuuucagagcuggcuucagaacgucucagcagugacugcugaccacugaauuuucacguaaaacaucaccagauaaaguuagccccgggugauccugcucagcaacucagaagggaagggagcuucagaacugcuuucuauccucauucuaaagccucugggugggacccaaggugaagacaaucucucuguaucuugacgcccacacuauuauuauaaaacuccaugguauuguaaucuaaagggagaacaaacaguuguacaaaacaaaagggucaauaagaaauagacaucagaggcugggugcgguggcucaugccuguaauccuggcacuucaggaggccaacguggggggaucaccugaggucaggaguucaagacccugucucuacuaaaauuagcagggcaugguggugugugccgguaaucccagcuacuugggaggcugaggugggagaaucgcuugaacuugggaggcagagguuacugugagccaaggucaugccacugcacuccagccugagcaacagagccagacucugccucaaaaaaauaaaaauaaaaauaaaauaaauaaaugaaaugaaaauauaaaaaaagacaucacauguaaaauaugcugagauuauucuggcaugauucuaucuggacagaaugcagauauuccugcuucaaugccaccuaacacuguguaugagauccgccacguacagggaaaagcugcaaagaaaaccaugugcuuaggccacuuuuuggcuucacaaccuuuggcuucucucaagagaauauuagaguauagaauugaucauaaagcaaauuucugcaccaagaauuuaccuuuccaauggagaaaaguuuguguuuacugaauauaaaauaaauuaauuaaaaaggcuuguaauccaacuaaaagacauccaagaugauguuggaacaaucuaacaaaaaaugaucauuuugugauaaacacccauaagagcagucaaauuaagucaguaaguauaaacgaaaaauugucaugguuauuuucuaucuaacgccaugacuuaaaggcuuacagaaaaauaaaauaaaaaaucauucaguuaucucucgaaucuccucuccaacauaaucacgcuaaggaauaauaugcuuaauuauggacuugauuucuagcacugggaaaguagaugguuuuuagaaacuacuuccauuaggcuaaaaaaagaggacacucggaaaccuagcaguaguaaaggaguaaaugauacagacuacuuaauguaacaugcaaccaaaugggggacuuggaagaugugccagguagucuaaagagugaauguaagaaaagacuggcuacugcuuagguaaaugguguagugugaaaugguacaaaaucaauggaugacagagaaaagcaugauuccacuucuaccucacuucugccugcacaccauaaaccauccucaaaguuacaagcagaacaaauuaagagaggacucaccccaguuagauggcaauaguaagagaauguuuuaaccacuuuacauggcagccccagggaaaacagcacccauggcauuggagggacuggcagauacagucacagaacaacucucuaaaagaaaccacagccagaaaaagcaaauguccuagcucuucccuaagauaggauccucaaauugcagacuaauuuguugcuggguccucaaaaucaccagagguuguguggcgcaguaggcaggaacauggaccuuugcaaacccaauucugccauuaguuacauaugucccugcggugggggcgucaucugauuucucuagaccauacguuuuucauuuguagaaccgagacaguaacagcaccuacgaaaugugagggcuaaaaaugaggcaacgcauauaaagcauuuacaaggugccuacuacacaacagcugaucaguauauaaauacgauuauuuuauuuuagaauuacauaaaaaguauuuucguauuuagaaaagaaagcaaugauuacuaggaggcaacaagaguucacaagaaccagaugauguuaucucuaccauucuccucugguuuuuaaauauaauguguuuagauuucugcaagauugauuucccaguggguagaaggaaaugauggauugguugcucauauagcuggacggacugguagcuaauugaacagccaugccuaaggaguauuguucaacaaauacuucauugugcuuacuauguguucagcauguccuauaugcuaaggauucauaagugaauaagacagacaaaaauuccuguccucauggaguuuauauuguaaugagaugaggcaguaaaauaauaaauaaauuauaaaguauaguagaauauggaauguuauagggaaaaguuagaccaggguaaggguaugggacugugggauggggcuuuaugcuuguaaucugucuguuaaauaagcaugcuaucugacauccaaaacacaguauaagccccaggcuguuagccuccuccccucuuccuacuuauaaaccuguaguauuuuuuccuuccacuaugagaacuucauuacucugagucauaauuguguguuuaauguuuaccuuugucgcuaagcugaaagcuccagagucuagggagaauggcaagaccaaggaagggucucagcauuugaggaauggcugcagaaagugucacgggaaggagaaucaaauggaccacacuggaugccucguguuuuuaaaggacauuguuauuaaugggacaggguucauacucauucugggucauuccagacacgggaguuugaacuaaugggggaaaguccagggacuaguccagcuucccaaaaguucuuuuucacaguuagaauaaucuacaaagaaaguaagcaugauugauuucauguucaaucagaaguuaaaugauuaaguggaaguuacuuauuaaccuacacuucuaaaauguaagauucuaacuuuaagacuauaauucuggucauuuccaacaauuuuauuaauaaaacguugaaugguaaauuucuguauuuucuggguuaguguaguaguaagucuaugacuucuuuguuaagaaaacccauacagagaauacaaagauuauuuauucuaaaaguaccaaucuaaaauuaugaaauaagagucauuauagcagcuaacaaauuaaauggauuaauuggguagagauuugagagauuauaauuaaugauaaaucaauaaaguauucaacaugaaaaucuauuacaacccuguuuauguuauuuaacuucaagcauucaguucuguaugcuucuaauuagcaagcuauaaaagaugccauccauaaaaacauaaugagaagaacuguuuauaaugauaauuaagauucauuugcucagagagaaggguucacacggcuacagguugcagcaaacaaaggguuaagcucauuauugaggaaaauacuacauuuaggcagcauuuauuagacauuuaacccuaucaggcagagccuugccuuagaaaauacaucauaaauaaugcuucuuacaagacaggcaagauuuuccaaagugagguagcaacuacugggaguccaugacauucuguaacuuugcugggcuugacucauccaacuguguuaguaauaauuaaacucuagcugauggcuuuuauguucucuuucugguuucucaagucuucccugcauugauguuuuauuaaaaauauauuguguauugugaaggccaguggagaaaaaauuuuacauuuucccuuuccgccucugggcuggaguuugccuucuauagcacuuugucucauacuccgagcacuguuugaggcuucucaugggcuugccaguggcaaaauugaggcucagaggugggaaacauaaacccauaauacaaagacccucacuuuuuagauccuuuuguaauucuggcuuuagaaaaaucaaaguuuucauucagcagagaagaagcuucuucccccuuucacagaaacucuaauaucuauaaagacccacucagugaagcccaaaaugcuuucuagacacauaauuguagcaauaaaagugugucuucaccucccacuguaccucugagcugauagauacaauuuguuacuccauugacaaccugccaacacuucacaauaauuagagccaaugguccuuuucuagauauagcauaauguaaccuucaauauuaacguuuuuuucccccaucagugcaggccuaagacagaacaacucuaagacuaguccuagccugaagucacagagaccuuuaaugcaggucacgggcaggacagcaaugaucaaggguaaacucuaacacaugaacugguaacccagcagucagccacuguguggccugcuacauuaaccgcccucugagccaagcaggcaccccagcgguccucauuuaaaaagaaaaaaauauaagaaucuuaauagagagauuggggggcuuauuuuucaugaucaugugccuuuaaaaggaaaguccuagagucagcccugaucaauacagccucuccugcuuccugcuuucaaucuguuaagcaagaaaaugcuuucauguuggcacuaaucccacugugcccccaaagaagagaaaaaaaccucccgagagacuauuuaauauccacacagucgguuuuuagaaaaacaaaacaaaacaaaaaacccaaggaaaugaagacuaucaggagaacacucccggaaaaacccuccugaaaacaugccugaguaaaagaaaagucaaaagacuagauagagaaaugauguccagggagcucauaaucugccugugcaagaauucuaguuucuagaaagucacugauuaauaaauucaugugcucauucauccauucacagauaacugcugggcaccaaugcugugccaguaccagggauaccauagcgagcaaaacccguagggccuaccucucagggagcuugcacauucuacgggggagcaggcaaaaaacaaacauaacaauuuuagauagugacaaguacuugcaaacaaaguaaauagugugauguaaaaaggcuggucugaucauuacgauuccuuucagcaugaaacuucccucauaucacaagguauaaugaggacuuuuaguccuuuggauggaaguccuaagaugagagacuauauuaaucauaauagguguaaaagacaaaaauacaacaacguaaauuucaaaugaagaagcaauaugcaaucucaauuucuaccauauccccaagacccuuggaagaaccuauuuauagcuuuaucgcagccauuuugaaaagguagagaaaaaaacaucacagguuuuugaaaagaaauuuugcaaauaacauggcaguauugcaaaaugcaaauggaaaugcugcugagccaucugcucaauauuacagcaacauugggaaaaggcucugaaagaaaugauguuugaaaucauuaaaaaaauaacaugucaaguuuaaaauacucaagaaucuuaaaaccagcaucaacacauucagcaaccauauggcccuacagcagguuaaaaaaauaaucgcccugcuugcaauuucuacuucaacccaaugguuucuaaaacauguuucuuuuucccauuugaguaccuuuucuuuccauugaauuccuugguguuuacaguuacuugaauuauaccuggagcauaauuuuuguuucacccuuucugaaguagaaauaagauaguaaggaagauuaaaagucaccuguucaagaaaaaggaaugugcagaugacucuauauaaauuguugaacacaucuuguuuuagguuuauugauuucuccauccugaucucacugucucaguaauaacugcuaaucucaucgaguaucguaauuuuccaggcacucugcuaagugcuuuauagucauuauaucauuuaaucaccacaaauuuauaaaguugaugcuguuauuaucuacauuuucuagaugcgaaauuuccucaaggucauacagguaacaugcggcagagccagaguccaaacaacugugggagccacgucugugcucuuaacugcuauuauaugcaacaauucaguguucagauguuugugcugacuucucaagguuaaaaaaugggcaacauagcaagaucccaucucugcaaaaacauuguaauuuuuuaaauuacaaaauuuaugaaggcccagagaauuacaaauuuauaauggaaauccuugguguuucaaaugaauuaaaaaaguaguuucauucaacuuacuagcuucacauaguagcuuguggauacaguaggaacucaauacaugauuacugauagcaguauuaauucacauauaaaaauauuacaucaaaugaucugugucuggugcauguauuuuaaaugcuaaaguuccuuuuguaucuggaucauaagaagacuuuuuaaaauuacaaauaauauuuaaaggugaugauuaguuuagaacggaccugagggaagucaggcaguaggaauaucugccaaacacuuaaguucucuaaauguagagauauaaaugaaguuauaaauguaacacuaucuauagcaaaaaaaaaaaaaaaaaggaauagaugagcguuacugaugugcauggccucaugcaauggucucagugcagaacuuuauuuggucuuaugaaacacuuuaccaaaacuuucacuuggcauuccucugucuguugcuuuugccuaaugaucuuaucucuucacugauuagcaaucucgucugucuuuagcaacccuuuaaaucucaugcagccaaaaguuauaaauaaaacaaagcaaauaaacaacguggguaaaauaaaucagugugauaagcaguugugaaauuacaaacuuauuacggaaaaauccauguaaacaaauccacuaaacacauagucauuaauuacagcucacaaccucccaucacuucugccuucuguucucuaacguggggugcuugguaaaucucuggucuagaguggcauuuuauuuuugcaauccuuggcuguagguagagcuuggccucuuuuccacucaacaggaagucuugaaaacaaagaugcuaagguuuagaguauuauaacuggaaauaugaaaggcauuuugcaauauuaccaaaaacuugaaaugaagguuaagaaauagaucugcauauaaugauccauuuauuuuugaugaaaaugauuugucaaaagguaacucagugaggaaaagguaaugguuuuaaaaaugguucuagaacaacuggcuacccauaugcaaauagaugaaccuugaaccuugccccauagcacauaauuaaaucgucccaaacuggaucucagaccuaaauauaagagccaaaauacaaaauuucuagaagaguaaacaucggugaaaaucucaaugauuuugggguuacgaaaauauuuccuaaauaagacacaaaaacacaaacuacaaaaaaaucguuaaaauuaaauacuuuucuucuucaaaaaacugugaaaaaaugaagauauaaaggguaaaggguuucuuuugggugugauggaaauguuugaaaauugguuguggugaugguugcauaagucugaauacaguaaaaacugaauuguacauuuugaauuagcaaaugguaugaugugugaguuaugucuuauaaagcuguuacaaaaaaauuaagagaauacacagucuggaagaaaauauuugcaaaacauauauuuggcagaagguuuguaaccagacuuuacaacucuuagagcucacuaagaagacaaucaccucaauaaaaugagagcaaaaaaaauaccuugauggaguaugucaaaaggacagauagccaauagaaagaacuucuaauggcuaaagcuagaacaagaaaagaauuaaacaaaguagcauuggauuauaaggugaaguauuaaaaaaauuuucaugaucccauauugauauaaaugaaugcccaaauaaauaaauaggauaggauaaauaucuugcgcauaagaauuaaaauaauuuacguagcuacucugcccucaagaagguggagcguaacuccccaguccuuaagucugagcugccaauggugacuucuuuccaaagaguauagcauggaaggagggaaaaaggauaauucuggaguggagaaaccugucaaacacugucucugccaagugauuaagguuaaugucaacugugcuaagucauauugauaguauguagaccugauaugauaugauuagacuggcacuuugccuguguggucuuccucccuaaaacucauaaucccagucuaaacauaagaaaaacaucauacaaauccaaauugagggguagucuauaaaugucagaccaauaugccuuaaaacucaaggucaucaaaaauaagggaagucugaaaaacugucacagucuauggaagucuaagaagauaugacaacgaaaugugugguauucuagaugaaauucaagaguaagaaagacauuaaguaaaaacuaagcaaaucugaauaaaauauugacuuuacuuaauaauaauguaucaauauuuguuccuuuguuguaauaaauauacaauacuaauauaagauguuaacaauaugauuuaaacaagaaccagaauuuuauuacacaauauucaaaauguccaagauauaauccaaaauuacuaggcauacaaagaaccgggaaaauaugaacucacauggggagagacaacagaugccaacagugagaucauccagauacugaaguuaucaaauucauugaauuguccauuuaaaauuggugaauuuuauuacacauaauuaugccuccaaacaaaaggaacaaaacagcagcaaaaguuuuaaaaagaguacagauaacauugaagcauuacauuaguauuaguuuagcuugagagugagauaaauugauucuuauggacuauucuggaaccaaauaacuacuauucacaccauuauuucuuagauaaauuacguuuuaaguuucaaacaaucagcuuacaaaaaaccuucuggcgccuaauccuuucuuaaguggauggccaagcauuucagaaaauguugaacuccagagaccccauuuaaacccaggaacaugagacuucugauuauuuggguauuaaauuauauauaaguauguuaauguuauucauaucucucaaaggauuuuggagacaguuuggaagaaaggauuuuagaaaacucucuaaaaugaugacucggcugacauggggcauauaggagagaacuauuaaacuuucucccuuccucuggcauugaaauuacuguuagaaaugaaugaguucugcuuuuauagaguacuacucauuaaguuccucgguccuuuccuagaaagaaccacagagacaaauaguguucuaauuuuuaucuuuacuuuuuacuaaacuauuugcauagguacauagguuucaagaagauugcucaaaugaauauuuauuuucuuacagagaaacaucugugaaacugaucaucuuucacucuaaauaaauaaauaaucauaauugguaucuguuugagagcucauuugcaaacuguuccuauaauugugccacucauuuacaggcacaacagagagaaucagaacauaauccugcacccuacuuauuugcauuaauugugaucaauugucacaguuuguuuauaagacugaauaauuuuuaauucuaaaauaauuaugcugauuaucaaaugauucuguaugauuuaguuuuuagaacauguuuaauacaaucauugcauucucagauguuuaacuacagggcuguuuauuucacuguauuugcuuuacguccaagaacugagagguuuuuccaagucauucugucaagaguucauuagaaaaauaaacuaaagugaauauaugcugugcuuuuuagguguaauaaacauuaagauauaggaauguaacauuggagcucauacacacacaaaucccagcuugcagcagaucaacuuccugugucugauggugaaggaucccacucauccuucaacccuacucaauucaaccuugguccuaaaaauaauuaaucauucucuuuuauauucuuccaaaguacuuugugucuccauugucacauuuuuccuugacuaccuuuaaguuagggaaguccuucuccucaaauugaccuuaaacccauggaauucaagaucucauuaaugacuuuuuuccccugacauaaacuaaagaaaaauagcugguuuaccacauuauacuggauuccuguucagaaaauaauucacuccccuccuccucccacuguggauggaauauccuccccuaccccuugaguuugguuggucaacuaacuugcuuugaccaaugggauggacuggacaugacagcagcugaggcuuaaaaugugcuugcucagcagggcucaccagccugaacucccaccaucaucaugaaaaggacaugccccagguagcauaugguugaaggaggacugacuugcagaucagaucugaauucaaccuucaacauggagcugggcccaaccaguuccagccugggcuggcaggcccacaacggaagcaaagugaauaaauaauugcuguuuuggcagggcgugguggcucaugccuguaauaccagcacuuugggaggcugaggggggcggauugcuugagcccaggaguuggagaccagccugagcaauguggcgaaacccuguuucuacaaaaaaaaaaaaaaaaaaauuagcugggcaugguggcaugcaccuguaguucuagcuacucuggagacugaggugggaggacugccuaagcccaggaggucgaggcugcagugagccacaaucuccccacugcacuccagcccaggcaacagagugagaccuugucuuaagaaaaaaaaugcagccacaaaaaagaacgagaucauguucugugcagggacauggauggggcuggaggccauuauccuuagcaaacuaacacaggaacagaaaaccaaauacugcacguucucacuuauaagugggagcuaaaugaugagaacacauggacacauagaggggaaaaacagucacuggggacuuuuggagaguggagggugggaggagggagaggaucaggaaaaauaacuaaaggguauaggcuuaauaccugguugaugaaauaaacuguacaacaaacccccaugacacaaguuugccuguguaauaaaccugcacuuguaccccugaacuuaaaaguuaaauaaaaaagaaaacaaauguuguucuaagccccagaauuuuggugugguuugaucuucaguaauagcugaccgauacaccugcuuuauaaacauggaacuuuauucuccaugaauauggcuugguuaaaucacauuuuggaagaacugccaaaauaaagcagcuccgcuucuccugucauaagcacagugcuaaauugaguuuggauggcuuuccucuaauagaauuauuuuacacuugcccacaucaaagcuaauguuucuccuugcugcccacucagucuuucaagauuuuccugugaguuauccucagcacucuggugcacuacucuucagaauagcuggagcuaucugcagacaugccacucuacccugccuucuagaaccacauccuuuuuagcauggaauuucuuuuucuuuugagaguggucugggaaccaccggcggcacaagcauuuagaacugcuguuaaaauuaccaauugcugggcccacuccagaccuacugagucagaaucccuggggugggauccaagauuuuacauuuuuaaccagcucccuaggaaauucuuauauuacaaccagguuugcgaaacccugauuuaugaauaugcuaacuaaccagauccuaagccaauaccuaauccuagaggauuucgaugauuauccaccaucaucuagaaaugcauuuguuuauuccuaauuuuuguuuucuauguguucauuuucugucuacuucaacacguuuucuucucuucauuuuucaucacaugaaaggucaauuuuuuaaaaaaguacucuugguacagaauauuuucaaagccuuugucugaacaagagaagaaguugcaaaauucugagcaagcaccaggaaaaaucaucuuugaucaguugguuguaaccuacaacaugcuacagaagggccagacgaaaccgggagcuuaggccugggggugaucagccaggaacacccaguccuagcagaccaggcuccuagaacuuucagccaauaaagcuuauggucgccccccgcaaaaaaggauaaccuaaauaaguuauuucagugguuauucuuuacuaagaaaugcauauauucucucaaaaaugugauacuuggguuagucagguauuuuccauauagaaaccacacucuccguuccucaaaguguuguccuugcacuuuuaacuuuuuaaacuuauuaacaaauuuuuauauuaaaauauuuaauuguggcugggcacaguggcuuacaccugaaaucucagcacucugggaggcugaggcgggaggaucaccugaggucaggaauuaaagaccagccuggucaacauggugaaacccugucucuacuaaaaauacaaaaauuagcagcugggcauggugcucaugccuguaaucccagcacucugggaggccgaggugggcagaucacgaggucaggagauugagaccauccuggcuaacauggugaaaccccgucucuacuaaaaauacaaaaaaacuagccaggggugguggcgggugccuguagccccagcuacuuaggaggcugaggcaggagaauagggugaaccugggaggcagagcuugcagugagccgagauggugccacugcacuccagccagggcgacagagugagacucugucucaaaaaacaaaaaacaaacaaaaaaauuagccaggcgugguggugugcgccuguaauccuagcuacucaggaggcugagguaggagaauggcuugaacccaggagguagagguuacaguaagcugagaccacaucauugccuagccugggcaacaagaguaaaacuccgucucaagaaaaaaaaaaaaauuaaauugacagauaaaaguaguguauauaauucaagguauacaaugugaucaccugacauauguauauauuguguaaagaugaucacaauaaaauuaacgugucugucacuacccauaguuaucauguucugugaguuuguauacauguacaguuaagacacuuaaaaucugcucucucaucaaauuucaaguaagcagugcagcauuaugaauagucaccaugcuguacacuagguccccagaacguauccaucuuauaacugaaaguuuguacccuuaaccaacagcucccccuuugaauuuagugauucucuccuuuguggagagaaucagagggcuucagauggaagugacucacaaauccaaauucuuuagguuucuuauggaaagaaaucauacugguaacagaccagauuuucagcaauguugccaguuaaaugauggguuuuggucaacagcuccaaaauugauguugccacugacucuguuucaugugcagcuuccaacauugccaauucaaaagauauguugauccuuucaauguaagaacucaugcaaacuuacauguaggcucuuucuaugguaauacgauauggggaguagagaaguggccaagaacaagggcuuuagagccaaacuaccuggauuugauccuggucacucucuguguuucaguuucccccacuacauaaaugaggguaauaaccuaccacacagaccuguguauaagauggguuauacacuuaaaauaaaugguuaaauaaugucucaugcacuagaagaggccaagacuugaaaguuguuaucauucuucugaaauucuggaguguauucuuggcacuguuauaaagcuuugguugagcugcucuguacuuaaccacuuccucuuuuuguuuucuuaucuugaaacgcaucauacauaacaaaagaauggacauaauuaauguauauguaccuuguagagaauaacaguaaaauaaauauuuguguacccaaacagcguaagguacaaaguuauaacaauaaauguccagagccacugugcucuucaauuaucucaucaaacccccuucaccauccuaauugguguuuuugucauucuuuugcuuuucuuuauaguuuuacuauauauuuguucaucacuauuuuuaaagaaacuuugcaaguugcucaaaaauucucuuauggccuauuuucuuguuuacacuccccaucugccaccuuuuuuaggcuucccugcucuccucaaccagggaacugcugcagauuuagaaagauguuuuagucuccacauuggccaaacugcuuuucuucacugauuaguuuuugaagucuucccccacacuucccccacccuuccccaagaccucaucauugugauccuggguagcuaaugauaaaugauuuuaaaguuuccagguuuucuuuuaauaucuauacuuccuauuuuuuuuccuaaaagcugaauuuuacugcauuuucucuuaaaucugucaaaacacgggguagaguucucugguuuugcugaauucacuggaaugguccagcuuccggccagggacuguccucugcagcacacuauuucauccauagauaauguccgggguguuuucuacuuacuggggccaaaaugugcugaacuuuuuggguucugaguuucauguuucagaaacaaucauaugaccuacguacaugccuuacuccagccaagaggacuuuucucaaacccuggaucacuaaaauuccauuuucacagccuuaucuaauuuuucaggugcauuuacagauaaugccccacaucacuaggucuggcccagugccccacggugugguccugauguuggcccaaauuacugaggaaagggaauuuccacauuccuagcuuguuccuuuaugcucuucauccuguguaagaaccaguguaaaacaauauuuuacaaacauaaaagggaccuuugaaacuuauuugauguguuagccugccaaaggcaaagucaucacgaaguggaccgaaugagguugugguuaaacuuccucaauuuucucuucuaaauuaaaaucuagugccagacaccaaaagguuuccucuuccugucccucuuuuauuaaguaguuacaauggcaauuaaaaagaccccuuuggucauuccacacuacucucuacuccaaccacuuccuauaaucuaaugaugcuaucuuggcaaacuaauauuauaaagauuuuuuauuaaaauaaauagguuuuagaagaaacacucaaucaaguaucucaguggauguguuuccugcaaaggcaauggcagcacagaaauuaaaaacuaauucauccuucuagacagcugcccaccuugcucaauaaagacucuacuauucauuccuuauggccauugauuuuugcaaguaauaacagagguugagaagaaaagcguaagcuuuuuuacagauggauguuucuaucauuugccaacagcuucugcauugucuauguaauggggaaaauguaaaaauuuaucuugugcuaaaaggauaacuauuucagaguaaaaguaaugcuuuugggcaauaaagauaacuauuucaguguauuauauuuucuuuugggcuaugaagucagaugaugacugauuuaaaccacacaaauaucaacaguuagacuauucuauuugucuccucuuuaagaaaaaaaaaaguuucagagaagaguuugcauaaucccaacccuaacucuucagccacuauauaaaguaucuuaaauaacuaugacuuagagauacuggaaaaauauuuggauuccucugauuuaugauuuuuacaugcaauguuauagagaacacuucaaaaaaucagcuguugauguauacgugaugcucugaccccaagauacaaucaauauuauuuaauggagacuaauuuacccacacggcagacccuucuuaaacaggguauauccagaaguuauugggcuaagugcggcaagaaugcaugagucagcuggugguuagcacccaacugagcagcccugggccagauuaggauggauacagcagaugaaagaacaugacagguucaugcucaguuuucauuugaaaugcauaugccacaaagaugucgcuucuuucacaaugguggagcaaacucuccauguuggaaaugacaaagaagggacaaaagaaagauaacaugaggaccuucuaagccaucagaauaucaggaaacagaagcagacauaaccaucuacuuggugccuccauuccacagaauccuccaaaaggaagucaagaaaguccaucguugccacagaguccugagcaauaauucaccacuacuggcaacaucugauuagaugagcugcuuacuaaucucagccacuguggucuugcagaauugcagcuuaucuagcuuucccgugcuuaugugauccaaggaaccugaugauggcugcauaacacaggcaaaaaacagauggggaauaaguucaaggucuauucucugggacugucaccuuuaccaaaggugucugaucccacugguggaccuccauucugggucccugauaaguuuaucugcugauaaaagucccuacauguaccaccuacucuuuuccuugaugaggaagccaggaguggcaaaaaugacugaaccaacaaugucuccaaugugccugcaguagagccccaggguggcucucuuguguucaaucuauuuuauacaaucauuuuuaaaaacacaaaaauagacuuguaggcugggagaacuauccaucuaguccuuugggagagucucucaaguuaacaggcuaccauugucaugaaaaggccucaugaccagccauucaagggcugccugcccacaacugcucugaaagacacccauauuccagauacuagaaacacucugcugcgacugguacccgacaaaccaacaaugagcaaugagaagcugaaguuuaacauguuagccaaugccagggaacacugcaaguaaccaaagggcuucaucggggaaagagaacugaaagcuuugccugaauucugcuucacaguccaauguguucacugggcauaaaauaguaagggcuagguaauauguucuuugggagugugauaggcagaguucagcaucaugaagaccucacaaaauucaaaucaaacaaaagggcagagucaugcuuucuuggcaguuggagacugagaggugacaugaaugucgcauguugcuccugaggcauuuuaaucaguguccccuaugaacuuccuuuagcacugaauagaaaggaaagagauucugaaacagagccaaucugacaacacugcaacacucaguguauuugcugagcccaaacugcugagaacauguggugguuggauggaaaccagacaguuaagcaacggucgggugagaugcugaauggaaaugaauauaagcuggguggguggacaaaauccucuaagggcacaauggcacagcuuccauugccauggcccagccaucaggugugggggaaagcaacaguuggacgaucuuagccaguggaaaugagacagcuucuuugaguggacucuuugaagccuucaaggaaaacagcaggcagcuuuggcccaugagcaauaggcucuagagacagagaguggugaaauaacaagccaaagaauaauuuacaugagcauggaagguccuggcugucaaauugcuugggugagccacacagaguucacguguuugacgacagaaucagauucagaaagaucucgguuaagcuggauggaccaacccagcaaaaugaaauguaauagagauaaauggguauuauauguagguccaaugaugaaacuccaagaacauauauaugaguggcagcuuagcagcccugugugucuaaaacuuagaaguuauaguugggagccaucaaagaagcaaguugaugaaaaauuaauuugauuaauaauguaaaacaaagaaggagacaacccuguuuacagaccaaaggcuccagaugucauccauuaggaagguguucaaagaagaggaauacaggaagucacugacagcauuuauuccgggggugugagaacucaaggacauaaaggcuuacauuuuaaaggguuaugauguggacaagagauugaaguuauucuauaagccuauuauggauaaaaugagaagcaaugauggacacuacaguucaaucauucauucaacaaauauguuaagcuccuacgaugugucagccauugugcuaggcagcccgauuggcaguuaaggaaaacuuucgcaauacucaagcuuuccagaaauaaacagggcuaccuucuggacacaauucacacaugguugcugaagagaguaaggcaaaaguugaaauuucagucuuagacugguuggaaauggaaugcaugcaucuuaagcuccccaccucagagagguuuacaaucaucugugaguuacacuauguaccucucuuuuucaguucuuccacauuucaagagagaugcuaaccaacuccacaugguguucaguagaaagcagccaaagccaacauuggcaaauuuaaauugaaaugaauggcauuuuaaagagaauacuggguuucccauagacucuccaggagaccugcaaaaauaggcuugaagaccucaucaucagaaaaaaagcccagccaugcacugcagagcuggucugggacgacgccucugcagcgaaccaugagcucacaucacugucaagggacgcuggauggugcuacaggaaaacagcagccuggaaaccagaagaaacugccaccaucaucacccuccucacuggaagggauuccaaucauucuccaggucuuugugucaccagccuccacaagaaagucuggugaggcugaaucagacuggaagagucugggucacgcugggucauggcucuaaguccuggcuucaaggcgggauaaaaaaucaagcacuggcggucgggcgugguggcucacgcuuguaauuccagcacuuugggaggccgaggcaggcggaucaccugaggucaggaguucgagaccagccuggccaacauggugaaacccuauaucuacuaaaaauacaaaauuagcugggugugguggcacgcaccucuaaucccagcuacuugggaggcugaggcaggagaaucacuugaacuggggagguggagguugcagugagcugagaucacaccacugcacuccagccuggguaacacagcauaauaauaauaauaauaauaauaauaauaauaauaauaaaaaauaaauaaaauaaaaauaaaaaauaaaaaaaacaagcacuggcauuuucaguuucuauaggugggcccugccucacaagaaaggggauucuaugaguacacuagaugcugaguuucaacaccuuaacaaagaccaaaaacauucaacauaagguguagccauucuucucccacuacucauuuaacaaagcccaacacuugaagacaaaaggugagaaaauuaaaguuagcaacauaacuucccuaacuugaugaauagcauuugcuucgaaggauccuucuuuaggaagaauucugauggucacagucacucacaaaugggguugacauugacugggaauugucccaguggguuugagauaaggcggcucuccccugaauggaacugacaggaggacaagcugaggagaaaccaggaguuucagcuuguauuacggcagaugaguuuucaggucauucugcugggaaacuaagugaccaggaauaacuuccuaguaucacaggaguaagagaaaccuccagcagucaagaaauccaccacacagucuccccaaggccuauauuucuauauuaaaaaaaaaaaaaaaaacauagcuggcagcccccuuucuccaaaagccuugagagaaagucauuugauaagugagaacugcagguguucggaauguuccuugcuaaugucuuguucuuucucuccauauccccccaauccccgggagugaaagcagaguggaguggaggggcucaccaucucuuccauccauuucccugugguuuccagaagacagugcugaggucagagccaggauaaccucucuggcuacacagugacgcauccacuggggcauuccagacucugggugacacuucauuacgccagacuuccuccaggaagugugagcaggcuaaucacgccccugggcgaggcgggcacguggagggagagauuagcguucccccacagcugucaagcugggccccucucauuaacacccacgacucucuuucuuuccuuuuuuuuuuuuuuuagguccuuugacggcagcucguguacuugaaguaugucacugaaaaacgcacagaugggaucuaccagaucaugagaaugcuuucacagcuuuugaaagagugcuggguuucuuuccuucagaagaaaaaagaaaugcuguauucucaggucuacccauuuuccacucucuuccugcuuuagaaauaaacuauugcagaagccaauguaguaauaaccaacagggcaauaacuaaaaucuagaucuuuugauuuuuuuuuaaugcuaaaguagcuaauuguaucugcuaaucaugucuucauaguucacagagaggguacagcaucugaaauauauucaacauuagcugcaaccuacugaaauccaacaucaggccgggaggggagacagcaggccaggcgagcgagugucugacagauugugcccugagggaagaugugucccaaagcaggaggaaguugcucagggaagggaucuuuuaucuugcuauaaaaguucuggacaagggucugggugcuuuaacauggaagcaguaagacaaugaggccuggaggaagaggaccaagaacugugagucugucucggaugauccagaggcuuuuugagcauuuuaaccaguaucaucuaugauccucugaacaauaucaaagaggaaaagaggauaagguuacuauucucuggguggucacuguguucucuuuuguaugaagcugucucuuugugcauagaagaaaaggagcuaugccaaggcccaacaguccuauuauuuucuguuuuagagauagggucucgcucugucacccaggcuggagugcagugguuugaucacggcucacugcagacucgaccuugugggcucaagcgauccucuggccucagcuuccugaguagcugggacuacugaugugcaccacugugcauggcuaacauuuuuauuuuuuguagagauggucucgcuuuguugcccuggcuggucucgaacuccuggccucaagugaucccucugccucugccucugccucccaaagugcuaggauuacaggugugagccaccgugcccagcaaacaguccuauuuuuaauauaaguuccuaguucuggacuuccagguggcaccugccacaccuacugcacccagucagcuuagggcuuucaccaaaaaaaucugacaccaagaaaagcggguccccaggaagcgguaaacuacaagaaauggacgggauuugcaaucuucccagaaaauacccaacagcauuuaucuguaaagacuuugcugcugauaauauuacaguacuucuuaaaucucagcaaaggccuuccauaaaaagaaggcauucacucaauaaacauuuacucagcaccuucuaugcccaugugucagcuguagagcuggagggugggggugggaagagaggagggaaucuaagaugauuugauaggcucgcuacugcauagaaccccaucauuuaaaaugccacuaauacaaucuuggaaauuaugaaguuuggggacuucacaggacuuugacugauaaguaauauugaaaaauaauuacucaaacaugcccauuuaucuccagcccaguacagccacuauugugcguccuuucaagggacaucagggcagcagcacagcuuacccuggggucccccugggcaccccagcauaagcagugaugugcuagacagccaccaaaaccaaaguauaacuacaaaaccuuguuccaaaggguucugggggagauucagggggaaaaguuacauauucuuaaaauuuugaucacugguggaugcacucaaaauccugcucuucucugggagcgauuuucaugcuguuccugaaagcucagaaagaauaggaaaauuuuauguucagugauagaugggcuagacaaugggaaaccugcacugaaccagacacaaaggaccuagcagaggugacgccugccagggcugugcaccuguguuuccuuaacaucugcugggaccccauuaguaaguuucuaugaaaaugaauuagacugugugccuucuggucuugcgggucagucucuuaccucaacaccagugucugaacugaacagagcuuggcagauucugauucccccuccaaccucugccccagccuuagccucugcaccaucuucuuggcucugcucuggugucaggagcagcaaacagugcagucugcaguuagcaccuugucacugcucagccauaagccccuagacgugacagaauuacuccucugagauugaggcuguaguuggcuaucuggacaaccugcaucaacuuccuacacccacaacccucuggaccuagauuucuacccugacucugcagccacguaggccccuuccccacagcagguggaggagagggcaaggucaugucugcccucuuccaucaugugugaaacuggcugagaaaagcgggguuguacccucagcauccuagcucugagaagaaccugcaccagcccugcuggaucuacccaugcagaccccaccccugugaucuccuggagagcuacuuccuagauaaggagguaaaacucauggagaagaugggugcccaccugacaauccucugcaggccagcaggcccccuggcaggcugggcaaguucccccaagaaaauaauugaaggcacuuuguaaccaucuuggacccuucucucuuaagcuguggaaaaagugcagacaauauagcuuuuuguuggaaaaaaacagcaaccauaagaaacagaauuugacaauuuaucaacuacaccaagaagccacucuguggucccucaaauugauuuaaauaccauaauaugucauuuaaaauguggacucuggaacugggcugccugaguucaagccucuuuguaucucaguuuguucuccuauaaaauaggcaauauaagauuauucuccucauaggcauuuuguaauuacagauugcacaucccuaaucugaaaaucugaaauccaaaaugcuccaaaaucugaaacuauuugaacaccaacaugacacacaaggugaaaauucuacacacaagcauuaacacaaacuuuguuuugugcacaaaacuacuaaaauauuguauaaaucaccuucagacuauguguacaggcauauaugaaacauaaaugaauuucauguauagacucaggaaccauccccaagauaucucauuaugucuaugcaaauauuccaaaauucaaaaaauauauaaagucagaaacacuucuggucccaagcauuucggguaagggauacucaauugguuucggauggacagcaaagugccuggcaucuacugagugcucaucuaaccaaguaaauaugagcuaucauuauuucuauuaaauauuuauuuaaaucacggaacuaugcuugguucuauuucucaccucaaugaauucucuaugauccaucgcgaaaauagauuaaaaacccagauaaggugauaaaauuacuguucaccuaaggaaaggcucauaaaacuggcuuauuuugcagauguuucuucaaggcugacucuuaacaacuaaucgaaggccguauugugaacauuguuacuacacauggaaaauauauuuugagaaauaaaugauaaaaguuguaaugugaacccugaaaucauaacaauuaacuuuaaaaacucugucacauuaaaaucuacuggucuuagacacuggggacuccaaaacaugggaggaauggagggggaaaaggguccaaaaacuaccugucaggugcuauguucacuaccugggugauggguuuaguugcaacccacacaauacaugacaaagcccucaguaucacacaauacaucuauguaacaaauuuguacaugcauccugcccucccaaaucuaaaauaaauauaaaaagggaaaagugggccaggugcgguggcucaugccuguaaucccagcacuuugggaggcugagguggguggaucaugaggucaggagaucaagaccauccugguaacaugguaaaaccccaucucuacuaaaaauacaaaaaauuagccagucgugguggugggcgccuguagucccagcuacucgggaggcugaggcaggagaauggcaugaacccgggagguggagguugcagugagccgagaucgcgccacugcacucuccagccugggcaacacagcgagacuccaucucaaaaaaaaaaaaaaaaaaaaaaaaagggaaaacggcacauggcaagaacaucucuaauuagugaucaccguagaaaugccuuaagaacuugauccauauaugugcuuuugccucugaguccaaaccuauuugucuaaauaccacauuuugggaguuugggggaacagauuucaaacgauguggagacaagcacugagaaagaccaccacagagcgaaggggaucuauacacacagacaggcaagcacaguguugucucugccuaggaacaaucccuccaacccgaggagaaauccuaggucucauuuuaaaaauauccuucagaaaagaaauaccucuucaacccacacaguucccaaugaaguccuaugcaaaaaugcuucuuacaaaaauaaaauaaaauaaaauaaaauaaaauaaaauaaaauaaaauaaaauaaaauuuaucggucuaucuugagcucuaaaugaaucuuuuacacaugaauaauuuuuuaacaucaugcaucggucauuuagaaaaucuugguucacugaguuguacugauuuugcaauauaacaucguucauuauacgacauuuaaaaagcccacauucauuaacauuaccacugaucucaucaaaaaaauucuuuaaguauuuaaguuaaaguaguugucaaacuccugguggcagauacaaguuuucuaaguucuaauuuuugcuuaaaagcucaaauuuuaucauuaacaacaaacacugucaguuguuuuccuugaagugacaaguucacuccauucauuucugggaaaaggucugucaaauacucaaguuugaaaaucauagucugucucuuacccauucuuuaaagugaaauaguguuucgugaauaaacguagcuuuucucaagacaaccauccuaccugaacaggcagaagcgccuugcacauauuucauauuuauagaguauuagaaagcacauacuccacuguugagauuuaauaaaauugguaacguuuguuacuucaucaaggacauucuuaagugaaacuggcauuuuuuaaaaacuggguguucguggcagaaaagaacaaaaugacugcuaauagcguuugguagcaccgcuuugauuccugcuaaguugccugcaguacugucauccauuguuuuuacaucuaucuaauguauuaucaacacagugaaaaaagacaaacaacauuuuuguauuauuaugaagauaguuuugaucuuggguaugcauuguaggcaucacugggcuuucaaagacucuaccuggaaaaucacugccuuagguagacuccuucaccucugcaugccucaguauucucaucuguaaaauggagaggauucgcaguacauguccugcagggauguggugaggacuaacuggaauaaaucauguaaacaaugaagaacaaagcuggccuauggagaugccaucuauggacuggcuauaaggagaucagacaucauuugaggcucuugguuaauccaggugugacaaaaaucaccaucuuagugguuuuuuuuuuuuuuuuaaagagcauuuaucagcuaucuccacugcauuuaucaauuauguccacugagaacauuccugguuauuuuccugagauuguuagagacaccaacaggucagagacucuuucaaaugccaaaacaacuagacuucucuuuaagaagcugggccgggcgcgguggcucacgccuguaaucucaguacuuugggaggccgaggugggcagaucacgaggucaggagaucgagaccauccuggauaacaaggugaaaccccgucucuacuaaaaauagaaaaaaaaauuagccgggcguggugguggacgccugcagucccagcuacucgggaggcugaggcaggagaauagcgugaacccgggagguggagcuuacagugagucgagaucgcgccacugcacuccagccugggcgauagagcuagacuccgucucaaaaaaaacaaaaaacucuacucacuguaauuuccccugauguggccugagaacauuaccuagcccacuucugcagacuucagagcaugucuucuuaggggcugucgcucaaaaacacuggaggaaaaagguggauguuuauauucauguccuuuugugugucuguguucucaaaauauugugacaccaagagacagaagagaaauugccuggucccugaaccugaugugcaaugucaguucucuuugguucaacgugguuuucaaaaacggacagacucuaaacaaagguaucugucccuuuagucaacgagacagggaacugauuugggggguuguuuuuuccuaaugauacuagguugaauuuuuaaaaauuaaagcagauguggauauauuaggaaguaaaauaaaaacuugugugauuuuuuuaagacaauuuuuuuuuugacuaaagaaacagaacuuacugaaauguaugauucuggaucacagggcagaagguuggggcaugggaagagcuacaagaaucuucauuaagaaaacuggugaaaugugaauauauucuguggauuauauaauaguauuauaucgaaguuaaauuuccugaaucugaaugauugucuguguuuauguaagagcuuguccuuguucuuaggaaauacauugaaauauuuagcaguaaaggggcaugaugucugcaaguuacucaaaaaugauuaggaaaaaaacauuagagugagacacggagaaaaagaaguaaauaugguaaaauguuuaaaauuguggaaucugaacaaagcguacauaggaauuauuuguauuaugcuuguaacuuuucuguaaguuugaaaucauaaaauaaucaaaauagaaaguuuuaaaaugucauuuaaaaaaaggacaagacauucuuuugaguuucuugugucacuuauuaaugacagugcuccccaggcaauuugcucccugcuuaucuguuuggccuuguccuguaccaucuccuuguccagcucagagcacugcaaccucugggcccuugucucugacccucaagugggccccgaucugcccccgaggccugugguucugggugcucccuaguccugaccacucuccaggcucuccuccuccagggcugccuguuaucaccaccucagaggccuuuccugauccuccuauuuaaaggaguccccucacuuccacuucugucacucuuuauaaccacuucuauuuuauuuaucuuucaaauaauauuaccacugcccaaaauugcuuuauuuacaguuaucuaucuuccuccaacggauuauucuccaucuggguagagaccuugcauuuuuggucgcuaccacuugugcuuggaacauuguaggcacgcacuagauaucuguuagcugaaugaaugaacagauguccccaggaucuggcagugggcauucaagcucuuccuccaccagggguaccgggcauggcaaguacucaauauagauguguugauugaaugacaauaugugaaugaguggauaaauuagagaaaguuucuaauucuaaaaaggacuaguucuggaaggccggugagcucagggauuauacagagaaacccacaugcagccuggcucaauauggucucccaggcaugcacuuugacauuuacccuccaaacagccccagucuggcuuuuguuccauugcuccacaaaagccgucccugcgaaggccauucacgaucugcauguugcugaauccaacaggcuuuuccaucuuucccuuccaugucacucuaagcagcacuugacagagugggccccucccuccuccuucagugacuauuccucaggcuucuauggcacuggcgacuuccaguuuuuuccugauucucacucuccucugccagcuccucuccaaucacuuaagaucccuagggguuacaaagaacccaguccugggccuccuccacuucucacuccaugcucauucccuaggacaugcuaugaaucccgguggcuuugaagaccauuuguauucuaaguugaguccugaaugugcaucuccagcccagauuugcuggcugaccuccagguaccuuuauccaaccgccuagcugauacaaccauuuggauaucucacagaaaucucaaaaugucucaagcugaacucuugaucuuugcugcuaaacuucuccuuuuuccauccuucccgccucagggaacauccaccuuauaaacccccuggaucugucccucucacauucacuucaucaguaagucaggacaauucugccuccaaaagauaucacacaucuacgauaccccgauccaucuccagugcugucacuguauccuaagguaccaucaccucucccccggccugugucccacuuuccauucucgcucaacuccacucuuuacauagaacccagaggagucucuguaaaagaggaaucagaucaugucauuccccugcuugagauucuccaacggcuuuccauggccaguagaauaaaaacaaaaauucuuaacauagccuaagugguccuauacgaucuagugccuccgcacccucaugccaaaauacuuucucuuggcucacgaagcucuaguaacauggaucuucccucaguuucccuaaaauauaaagacuucuccuaccccaaguccucugcacaugcuguuucucaaccuggaacguauuuccuccagcuuuucagcucucuaagucauccacaggcucucauucauauugaaagguuuuaagaaggaaaauugcuuaaagucgaguuggauuuuauaguggcaaaagaguagaaacugaauuggaguguugcuggacauaagggcagguugguagaguggguggaggcuacuaacgcugagggagagaggaagauaagaaggucuaaccuaacaacauuuccaggacagugaggaauacacagauucuugggaaauuccugucucccaccauucuugggaaacauuccuuaaggacaaucaugggaaucagcuggacaugguagccagcauggaaaugcugaagaugcccucucaguuucuggguuggaugaaugacucgucaaacagugaagccacugagaagugggauugagggggagauguaaucgguaugaagggcaggaggaagaugaugagcucaguuuggggcaugcauuugggaugccagggggccuucagguacagaugucuaccaccugcugugauggggacuugggaaaaugcuaacaauuggaaucaccacuaugagaaaugagacugaaagugauuagaagcaugaagaaagaggcugugaggcccauggguggugaaagccauuacaacugauggcagcauagacagggaaccuccuuuaugacgagacugucacuggcacuuuauuaaagaccaucauucuauagucagaaguucagaccauguucacaaaacacaugaagccaggaugauuauuuuuggaaugcaaugaaaagauuaaaugaaaacauaaaacuauuuuaugagcauaauauacuacuuuguuuagaaaaauauauacugcuuguuuguuacuaguaugaagguugcuaaauagagacuagacacuaucuagacucuagguguuaauuuuuuuccauuccaaaacaaaguaauucacaaaaacgugcacuauucauucaugcaauaaguauuacuaagucccacugugggccagaugcuauucuaggugcuggagagagaguaguaagaaguacugaaggcacuaaaaaaaugcauguuggaugaacacaucaaaucaaaucacucuauuauuacaucacacccucaacacugcuccccaguuccacagacaugauacuaucagucagcuuaccuugauuaguaaucauuaaauguugcagaaacaccuaacaguuaaguccuauguugaaaaaaaauagacauccaauaaaaugcaaauuugugguaagcaguaggagaaaacaagaagcggaaagaggaagguugccuaaccucgauggcaauauucucuaggucauccgugagcuuugaguugugaagaaaaauccaggcaggucaauuugaccuuggaacagaauucuuuugguugaauguuaaguggcuaaauuacaacuuuggggagaaacaguucuugcaauggaacgcucuucccugccugauuagacuuaaucagacuuuuuuguacuuuagggucagggaaaauuuucaaccuguaaucauguacuuauugggacacacuaagaguucaugauggauuuuuaaacacccagagccuuccaaauuaacucaaagucucaugauuucucccuuuaauauguuacuuuauaacaaguagauuuuaauaaaaauuaagggaaaaaaauuucagguuucugccaggaggcacugacuuguauuucuuccaagucucaugcucucuggggguaugcaucuacugaauucauaaaauaaaaacauaguaaaugguaaauguaaauguaagaagagguaagacauuuccaucaauucccuaagaaaacuaucaccaaacucuugauuuggaaauaaugaagucucccaaguaaaaguaaaaggaggguuggcuaggggauucccaaugccugccaacaaaaccugguuuagacuuucuguuuuagagcauucuggccaauaaacuucacagagauuuaaacaauagcccuuuggauucacuuuggauuccuuaaguccauggacugucuuucaaauaucuaaaugaaacuagacagaaguuagaaaaaaaacaacuagauaacccuaaggccacaaaauuagguaacuucagagagaagaugucagaauuuuuuuaugugcaucaagucuauacucaugggcagcccaggaaucugcggguaagaagcacugaagugauaacucauaggguugaaaaaaauuccggagcugaucacggugaaggaaacauaaagcacgcaguucuaaaacuguuuuccagauuguauucuuuaacaaagauaccuauuauuuaugcuuuugaaaaaagucagugacgucccuacacaguucauaaugaguucugcagauucauggaauuccuuucuugaaaucauuuccuuucccugaacuucuauguuuauaccauccauaguaucacauccaucuuccagcuuauuuaaauucugacugugaacagggaccauguuuguaucuucugggcugugcucaucaacuuccuaguagcuccauaaacguguauaacaacaauauuaauaauauuaaugaagcacuacauuaaaaacuacagcguguguaucaguauuucuucuauuuccuugagguacagcaagcaaccuuuguagaauuucucuaucaccucguggguaggagaaugaaaagaguuucucugucaagaugauuuggagcuuuuggauaguuugcuccaagucaacaggguauaaaagaaugguccuuauacucuuguguauuuugccaaaggcagcaaaauaaauuagucaucauuucacacguggccaaguucacaaaccaucacaucuugccaacgugcccaaggaccauaucugugcucugcgaccuaaauacagaaacccuagucuuaauguccaccacuuucuugaguauuuuauguccuuuuugauuacuauuaauguccaugggaacagauaaaguagcuacaaacucuuuuaacagguaugaguaucagcuaucacuguaacuuucauuaaaauauaaaaacaguuaaaaaccaaacagagcaucacuuuuuaauauuaucuaaaauaacaauaaagguggucagaugguuacguguucauuuaauugcuaaugaagccagaccaauaagucaaagcuggauucccuguagaauaucgauuugaaguauuagcagcaaggaucguuugguaagacagauuuaaaauaggaguaaagauuuuacuuuccaaggauucaucuuugaauucuugugggugguuguuuuauuuccagccugcuaaaaaccauaauaucaccugaagcaagcaggcaugagccuggaacgggagugaaaugacaacgaaacauuuguacauguuauuaaagcuaaugaagcaagacacgcacugccugguuuugugucacgcgccccuggagagcccaacuguguucuggggcuggcuguggcaucuccccaggauauggcucacccugaggccucugauucagcggcagagcuguuuuuccccucgggaaagaccaaacagacaccugaccuuuuauaaaaccucuaggaugaaucacaaguaaaguucuuuggcauucugaggugguggguggaaaucaaggcuugacaggcggccaugggaugggcagcgugggcuggcgcuaugggcuaugccauagcguggagaaucccucacacuaggaccccuggccugcaugucaucuggcauccagaacucccacucaauuuccaaaaggugcuacccacccuggaaaaaaaucuagcccacugaguagcugggaaaauccacagccagggagacagauggcucaggaagaagcaaucuggaauaauagugagggugugggaguuggaguguaggcugggcaaggagaucagagaggaaagaacgggcaucuguauguggcgacagaugacggagugcuguuugggacgagcaguuggaggaggcaaaggaaauggaaguaauguacuuaugcauaagggcuguaucauaauuaggaaaauuccccuucugucuaccccgcaagucccacuugguucagaugggggcagacagcagagagcacuuacuucacggaggaagcagaggcuacccgcuauuccaacaggcuuucuauuucugauagaaacaaauccaaacugagcuaauuuguguacagcugcaggcaauauaaacacggcuauuuagaauucuuuauagaguauaggccuuuguacucuauacuucauggaaguuaauaaguaggugucaaacucugaauuaaaauucccagaagaggacacagcacaaaggacaauaaaaaugauuuuuaaauaaucauagggauaaauagcauccacuucugacaaauguaagugcuggcauaaaauguuauuaggcuacagagauugucuuuuguucaggaaguauauuuuauucuccugccucaucauucaucauccuaaugagcccucaaaauguaaauuaaauagcaaagacggauucauuugaaaagcaucuuuucaaaaaaaaaaaaaaagcuagguguuaaaccauuuuuucuacuuuuauucuauauauuguuucauuuuuucauugaaaaaaagcccucaguacuugaacacuuuaugggguaaguucaugcaauucauauuuucaguaaacaguucauucauucuccaguacuaugggauuggugauuugaaaagaaaaaaaaaaucgcauuuuaaaaugguaugcccuguaaaugauguuugauccggaaaaucugagaaaccugugcacgcauucacuuuuuuguuuuauucagaagugauuugguccagggaaacccucaauggaaaaggauuagugaaaauuucaaacagcuuuaguuuacugaacugaaugcauuaauggcuaagcaaacaccaguucaaccauuaaugauaaaagaagaaggucaugagccaaauuaguugcaauuucuuguuauguauugauaagaacauuacccguuccuaugaugaauagagaaaucaggguuuuguacuugaccugaauuuaugcaugagcacacacaacagaagugacugaacagcucugcuggggaggcacccaggaaaaacacgcugggaaaggaaaauagcagcaaaucaugucucauuuuggcaugauugguccucauuugccugucucucucucucucucucugucucucucucucucccccucacucuccccacccucucucacugcaacccauaaaucauucuucgcauucuuuggcuguuccugcuuaugugagagagcucagcucccagcucucugugggugaacauauauaaaaugaagacacaaguaacugcacuguugagguuugccugauguccagggaacagccauuaaucugcacaaggggguuucaaaagccccacucugccgaauaaauuaucguuaaccaaucuaggcauucuaaagacacuauauuuuuaugaggucaaauguugcagaaauaucccagagggaggguagaaacuauccagcugugaaagaagcuagugacagcacugcacagaagccugggggguccugcaguggcuacagaccggcugcagcccuggcugaagcacauccucagucugccugguucaugaggacugcugcauuugggaagcacucaucccucacagcagugcccaaugcaggcucaccucuagagaaggggcaucucucuuggaaggucuggcugaugaaagagcauaucaugacagacaggagcucaugguaaagccugcauaauccacuggccauccuguuccaguuuacuuacucaguuauuuuuaauggagaauuuucuuuuuaaugugacagaacugaacucaaugcaaggcucaaggcugucgucaugacaguugcccacauaaagaaacuguagucugggcccaaggcauggcccuagcaauuucccaguaaugcacauuuugacgggcacaucaauugguuuaugauguaagaacaacacuaauuagugaggaagaagccaauguccuguguugauagggcccggugcaguuuaagugaugaagugaacguuacuucuaacaaaggaaaacaagguauuauucugcacagauauuuaacucugaagaaguguugaacaaugauagauguauuuuaaaguggaauugaagcuucauccacaguuuaggaagagaacuggcuaggauaucaauaaauuguuuuauauuugaccccaggcaggaaaaacaacaugcaacccagggaagggauggugccuugcugugaaauaugugcauuuuaaccuuugcaauauguuaauaauuaauaugaauucacaccaauacgauaucuucauaaaaacacagaacucucauguauaaaaccuuucaaguauaaaagaaauaagcuacccccuaaagguuuucugaaaaaaauucccauuaaagaagguucucacagucugaauguagagacuuuuaaccagaccuaaaauucuugcgaauaagccccaugcuauaugacugacagcaccauuaaaaacgcuaaaaaauaaaauacacgcuucauuagucucccagcugaacucagaaucucuggcccagaauaaaucuuagccuuuaagaauaaauucucuucugaauuaacaucucagagucauuaaucuuuggagugacccuucaauuucauuuggagaacuacuacauuccucaaaggucuuuuuucuuuuggcaagccaugauuucauggagagaaggaaaauaacaugaucuuucuuuuaucauuuccucauucucgcccucaggguggcuucucuucccuucccaacugaaacauccuaaaucuaaaaucaacagagagccuucuacugagucagcaaggaacuaaaauuuaacuuuagggauacgugaaaauaaaaacaagacuaggcagaauuauuauuauacauuucaggaagaaaggaagcauuaucgugaacacaauuuuaccaaauuaaaaaugguacagacuuuauucucuauuucaggggccuuguuuauuaagcagacagaacucugcuugauuauuccaugaagucgccaaccauuaaucaugcacauuuguuuaacaggucaaaugaagagaggaaauuugugugcagucacggcaaauacugccucauuuuacccacugugauacuaaagguacagacaucauguuguaacuacauuaggagagauugguccauaaaguaauuugauuauaauuccuucuugagcagacaacuauuuuugaaaagcaaauaacuauuuauuuuuugauuauuuauuuuuaacugauaaaaaguauacguauuuaugggguuacgaugugguguucugauagauuuauacauuauggaaugauuaaaucaagcuauuuaacacauccaucaccucacguacuuucguuguacggcuugaacauuuaaaaucugcuuagcaauuuugauauauacauugcuauuaacuauaguuaccacgcuuauuugcuuauguauguauguauuuauuuuugagacagacucucacccugucucccaggcuggagugcaguggcaugaucucggcucacugcaaccucugccuaugggguucaagagauucuccugccccagccuccccaguagcugggacuacaggcacauaacaccacaccuggcuaauuuuuguauuuuuuuuuugguagagaugggguuucaccauguuggccaggcuagucucaaacuccuggccucaagugaucugccagccuuggccucccaaagugcuggaauuacaggcaugagccacugcacccggccugcuuauuaaucaagauuuucaaaguuagauguuuaauuaaaggauaauaugucuauaccacucauccaacaauuuucacugugaagaccacauuagccagcucccagaggagacacauucuggugaggggguggcuggguucaccauauucgcuucuaccauccuccaaucccagccucucccucuaccugggggauucacuggaaccauccauuuguauucccacauuuuuuguguucuuaagccagaaaugucucccauauagcuugccaacugcccaccgcuuccaaacaccucuauccucuacugccacgugaaucuuaaaauagagcuuccacuguucaguucuccagacucaccagccguuaauagccccucaucaccuagaggauaaaucuauaguccucagagccaaaagcagcccugcccucagccuucucaucuggcucauuugggcaauuucuucugaacagucuacaggcguuccuauugggaacaucugcucauccaucccaccugcaaugccuuucaaaaugugauucaaauucauccacuuuacccuaccucacacacaaaggccuuucccucauuuucccccucaaaacccaaugaccacacugucuugcuugauaugcauucccuccugucucacagggcuauuuaacauuucacuuguuuaagucuuauccauguuucccugagagcaggaauuguguuugguacucacaugcacacagccugcauguaacaucacaccuuacccagaguaaagacuaaaacaaaaauguaaucauuuaaaacuuauuuucuuguuccuacuuucaaucaaggaaucaugagucucagagauacucuaggccccuaaaucuauauuugugcccaggaguugcugauuucagggaugggaguuucaaagagagggugcagggucuuuuuuaagucuugacaauuccauccauggccccuuguaaguuuuagagguugugaaagauacugaauccuugggguuccaugaacuugucuguagugggucugugcauucacuccaucauacucuugguuggcagagaagcucagccacuugggccacuggaacaaggucauuuggagggcagaacucagcucuggggcagaucauacgcacaggauugguuuuggaaucuaucaugugauagagcuucuccaccuaccuucucuuacuacauuaacccauaagagaggcuuaccuguuaccaacuaguuucaucacauacugucuggagauaugacaggagauacuggaacaaggaacacgcagacagugaaaguuuauugauucaguuuacauuuaaugauugauugguagaaagagaaacaaguccugaacaaagugugccccuccuucuugaugccccaaaaugcauuuaaaaaucucuuucaaauauaccucguauguacccucugccucauaccuaacacugaucacauuuuguccaguuagauugcaccuuuccuaccucagaaagguuuaccugaccuuacuugaccaugcuagcgaggucugaucaccauguuccaugcacauauuuuaaaguugguggagcacuuacuuugucccuggccagcuccugcuggggaaccuugucuuuaaauggacuggccuuagccugucccaacauacacaugccccaagaugcugacaguaaauuacaacauacucacucgagucauuacaauuuuuuuuuuuucaggaauaaaggagguacgcgcaaggucagagagccuccuaaagcaguuuggacacauuuccaugaugcucucugccugagagcagagcuaaaaucauccacaguccucuacugccucccccuccaugcuacaaaaauguaaaagaugcacauuugccauuaggaaaacuccucauugcauuuuggacuugaaguccacuggaguagggccauuuaaaaauggucuauauaccacgcuucaugaacaaguuuuauuacccaaacugaaaaaaauuagugauggaaaaaauaaggcagauguauauuacaucagaauaacugcugcagaaaaaauuccaacaucauauuucauuugaagauuucuugaauggccaaagagcaguauuugugaaaauuuuuaccauauguauuuaggauacuuucuuaaaguuuuauuuuuuaaagacuucaauuuaggaaaaccauguuuaaaaugcauugacuucaacucauaccuagugcuguaagaaguaaugcaucucccuuaacgaaauguccaguuacuccuaauuuuuaagauuucaucacuucucucuuaacuucccuuaaugagaaggcugaacuagcucgccuagcugaauuuaucaguagcccaugcuugaaagagaaaugguucugcccucuguugggggcaacaggugugcugauggaagacagaugagcuaaucuguucaccugaauccucucugucauguucaauuuagccucagucuuuagaaacacaaccuaaaaggucuaaggcaaauagcagcuguccaaaucagagaccaaauuagagacccugucccugaguccagaaaggguaaacauacucuauuguuuccucaccauuuguuuuuggaaacacaaaauuauaggagggggaaaaccuuauuguuauuagaaucaucuuucagcaagaaagacaauaaauucuaagacccuuagccuuuuguauaacuguucagucaggggaguguuagcacugugcuuguuaauuuagaaucuaguuuaugaagcugauuaucuuuuuaaagcaacacauuauccgugcucacaaaauaucauaguauuacuaggaauguaguuaucacauuauauuguaauuaucacuuaaauaucugcgcuguuuaccaggaaauauaagcucuucaaugucaggaguuacuccuuuuucaaaaaaaucaugguucauaacacaacauuugaaacauguuuagcauuaaauaaauauuuauuauugcuauacuuaucauuaaacuacgcuaguagauaucaacuauugaguucuuauugcaaaaggcaucgugcucaacucuuuccauacauugucuaauccuuuauggcaucccuaugggacagguauuaccacccucuguucacagguaagcaaacaaggcuuaguaagguagguaauugcuccagaucauucagcuguguagggaagagacaggcuuccauccagggccacccaacuccaaacaggcacgucccuaaaugcuacacuaaauauccauggacguccaugauucugagaacuagcucucugcacucacuauuuguaaucaaaaucagcaaguguuauauuaauaacuucagaaacgcugucauagucaaaaauuugcaucaaaugucuuagaaaugagccuaauagucacaauacuuuucaucauccccaagaaagagacgaaaaaguauauucccaauaaaauacuuggauggaaaggcacaacucgaaaaauaaaacauuguaaaacuucacuguaauaugagaacaaaugaagagagcagaugaugaagguacuggaauaaauuaaagagagcucaucuauaaagcauagauaucgaggacaaacuuacaacuucaaaugaauaaaaacuguuaauuaaacaggagcuucaguauacauauaauguuugaacuuugucauuuaaaaauagcauuucguuuucugcaccacuagaaacuacauuuugaacacauucaggauuucacagcuacaauacuagaaauguuuauuccaauuaaauguuacaauuacucuacuguguauuaucuuuuccuuuauuucucccuauuucaucaauuucuuuuuaaaaauuguguaagucaugcaguuuuugaaacucaccaucuuacaaugacuuuuauucuuaaguaugucagauggacauuuaacucgaugugacuuuaagaacucuuucuuuuacguaaucaaucacuuguccuaaaaagacuaaagcaugugcaucaaaacuguaucuuuuuuuuuuuaagcaugcagcugucuuugucaagcacugcaucuuuucaaggaaaugucagcaauguuauucuugggccuccuucugcccaagaggccaaggagggaugaacaaugacggcaacaagacacuuaaucaauagcagucacagcaccauuuuuuauccuccagaaucuucauuuucaaugagguuuacaucauuaaaguaagaaaacaggaccgucaaucuccauuggcuucaagugguggacggaagaauuaauuugacugccauaaaaauaaugauguagcuguaugcuuuaaaccuuuaaaaauuuauuuuuaggcuuaaaaccuaggaggaggacagacauguugccuagaaauaaaagcacugauuuaucaauucuuucuuuuucuuauauucuagacagauuuuuuuuuuaaauuuuauagauguggucucacugugcuguccaggcuggaguacaguggcuauucacaggcgagaucauagcucacugcagccucaaacuccugggaccaagcaauccuucagucagucuccugagcagcugaacuacaggccugugccauggggacugacuccacacagauuucuaacagaucugaaucuuguaaagaaaggcaauagguuucaauccaaguccuuuuaagguguuaugaauaauccauuugaaauauauuuauuagcagagguaccugugccauuguuuuugaaucauguugacacaugccaucuccaacauguguucucacuaugacagauuuauaugaaaggaguaaaaacaucacaagcacccgcauaacgccuucccaggggcagaggcagguuaucugggcccuuaaaagcuauaaugcuaucuuuaaagaaaaaagcaaaauuauggguuugaaauuaaguagagggccuuagaagaggacacucaaccccggagcccugaaacuuaagcuguuuuuuugagacagagucucacucuguugcccaggcuggagugaacuggcgugaucucagcucaccgcaaccucugccuccaggguucaagcaauucuccugccucagccuccugaguagcugggauuauaggcgugugccaccacaccaggcuaauuuuuuuuauuuuuaguagagaugggguuucuccauguuggccaggcuggucucgaacucccgaccucaggugauccaccugccucagccucccaaaguguugggauuacaggcaugagccaccgcauccagccugaaaguuagacuucuuuaaugguaaaucugccccugccucauccaccagaaaacacaggugcccuuuugcgugugcacaggcgaguucugaaauaggagggcucucuguuuggucuuuuuguucccacaguguucucccccgagugccccagacauucugugugaauuugguacauguaccagcauacgccuggagugguaaugggacaccagcucagccagcggugcucugugaauuuucuggaaaacuacagguggccacuuccacccaaugaggcagcagcaagggaaauggcaggacaggugaaggguuuugauugguacaaaauucagggaacacacaggcucugucauuagguguacguucuggguucucaugccuagcucuauacauucaaauacuuugcuucuaauccuuuaguuuugguauucacuucaacugaacauucaucagaaaugcaauuaaaaauacuuuuaacaaaugauugagauacaugcauucccagcucauuuucaauuaugacaaaaacaaaacaagccuugccuggacagucacgaggcuugaccgggcacacugaaugcucagaggucagagugggcaggagccccggagcaggaggaagaagcgggcaaccucucugaguucugcacuuucucccaaccagcacucucucacaggcugcacacuaacuaccccuccgugccccuguccuucaaagggcaggacuguggggguguugggggcaggcuuugacgugcaccacuucugucugggcacagugaccucugcaugccccuggccuaucagguacagauccacagccugucaguugcacccucccugacaccaccaccgggaccugcacagacugggaguucauuuccuugcucacuggggccugccuuccccaggcuggugucuucugauagccaaacugaggggugggagguauuuugaaaugcagauuuaauuauucauguguggugaggccaacagaucaggagauaacugccacugaaaugauaguuuguuacacacaguucccaaugggaggggacaugccacacacggugggggucacacagggaagcaccaaggucagcugggagguagagggagccagggagaaaagugggcaagagccuuuauuguuuuccaugggagggaacggacaaggauuugaguaaguagguuuaggauuggcuauuuggaauaacuucagcgagaucuggagcacagaggcuguccugaguuaucugguauguguccuggauugauuagggcaggagacaggggcccagagugugagagcccagaaaaggaggugggguaugggcuuuggagcaguuguuugugggugaaaggcguguucccagcagcaggccaggcuuuugcugucuccgggaauuagcuagccuuucagggucagugaggcccuaagaugucaaagcuucaaaaugcagaauaaaaagacaugaucaguaaagaagcgaacaaggagcaggcaggugagcaucacagccuccagcagaggcagccagagucugcccagcccggcaggaugcugaagcuggggaagacagacuucucuuaccccugcugcaggugcgggcaggcgggcgacugagcuuuccacuuugguccugugacaaauggaggacagcugcagauggauguuucacccaacaccaagcaagcagacauaaccucacugugcgaggcgauacugccucacuguacagaugaagacacagagguucagaauguguggaagggcuuuucccagggucccacagcucauaguugguagagccaggauuaucuccauuuucucucucaggcccugggcuuaaagcccaccagcacauuuuuuuuuuuugagacagagucucgcucuguugcccaggcuggagugcacuggcaugaucucagcucacugcaagcuccgccucccggguucacgccauucuccugccucagucuccggaguagcugggacuacaggcacccgccaccaugcccggcucauuuuuuguauuuuuaguagagacaggguuucaccguauuagccaggauggucucaaucuccugaccucgugauccgcccgccuuggccucccaaagugcugggauuacaggcaugagccaccacacccggccaaagcccaccagcuuuugaaggucucgcacaaauguuucagaccuuuagaaggaaaauauaugggcuccaaaauaaaaagagaaagcaauaaugucaaaauuaauaauguuuaauuaaacgucuaaaaacauauuaagccauuuuuauucauuguuacauuuaguuuucauuacaaaauucauuacacuugaaaauaauauguagcuuagauuuuuucccacauucuaagaauucuugaguuugccuaaugauaacugagaagccaacuauaaauuaaaugaauuacucauagucagauaacuccaaaagcaaaauuauaaaagcucuuuauaaagagcuuuauaauaaacuuuauaaaguuuaaagaauuuuuucaacuguuguauuuaauaugggaugugagucuauuuuaaucugucucccaggaugggguggggccucugaaagaaagcaggccuacuguuucggaggucuucaaagggcccugccugcaucaaccugcucucaaauuccagcuccuucuacucgcauucccuccccagcaacaccugcccuggacggcaguuccagaggucccuucagagcaggcccacugcugagaauggcucaggggcucugcuuccugcucaagacagcauccgaucucuguagcacugcaggcccugacugcucccacagaguguuauggccucuacgcacaccaacauccugagcaccagagggaaucuugggagaucaauauaauuguggagaauaauucuaagauuaccucccagcucgugguggggcccagcauucaacucuggguccuuccauccuagaacagcauagagggaagguguggacuuggggggugaccaaugccagugaccaaggagaagcuguuccaagggugggcaaggaagggaauaugguugcuuaauucucaccucccuggcgcucccacagaucauucugugcccaugaagaagacaucacagggugaaccaugaccauuaacagcuuugcuaaaaaaauccacguaacugucuuuguuacccauggcaggaccugccugcucccuggugcuggggccaccuucugcucaggaugugacaauggucacaccuucucagaaccuuccacaacaggaauauaucugauuauaugaauauaugugaaguauuucacagagugugcuacacagagcaagcauuuaauacguaugacugacuaggagccugacagucucuauuuagacagcacuguggacucaaugcacguuuuuccucaaaauucacaaguugaagcccuaaccccagugugaugggauuuggagauggggccuuugggagguaauucggguuggaucagaucaggaaggcggagcccuugugaugaguguccuuguaagaagagacaucagagacacagcacaaagguggcugucugcaagucaggacuggggcucucaccaaacacugaacccugcccggcccugauccugagcuuuucagccuccagaauucggggaaaauaaguuccccuuguuuaacucuacagucuauggcauuuuguuacggcagcccaauaaugcucacugaugguuuuauaaacuagagaagaacaucaacuaacacuauuugauuuucauaaauugagaggggcuagacacagaaacuuccaaauaccuuuaucacuauccuuaaauucuauuugaaauuuuuaucuaucaguauuuaagggacucagaaacugagaaucuggguucagacuacuugaguuuacaucccguucugccacuuucuaaguuuugaggcuccauguaucugaaccacaaucuucuuaucuguaaacuggagcuaauaaccggccuucucucauggaaugguuguggaaauuaacccauuuaugccagagguugcaaauuucuuuuuuugugcaaaaucagaccuuugcaaugaccuugaguaguaggauauaaauaacucccacaagcuuagcaauaauggaaccaguaauggaacacuaggcauaaauggguuaaacaggauguuccucacaaagcccagaaaaauacacauugauauggugccuggaugccuuuuuuugaaaaaaaaaaaaggagggaaaauaaagauaauauuuauggcuacaugugcaucugcuuaaagaaaacucuagaaggacacacaagguaauacuaaauaugguugugguggguugaauguugagggaagggaggagagaaaaaagggaggaggaagggaagaaagggagggagggaaaaaaggaaggaaccagaagcagugucugguacuucaucagcauucugguuguuugacguuuuuucugaucagcgucaggaauuuuuuuuuuuuuuuugagacggagucucgcucugucgcccaggcuggagugcaguggcgcgaucucagcucacugcaagcucugccuccuggguucacgccauucuccugccucagccucccgaguagcugggacuacaggcgcccgccaccacgcccggcuaauuuuuuuuuuuuuguauuuuuaguaaagaugagguuucaccauguuagccaggauggucucgaucuccugaccucgugauccgccuaccucggccucccaaaguguugggauuacaggcgugagccacugcacccggccaggaaaauacuuuuaaaaugcuuaaauuacauaauacauagguguaugcuuuuagaaacaucacacaguacaaaagcacacagauuuaaaaauguaagucccucuucugcuucagucuguauccaaaauuaaccaauuacuaauagcuuugugugccauuauuuaaaaauaaaaauggaaccacgcuauguacagguguggcagcugccuuucauucagcauuucucgaggccuuuucauugccagcacacauagguuggcuccauuuuguguaacugacacaugagaaaccacaccaugauuacaccacgauuuacugaacuucuucuguauaagaaagcacugggguuguugacaguuuuucuguauaugaguugaugcaugagcauggcuauuucuacuggauauguucugagcaaggaacaucaagcucgaagggcucacacuuucaaauuguauagauacugccaaauuacauucugcaaagacaaugccuguguccaaucccaccaacaagguguuucccauacuuuggaagagauuuauguaaaaaucauguaaacauuuuuaaaguguuuuuuaaguugaaccgcaauucagaaacauugaguagaagugugucuuugauuuuaaaaagaugauaugcugaaauuuagauacgcugaagugcagagacauucuuguggaauagggaucagagccuucccuuauauauuauugaacugcauccauuuacauaaccuucugaagucaguuuuauaaagaggccaccaggcucauggcagacaggaucuuaccccugauaaaggcugaccucugacacugcaaagccccucaccaccgugccagccacagugagcguccgggcuaugcucuccauccuugcugacgaacagacagagcacacagcagggacucggugggagugauuuaaaguacugaacugaagaagggaauaaaccauauuugcacauucuccauagcugcuucuacacuuauaaaaagcugucucggaugggcgugguggcucacgccuggaaucccaauacucugggaggcugagguggguggaucaccugaggucaggaguucgagaccagccuggccaacauggugaaaccccaucucuacuaaaaauacaaaaauuagccaggcaugguggcacacgccuguagucccagcuacuugggaggcuaaggcaggagaauugcuugaacccaggaggcggagauugcagugaggcgagaucgcaccacugcaccccagucugagugacagagugagacuccuucucaaaaaaaaaaaaaaaaaaaaaaaagcuaucucauuuuuucuuuuuuccccuaaauuucaauggagaaacuggcaauauaaaacucaagaaaacucuguccaccuuaaguuucuggauaaauaacuagggaggccuaaguugguuguauaauaaguagggcauuuauaugaccuuguaaauuuguaugaaacuguguacuauggaaugcaccaaacauucugcauugaggaguuuccuacuacuaucagggaccucugaagcuuccccaucuaaagacucaccugugauccccaaauuccagaaauauagaaagccauccugacccacucccaugcugcagccaccuguccauaagcccacuccugccacuucugcaggagucucugguucuuggaguuaucuuccugggucagugccugaugccuuuugcaugaacugucacccaagaaccugucagaaguuuccagcugaagugaagcagauuuaagugaaaugacucuaaauuucuagucaagauguuucauuugaucauuuacuucccugucaaaaugcuuuuuuuuuuuuuuuuuuuuuuuuuuuuuuuuggagacggagucucacucugucacccaggcuggagugccguggcacgaucucggcucacugugaccuccaccucccagguucaagcgauucuccucccucagacuccccacuagcugggacuacaggcacgcaccaccaugcucagcuaaauuuuuguauuuuuaguagagacgggguuucacuguguuagccaggauggucucgaucuccugaccucgugaucugcccgccucggccucccaaagugcugggauuacaggcaugagccaccgcgcccggcccugugcauucuuauuucauaguucucucuccaucuucccagguguacaugaacuguuuugcaaguacaccccgugaauuuuaaagaaaugguuuacuuuuauuaguuacuacauauaauuuuuuuaauuguauugugaaggcuuuuuaaaaagcugaacaauaguugguuacuuuaucuacuaaaguuaagugaaauagauauuuacuacaaaauaaaugaaaggugaauucaacuaauuuaccauaauuaugauugcuauuuugggauaacaaagaccaauauuuaaacugaauuucaggacuuuuuauucagcagcaaguauaagacaaauuggaugguaagcauauauacuuugaaauuucauuuucagucacaugcaauuaauuugaaaauaaaacaccccccuggcucccauucucucccccuaaaacaucauuccagccuauuuucauagaaucguaggagugaaauagagucacacggacuguggcuaucaggcccccucagacuuacucaaaaugucucuuuggccaggucugcccauccuuugguggaggccugcucagacccacucgggucucucugcucauguuggucaucucuccucacacugaccucccacugcccacaccagaccaccuuuucaaaacccggcuucuuaucucaccuugcaaggccucugcugaggauuuuagugcccgguucuaacuuccuuccaguucuggagagcucacugucuagaccacuccuguuaguccucauucacuuaccgucuucuaucaucauuugacaguccuuucugauaagauccuuuaggagugagacacacauauauuguuuuauuugaccaguaagguaaugaauauguaguuagcaaaugccaauaaacacugaauugaaauacguaguugaaaaaaagauguaggcaaaugaauuuuaugcacuuaagagccccagaacucuaaugcaaaauuauaaucugccaguuuaauaaaaacacauuaauugugaauugauaagaagaaacaaagccucucaagugauuaccuucugaaaaauacuggagaccucaucugauaagcuggguugacaagucuuaaggcuuuucaaagucuagcucccucuguaauuuccaccaaguacacgacaauguuauaugagaaccacagaaaaaauguggcugcuucucuuccuuccuguuauuaacaaaaauguuugcagaguggaagaugucugagugcucauucccuucauuucugcuuuagcuucuuaaagaauggacauuuuuucccuaaaggaucuucaaaauaauaaccacucccauuuacugggcacccaccccgugugcagcacaacgucaaacgccauaugggaucaucucacuuuaccaucacucaagucauagaggccagauccuccacaaggacacugaggcaccgagagagaguggguaccacgaugccaucucgcagccacauccuugcccugcugccaggcuagcucuugaugcugaccacagcucuccaagcccaucgccuaggagaagcugugggugcaaacuucaagaacaagcucuuccucaggaagagugcuucugugagccacuggaucuggggcaacuucuccuuuuccaucaucuucucugccccgggcauggcaucacagucuuguccacaguccugcacuugcucacguugacacugggggcugccaugggucgccucuggcccaccugcugcacccggauacugaggaagcccauuccccaggaagccucuugcggccacccacucugaucaccuccugccaccagaccaauuuuucagucauacauuuucaucucagcauaaaauucuaagacaguccccacugccuucaggccugacaucaaaggcuccacugccuggggcucucucgcuuuggccaacgcugacucccacuuugcccugcccucacagggccuguccugccuccuccccaccagcagcccagucuccuuccuguuuccuguccuccacuccuugcucccacucuucccucaaaccucugcuuaugcuaaucucaccuucuaaaccaagaccacugcaaaugccguauuucugcuacagccauugucacagggcugggcacacagauugucuuaauaaguaccuguggauuugacaugucuggauuuuggcaacacaaauggaaugcaaaauacugaauagauaagaaaacaaaaaugccuacuucugaaaaaauaccucuuccuacuuucacgccacauucacaaauauacacaaguucuuccaacucuccuaaucuuggcaaguuuaaacuacaguuuucugaaacaaaggucacuugcucagcuacagauaaauaaaaauucacaagcaucuccaggaaaaucaauacagguacuaaaaaaucuaaguugauaauaaauuucaguuccccuugcacauagcucaggaaugucacuauuuacuggaaucacuguaauaucagauauuucagaagaguauugauuuggccacugaagugugacuaaagggauaaauaaacugcuccuggggucaaucgauccauuuaucuucacugguauuuuauaaaaagucaaaguagcauaaacuuugauaaauaaauguuaucaugaaagaaguauugcugacauaaggauuugaaggaaaaaagaacagacaguuccgcuaccugaacgccacacaauuggcuucacauuuuaguaguuuuaauaguagcuaccgacauagaaacauucuuuuucuccugcccuacauaauccauggggccaggucaaagucugagccacauggccaagaaacagaggggccacaagucaaguccuaaugaaauagaaaggcaaaggaaauaacauuuguuucugccuuauuagaaaguaacugcuagggucuccaagguagacacaugucuuuggauauuuugaaggcacgucuggaaauggcagaacuauuuagacuuagaaaaucaggauggugugcacucugaaguggcuuuuuagggcuuuauuguuaaaccaugcugcaccaauaaccacuuaacugcacugcaaugaucccauaagauuucaaugcaaggccauggagagcucacaacaucguggcuguaauaggauauuaaggcuugagaagaauuuuaauucaaauguaggaaacgugggaacccugugaagaggcuguaacuuaccaugagaaauuauacuggcaagguuuuacugcaguuguagggagacaguauuaccaucucaugaugaaacaaagugaugaugaugaaaguacaugaguugauacuguaauuucagcccaauaaagacuucacuuaaauuaccauaccccaggggaacgcacagcuuucaggaugcagagacuguuauagaucagaaauuugguuugggucaccucuaagagggcucucaagcuuuaaaacauuuccaauccaaauauguagcucuaagacucgggcccacccccacuccccuucucagugaccacccagggcucauucagaagcuccuuauuuuaauucuugccuucacacagaccacuggaccacugccgccuucaaagaccccugcccauagcgacaacguuuuucagggucccauuggaggaaagcccacucagcauuuggugaggcagcuaaaagggcuguaccuccugcgggcuggugcagugcccagcaggacacagugggcccuggauacaauggcauuuacugacuggaagugucuggguggccagaccaggccugggauucucugaaggucacagaauguuggcaaugugguucuagcagcugcuagagcuacucugggcaagaauagagcgguagccauggguacagucaaagggggaaaugcccaugacgaaaggcugucuggcagguuugaugaucuccgcaaaauaggucuggcucaauuccgugacggcagguugcuagaaagaguccacagagugaacaaugcuacucauuuuccuccuucuccuaaagagccgcaagugcaggauuagccacaggcucguaaaaaugcagguccccucuaacagcagguugcuccaugucuuuugaagaaacagacugugugcguacaugcaugugugcaugccugcauaugcaugugugugcaugcaugcaaucuggcuaugaacgcauugcaaaaagucucucugaugucaugacacuaaagaaauaaggugagguuaucuuugaugggaugucucuuuucucuuuuuuaccccucaauucuucugaggugugcugggaucccugaagauaccuccccaaggcauuaugucugcguauuuugagccugcucuuucucuaccauggaucuccucuacauguggauuauuuaguuuggcuacagaaaaucuaaacaucacugcagcuuugucugggugcuugggcugugcagcaaucuguguuucucccgcugucaaguggguucuuccaacccugcuggcacuacuaaaccauugcccuccucucucuucacagccgaagggacaccuccacuuauaagaaacucauuaucgugaucccaaccugcuacucuucagguguucacuauuucagagaauggcuggcaacuccacccuucccacuggccaaacugggaaucuggggcuuagccucuccucccuccucauuucacccccauccaaugcauccuccagucuuucugaagagccaucuucucuggagacuccucuccguugcugcaguacugagucuagcucaagcuuccacucauucuuaucaaauuguugcagucaccucccugcaucugcucuuucuccagugguuucccuugcugcagucacagggauguuucuaaaacaccagucugauuauguugcucccugcuugagacacuuugauagcugugccccccagagcagaaggccaacugcuugucacagcuaagaaggcauuucaugaccggucccacagucaucucuuucagcuccugucacaacuccacguuccggccucuuuccacgcucacccacacuuugaggcuuugaaaauguuuuucccucugugccuccuuugcgucucugcuuggauguaauuuucuccuacuuagaggcagaggucccuccugggugcucccacagaacccuugugugcgggugaauacuguucaucaaguauagaugucugacauauuuggaaguauauuugcuuaugacugcuuaaacuguaggcucauggacuuuaaaacaguauaaacuuuaauaaauaguauaaauaauuuauagcccuguaaauucuuaaaaucuggaagucacaugcuacaauuaguauugacuuguuauacauauacaaugaaggaaauaauucuuuuuuauggacaaacuaagcauuuguuuaaaaccaaugagcgauaaacucugauuuccagugugcggcucuucugaacguuuuaaaugcauaaauacacaaacacacaccgcgcacucacuacaugcuugggcauauucagcagaauucaacugucaucucaacucaaugcaggugucccucgucaaggcagguguaccucaucaaugcagggguaccucauuuuacaugauaggcauucuuuuaaaguagcaugcaaacucaguuuuugugaaucaaaguugauuuuaagugucccauuugagcaaauucuaugguaacuguauguucaaagggaagaaucaccuccaaauuuaaccuucuugaguaauccagacuuucauaauuggauuuacuuaaagcaguauuauaaaguaauuaaauugauuuuaacgaagaauaaaacacaaagaaaaaacaguaagauguguggaucacauuacacacugccaacauccuacauaaugcaaacacugagaugauuaagcugucugaaaggccucccaugcauaaugauggaaaaaauauaggaaaguuuagaguuuauauucuugugaaucccauuuuaucuacuaauucaaauuuuucuuucucuuuuacucucaauuuacaacuaccaaggacacaaagagcauucuauauugaagccauuucuccuccagaggcauaacaaugaguuucauggaagaagaaucucaauuuucugaauaaauaugaauaaguaaauaguugcuuagguacaccagcauauauguauaauauuauuauguaauuguaccauuacacccuauuucaaggauucuuagaugcuaccaguauaagacacuaccacguugugugccauuuagagagaaaaacugccaaccaaauuaugacacguaauagauuguaagacacaguccaauuucagagcuauuaaaaugugagaaauguguaucuuuuaaucaaugauauaugguaacaaacucucuucugcuuuaucuccagcauuuggaaaagugcuuggcaacaguaaacacucuaucaauacuuuuugaguacaggaagaaauaauaagugaauauucaaaacaaugaaauagguauguaucuugcauuuaagacaauuauaaaaugauuggcacugaucaaacguuuuaaagagcaguaguugcuuuauauaccagauuaucucuucuuuaaaauuagaguucaagaaauuggaauaucaauaauaaacuauuuacagacuuccaucacauagauaacaucaucaaguuuaagauaaauaaaaucagauaugaauuuaaugagauuuuuaaaaacuagauggugaaaauuucuguuauaguuugaaauauauuuguauuugucuccuaguugacuuaucucucaggucugggguaucuuaauguuacuagacacccuauaggcuucugucuugagucacauccauuugaauggaaaaugccauuuuaucauugcuaacaaccugcugaugcugccaauuacgaaccuucuuccuaaauacauuacaggaaguccacucuauuuaucuucucuaucugacauccuuuuaagacauucccaguagacagcccuuuucuaaaugaagagagaauuuaauaacaucucauuccugcuuaaauuugcuaaguuuaaagcaacuguuuuauauaucuucuuuauuaauuuuaucauucaucugaaaacucuucucuuuucuuccucacuuguucugccuuccugggcucaugaguaugaaacuggaaacuagauacgucauuucugauagcuuuaccaucugacgcucagcuggaaauggaagcuacgauuuccccaagccuugaucuccauguauaaaugcugggccugucaggucugagauaaaucugugucuccucugugcccaauacacaaugcaaaacaggguccacgccccuggagaguagcuaggcaaggacaucauguucuaucuuuaaaauaaaaugcacauccucccauuaaauggcaaauccuucauuucuaacgguugaauaggaugguacuuacaaaugaauuccacuugguuaaauuuagaguucggaaaaaaaaaaaaaguccuauccaaaaauacacucugccuuggggcccuuuuugucugauuuugaauuaauguauuuacacccuuuccucucaguaucuugugagacaaacacuaguugauauaacaauaucagacucugaaaucugaaacuugaauacucugauuuaguuccuuguacaguuauuuauuuaaagggggcuuucuuuuuauuaauaugcuuuucagggagggcacuauugaaagcuuguguguuuuucauuuuguuuguuucuucaauaaucaaccuucccuuugccgcuuccccagacaacccaggagucccuccuuucccacagggagaggggaagauaaucccgaaugagaauggcccguuccauagccugucuccuucaagauucucucugcaaaacuaacauagguggguccucuuuuucagggccccuuaggucuagaguucgagccguucccauauugcuggugcuugcagcccuccccacagcagugcugggcugcuccaggauggugccuaggugcccaguggccccaucauccugacuccccuuuccuccaaucuccccacugcugcucccaccacuggcuucuuccuccucaugccagacuuuguggccuucuccucuguggcugucacuccagcuuuuccuccuccugcucucucuaccaccucugccccaaugcugagacagcccagaaacaugcuacccauggcagcaucaaggguuguguucuggcugcucacaacuuugugggaaucugauggcgcacgucuguucuggaggaacuugcugcucuugcccuccguggagcccacgucuucacagaguugcccuggagaugccugcucagguucuugcuagccuaacccugccugucuggggaaaggcuuccaacaagaacuugcauaagagcuauccuggucauggugaccaucaacacagaaggccaaggauggucacccaugagccugccucaaauucucaguccgaauacuuuuugucugccccucugcccucccuuccucuugcucaaaaauuaagacuauaucaucagcuacaguuucuucucuuguuguuucagaugcugguuauuguaaaaugccaaggaggaaccacacuggcuuauuguuuguucccuuugcucuccuguguuuauuccuagcuuccugcauuucugcguauuggcacaaauauaaggcuuuuguuugaauuuuauauuucaaaaacuauaacagauauucaugaguuuaauuuaacugucuacuuacuagcagccaugcuuguuaagggcugcaauaaaccaacugaaaaauuaagcacuccacuuccucacauccuaagcaaugcauuauuuuaagaguccugucauuaggaauucaguugguacucauaccagcagcagcagauccuaaugacuccauuugguauucauacagauguuaucauguaucacgcccuccacugccaucagagaaucauucccauucaauguuuuuuuuuuaauucccuguguuugauaaauacgcugauaaucuuugcucugcacaauaaaagaauauuaaauucaggccugacuaaugcauggcuggaaacauaaaagaaacuuucauaggucccaacaccaaaauacucugaccuauuccuacuacuccagccagcugauuuuuaggcauucuuacauuucuggacgccauucuaaauaaugcgaagauaaaacucucuaaauugaaucuuaaaucuuaaaauguaccaaaccauaacuaccuuugacuguuuacuuuuaucaugccagauauucacuugauugucuuaacagccccaugaagccagcauuauuaaccucauuuuaugcaggaggaaagagaagcaaagagguuaggaaacacgcuuggccacagagugaggauguggcagagcugggcuucagauucaggacuucucaacuaccaagugggugcuuucggaccuaugugucagccagcaauguaacccuaccccuaucuaucugggauggucaguucuauaugucaaugaggcaagaccucaguccccagucauucaaucaaacagaaagguuauucaauccaggucuuucugugaaguuauuuuguagauaagaugaaagucgauaacaauaauaaaaaaaagucuaucaucaguugacuuuaaggaagagcaucccagacaaccugggugggccugauucaaucaguuaaaagguucuaagggcagaaaugaggauucccugaagaagaagaaauucuacugguggacuucagcuucagcuccggaccacauguuucuuucuacacugcucuuccugauggccuguccacggcuuuuggacuugccugcuagccccauauucguauaagccaacaccuugcaaucaaucaaucaaucaaccuaccuauccauauuacacacacacacacacacacacacacacaaucuauguacacauccauauaucgccuacuguuucuguuucucuguuggagcccauacugguacaccacugaagggcuuuuacugacgacugaagagcucucaggugcuaauacuaugccaggcacucucaccuguuaauguacuacaagucuauauguguacuacaugccaggcaauuacugaaugagccacagucuuuaaaaucaaccucccucaaccccuuaaugacaagcaauuuaauucuagcaacacucauggcuauuucuccuuuuguaagcugggccucuuuuuauccuaacggagguggaaaguuacaacccuuccucuucacaaucugaagccacucguguuuaucaugucauugauaaaaagaugauaaaauuauguaaaaccuguaaguugccuaacacugugccaauucuguucacuguguguaauuuuauuauuuuauauaauuaacaaguucaugcaaaacucagucauucuaugugcaagauuaaagugaaguaauucgaguauuaccaaaauauuauuccuuagacaccaguuuagaaaagccuauucuucucuucagguuaaauaacccacgcuuucuuaaugcuucacugugaaucaugcacccagacuuggaauuaccucccuugucugcuguggagcuuuuacuauucuuuuuuuuuuuuucucauucaaaguagcuaacauugccuuuggucuuuuaauaaaugauucugaauuguugaggaauucugguuuuuuucuucuuguuguuguuuuguuuuuuuuagauagggucucacccugucacccaggcuggaguacaauggcacgaucccagcuuacugcaaccuccgccucccagguucaagcgauccucccaccucagucucucgauugcaggugugagccacugugccuugcuggaaugcuacucuuaauauaaaacaaauacuauguuuacuaaccacauucauucuuggguucacuguauccuuuuugucccacuagagucuaccuucugauucuccccuuccaagcaaagagaaucuugauccuuuacugucagucuugauucgagugaaugaguacuggccuaugaccaugggaugcguacaaauuaucuggucuuuaacaaaacugucugccugaugcuuguuuccauucagguggcuuaugcuugcccaacuuucuccuauuucauaaauuuuaaucuguuuuggcuaugucaccuccugccuauuggucuaaaccaauaacuggucaccuauuugccacugaacauaguuuucaacuuuucacucaugucauugaucaagagaugaauaaaaauaaccuuuuuuuggaauagguggggaaagaauucccuauuuaauaaauggugcugggaaaacuggcuagccauauguagaaagcugaaacuggaucccuuccuuacaccuuauacaaaaauuaauucaagauggauuaaagacuuacauguuagaccuaaaaccauaaaagcgcuagaagaaaaccuaggcaauaccauucaggacauaggcaugggcaaggacucaugucuaaaacaccaaaagcaauggcaacaaaagccaaaauugacaaaugggaucuaauuaaacuaaagagcuucugcacagcaaaagaaaccaccaucagagugaacaggcaaccuacagaaugggagaaaauuuuugcaacauacucaucugacaaagggaauauccagaaccuaaaaugaacucaaacaaauuuacaagaaaaaaacaaacaaccccaucaaaaaguggacaaaggauauaaacagacacuucucaaaagaagacauuuaugcagccaaaaaacacaugaaaaaaugcucaucaucacuggccaucagagaaaugcaaaucaaaaccacaaugagauaccaucucacaccaguuagaguggcgaucauuaaaaagucaggaaacaacaggugcuggagaggauguggagaaauaggaacacuuuuacacuguuggugggacuguaaacuaguucaaccauuguggaagucgguguggcgauuccucagggaucuagaacuagaucuagaacuaggaauaccauuugacccagccaucccauuacuggguauauacccaaaggauuauaaaucaugcugcuauaaagacacaugcacacguauguuuacuguggcacuauucacaauagcaaagacuuggaaccaacccaaauguccaacaaugauagacuggauuaagaaaauguggcacauauacaccaugaaauaguaugcagccauaaaaaugaugaguucauguccuuuguagggacacggaugaagcuggaaaccaucauucucagcaaacuaucgcaaggacaaaaaaaccaaacaccgcauguucucacucauaggugggaauugaacaaagagaacacauggacacaggaaggggaacaucacacaccggggacugcuguggggugaggggaggggggagggauagcauuaggagauauaccuaaugcuaaaugaugaguuacuggagggaggggggagggauagcauuaggagauauaccuaaugcuaaaugacgaguuacuggggggagaggagagggauagcauuaggagauauaccuaaugcuaaaugacgaguuacugggugcagcacaccaacauggcacauguauacauauguaacaaacccacacguugugcacaugcacccuaaaacuuaaaguauaauaauaauaaaaaaaaaagaaaagaaaaaagaaaaagcguuucuccacagaguggagaaguucuuuugggucucgguauaggccaugucagcugcacagugaaaaccaagaauguggcauuccuugcaaagaaaggagauucauuuugaaauugcuucucaacuuucacguaaauuaugcccaauauuuuaacacauugacaauaugaucagcuuucuacuucagaaugugcugaguuuuuucccuaucuuuaugcaguugugaaguaccuaugaaaccaaguggauaaacacaguguuaugggcugaauuauauucugccaaaaguucauguguugaaguccuaaccccaguuccucacaaugugacauuauuuggagauagggucuuuacagagguaauaaaguuaaaaagagcuaaaaauaaauaaauaaauaaccuucuuauguauagccgcaguauguucaaucugaaaugaacuuugaaauacaaaauguacugauuuggauugaaaagagcauuacuacaaugcuauccccugccucagagacuauucgcuaaauauuaauucuauuaaaaugaccauucaggagaaaagcacucuuaauaccugauuugagaauaagcauacuucuguuuagacaauaauagaaaacaauucucccauuauuuauucacuaagcauugguaguuagcauuuuuauugcucauuuguuuucauuuccaagcagauuuuucaaaacuagacuugauuaauaauauacuauauuauguaguagcauuuggauauuauaaaacauuaaggaaaggucuagauagaggauacaaauauguucuuccuccacugcuacuguacuucauuuugaucacugcaugugcaaagguaugcaucagaaacuucuagaugaaaacugcuaauuauuacaaggaugccauaaacaaucuugccuucugcaucacuguguaauagugcaaacaggaauaacaugucuuggaccaaaguguaaggaaaacugugcuucucuaaguugcuaaguugauauuuaaggacaauaugacucucaaagcccuucgaguuucucuuuuaacuucagcugcuaggaagcucaaauccugucuacaggcuacuuuuacuuacaauguaauaauugcaugaauuuuaacaagucaccuuacauucuuuucuaaagaaggacauaagaauagcauuguaguuuggaaggcuaagauauaugugaucauuucgggagcucugaccagcuucgcuguuuggcuggacaaaucacauaauuagagcuaacauuagacacuucuccacauaggaaauuaagacucuacaaugccuucccucuuauccaagcucacucugauauuuggugaaguuuaacugaagaaucuuaaaagaaagcuuuuacauaaaugcuaaggaaggcauaaaaaaugcuucugauuugcgcacacaugccguauaauaacccagugcagugucugagucagagcugcuagggugugggcuuccuggggcggagcaccuuaguccaucuauucuguuaguugucugaugcuuuccuuuugacaaucgauugaccuguuuuguaggaaauguggcacuaugggucuucaugauuuugcaugauuagccgggcaugguggcacaugccuguaaucccagcuacucaggaggcugaggcaggagcaucacuugaacccagaagguggagguugcagugggccgagaucgugccacugcacuccagccugggcaacagagugagacuucaucucuggaaaaaaaaaaaaaaagaaagaaaaugcacuuuuuaugcugagggacaggcagugcaaaggaugugagucuggcugcugucgcagguucugaccccuuugacauggaaaaauuccaaguaggaagguucaguagucauuugggguuuccagugcccuaggacucauacugaacuuuacugaucaacacuugaacugcacagaaaugcagcuuguaaaugcagguauuauguauuauuugcaaaaugguccuuugaaaaauuaagcugcucuccucagcagcagcugccaucaucucccugaaagaaggcucagugguaaacgaauggcagcccaggggcugcaaggaaagacuuguaucaaaaacaugugcaccacagacacaaaacccacuaccugugccagguguuagagaacucuguguuguuaugccauaaugugaaguuucaagaagaggugaguaucugcaaagcaauuuaacauuuuaaaagcuguaggugguaaagguuaaccucccuggugauucaucaggacugucuuguuaagaguggcagaauuuacaagcacaaaauaauagcuggcaggagaaagugcccaaaugaaagaggaauagaauccaucuacagccagcucaccaagccucugaaacaggauuccuuggcauguggaaguaauucagagaucaaugggaguaauauauugcucuuuagcccaaaggagaauaaggcuacauucacacaacuaaggaauagugaguccugauuucuacaagagauuagccuauaaaaggaagacuguccuauuuauuaacauaagaaccuagcauuauuagaggcuuagggcaaaacuccaccuugacccaugcgaaaauauuugcccagaaacuaacaaucaauuguuuuacauuuagcuaaaguuuuaugcuugaugacaaacauaguccauaaaugccacuugguaauuugcauugguaaaaacuagccaaaagucacacuuagggcauaugugcuuccaaauaccgcauaacuuguuauaacauguccucaaauuuacaacuaugcuguauguccccauuaaaacccaauaaauaauuucucuucaccagugauuaugaagauuuuucuucauuagaguagcuuccaaucaugcagugauuucaaaagguccuauuuuuaaccccaauaaacauaguuguauuucucaccaaaugggcccucgagaucagaaaucacuaggauaugaaagagauagcuacauacucaaucaggaaaccauaaauuuaaugaggcaaaaucucacagggucauacauacccaauggauaacauagggaaacaaauucuuagcuuacuguuucucuauuagggauugauuuuugcccugccaaaauugcauauccaugagcaaaauaaauuguuauggcuacuuuaagucacuuaauuuugcaguacuuuguuacacggcaauagcuaacccagaaauguccuuaaagagauuucagagaugcaugugaagggcuguccucuuuacagagacacacacuaaguaggaccaaaauagacaagagaaaggaaaaaccuccaucugcgccccaacacacuguuccccacuaaccccacacuccaucagagccuagacucacaagcccuuuacuguguucugauaaccacugugacaaaaccaauucaauuucaccccuucaguucagaggggaaaagaaagaagagaaggaaguaauuuaaugacaaagacagugucuuauucagcuauagccccuacuguaccuacauacaacaggaaacuuuauauaaagaauuauuuuaaacaaauauugaauucuagauagcagccuugauuuucacaauguuagcaauuuugaauccacuuuuuuguguauucugauauugaucaaauaaguaaguauacuguggauagugggaacaaguuuucuuauagucagagaagggaguuauaaaugcagaagcgggaacacuagaauaaaccugugaaacuggacuggaauuggagaugucaauaugaacccuaguuucuauuagauagauugguagacagauaauagaugaucaauacugaaguagauguggacagauauacguauguauauguauauaugcacaugaaauacauacacagucuagcucuguccaaugaacgggccuagaacacacaacacuuaaguaguaaugagcacaugugguauccggaucuugguuucuaaauaccauguccgcaaucaaaggaaccagggcucucuugaaaacuggcugauucuagguugggguuguagaaugaugaaaugauucuagaacaucuugcuauacuggaaaaagaaauaaugaggaaugauggggauaugucaaaugaaaacaagccaacuugaaggggaucccauugaccaaaucucagauaauuugacaaaaaaaaaugugaauaaucaaucauaaccuacugaauaaaauaaaaauccaugaguucauacugauuaaauauaaauaagguagaagagaaaggucuuccuuauagaggaaugccaaguaauaaauguagaaauaaugaugcauuucuagaaaaucaccauuuggcaagcaccacuguauuaauugcuucugguagguaccaccaacgaaugcuaaaaguaaugucugagagcuugaugaaaagaugucuacacggucucaaaaagauacuuauuaauaacuucaguggagaaacuuggcagauacccucuuaaccaagugauggcauucacaucaccaguaaugggacaaaucaaugucaccugccucuugacaugaugugcaacgaacugagaaggaccagcaucucuccuggguauuccugcaaaaaaauguaaaacuugaaucuaaucaugauaaaauauuaaacaaaccuaaacugaagaaaagucugaaaugcuggcuuuuauucuucaaaaauguaaaguuuguaagggacaaaacaagcccaaggaacugcuacauauuaaaggagccuaaagagacaugugaacuaaauggaaaaugcaugagcuugaaguggauccuggaccaggaaggugaaagagccaucauuaggacaacgugagaaauucaaauaaggucuguagauuauagcauuguauucauguuaacuucuggauuuugaucauuauauuauggauauguaagaggauauucuugcuuucugggaaauacacacugaaguauuuguuaauaaacaucaugcuggccgugugcaguggcucaugccuguaaucccagcacuuugggaggccgaggcggggggaucacaaggucgggaguuugaaaccagccuggccaaaaugaugaaaccccaucucuacuaaaaauacaaaaaaaaaaauuagcugggcaugguggcacacguguguaaucccagcuacucaggaggcugaggcaggagaaucgcuugaacccaggagcugagauugcaccacugcacuccagccugggugacagggcgagacuccaucucaaaaaauaaauacauuaauuaauuaauuaaaauaaaauaaaauaaaauaaacaucaugccugcaacuuacucucuguagauguguaacacauguguuauacauacauauacagaaaggggcagaucaggcaggguagggcagggcaaagcaacguggugaaguguucauguuuagggaaucugaaugaaagguguaagggaauucuuugacucuucuuauuauagcuuuuaaguaugaaauucuuaugucuuaaaauuagauugacauaaaaagauuuuaaaaaggcucucgauaauggaacagauuaaaacguuacauauuaucaucugacagcaguuaacauaaaaaaaaaccagagccacauggaucaauagggauaucaauagggaucaaaaggcaaguuagauaaugucacggacagcaugguaccauuuacguaauuuaagacacauacaggaaacaucacuacacguuauuuauauaaacauacaaauguaauaaaagccauacaaaccuggccuggauaccuauuuaguuucaucauacugaugaucucugcgguggagaaaaaggaacugagaaugggaguaaaaagcaaaagccagggaggggaguucaaaucccuuuggagccagggcuauccgacgcaggcacaaucuggacagucacacagggccuugagauugguuuaauucacugccugaugccuugaaauucuuaacaauuuuuuaauuauuaaauuaauuaaucccacauuuucacuuugcacugggccccaugaauuauguagccaguccuauuucuuuuacuucuuucauaaaaaaauaacugaaaugaauuugcuauuucuggguaguacacacccagguguuuacuguauuagucuauguacuuuuugggauuuaaauaucuuuuucaaauuuuuaauuauggaauugaauugagaagaaccagcuucucuccuggggauuccugcaaaaaauauaaaacuugaaucugaucaugauaaaauauuaaacagacuuaaacugaagaagagucugaaaugcuggcuuuuauucuucaaaaauguaaaguuucugaaagacaaagcaaaccccgggaacugcuacuuaucaaaggaaccuaaagagacaaucugaacuagauggaucuuuucucaaguucaccuuaagguguuacuguagccuguggccauaaaacugggaaaaaccccauaacaaaucaaaauucagcguuucaaagugggguggcccuacaggagagcucaguuaaaagaaaagcucucugccugggacacucuucccuucugcgagaccuuagcauuacuucuucagacauuuucuuaaacuccccaucuguaaucccucccguccugccuggacuaucaccucaucccucacccuguuuugguuuuugcacagcauuuacuacugucuaaaagucuaucacuuauuuacaaaguuacgcauuuuuuauucucccucaucagaauuugagcccugggaggucaggggaucuacaugccucgccuccugccauguccgcaacaccuaaaacaggacuuggcacacaagacaucuaauauacggugaagaauugaacuuaggaugagaggcagagacagagaaagacuggcaaagauggagagaggccuaaaaguauccauccuuuuggagaaagcucagagcaagaucuuccaacagguucuccaauggccugcaguaugcaagcacaguacaaccacagucaagaaccagcaggccaguggcacacugguucuugaaaaucaccaucuccagucacguccugagaacgcauaucaugguaacacucccuaggcagaauuaggagccacuucuucagaugcagcggccucccuaggucaucaauucugguugucucaaacuucacaacaggggaaggcugugaccgaaucucauccucaugaggccacaaggcaaagacaccugcaaagaugaggggccugaugcuuaagggcggggauuccuuggcaucuccuuggugagcuaggauugccagagaucucucagaauauuugcacuuucugugcaucucugcucuuguucauacuguuccaccccaacuuccaacaacagacucaaacuucccucauacacuugcuaugaugacugagcccacuguacaggcaggguccuggcaaauggggcaagcuggguccuggcagauaaggguuuaauaaagggacuauuugccuaccccauugcagggauaugguacgacucugucugagguuagaaacagaaggguagugaccacccuuuggccugaagggccagagcccugaggcuacuaacagggugucggggaagaggagaagaccucacucuucugccucccucuggucucuugauacuccucauuggcugaacccacccagaagccagagggcaggagauccugaugugguuccuacaguggacuucccuggcacuaagggagaucggggaguggauccaggagccaccgauagaagagacucugcauacucacacuaacacuuauaacagggaauguggauucuaccccuuuuugugugaguucugcccuugcuuccugugugcucgccuugucucccucuaagaguuuagauucuaggcucgucaaggaaggugaacaaccccuaaagagcuuaacauauaaucauacaucauaucauagaaugacaauaauuuagugaugauguaauagauuacugaacaggcugccagauuuuucuauauuaaaaaggaccccaaaguaugagaauuuaugauauucugauaauagugauagcaguggguaucuaucucauuaacaguagccagaauucuacacaacuaauuuacauuucuacacaggauacagcauuaccuaguaagaaaaguaaaugauggagaauaguuugcuauucaacaaggaaacugcauuaucugcccugcgaacagugcgcaaaaaaauucuguuggguauuuauuauauggccguuauauaaaaauauuacagaaauaaaaauccuaggaagagaaaaaaaaucuucacaaauucuuauaggccugaaugguaauaugcuagugcacaaucaauucugauagaaaauaagguaaaagaaaaaaccuugcuuuuuucuuuuaguguaguuuucuaaguggaauaaauaauucacuauuccuucaaccaagaaacucucucgcuuauuauuuaaaaauauuuacugguugcaguuacaaaauauggugcauuuuucccccuggcuugcccuuuguauugauguauaucuucugauuauaagaaugguaacucagaagucauaaagaaaaguuuuuugaaacaccaucuugcuuuagagacaauaaggaaaggguaaucaauccaaguuugaaacauucuggguauaucuugggccauuuagaauaauuugaaauaccuuaaacuagacuaauucacaucaccuucuauguucuuaaaaacucuccuaaaaaacauguucauuacccuauuccuaguucugcagcacuccagaaggcagaguaacagaucaagucaccacuuaccagguucagguccugccuuccauaaggagaaugucuguucucccgacaguguuuguaauacuaauugcucuaaccuuuaauucauuaacaacuuugcauuccuuuauucauucauucugacaacaaauauuuaugaggugagacagaccuaacgcaaauagguauucaaugacuguuacagucagugcuaaccuaaaggcuaccucacaaaagugguaauuaagugaaguaugaauagugaguacuaguaauuacuugaaaccaaaacccaguagaagcagccucuccaaaugcaaaccuuucauagguuuuaaucucauuuucaaagguuguuauacaaaugaauagcaccaacaaaauucaguagaaaaacuuuugcaugaagaccaaacuuggguaucuuugagucuuugucauucaaaaccauuuuugcacaaaaccacuauauucccccaucuccccacagaaaaguugauuuucaucaggggaaugaaaugccuggcuauccuccuuuaaaaagcaggaguuaauaccaauucuaaucauuauuuuuacugcuuuaugguacaucuuagguuacugucucauuuuuaugaauauagacaauaaucauuaauuccccccgguaguaguacagaaucaucucccuccacugcaacguuuucccucauaaaagacauggaugaaaaacauuuggggcaccuaauucuucuuuuauggaugauccaugagcauaaaacuauuaauguuuaucucuuaaguguaauuaccauauuucccacaucaaugcccacgguugaacacaucaauuaaaacuagauauauaauuuucacauuucagaugaauuuaauuaugugaaaucuguuuuaugcccucuugucuauauauuucuggagguguuaguuugccaguucuagaauggguugucgaauacgggauggcuccuucuaugaacuaacccaauccuccaggcagcugccauuaagagcagagaagccaugacuguucagauuauuuuauguugaauaggugaauucuguucauuuuuagaaaacugauauuaaguucaacuuaccuacaauauuuuuuauuaaaaagucuucauuauuuaaaaaguauuucauacuaaauaaucucuuuuguccccuuccuaaccaacugguaguuccuuuaagacaaaaguuaaaagcaauacaguuccccaaauuaaaccaaaaguaugcacaagaaaaauaauacaaauaacaggaaauaaaugaaacaacugaaaaauaaaaaaaaaauuaacaaagccagaagucaguucucuaaaaagccuaauaaaauugaugaccauuuggcaacacugaugaagauuuuuaaaaagagagaaaaccaaaguuaccaauaucaagaauaaaacagugaauaugacuacagauuauacaaaaauuuaaaguaugagggaauguugugaacagcauuaugccaguauauucaacaacuuagaugaaauagagaaauuccuugaaaaauacaacuuaccaaaaggacacagaaagauauagaaaaucuaaauaacucuauaucuguuuaagaaauugaauuugaaauuaaagaacuucccaaaagaaaacucuaggacuaaaugucuccacugguaaguuuuuccaaaaaaugaauaaagaaaauaauaccaaucccacacagugucuuagaaaaugaaggagagaacacuucccaacucauccuguaaaguuauuauaauccuaguaccaaaaccaaagacauuauaagaaaauuaccaaccaaaaucccucaugagcacagaugcaaaaaucuuuaacaaaacauuaucaucuagaaacauauaaaaaaaaauaugccgcaaucaacuagaguuuauuucaggaauuaaagguuugaaaucagcguaguccaauauauuaacacauuaaguaggaaaacucaugaucauuucaguagacucagggaaagcacugacacaucuauuuauguauuuaacauaacccaguuguguuacuacacccauuuauccuaaaaacuuucagcaaacaaggaauagcauuuucuuagccuuuaaugcacaucuagaaaaaauguauagcuaagggcauuugacagugaaauuuuaaauguuuuucccuuagguugggaagacaaaaaaguccacucucacuaucuuuauucaacauuguauuggaggucccugccuguacaaucagauaagcaagagaaaaaaagguguacagauuggaaaggaagaagugaaacucuauuauucaucauguguauguaaaaaaucugaaaaaaucuacaagaaaacuacuagaucugacaaaugaauuuagcgauguuucagaauacaaaaucuauuagcaauaaaaauuguuaaaaaugcuuuuuacaagaguaugaaaaacaucaaauacauacuuggggauaaauuuaacaaaaaacaagccagcuuuuuauacuaaaaacucuaaaacauuacugagugaauacauaaauggagggauauaccaugcaugcaugaauuggaagacucaacagugcucagaugucaauucuucccaaauugaucuaaagauucaauaccauccaagucaaaaucucagcaaaguuuucucaaaagaaaacacauaaaaauacaacuugaaacagucacagaccuaaacaucaaagcuaaaaauuguuaucagaaacaaugagaaugccaacucuguaacauucauucuuucuauaacucacaauugcagucucaucaugaaaagaauuucagauaaacacauauugaugguuauucuacaaaauucuuagaguagucuucaaaagugucaaggcuauaaaagacaagggaagacugaggaacuacaacagauuggaggaaacugaggaguuaucacaaccaaaugcaauguaguaucccagauuggauccuggaaugaaacaggacauuauggggaaaauuguugaaauccaaacaaagucuguaguuuacuuaaucuacuguaauguucauuucuugguuuuaauaacuguaccauggucauguaaaauguuaacaucaagcguagcugaaggaaguguacguaggcacucaauguacuaucuuugcaacuuccuauaauuuugaaauuauuucaaaauaaaaagcuuuaaaaagaguuauuagaaugaaagagacacuucuuguaacacagaaaggaauaaaugugaaagaaaaauuggacuucaucacaauuaaaaauaucuguucaucaaagaguaccaucaaaagaauaaacaaguaagccacgaaaugagagaaaauauuugcaauacauauaucugacaaaugacuuggauccagaauauaaaaaccacucugguacucaauaauaaaaauuagcaacaacacuauaaaagauaggcaaaagauuugaagaaacccuucacaaaugaagauagcacauggccaauaagcacaugaaaaaguauucaacaucuuuccuauguaggaaauacaaauuaaagccacaaugagauaccaacacucgcucacuagaaugaauaaaugaaaaagacuaacaacaccaacuguugaugaggauauggaguaacgauauggaguaacuggaacucuaaaaaaccgcugacuaaguauguaagauggcauaaucccuuuggaaaacucuuugggaguuucuuuaaaaguuaaacacaaaucuacuccauaacccagcacuuucacuccuagggguuuauacaaaagaaaucaaaccauguaucuacagaaauuccuauauuacaauauccacauucauuuuauucauaauaaccccaaacuagaaauagccuggauuuccaucaagggaucagccaacugcgcuuuauuuauauagaagauuacuauucagcaaugaaaaaaagaauuaaugaugcagacaaugauacugaugaaucuccaaaauauuaguacugugcuggauaaaaagaagccagaaacuuaaggcacauacuguaugaccccauuccuacaaaauuauaguuaaguaaaggacaaccuauggugacaguaaccacagcaaagccugcuucugggggccaggacagugacuggaaaguggcaugggggagcuuuuaggggugauggauauguucugugucuugauaugcauucaucacaacugagugaaagguaaauuuaguaacugaacacuucacugcaugcaaauuauaccucaaagaaaguaauaccguuuucaagaacuaaaagaaccauuauaagaucuucucaaguaaacauuugagaaguguuuuuuccuucaugccuagauucuuuucuaccucuggggcuaaaauaaaccucacgguuccaggccuccagccacuccucugccaacaguagucuacaucuauuuucuacccagccuuuuggagcucucagccagggaaggcugcugugugucccuaaaaugcuucucgaacguaguauacuacauucaugcuuaugccauucguuccuagugcagcacccggaguagcaaccuuauaaauguuucugauuuuacaaacuuuaaaaaagaauaguaauuucugcccuauaccaccuuuggaagaacugaaaacuaccaugccaaauucauuauguuuuaagcuaacucuuccucaccccacaggaagcacagcaguacugagcuccaucuccauucuagauaagauacaccgaggaaaucugaagacaaggcagaauugggguucucuuuaaccuggaucuauucagaccauacugcucaaaguucaauggcuccuuagagagcuacaagauuuuguucacacaguguugauaaggucugaaucacauuugugaugcuuaccacaguacagauuguuaauuucuacauauuagcuuuugauguugaaaagcauaccaaguagcucgaaagaaaaaggcucuggacuaaagaaucagcaaguauuuuauuucguucacauucuacccaaguacucucaagagccacaauugcaagcucuauaaacuuaagaguaaacuuauauuuaugcaaaaggaccaacgaaagaugaucaggauccucugacgucuagcuggauguagagugagguccaaugaauucacucaaaagaaauauagcacaaagcaacaaugguuguucaaaauggcaaaugaacauauuguucguucuuuuccaauaaaaauucaauuuuucuuuaagaaaaaaauucccaaaauauaaaauuucugcauccuugguuucuuacauuuaaagaggcaaaaaaagaaaagagaacauguuauggccuaccgcaauaugugugcuccaaacauauuaaauguuugcugccucuagagagucacgguguauaauucacuuuuaauuuuauaauuauuacaauuaaaauuaaacaaagguaaagaaaaaaaucaauaccuaccuauaaaagauaggaaaaucucacuuuaaggaauaucucugcuuucugaguauagaauggacaagagagaaucugagcagaugacuuaaugcagucuacugggagugaaccuuccuaugaaucggccugcuagauaugacccucaaagaggcaucagacauuucuccaacuuaagcuauucccauguuuauuguaacauuccuccccugagcucaccugcccuguccuuuccaagucucacugaacaaacuucgguguuccacacuggacugggggauucggaaaauuucccaaaagauaugaucccuguugugggggguuaaauuauuuuggaaaacaaauaaaaaacauacacacaaagacaacaauguauauccucucccuucauccaacacaaaucuuaaauauccuucaagguuccacuuguccaucagcuccuuugagcuguuuuccuagaguucccaaagaaaugaacccugcuacccauauuacgauuagcaucuuuauuauagcuccuacuuacaauucaugucugaaauauauguaguaggcucuaaguuccucucuaguccucucagaauucuuuccauggugcuuagcauagcaccuuguaugcaguuaguggucaccaaauaauaguuguauucucaaucuuuucauuuaagucuggaguagggaagagggcugucaugaggaggaggguuaaggaguggaaauccugcuucuaauuaccagcaccauucuccagucugucacauuacuuauaaacucaaacuucauuuuaccuuugcuuacugcaaugaauucaacaucgaucuggaaaaaccgacaucaugaggucaaucuaucacgugcuaugcugcagauuuaggaauuauuaaaaugacauauagaacccaaaaugcuacuuaaucaacuuaauuuuccuguguccauacacaccaaaaaugauuuauuaauuuuuuuuuuuuuuuugaggcagggucucacucugucacccaggcuggagugacauggcuugaucauggcucacugcagccuugaccuuccgggcucaagcaguccuuccaccucagccaccugaauagcuaggaccacaggugcgcgacaucauguucagcuaauuuuuuacauuuuuuuguagagacagggucuuacuauguugccuaggauggucucgaacuccugggcucaagcaauccuccugccucagacucccaaagugcugggauuacaggugugagcuaccacaccagccccaaaggagaauuuuuauuuuagaacuacagcaugaaguauaaaugacuacgguuuuauuuuauuauuauuguacauuuuuuuuccuuuugcucacacugauuuauuaaaauuuaugucaggcuugacauggaugaucaauccuuauuuuuucaagcuuacuaaggauauuuuccuacaaaauaaguauauaaauauguuuauaugcaagcccuucuaaggaaugauucucaucaucacagaucaugaucuaggaauuucugucaauuacucuugagcucuuugaggucaaggacuacauauuaaagucuuuguacuuucagcacauggcacagugccuggcacauagucggcacucagugaaaguuugugaaaugagugcucugccaugagucuuaggcagaugaaagaacaacucaaaagugaagacagacaguaugcugaacucucagccuucugccaccacggaaauaugucuuuacaugcuuccacaggguucaaguccuggcccucacugaggcugucugggcagagcaugcuguucagaagucaugugcagguagagugcagggaugcugcauacaagaacaugauuaaagacccagucccugacaugggcucagcacagaggagacauucagugaauguucaaugaaacugcuuauguuguucuaaagccaacaaguugaacuuccauucccagggaguugcuguacuaucagggaaucaaccaaggucucacaacuauggaucaggaaccaauaauguugggauauaagcugaugucccuugcaacuguguagucuuugcaggcauuuugauuaauaucugaaaaagcugcucacaguuaaaugcaaucaucauuuagcaaacauguauugagccccaauucaacuauucaaggaauugaggauacaaaaauaaauaauuugcagucaucaguacucaugcaacucucaggcaugggguuacagcuguagcauaaaccaaugaguacgauaccagaaucuaaauauauaugccuggaaaggaaagcgagagagcuagugagacugcaagugcaaagugcacauacaggggugcaacagcacaaaagaaauuuaagcagugccauugcucccaccugcccuucuccccaguaagcaugcacacccgaguacacuggaguggaagcccggggccuguuaccuccuacagucaggcacugguucuuuacgcuucucauuucucugcacugagcuggaugcuacuguuuaaagauacaaauuuuucauauaacaaagccuccaaacucaaaccaccuacuucaggcauuauuaauuucuacauacacauuacacauacauacauauaggaccggguaaauuagaauacggauuagcuguuuuuugugagagauuuagggagccucagggacaauuucaauugugauuucugcuucauacucugaguaugagucuaaugguucuguggaacaagcaaagugcuucagaagcauaggagcuggugcaaggggcaagccugcccugccuggggguuacagaggauuaaguauggucuguacugucacgauucaacaaccucuuaaaaaauacaauauaugcuuaacaaggcuucuguugaccucuuucuggaagccugauuucuuuccuccacuuauguuaacagauuaaaaauuuaaaaaaaaaacauaauuuuuuuaaguaaacacaaucaggauuuugcccccaaauguaaaucuccaaaaaaucugaagugcggcaucacagccaagugaugccaauccuggucuacuucuacugccccuccaacugagaccagcaaucucacacaggcucagggcauaagcuauguguagggugguccuagaauuguugagagccuggacuccuaccuccuuaaaggaaaggaugugaaaacugcacuauggauauccccacucucaucaugccccuacuugcacaagccaaagcuugcuucaagucaaaagcuuaggagaugagcaauuaaacaauuuuccaaagguuucuaagugagucagaaacaauccagccacagggccucuccagggcacucugaaaaguacuaagugucaugcacacauguguccauugcagcacuauucauaauagcaaagacauggaaucaaccuaaaugcccaucaaugauagacuugauaaagaaaauguggcacauauacaccaugggauacuaugcagcuacaaaaaagaaugagaucgugcccugugcaggaacaugaacggagcuggaggccauuauccuaggcaaaugaacucaggaacagaagaccaacuaccacauguucuaacuuauaagugggagcuaaaugaugagaacacauggacacauagaaggaaacaacacacacuggggccuuucagaggguagagggcagaagaagggaggggaucagaaaaaaauaacuaaugauuacuaggcuuaacaccagggugauuaaauagucuguacaacagacccuuaagauguaauuuuaccuauguaacaaacuugcccauguaccccugaacuuaaaauaaaaguuaaaaaaaauuuuuuuaaauacuaaguguccuaaucagagaaccaugaauguacauacugagaggccccagagcacgugggagacugauaugguuugggugguuuuguguccccacccaaaucucaucuuguagcucccauaauucccacauguggugggagggacccagugggagaugacugaaucacagggacagguguuucccgugcuguucucaugauagugcaugggucucaugagaucugaugguuuuaaaaaugggaguuccccuacacaagcucucucucugccugcugccauccacauaagaugugacuugcuccuccuugccuuccgccaugauugugaggccucccuagccacguggaacuguaaguccaauuaaaccucuuucguuuguaaacugcccggucucagguaugucuuuuaucagcagcgugaaaacagacuuauacagaggcuguuucaugcuucagagucuacauagcuauuguggggcagauguacuaauaugggaagggaaauuaaaguuuaagacuaaauaacuucaugaaaaucucaacgcagcagguaaauggcauuauguaaguuuuuaaaauauauaaaacauuaagccagggauucuuccuugaauacaaguucaaggaagcuugaacuuguuccuugaauacaagcucuuuguccucacagacaacuacaagggaaagcugauauuuccaggucaucuucacagcacauacucaccuaauuacauuucuauaacuagaacaaguuguuguucucguaaacuuuguuuuccagugucagauggagcuugaaagcugccauggaugaaagacuccuucaaaaguucaguaacuguaucuguguaaacuaaguuagguuccucuuuuuaucguaucacuucaguaaauaaggccaguugugcucauuugucaacaggaaacacagaaaggaaccagaaaacaagaugcagccuccggaggccggucuuggccaugugcuggguaagguaacaccauggcugugucuugagaccaccccaaccucaguucacuugaaugaagaauuuuauaaucucaacucuaagggaccugucaaauuaguccagggugagcucagacccacucucuugaaguggcagcagccuuugaugauaacaacucugaccgcacaaacacuacacagcagugugcgacucacacaucacagaaacaccacaggagccacacuuucaggucuagaaggaaauacuguagauuaaagucaacuuuuaaagaaguaaaaaaagaauaauugacaucaguuuaauacauuuuggacaauuauuuaagaaauggcaugcguaaaugaaaguaaaaacucagcaaggugaaguugggaguuugagaccagccugaccaacauggagaaaccccgucucuacuaaaaauacaaaauuagccaagcaugguggcacaugccuguaaucccagcuacucgggaggcugaggcaggagaaucgcuugaacccaggaggcagagguuguggugugccaagacugcaccauugcacuccagccugggcaacaagagcaaaacuccaucucaaaagaauaaauaaauaaaauaaaauaaaaaggcuuagcaagggugagaaaauucagacucauuacguuacuuaaucaaaauucauaaaauuaauuuuggagcaauucagcuccagcaacagaaagaaccuaaucaucccuuucaucaguaacugcuuaucuucuucauuuuaauuuuauguugaugugcuuauuuauuuuuauuuauuaaugaaucuaguuucuuguuacccuggacuucccauauuaauaaucugaauaaacaaccuuauucaacacauaucuuuuuaccaaaaaauguccucuuagacaaagcacacucugacaucacguugccuugccuucacuugauuuagacuccaaguucacagugcaauaaaguacaaggcaauugagaaauuuuaaagcaaauguguuuuggguacagcauuuuacaaccaaaagagcuuuaaaauggcauuucugaacaacugaagaggcuagaaugccaacaaauaucugaaaaugagcaugacauuaaaauacaguuugacauguucagugaaagagaacuggggguaaaugcgccauuauacauuuugaauuuuuagcuuuuuuuuuuuuuaaugaguaucugacuucuucauguguuacaaacucaggaaagcagacagucuugggauauuaaaauagauaaaguguuuucaggaugagauggagacugccacagaacuguacacaagcaucucucuaaacuuaaagaaaacacugauucugggcuaagagaguguuuacuguguagaugaggucuacaggauaaacucaauuuauccaaauccugugccuuccagccaagaaacuauaaaagaagacuuuguagaaugaagcaaaaagucauacuuccuuuccuaaggauugcaaccuguucacaagacaggcagagcugaacagcugguccccuuccagggcuccaagaaaugugaauuccaaggacaagguagcccugaaaugccugccucaugggauccugcccugucaguaguaagcaucuucaaaguggcuccugcagguuggucuccucaaucacagaguucagacagaacccugacaccagccacguguaccaugcggucagccaaauguguaaggaacuuguuuugagaggagagaagaaaauucuauaguaggcgagacaggcuucucucuccugcuccuccucccuuucuuuuucucucucuccucuuucuucccuccuucucucccucuuucucuuucucucacacaguuccuacauuucugcacugggggacaaaccaggcuucugaucaaaggcaaucugagacuuggguucaaaagcuuugaugaagauugguaccugcuaugcagauggggggagggaagaagagacuagccuaggggcuuuuauauuucuuuaaagcaucagccauuaaugggcuaaguuuaccacugggacccagagagcuaguccccaaacacaagcucaaaauguaugcauuuuccaauucaugguuuucaaggacauguuccauuucuaugaggcucuaaugagaucugagagauguacauauuuuuuuaaagucacacuuacaauggcucucacagcacauccgggagcaacucaguaacuugucuaagcacuuacauacugaaguuccgagaaccaccagcuuaagguucagaauugaaauuuacagacccagucuuugcuuuuuucaacucuguaaucuuguagacgguucauagguuuaagacauuaaauaaccauggauuaucaugacucuagaaucaguuggauuugugacaaaaauuagcaaaaugaugaaauaaauguaaggacccccuucccaucucauuacuuugguuaguuuaugccccaggugggaugggucaggacuuaacagucauccauucauggaacaguuauugagcucaagccacucccuggagaugucaagaaaagugagcugcuuucucugcaggaaagccaaagaauuaggcuggugcaaaaguaacugcagcguugccauuaaaagcaauagcaaaaacagcaauuucucuugcacaauauauggaucuuuuauaagggagaaaaaagguauuauugaucgauauggcuagaaacaggcuggaccuuuguggguauaaacccagaagggcccugguguugagguguuggaagaacacugauggauucuuuauuuuuuucauuaacuacuuaaaacaacaguuauugauaggguacuguuuagagaucacuacaauuccuuugcaguuauuugacauauauaaacauacuauaggcugggugcaguggcucacgccuguaaucccagcaccuugggaggcugaggcguguggaucaccugagguugggaguuugagaccagccuggccaacaugauagaacccagucucuacugaaaauacaaaaauuagccaggcaugguggcggguuccuguaaucccagcuacuaaagaggcugaggcacaagaaucacuugaacucgggaggcagagguugcagugagccgaaauggugccauugcacuccagucugggugacagaguaagacucugucucaacaaaaccccaaaacccaacauacuacaagugaaaguaaucugcauuguaagguuuguuaugugcccuagucugcccacaggaacccugaaaaacaaaauguuaaauggcacagacuuuuuaacugcaaauacuaggugcauuuaccuuccuuaauacagcacugugaucacauauaugaugguauagaucaagcuuguccaaccugcagcccauggacgcaugcaggccaggauggcuuugaauacggcccaauacaaauuuauaaacuuucuuaaaacauuaugagauuuuuuuugcgauuuuuuuuuagcucaucagcuauuguuaguguuaguuuauuuuauguguggcccaagacaauucuucuucuuccaauguggcccagggaagccaaaaaacuggacacuccugguauagaugguguggcucauucugcucauccuucuuugagaaagcgcauuucagaagcuauuucuccucauuccagauuuuaugcugauuaaagaaaacaagauuugcacacagagcauccucuaguuauuuggguaacagacacagccaugagaauguuccgcuccacaggggccaucagugcaaauggccuuccccacacuacaucgaccacuuccccacagcaagcuuggccaggauccagccaaccagugcugacguccuucgcucagggagguguugggccuugcacacuauggccccuuacacacuccauugcaauuuuguucaucucuguccagcuaaacuguagaaacccggaguguagggacugcgucuugaauucaucugugucuggcaugugcaaaaugcuccacaacaucaguuuuacacucuuaggauaagaaaauucauuuucaagaguuuuaaugacuacagagagguggcaagguaaacaguuuccacgugaccccauagacuucuccauuaaucauaguuuccaauuaacuuuuuuguugugcuacauagaucuucuuguucuauuccagaucauaauguacaguuucaauaauauguuuuuuuaauugauguuaaauaugcuccuagaagcugcacugcaacaaaguaauuucagagaaaggcaaacuggauucaguuuucagauaauaaauauauaugugcauaauuaaaagagauugauguuuccagaaaggagcacaauggaaugaagaagguggugcagaaaggcugagcccugugcuauuagugaugaguuucaccggaggucuuuuuuuuuaaauaaaaacuuaauuucucugucuuugaauucuaugagaucucuuucagacaaacacaacauucugaaaaucaaagacuuggggauuacuugggaaaaguuccuuugagaacucaucaagaaagcaaggggcuuaaacuugagacauaguauuuagcuuaagaauuggaaagacucuuuuuuuuuaaguucugggacacacgugcagaacaugcagguuuguuacauagguauacgugugcuuuggugguuugcugcacccaccaacccaucuuccagguuuuaagcccugcaugcauuagguauuucuccuaaugcuaucccucaccuugccccccaccccccgacaggcccugacagacagggugugauguuccccuuccuguguccauguguucucauuguucagcucccacuuaugagugagaacaugcaguguuugguuuucuguucuugugauaguuugcugagaaugaugguuuccagcuucauccaugucccugcaaaggacaugaacucauccuuuuuuauggcugcauaguauuccaugguguauaugugccacauuuucuuuauccagucuaucauugaugggcauuaggauugguuccaagucuuugcuauugugaauagugcugcaauaaacauacauguacaugugugaaaggcucuuucaaauacgagacuugacaucugguagaacaaauaauuaaugguguccggagguaguuaaaaagggagggauggaagacaagcuucaacuccagugccaaccccaacugagcaccacgaccaucccuggguccccguagcuaucacugcauaauauccaccaugcauuacaggcuuuggagguagcaccagcaucucuagggcagccagucauuucucuagaaugguguagaacaacagcaccaggaacugaaaggaaccugcaguacaacacagcaggugaggaauagaaagccuugcccgaaucucaccaccagaggugcccuuggacugggacucaggucacuucuuucugccaugugccuggugggaguaggaucuagacagggguauccagaugaagugucaggucuccuuuaguccugugguuugacauguuuaguucaaugguuucacacugaacacugacccgacaaaugggcauuuucauguguggaaggugaaugaacauguucugugagcuuucauaaaguucugcuuaaaaaguuuccaagcagauccucccuguggccccgcauguauagagcuauaaagggaauucccuaaaacaacagacaaaccuccagggccuccacggugcugcacacauguucuuaagcaucucacaagcagccaaugacauguaaagcaaaucaccucucaagaaccacagaagcaggguaaggaaagggaauaucccacaaaaccucuaacuacaggagcagaguaaggaaagggaauaucccacaaaaccucuaacuacaaugagaaaagcacccaguggggaagaacccugcccccucagaagccacugggaaggggcacuuccacccuugcucagccccucacucacaacccccugggcaggaggaccgucuucuauuagugccucugucggggagaagaaugggugcacacggcucagcuagguccuucuggaucuucccaaggagaaagugaaucugugcugcucuccugccaugcagaaaacuuagcuagcagggucugcccucaggagaagcuguggcugcuaagcaucaccugagaccaaugugacugggauguuuaauuccagggagaagaaacacagacugaaggucaccuucucugaaccuacauuugacugucauguauaccuuauuucucaaaaaguuuugaauucaggagagaaagaaaagauguguguuuaugagccucuuaaaaucccagcacauucaugucugaacaugggaggucaucuaauguuucgcauuagcacagggauggcaaaugucuacugccuucucuugcacauguggcauucuccagagccaugaagacccaucagaaucccugucaacaugguauucauggcggggcagcuacuugguggccaccacugcaacaugaaauaucaccuauuuguuauggcugaccuuugccuaugggacacuggccaugucacuuucggaagaaccccuucuuacugugcuuagccaaacaauuuaccuauagucauuauucucauucagccauucuacaaauauuucauaagcacuuuauaacucuuuuaagggagaggggagcagguauuuucuuuaaggaucuucucugaaauaaggaaguacuaagaacaaaguaccaugaaccuuacugagaagacacauucucacuacaguagcauguacaauuuaggaagaaggggacugaaacauuccaaagugugcagagauggugggccaucccaaugauggacugugacaaucuuacauuccauaugaugacugacaacuuccugagaccuuggcuccaccaucaguguuucuaggaccccauaaauagaccauaucaaagagcuauuaucuaccugaauacucuagugccacuuuucuauuuuggcagggucugcccucaagagaagcugugguuguugagcaucaccugggcauccccucacaauuugaauacacuucaguuuuuuccauuccacuuaaaggagcuaggagaguaagacaucagaguccccagcgacauggaggaaggaacugagaccgucuacgugaaacaauacaacuucaaauaaaaggucuucccaguaaguaacccgguuacucguccucaguuaagggaguuucaugaugaaucacugaauaaaagcaggaggagguaggaaguaagaauauaaauucaaacauaaaucuuuaaaaaaaucuccauuauuuguauucuaaaaucagaagaggaagaucacccauacuaacuggcuaaucuaacccucaggaacuacagccuuuggggaaacagauuuggguauuuacgagcuggguaugaauuagaggaucucaguuggcugguacggaaagauuagcaaucacuagccacacagucucagcuaaucccccaucugaggcacaggagcuguuacagccugguggggcuaugugggcaggaauccccaggaaaucugaaggaucacuuccugacagcuucgugugcugaguaucagcaccuggccugcuuugaugauggguuuuacccuaaucagaccacccagaaaugaaagggacaagggagccagcugaguuucagggagauguccaagaagcaaccaggaggauuagagaggaaaggcguucuuguuaucugucaaauccccauacgugcugacaaggacgggaggaaaugccguuugaggcuguguacuuacacaguuuacaggcuguaacuucaucuucuaaccuguaggauaaauuacccaaaacuaaagggacaaaauccaacuucaaacucagaagaccccaggaaggaaaaggcaggagggugcauucauuuugucugcagacucgggcucauggggagaaaugacuggacuuccgaagugcaaacacgcuugcuaaaaaggcaaacacacuugagaguucuaacgaccuucaucaggaaaggguucuuccuucaguaaguauugucaugcauuuuuccccccucagcugagacaccagcccaagguggauuuaacuguggcacuuuucauaagcagugucaacucaggacaccucaguaagcacagcucucagccucucaggucuaaucccaagacagcuaugguuuuuucauggguccaaaagcccagaauauaacauucugaaaugaugauuuauguucaggaaaagagaagcaggguaggaccuauuucuugauggacaggaacagguccaucugaaaaugcugggacuggaagcauuuuggauuuuggauuuuuuuuugaauauuugcauuauagaauaccgguugagcaucccaaauccauaaauuugaaguccaaaauguuccaaugagaaguuccuuugagcgccacgucagugcucagaaaguugaauuuuggagcauucuggauuuuggauuuucagauuugggaugcucaaccuggauaagagccagugauguccuggucugaaaggcugagagagaagggaaaaggucacucacaaagacauuuaggaggauauggaggagcuauacauauaaaggccauagaauuuaaaugaauugaaggauuuuuuuuucuuuuuuaagacggagucucgcucuguugcccaggcuggaguggagugagcgaugucagcucacugcaaccuacgccucccagguucaagcgauucucccgccucagccuccugaguagcugggacuacaggcgccugcuaccacgcccagcuaauuuuuguauuuuuaguagagacgggguuuuaccauauugaccaggguggucucgaacuccugaccuugugauccgcccgccucggccucccaaagugcugggauuacaggcauaagccaccgcgcccggcccugcauuugauuuuuaacagagaagauguaaaaacaguaauagaauaacagacuuugcuuaaggaugguaugucuagugacaacuggucaaacaugagaguguuaagagagggugguuauaauugggaagaauguccuggaacauucagaaugcacaaucccuggauuuaaggaaaagguuauaaaaaccaaguaaccagucguugauguauuuccagagucaccuauucuuuaauguugccuugauucuuuuaauacugguaaauuuucauaggcaucucacaaucacaaagagaugaauguggauccuggcuccaucauucagagcuccaugaccuugcucagguuaguggcuucucagagccucagcuuuccaucaguuaaaauaccuacucuuuagauacuuuucaagauuagggugcuuaacccgguccuaacacacaguaacugcucaaaaaacaguaacuaccauuaacucagugaacaauuacugagcaccuaccaaugaagaauaacaucagccaugucuucaaggaaaauuuauaggcaagacggacaugcgcacaaccaaguuagacuagcuauggaaacugugggcauguuauuugacccgucugacugcaaaccuaucauccauagaaugcauauaguaagaguguguaccugacaugguugugguaaggauccacugaguuaauacaugucaggugcucaaaauaguacaugacacacagucgaugaugaugaugaugaugaugaugauaugauguaaugguuagcuuuauaugucaaccuagcuaggucacaguacccagacauuugguaaauacuagucuagucauuucugugaaggcauuuuuuagaugagauugacaucaaaaucaguaggcuuugaguaaagcagauuacucuguguaaugugggugggccucauccaauuaguuggaggcuuuaagagaaaaagacugaggcccucagggaagagggaauucugccaucagacagccuuuggauaagacugcaacaucaacucuucccugggugucuagccugcuggccaucccugcagauuugugacuugccaguccccacaauuaugugaaccaauucuuuaauaugagucuuagugucuuucucuggcucuccauguauauaauauacacuugucagagacagagagauucuauggccuuuauacaugcagccccucuguauacaccuauagaauuaccuuuuuccucucucagccuuuccaaccaggucauuacucgcucuuauauggcuugagcauuccaaauccgaaaaucugaaaugcuccaaaauuugaaaguuuuugaguaccaacaugacacucaaaggaagcacuguugcucucucucucuuggucugacauauccuauuaaucuaauacaaauguuauuuuguuauuuuauuauuuuauggcuaagaaagaaaggaagugugagaaaucaauaucacaaacaagauuucugcuugaucaacuuuuucugcguggcccuggaaggacuauccuguuucaucuuuguuccauaaauccacuggcagaaugccaagagaaguuacuuaaugcauaccuggucauuugcuuuuuauuagaaaauaaauacaaauguuuaauuaagauaaacuuggguaacauuuaaccuuccugaugacaccauggggcaaagguuuucacacuuaacucaguuaaucacauaaacauaacuaaguucucugaugcaggagagaaaagggcccuggugagucucccucuuuacucucuuaaagaacaccuaagcuccucuccuacagaagagcucauuucaguuuagauugacacuguauuuaaggaacauuuaaauauuugcaacaaauugaaaugaaucacccaagaugaaaaauccaacuuccauacugcagcuuuagaaaggcuaugauauacugaaauagaaacuacuaguugucuuacucugaacuccauacaggaauguauauggcgauuuccaaaacgaagcuuccugaagcaucugauauucugacuacuucugcuggauuaguggaacacuuuaaauguaaaaaacgcaaucuguauuucucucauuaucuguuuauagcacuaauaagaaccacucugcucuacugucaguuuuccgcugggauaguuuuaaaguuuuaagaguaccuaaaagcuuuauauuuaagucuugcucucaaugauggguguauuguucugguggggccuauauagcuuuagaugauaguuagauguguuaugcuauagucauuuaaaaguuaauuuuggggaaacaaaauuucucaauaaauacuaagaucuuagacuuuucaguaacuuccacugccaaaugcguaugucuaauguggcaaaugccccaugcuauaauccgaagucaggacaccugaugcuccaggguuuccagacaugugugugugagugugcacagggucuauguaugcugguacacuuaaucugcuagaugggcuuucuucugggauuauaaaguacuucacacaaauuaagccaugagaauaagacuucucugaaauggauagaauauuccaguucuccauuuuauccucacagugucagaggcauuugaaucagagcaacuccaucuugaauaggagcuggguaaaaugaggcugaaaccuacugggcugcauucccagauuguuaggcauucuaagucacaggaagagacaggaggucagcacaagauacaggucacgaagaccuugcugcuaaaacaggcugcaguaaagaagcagccaaaucucaccaaaaccaagauggugacgagagugaccucuggucguccucacugcugcacucccaccagcaccaugacaguuuacaaaugccauggcaaugucaggaaguuacccuauauggucuaauaaggggaggcaugaauaauccacccuuguuuagcauaucaucaagaaauaaccaaaaaaaugggcaaccagcagcccucagggcugcucugucuauggaguagccauucuuuuaucccuuuacuuucuuaauaaacuugcuuuagccuugcacuuguggacucacccugaauucuuucuugcaugagauccgagaacccucuccuggcaucuggauugggaccccuuuccuguuaacaacagugucgaaaaccaaaaccagaacuagaaccaggaggcaauuccagcucgugauuuuuuuucuguuugucauacccccaccugucuuuguuucguggccacccgcucccggcucccaccugucuggugcagcacucugggaccacuggagaggaaaucagaaaaggcugacggaggcuaaagacacugugguagagcaggagcauucccaggcagcacaggcugugcuucugaagcccugagcagggaacgugagcucuugcugagagcacaccaggaaaaacuaaccccugccaagaaggugggucugaccaagggcccgucuccaggccacagacggugaccacaggggaguuucucuggcaaacagucagagagaaaaaaagaaaacaacgaucucagcaccacucugaccucauaggacagcagggauucuuuagaggauugggcagcucucacugcuacuaaaggcuucaccugaaagaaaaauugaacagccucgugggcaguuuaaugauguaccacgcuacuguuauuuacugcacuuauuagagcagccuagcacaccauaguaaaucuacuaaaguuuuacauuaccuuaaguauauaugguagcagagucugacagcugcauaucacgaugauccauucuuccauucuucaugacuaacagccccugaauuuuguuggauaaggcaauguaaccaacuuaaaaacuacauuuccuaauuuccacugugacuacacaugggacuaaauucuguucaaugagaucaaagaagcucuaucugggggcuucuuacaaagcuuccuaaguggggacuuagcuaaaaccccucuucuguccuuccuccuucuuccuccuuccuaucaggaauagagacacgauggcuggagccacaguaucuugugacagugaagcaauuuugagaauagaagucacacacuaaggaugacaugauaacgaaaaugaaugaaucuggggugcugaugacaucacggagccucugcuccaccccugcagugccuaccucuauacuucaugguaugugaaagaaaacacaaauaucauuuuguuaaaaccauugauuuucaggucauucacagacaacugcaauuccuaacugaaugaguguacacugaacacacagauacaacauauauauaaguguaagcagccugcugagaucaaccaaucaaucauugaaagauuaucucccaggcagccgcagucaucccuuucucuagugaaucguucagcacuuacugagugccuacuuaucagccaaguguugaagauacgaagauggaugagacacagcucacgcccucaagcaaaugacgaucugcuggaggacacacucaggaaguagugguaacugcuguaugaacaguaagaugcaugcagugcauccauuuaacagaugucuguuacacaccuacuaagugguaggcagucuccaagggcuacguucacaagucuauauucuagauggcauggggcagagcaaguuagaggguggacaagaaaaauaauaaagaagaaaaugaaggaacaagacaacuucagaaaauaaggaugaugugcuagugagugacugcugggagcuauuuuagacauggugaccagaaaaggccucaauguaaaggguauauuuaaacuaagauuaugaauuaaguggggggaggggcggggggggggucgcggcacagggaauggccugugaagggcuuggggaagaacauuuuuggcagaaggaagagcaaguagaaagguccugaggcaggaauaggucagauagaauguuagaggguggugcucauggcucagagaggagcuuugauuguggggaaauggagaagucaaggaaaguuucccaaguugcccuugacuacaaccaagucuuccuccucucuagagccaggggauucccaucagagaaggagcacagcugccugaaccccacccucuccacccaccuggccucacagcuggcucagugacaccuuuaucugugccuuaaucccaauauauuuuccuucccugaagagcaauauggaugccgucucccuccaaguauaagacuugggcugaggggaaagcagaaaccccuccuuuuccuucugcguuagagaaaaccauuuuucagcagcacuaccacuucaaaagcagcuguccugaauaagacccaggcugcuuucagaucaauggccauacgaaagcucacuaaaacaccauuccuguucgagguuugcccaguaccacaguucaaaaggaucaaccccauugucaugggucauaguccacaccaguguagaagagcaacagcccccaggaucuacagcugcagagagcaccaggcaggauaaacugaugcaaccugcccccuuacuccaaaauccuaagcuggucccaugcgaggguccaugaacaggcaugaccaugcuggacagugucugcaguccuagguacccucaaauagcuucaucacaaauaccaaaaagaugaugacaucccuaaucuuuugauuuaguuacuauuauuuacccaucaggaaaugcacuaggaaugcacuagucacagaaucaacuuuagaagacuucaggggugauacaucugauuuucaaugaauggugguguuauuacauggacagugauucuuugaucaguaaaagaaaaugugacacugccuucuuuccaaacccuaccucuuuuccucugaaaacuaugacuuuaucaagugacugaguuuuucccuauuuuaacaaagacuuucuauccuuucauagauucacugcacugaauaaauugucuguuuauuaccuguugaucuacuucuagugaauucugcuuguuaaaaaaguggaaucguaauuucucacugguuuucuauuaagccuccacucaauguucuuggucuccucucuaacaauggagcugaugaguuuaguggagucucccgguaauuucccucuuguauugcauguuucucucagaugaauauuucaguuaaaacugagacuaguugauaauuuuuuccacugaagucuguauuccaauuuuuuuuuuuuugauacaggguuuugcccaggcuggaucacaguagcaccaccacggcucacagccucgaccuccugggcucaaguaauccuccuaccucagucucccaaguagcugggacuauaggcaugcaccaccaugccuagguagugauuucauauuuuuguagagaaagggucucccuaaauuaccaaggcuggucuugaaccccugggcucaagccauccucccgccuccgcuucccaaagugcugggauuacaggcaugaagcacugcacccggcucuacuccuauuuuugucugguuguucaucuggaucugaccaaguacggccuaucugccucacccacuucugucuuccauaagcucuguuuaaugucagauaacauguauugacuuuuuguucuaucugccaaaauugggauuggaguugaguauauuggguugaaguugauuauauucuuuccauguugucacacuguggguguuuuucacuguaaaauuagagcuauuuaaauacauuaucugcucaccuacaaaagcucucacuucuucagaaacacagagguuggucaaugcuucccauuccacugaauucacacacccugcugggaauccagugaugaauggagaauggggagggucagccucaccuuccaugcaggucaauauguuuauuuuuaaagaagagucaaccugcucuacuacuuuuuguuuuuuuaauuccuuaguacucacacacuaugaaccaugcacgcacaugcuacgaaccaugcuuggggaagguacaagaaggauaagacaaggcauugggugacagagcugccacggggcucgccucuagccagagugauauauaguaaaggguccacaggaccuauguccagaaagaguuuucuuuuuccagcaaaacauaauaaacaaaaucuaaaauauauauugucuuacacuugagagaaaauauaugaaccauaagaagcuaauuauuggauuuuuuaaaaaacagacuuagagaaaaugcagucauaaggacuucacgugagucuuugaguagaauucaaccauuuaaguacuccccacucauuggacaccuaugcacguaggcacuguuagugcuggaguaacaaaggcaugaccugcauccugcucuuggggagaccuggcccuuagacaugagcacauguauagagguaacucaugcaggaugauaaggcugguggagagaugcaaaccgagcacacaggaaccggcaaucaaucaaacagccuuuagcugguugugggaagaccacguuagcaaacagaugcugaagucuucuuuacacacagaauuagcaaaacuaguagcaaaacagaucuuugaccagguaaagccaguagccuaacgggacucugaaguaaguuuuuacacuuuccuugaagacucauggcaaauaugaaccuccuauuucugcugauggggugaagagcugaggucaaagagccucccugggucucccaguucucaucacacuuucucaccuaugagggcagacugcccacccaggcaucccaggggcucccacccugggagucaucagguuuggccccuuuucuucuuuucaugaagacaaugaacaggaaggaguuaguaacaguuccugcuuucuacuugcucaauuuuuaccuccugcuaucuagcaggggaaaaugagaaacucuccaucggccucacccucacuggagaaauuguaugugauccagguuauguaaacaacucuuccuucaaacagcuucuuguggacuuuauaaccucgucuaccaguauuguuauagauggcucagcucuaaacucugagauggauaauugauauagaagccauacucccugaaaguaagccaugcuuauggaagaugcuugggguuuaaaaacaaaggcugucaacaaaagcccucccagccacucggcaccuaucagaaaaccugugaaggaugugacagagagauccagcacacccagcagaagucuggaugaugcucuaaauauagcuguugaaugauuaguaucaaugacuacguaugugcaaagccaguuaacuaaauuuugacaaauagaaauuccuugguuaacuauuucaaugauuuucuaaacauuucauaggaaaugaaauucaagaaacauguaucuuucaugcaguccuccccuggguucuaccagacacaacccuuaccccaaagaggcagauuauaaagagaccacauaggcaguaacagagugguaaaaagauggggaugggacagggugugguggcucaugccuguaaucccagcacuuugggaggcugaggcaggcgggucauuugaggucaggaguuugaaaccagcuuggccaacauggcguaaaccccaucucuacuaaaaauacaaaaacauaagcugggcauggguggacgccuguaaucucagcuacuugggaggcugaggcaggagaauugcuugaaccugggagguggggguugcagugagccgcaaucacaccacugcacuccagccugguugacagagugagacgccaucuuaaaaaaaaaaaaaaaaaaaaaaaaaaaaaaaaaagauggggauggaacacaaggaagcucugacuucugccggaggguucaggauaccccacugucugcagaauuuccccauacccccaaacucagacauggagcuucccuagcagacugacaguuaccaaaauauaggaaagaaaauuaacuugggguacccuaauuugaaaucaauaauaaauaggaauuaggccaaaguuuacguuuuuuacuacacauauaaaauggucuguuggaggaaacaacaguaccaagaguuguuguguaggauaagucauacuuaaccuacuuaggagacuggaguaucucagacaucucugcauccgcaauuauauacaaauaacuaacaaacuaauuacaaaccauuaaggcagugacuaugucuuucauuugugugucacucaaagggccuugccccccauucuagacaaaaugaucuuuguuaaaaugugucacuuaugggcuucuacuuggcaacauguuggucaucuccugcaagcagauauauuauuugauucggucguucauuagguaaauauuuauucaauauuuauuauguccaaagcucuguauuaagugcuauaacugaauauaaaggcgcauaacacaucuaaacaaauauacgggauauaaagucagaaagugaacauccagccgggugcaguggcucaugccuguaauccuagcacuuugggaggcuguggugggcagaucacuugaggucaggaguucgagaccagucuggccaauaugauaaaaccccgucucuacuaaaaauacaaaaaaauuagccaaguguggucacagacaccuguaaucccagcuacuccagaggcucaggcaggagaaucacuugaaccugggaggcagagguugcagcgacccaaggucgugccauugcacuccagccugggagacagagugagacccccuccaaagauagaaagacaggaaagacaggaaagacagauagacagacagaaaaagaaaaagaaagaaagaaaaagagagagagagaaagaaagaaagaaaaagagagaaagaaagagagagaaagagaaagaaagaaaagaaaagaaagaaagaaagaaagaaagauagauagauagauagauagauagauagauagauagauagauagauagauagacagacagacagacagauagaucgauccaaacacaggcacacugagugaauacauuacaggaaguggagguggcaucugaccagggagaucagacggaggcauucaggacuggcuuggggaaugcacaugauucugguguguggagauaagaggguuggacaccagcucaagagagauggaaagcauggcacgggggccaugggcaacacugagacauuucuuuuucucagcgcuggaauaaaugaagggcugggguugaagggaugaaucagaagaaaacauggacucagcacagagcauccugcagccgagaucaggcaucuagauuuggcaguccagagugagugcuuaaaagcacugaaugcuuuuaagccaagaagguugugacaauuguauuuaaaagcaauaaaaccaaguugcuucuccaguccuccauaacuuaggggagccuccuucaggcuggcugacuccuuucucccacgcgggucugcgcugaugagaggcugcuguacaggucaccaucuagggugggacucggagcucucuggucuguggcugagguucacugcaugucaugacugccuguguccaccuuuuuucccaagauggccugacugcuccccaucugcagugcucaguuccugcaaaacucaccccuuuaugaagcuccaaguuuugaagacuccuacccuuaacacauccugcaacaacugcucauagugccucggguuccaucucccugccccauuacacguuuuaauaucugcagcacagucugagggcccugguuggcuuuauaugcaaauagcaugaauaauuuucuuugauguuuuauucuauuguguuucauuuggaacagagaaacucaaaggaggaaggaugaugaaugagaaaagagggcagcaagcgccuccauguaaggugcucuaacuuaaaucagcuuuuugcagauucucugcuauccccaaaucauccuccuugccuaauucucaaaaagaacaaaacuucuccagacagagcccgcaaggccagagcaggacaagcagugugugcaucccccgcucaucccaaaucagcaguccauguagaauuaaaaccagucucaaaacacaagaauaaaacaaaaaaaaaucagacuaaaaacccccaacugucuucuguaucaugagcucacaacaagauccaaucuucccaauuacagcaauaugaauacugggaaagaaaugcgugaaaaccuccaaaguauccucaauuuaccuccuccaaaguaaauuucauuugggaaaaauaaagguaaauacauaacagagggccuuguuuaaguugacaauaauauuuggcauaguguuuauuucagcuaggagguuaugccagggcacaagggguaaauccauggauuugggggucagaacaccucgagauuuaaauccuagcucugccacuuucaagggugaccuuaagcaaguaacuuaggcuuuggauuccucaucuguaaaauggaaaaauaauauuaccaacccaauggggcugucaagaauuaagugaaauaccugcauauaaaaguacuuaacacauccauuuaggauauuuuauugcuucuagcauucauauaucuaaacuguuuuaacuauuucuaucuccuuaaguaaaauauuuguuucuuuuuaguucaccuaaugcagcaguccccaaucuuuuuggcaguauagaccaauuuuguggaagacaauuuuuccauaaacuggagagcaggggggaggaugguuuggggaugauucaagugcauuacauuuauuauguaccuuauuucuauuauuauuacauuauaauauauaaugaaauaauuauacaacucaccauaauguagaaucagugggaacccagagcuuguuuuccugcaacuagauggucccaucugggguugaugggagacaguggcagaucaucaggcauuagauucccauaaggagaaaucuagaucccucgcaugugcaguucacaauaggauucaugcuucuauaagaaucuaauacugcugcuaaugugagcucaggcaguaaugccagcaauggggagcuucacacagaugaagcuuugcucacuugccagcuacucaccuucugcugugcggcccaguuacuaacaggccacugaccaguagcgguccguggcccagggguuggggacucuugcucuaaaggcagaagaaaagauaaacuuuagggaaauauguggauuccauuugguauaugaauguucuaaauacucauaacucuuauaaauauuucaaauaucaaauaauggaauaaaaugucuuuucacaucaucacacaauaaccaugaaaugauauccagguacugaaaucacucuacucuucuauuuucccuagccacaacaaaggaauucuaaaacauccaaucucugacacuagcuauuugauuuacaggaggcaggcaacaacacacuacuaacaaagugacuuuagcuaaaucuuacguacaugugccacugcaucaacucaguuuggacaaauaauuauauaauuaauugugcagaagcauuaaauguaacauaauaguaagcuuaaauggauuguuucuauacucuuuuccuuagccaaguauuucuggcugugugguugggauucugguuuuuguuucauuuuacuuuaaccugucaaaaaauaagggaaaaauaaguuaaagaagaguaaguaugugggugaauaugugguagagguucuaggagaggaagaauaaaaauacauggguugaaucugaacauucucuggugaaaggcauauaaagucacuguauucuguauaccagagccugggucauguuuguuuccugcaugaaugaucacaauaauucauugcuacuacuaauaaugaagaucauaugacugaaugaaaauuuagagggauuuuucuucucuuucacuaaauugucauauccaugaaaucauuuuaucuuacaaccucaaaauaaggacagauuuaaccauuccaaauucauagauugaaaauuuaugcauccauuuagcaaauauuucauaaaaaccuacuauacauaauuacaaucagacucauaucaauaugugaauuuuaaacuguguauuauuuauguuucuugccuuacugugacaaacucuugagaagcugaaaacguacuuccuaugacaaauaaaauccaauuuguagacagaaaacugaaguugaaaaaaauuaagauaaugagacuacauaugucuacauccaaacacacgugccugugugcacacacauacacauaugucccuuuaucaaauuugguguccacaaggggcugcauaauaugaauccacugaaaauagaggucauaguucuauacucaauagugaaauaagccuuuaucuagucuaaagacuaagaaaaauuuauucuauagcuuaacauuuuuaaacauucuaauugaaacuauaccuucacccuuaagcaaagaaugaaucaagucauaauuauuuaucaaaauaauuuuucugauaaaaauuaugugguuucccuugaaaauaucuuucugauuuuguauucauaaagaggaucauuuuugcaaaaauaacuuacgguuucugcaauucuugcaagagcuucucuuuuuuuaagauuccuccuaugccaucauccacucgauuuucucuuuaauuacuaacuugccuaacccugccaaaugcucauuugccaguggcucugccugcaaugcaagcaggucuccaacaucacuuucacugacaucaugaaaucccguauuuuuguaagauuuacacucauauuuccaaauuguauuguaccugcaguuccuugaaagauguuuacaacaaucuuauuagugaaggacaaguagaauggauggguacaagagaugacagguuaggaaagagggauguuugagaaggaaccaguuuuacaaauggucaguuuauuaguaaauacugucauauuacaauaccuuuuuauuuauuuauuuugagauggaguuucacucuugucccccaggcuggagugcaauggcgcaaucucggcucacugcaaccuccgccucccagguucaagccauucuccugccucagccucccgaguagcugggauuacaggugugugccaccaggccuggcuaauuuucauauuuuuaguagagacaggguuuugccauguuggccaggcuggccucaaacuccugaccucaggugauccgccugccuuggccucccauuacaauaacuuuugauugucuuugcaacccuggaacugacugaaaucucugagaauaacagcuuggaggacauaaaaagaagcgcuaagcugccuugcuuagagagcaagagguacagguuugguuacucucccuuuauuucagaaaggccuuuguuuucuaguaugguuuggaucugugucuccaaccaagucucacgucgaauuauaauucccaauguuggagguggggccugaugggaggugacuggaucaugggggcggauuugcccuuugcugcuguucuugugacagugaguggguuauugcaagaucuaguuaucuaaaagcauguagcaccuccuccaaaccccuuccuccugcucugaccauguaagacaugucagcuuccccuuugccuuccaccaugaugguaaguuucuugaggccuccccagaagccauuaugcuuccuguacagccuguagaacuguaagccaauuaaaccucuuuucuuuacacauuacccagucucaggcauuucuuuacagcaaugcgaaaauggacuaauccacuuuucaagcuccuaaacccucuugcagaccccucugucccgcugcccccaucaugaaagcgcccugccuuggcugaccucccaugacucgcuuuucuuccuuccaugacugccaguccuguguguuauuauuucuaggcuuuauuagaaagaugaauacaucaaaauagaaauaacuuauauaaaaauuauauuaaaaacucaucuuaacgauacuauuuaugaugaaaagggugagccugcagaagcccucucacaugucucaugugucauguuuuccuuuacaaggguccuucugcuccuuaaucaaaggacugacucacucaggcagggcaccugcacccuccuggucaggaaugugaguguggagggcaggcagcuugggugcaaauccugccucucgaacuuacuaugugaccacaggugaguuguugaaucauccuguguuucaguuuccuuaccuguaaaauggagguaauuacagugcuguacuuacuccgcugaguaagaggauuuaagugauaagauaauacauggaaagugcuccauggugccugagguccaguaagcaccaagugcuagucuuuaccgggaacaucaaacaccaacuggugcucagcaaacacgaagccccacacuaaggccugggaauacagagaucguauacaugccucaggccugaaaaggguucuaagauuuuagaauuccaaagguauccucacauucacaagcugugcaauuuggggaugggggacugggacggacauucagugccaccugugucuccuggcaccucuacaacucuagauugggcaucucuaaugucuuuagacuuuccuccacuggaaaaaaaauggagacaauacaccuuaauccacaaguucuuuggaaugaguauggcauacaagacacauuugagaaagcgucuaggacagacucaccccaacacucacaaaugugcauuucccuuccuuuguuuuuaaaagaagaccauaaacguaacuugaaaauaccuagaagaagaugugccauuuaaaugaaagugaucugugauuaauuuuaaauccuucuauguccaaacuacaagucuuagaagauuguggaucgguaauagcuauaacuucucaaauuccucaaaauuuauuuuuucauccuguacugaaguggcuuaccaaugaacuaagaaaguuauauuguaauacccauucuggggcucuguuuuauauagaagaugagaaaaauaacaguuucuaaaaauagguaagaaaauuacgugaaaaugagaggugaagugaggaauggcaagaacuguagaaccaaaucagugggcuggacacaugagggacggugagggauggugugggaagaacccaagugggaagcugggcuuccacugccuugaccuccacaucgccaggcuucucuggcauguuccuuugaucaaugguccaaagagggagagacucagcucucacccaugcaccugagugagugacuggggagacacagcaaaugcugaguaagcacagagagccuguaucugguagguuugauugcuggacaaggccauggccuaaguugccuuguauacuuauuccagggacuuuuugucuaugugugaauggagugauauggauccuuuaccacuacuggaaacaaauaagaaaccucaaagaauaaguacuaccaacagagggucagugauguguuuuuguauaccuuuagcauuaucuaaaugcagggacauaaaaaugcaugguacaaaaaaaaaacccacuuaauuaacaauuugccauucugauaauuauacauagaaggcauuguuuggguuuuucuaucuuuggucacaucuuagggcuauucugauuuaaaaguauagaguauaaaagucaguguggcaauuucucagggaucuagaacuagaaauaccauuugacccagccaucccauuacuggguauauacccaaaggacuacaaaucaugcugcuauaaagacacaugcacacauauguuuacugcggcacuauucacaauagcaaagacuuggaaacaacccaaauguccaacaaugauagacuggauuaagaaaauguggcacauauacaccauggaauacuaugcagccauaaaaaaugaugaguucauguccuuuguaggggcauggaugaaauuggaaaucaucauucucaguaaacuaucgcaagaacaaaaaaccaaacaccgcauauucucacucauaggugggaacugaacaaugagaacacauggacacaggaaggggaacaucacacucuggggacuguugugggguggggggaggggggagggauagcuuuaggagauauaccuaaagcuaaaugacgaguuaaugggugcagcacaccagcauggcacauguauacauauauaacuaaccugcgcauugugcacauguacccuaaaacuugaaguauaauaauaauaaaauaaaauaaagaaaaaaaaagaaaauauugcuggacuuuggaaacuacaaaaaaaauaaauaaauaaagaguggagaauaagaaagcuggaaaaaaaaguauagagaggauagauuucauauauuuuugcaauaaauggcaacuuccacauaacacaaauccugaaacuuuguggaaauguuaacaagguaauuguauaacauacaaaacacuguagggaaguauaguguuuagaaaugcuucaauuaucaccaaggugauguaguuaaauaaggauaauaaaauauaauuaaacauucauuacagaaacuaucaaaaauaauugaccuguacaaagcacagcacuccuauuaaaaggaaacugauggauaauaaaauauauagaguauucuguccucuagacauaauuauuccaaggcagcaauuaaauuuauagaaaacuguuaaguuucuucugugacgcuuuacuacugugaacucaagauguuuugagugagaauugccuccaaaaaauucuuaugauuguuuaacaucuuaacaagaaguacugccauaaauuuaaauauguguguuauauacaaaaaaaagaugaauuuuaagaugcuuaggacucugcuauauuugucauauuucugguguccacaggauugacuuuugcuccaguugaaaaugucuaauucuucuauagccaaaucugagcacagucuaauauugaagaaaaauuuaauguuaaugcaaaaauaacauucugcagaaagagugacagaauauauuuuuaugaauaauuaucaggccaaauuuuuuauacaaguuuguuucuucaucauuuaaggaagcgggacacuguuccaugaaaucauuccagugucuuaugggaagcauaaugucuuuaaaaggguacaaaaaucucuccuuuuggccuuuuucuagcauauucagagaguauugagaauucucuacauagaggcaguuguaaacauaaacuucuuuacacugcugcugggggugagaggagaauagaauauauuuuuauacugacaaauguuuuaaccacuggaaaaugaacaugacuuuaguagguaaaauuaucauguacaggcaucagaaaggaaaaauaaaagcagaaaaacugagaacuguguguggagaacagccuucaaaaauccaauuguauuucaucuuccuccucauuuagucuuuuuuuuuuuuuggcugcaaagaugcuuuaaaaauauauuguuuuaguccaaagauaccccuggcacaagcgacaauaauauuacagggacauuaaauuaaggaaagaaccaacugauaugugucuaugagagaagagcuacagggugaggaacugggaacaaaggaggaagacacuauuagcaagcacuggggcccuccuuuauugacgugggggaaaagucugagucccagaaugaauauuuccugaagcagagcugaaauggaacugugacggacauguaauguaaacccugauaucaaaagccacugaaguuggaggggggggcuguuuguuaccgaagcauaacuuaagcauaagcugacugacacaaagccuaacauccaguuuuuacaagcaaguuaugguuuaaggaccugauuuuaaaugacuaaaaauguuaucccucaccugcaaagccuuguuuuuacauuaaaauaaauuuaaaugauuuggcaacauuccuuaaauaugccagauuuugacaacucaaaauuauaccacuaaagaaauuccagagacauguguguucaucauccaucucuauucaugacagaacauuucagcaauaacugagcaagaggcaauuuuuuauaccuggagugcagcacuagguaauucuggcaaggaguuucugagagaggaacagaaaauggaauaaggaagucauugauacuauauggaaauucaccacuguugcugccgugacugaagaggcaacgugaguucuaugccauaagaaucauaauguaaaauagguuaagcauaaaacaaaauaauauaagcaccuacccacaaaaauuaaaauuuauggaagauucggcagaaacagcugagaguggugcuuaauaaaucccaggccuugugcuaaagccuuggguuaugaagauaacauacauucuguugccugugaaaucugaaaggggucuguaacugcaugaacugcaaagacacccucacauucacaggcuguguguggacauacgugugugugugugugugcauguacgugugugugugcgugugugugugugcgcgcgcgcgcauuuuuagguagagaccaauuagauaccuuauucaauucaacauagaccccugaaaaucugggaggucauuccccuguuauuguuaaacaauuuaucacucuuacuggaaaggaaguaaugcuuaacaccuuaggguugcaugcagaaaucaauuaaaaucuaaagacaauaauccagcaugauauuucacuuaaaugaaccuccacagccugucaaauuagaaaauucauuuauguaugugugugugcuguggaagggggagaaaacagaacacagagggagucauuguauuucuuuacagaaucaaaaugacacggugcagucacaaagacaccggcccuuugguguuggccuacagagcacucacgaggcagcacagucuccaaagauggcaugaaguuuuaaaaggaccaacuggcccauccagguuagaaagaucuuucacuagugcugucugugacagacaauaaaccacugucaggcugcgaaggucuguagaagacagaagucugcacauuaagucuuuuuuagaggggaguucacugaauguguggaaacaaaggcuuggucuuguucugccuauggaacccucagcaucugaggcagaggagcagggggucucuggauggcaggccaggacuucuaaagcaggcagcaggccuggcccagucacacucagucacuggggcugaggucagugugacacgcuuuuuagaugcuugaagaauucuugguagaccucacuuugccacaguaauuaaaacgggaugguuuucaaacuccugggcaguuuuaccccuagaaugaggaaacuggucauugugaugcauccugccccaauaagaacacuguuuuaaguuuuagacacaccuacaagagggacacgauccaaacaagaccgaacagacagacaggcuucagaaauguugaugggaaaccauagaugcaaagccuggaaaaauugauggaacugaguaguuaccucaaaaacugggggauacaggcagggcaacaguggcucacgccuguaauuccagcacuuugggaagcugaagugggcagaucacuuaaggucgggaguucgagacuagccuggccaacaugaugaaaccccaucucuacuaaaaauacaaaaauuagcugggcaugguggcacacaccuguaauuucagcuacucgagaggcugaggcaggagaaucacuugaaccuaggaggugaaggagccgagaucgugucacugcacuccagccugggugacagagcaagacucugucucgaaaaaaaaaaaaaaagggaggacacaaugcgacacaauucaauaaauauuuacugagcaacuuccagguggacgauccuaugcuaagcaccgugaugggaaauguagauaacgauaagaaacagcuucuguccuuagggagucugcaaucuaaaugggggacaggggaaggggagguugaaaauaagcaagucacaaacacaaaacaggccugaggaaacacacaguauuaugaccuauggguggaaaagaccacguuucacuagaggaccuuucugagaaacagauaggauuuugggagccagaggauuuuugaggggaggguaaggaauaagaacauuaucaaggccgggugcggugguucauaccuguaaucucagcacuuugggagguugaggcaggaggaucauuugggcccaggaguucgagaucagccugggcaacauaggggggcccaucucuauaaaaaauacaaaaauuagccaggcgugggucacagcuacuugggaggcuaaggugggaggaucgauugaguccaggaguaugaggcugcagugagcugugauugcaccacugcacuccagucucggcgacagagcgagacccugccucugauaaauaaauaaaggagaggacagcaagaguagaugcugagcaggcaaagaccaaaugcucuuagggaagaaaaaggagguagcaauuuaaucagcuuccuuucugucaaaaggcuaagcccuaaguaguuugaauccuaauaaaauauugcuuuuguuguuguuuguauuagagacaggguguugagcaccaccauccaugcccagcuaauuuucguauuuuuuguagcaagagucugccaaaaaaaaaaaaaaaaaaaaaagaacauuaucaagaauaggacaaagagucagaaaacaaaauguaugcggcuggaaaaauaucaaaaauagucuaguuuuggcuggaaaauagggcuugacaagaaaaggaagauuagcacaucuaacacauauuuccaaggcauauuuauacuuaaaaauuuuuaucacauuaauauaauguucucaucacaguuaggaaaaugaagcauaaaaaaaaucuuccucacaaucccucuguuacacguaauccuuuuaguccagcacauugcaagcgcucacagauugccgaguugaauggaaacaugaacuuacauuuuaaaaaauaguguauagcauauauauauauauauauauauauaugcgauuauuggcauuuuuccuccaaaaaucagucauguguuucuccccuuucuaucugcuuguaaacacagcccgcucuugcuaaauccauguucacaauauguuccccauuuuaaccccguguuagcuuccucucuacacccagcauagccuauggcuucccccugcaucaaccaaucacaucugcacccaagcaaaggaccacagauauuuuaacaguaaccuaaagagaauaaccaaggacagggauuuguauguguguugcuuacuguuacauuuccagugucuaaaacaguaacuggcacagaguguguugaucaauaaauauuuuguuguugaauaagguaaacagauuuguaaacuuacacagaauaagccaaaauacaauuauguauuuuauuugcuuaccugcuacuuaagauuauucaugguauuaauagaguagcacaaucaagauuuuacaauaaacgaaaugugaaaauguaucuuuuaaaaauccuucuuugaugggcacuaguguuaacaucugaguaauuacucccccagaacucaucuuuaaauguuuaauuguguuuaaauaauaauaauacggguuagccucuacugugauuuuuagacucaaucugaacuuucuggucauaaauaacgucacacauucuuaacuguuaaaaaaaaaaaguaccguagucauucugauacuucauuuaauauuacuauuuacaauuauuuucuauguuuacugagaaaaugacuagcaccauauggacuaacucagagguauccugcugagaugcuaugcuuuaucaacaauaugcuaaaugcugcucuccuuaugacaacccccaaacacuuucucuucuaacaagugcuuugcuucacauuacaaccuuucguuaagaagucaagcuugcucucuccguccucugcucuuucuucuuugccucccucuccuguccuauccuuugugcuugcuuacauacuagcuaggacagggguccuccaaauucagccuggggcuugcugcauuuggggaagagacauuugcagguuccaaaauggccuggaugucagcagcagugcacauggaagaggaaggcguuccaggacuccuagagcacugugauaugcuaaucaggacccagccuccacacuugccaacccccaugaugugcggcuccuucugagcugcccugauguagcugccaaaccugugaccuacuuucacacagccuugugcuccuggcuccccacaggcaaugcccuuccacaggguggacuugcuaucuguuuucucaaaacuggaacucacauugagccagccagauacccuuucagccuuucaguccuacugccuguggagcuucagucaucaugugucagcauuuuaaaagccacucauugucacagaguucuucccaucgcucuucucccacuaacaucuccccaccuugccucccacucccccagcauauggugaagcagggccaagacaacuugggaaaggugucuuguuuuaagaugcuaaucuccagcuuucuguuccguucuaccagcuagaggccucuuucaugugaagaucauauacuuugggcaucacaacugcugaaaaacugugguuauuaauugcucaagucaggcuggaagauguauugaucuuuccucccucgggggccccgguguuucuugcccauaucacucacuuggcaauuaaucacauuuugccuugagacaucugcgguuucacuuuugccauuuuccuuagcucuuuguucccaacuggcugguccacuugaugcacacagguuuuagagauuaucugucucugaguuuuccacaguccuacacaguccuacacaaacugggucucaaaaguauuuuggacugacuucuugucuggaaaauuucuuccugcuccucccugcuaagcacaaugauaaacccugaaaauaccacaaggggcagccaaagguuccaugugaaaggugaaaagaguaagguaaacuagucagagacgcugcccugccaauagaagaaggcaacccggaccuggcauuucccaacccacagccuauauacagcaacagaaggcagucccgguaagugcauuccuucugcaaauugaaagagucucaccaacaaaaccaggagggguggaauccgcaaggcggauagaucaaucaccccacugaaaaaacuuggccagaugaagcacucuccuaccucucuaggccucagauucuccuucccaacucagaccaccaugcaagggggaucacccagcccaggaaggguucuccuucccuaccaggccucagaaacaugaggcagcugggcacaccagaaaagggaaucccaccaugaaaaguacccagcccaggaagcacucuuuauccauuuccuucuuauaggcuacauacuccacugcuccacauaaugcaguagggaaccuggccugacaaaaacuccuuccuccuccucaagcagcugcaccagcagcgcaagauaaaccaagcagaccaaaguagcacuacaaaggcucugaauguuaagucaucccuacaacuacaguccacaaaaguagccugugugcuaaauguuaaaauggagacucaaaauaauagccagaaugucaggagaugauaaaaaaucacccaucauaccaagaaccaggaaaaucacaaccugaaugggaaaauacaauuagaugaugccaaugcugagaugaucaguguuaaaaugaugacacaagacuuuuaaagcugucaucaaaaaaauacuucaacaaugaacuauaaacuaucuugaaacaaauaaaaccaaaaucucagcugaaagagaaguuagaaaaaugaacaauauugaaacuguauaauuaaaaaauacuauaacagaaauaaaaacugacuagaugggcucaauaguaaaguggagaugacagaggacagaaucagugaaccugaagacauaucaacagaauuuacucaaucuaaacaguagagaaaaaauacaucucauuugucuuuuccguuuuuuuuaaauauuagcaacauccacacugauauuuaacuucuuuuuuaaucauuagaguaccaaaagggaagaggaaaguauggaugaaagaguauucaaauaauaauaauaauaauaauaauaauaauaauaauaauaauggcugaaaauuucuuaaauuuggugaaagaaauaaacucacagauugacgaaauccaaauaggauaaacaaacccaagcaaauccacaacaacacacaucauaauucaacuucuaagaccucaagacgaagaaaaaaccuuaaaagcagccaaagagaaaaggugcauuaccucuaggggaguaacaauucauaugauaguagauuucuuguccaaaaccaugguggccagaaaaaaugucccugacauuugucaaauacugaaagaaaagaacuaucaacugaauucuauauuugguaacaauauuccuaaaaaaugaaaggguaaauaaagacauuccuaaaugaaagaaaagagcauuuguacuagcaaaucuacccuuaauaaauggcuaaagaaaguucucuaaacagaaaagauacacagaaccaaguuugaaacuucaggaaaguaaaagaacaucagaauggcuaaaauugaugguugaagcaaaaauuauugcagcaucugaugugguacacaauguauauacagggaauacuuaagacaauuacauuuaaagagaggaaaggauaaagauacccaaauggcagucagguuucuacauucuacacgagguuuaacacucauucaaagugguaaaacacugauaguggcugugauauguuuuuuauguguauuaucauaccuagagauaccacuaagaaaaguauacaaauagauguacuaaaaaacaaaaaaaaaccccaaaaacaaaaaucacugaaaacaaaucaacacagaaccauuuuuuaaauguucaaauaacccacagacaauuaagaaaauagaaacagaagaaugaggagucagaaaaacaauaaaagacuuagcccaaacauaucaauaauuaccuuaaaaguaaauagucuuaacaaccaaauaaaagacagagauugucagaguggauaaaauaacaugauccaauaauaugcugucuauuagaaacugauuucacauacaacuucauauguagauugaaaauaaaaggauagaaaaagauauaccauacaaacaaauaaaaaaaggcagaaauggcuauauuaauaucagauaaaguaaacuuaagagcaaaguaaaauacuaaagacaaagaagaaugugacaugaucauaaaacaaucaauugacuaggaagguguaacaauccuaaaaguauaugcaccaaacaacagggccucaaaaauugauacagcugaaaugagaaacagauaaauccauaauuauagcaggggacuuaaauacccuacuuucaguaauagucagaacuacuagacagaaaaucagcaaggauauagaagaaauguacaucacaaucaaccaagauauaauugacauauauuuuaaaacucuacucaacagcagaauacacauuuuucaaguguucauggaacgaauguucaucaugauagagcauauucugugcuacagaacaaaauucuacaaauuugaaagaacuaaaaucacacagagcauguucucuagaucauaacaaaaucaaacuagaaaucaauaacacaaagacaacagaacaaucuccagauacuugaaaauuaaacauucauuucuaaauacugaaugguucaaagaugacaucucaaaaguuauauuuaaaaauccauagaauguaauaaauauaaaaauacaacacaucaaaauauguagcaugcagcuaaaguaaugcugagcggggaauuuacaguacuaaaugccuacauuagaaugaggaacuucuaaaguauuacaugcaaaaauucuccauaaaauauuagcaaauuaaaucuagcaauguacaaaaagaauuaugcaccaugauuuauuuaggauuuauuccuaggacacaagggcaacauaagggaucuuuguggucaugaaacucuucuguauccugacuguguuaaugucaauaugcucaugauuguguuguaagauauuagcacuggaggaaaaugggugaaggguacacaaucuccuuguguuuuuucuuacaacugcaugugacucuacaaugaucucaacaauuaaagcaccuguggaugcugacuauaauucaacucagccaucaauguuuaagcaauguuauguuauagaagacugacagugucgugguuguugauacucagggguaagacucuccaaaacuaggauuugagauuguugucugagauuucaacuuuauaaaccacgcgaaaugaacagaagaugaaauacacaaauuuucaaaaaaaaucacuaugaucacuaugauuguuagacauauaagacuagauuauaagcugacagaacccaccuauucaaagaaaggacauguggcucagaaggaugguugaagaaaccaugcuaacaaagaaacaaagaaagugcacagcauccaucccaacuacuuccaggggaaaagaagccuuagucaaaucuauuacuaauacccuguugguaaggcaucugcaccauggaggaagaaacacaaaauuguauucauuggacuucaauuauuccaguccugcucucuuuccuggagugcacaguagauaaaugaaaauauuuagaaauccacauuaaacuugcaucggaaaacugagaacaauagcugaaauuuaugguuguacacaggucugccuuugcuuuuuuccucuaagcccgccaagaucacaauccuauauucuuuccaaagccuuuuaguccuuuuccuguuuaaaugaauaaauugacauucugguuucacauguuugucguauuaguuuaguuuaugugaauccacucucaagaguuugguggcaaaacuagccuucugagcccaaggcccagccuaugggcugugagaaauucaccacugaaauggcaccaaccacaggugacccguuagaaguggggcgagcucucaagaugacggacauucuuucuguuuugugguccagugugaucuuucaaaccuacuagucauauuucugccaaaacuagcuaauuagacauggugcuuuguucuuugacuauauauauuaacacaaaugccucaugaugaguagaaauauacuauacaugagauuuuuauuuugacuagcaaaaaauuuugcauuuuuguuuacuuuaaagcacuacgaaaaauccaagauauuaaaauuauuacaauagacaaugaaauuauuuucuuccaauaccagauuuugauauagacuuuuauuaauaaauuuauauugaguuuuccaaaccacauccaucuuucucugucaggacucccaccuaguuuccuaaugcccagugcucaaguagccugucagguaaaaagcaacuaaauuagauggacuuaauagguuuguacuuaaagauaaaguaaaacuuacauggcuguaauggccaaagauuacaauuuacacagaugaaauacugccuaaagggucauuuguuauucauggacaaaaaauaauaauaauaaccuagggaaacuaaacccagaaaagaugguuuuaaaagaaaaugaagaggccgggcgcgguggcucacgccuguaaucccaacacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaaagaaaaugaagaaugacagaggauauaaucaguaaaauucaauagagauauuauuuuuaagucauugauaaauaaaaucuuuaucauaauauuuaugaggaaaauaauugauucugauuuaaauaauuucauuaagauaaauaugaaaaugggaagaaauuggaaacagauuaauagcacucuauggaaaauugauuaugggaaggaauuaaauuggcuuaaugauguucccucaggaacuucaugaaaauuaauucaugcugggccaguucugauuaaaauguuuauauucauaaguuggaagucaaaacauccuauguccugaugacaucacuguguuucuuggacucugcugucuuccauacugcaauucugccuucucacaauucucaccccagcccuuccauugcucuuucccccaguccuucacuucuguguuuuuccccaucucuuacccuuauacacagguacacagguauuccccaagguuccauuuucagcccaccucuguaaauccugucucccucccccucuuccucucccaauuucucugccucucuugaccacccccccgcccccaagcacuuuaaugcugaugacuuccaucuucacaucuugccugauccuuucuccugagugccaguucuaggcuuccaaugccugccugacucuuuccuauggacguuccacuguugcauuaaauuugaaccauucaaaacuggauuggcaucuuucucuauaaccuaccagacacagggguaugcuggagcuggcucaaaccagcuugugaacugacuguguccaucucuucccaccuccacauucaguggcacuguccugggggcagacugaaaugggcuuuggugagggcauuuacgccauggaaacuggcaaacacaacaaguagagcccuuuguucaccagagaaaaaagcacacccuugcuuauacgguaccaccauauccuuaaacagcaaagaaacuugaagccauuucaggcaccucacccaccuuacccuccacauuuaauuaauuaccaaguuauuuguauucuacuucugaaaugacucucacacagccacuuucuuuccagaaccaaugccacugccuuagcccaaggucaccugugugugccuacgcucuugcaacaguuuccuagcuggugucccugacugccgucuuuuauaacacaauccaucccucacacagccacaggauugucucacuuucaacacagccugcaacauaccauucugcuuuaaugucucaccauguucuaaagaacaaagccccaaaacaucucagcaacaguagaucauucuguguucccugaccacaaaaacaugcaccuauacacauccaucuuugcccugucccgaguucccucauccuccucucaaggcccacucagcugagaagccccuucccagcuccccucaguaagaaugaacuagucccuccucuaugccuacaugaccuuugucuuggugccauccuguucuucuggccucaugcuuuagugccucccacuugcucaacuuggucagcaacugacuucauuuccuuccauuuuuaaaacauacuuuugcccuuaaguggauucuauuuuccucucaaccauguauuuucuucauuuugcuucccuaacccaauugcaauuauccccaaaccauaagcaucuacagaguuaaggaugccuacucugucugucacaaucaugcaagaugaaaggauguuuaaccccaggcuggguguuccaaguggcugcaauuaaagcaaaucuuuuuuuucuccacuuugguugacucuaugauuaaaaaagaaaaugauuucauuaaagauaauuuaguugacauuucugcuuugguacaacuaggaguugagauggcuuucacugcccugaaauaauuuagcaugcaggaacaucaagaaacaaggagcaggagugccaucaacauagacgagaaacgagaaacacaaagggagccacaggggacaaauggcccaugguuaaguuugguuugucauaaaaggcaugggcagccacaacagcuuccggcuagaaggugcauuggcaaccuuccuccugccuuucccuuuauaaguuucaccucccucuaccucucuuugcuccccacuucuuaagcaacugaagagacaucuucuucaucaugugccaaaauuuagcaaugugccacugcaaagaaagagaaccacaggcuccaggguccuaagugagaugagaugaaaaagcagcaagagggaguguggcugcagaaagagcacagcaggcucuggagucgggcggaacaaacugacuucugccccacacuccugcuguccucauaagauccaagaagaagcaauggagugugggagcaguuuucuggcuucuuucucuccauugcuuggguauaagggagaggagaagauggaggugcacugccccagcacauauuccgccucucuuguuaaugacuccccaugggugucaggccacagcaucacuccauuucuacccucagaggugacacacaacuucauguucucuuugggugacuagugaccucaguucacuuugaacaaaacguacucacugguaugaagauccauguuuggacaacuccucucacauaugggauggaguaaacuccuuugucuaugaagacagauuauuucuuauuaauggaaaguuauuaaccugaaaaucugcaccauaucuaccagaucauuuagacacaaauuuuauuuuauuuucauuuauuuauuuauuuauuuauuuuuugagacagaguuucacucuuguugcccaggcuggagugcaauggcacaaucucagcucacugcaaccuccgccucccaggcucaaaagauucuccugccucagccucccuaguagcuuggauuacaggugccugccaccccacccagguuuuguuguuguuguuguuguuguuguuuuaguagagaugggguuucaccauguuggccagacuggucucuaccuccugaccucaggugauccacccgccuuggccuccugaagugcugggauuacaggugugagccacuaugccuggccaaaucuagauacaaauuuuaaaauuaacaccuaccaauacaaauaauuuuuaguauuucuaagucugaauauccauuuaguaucuuuuauaauuagaacuuaugaaauuuuacacagaauuaucagaaaagugucccacauuuguauaauguucuccucuugcaggcauucucugucucagucucauagcaguucucugugcugcucuccgaaugcugcaggagaagaaacaacauaucgcauaauagcagacgaauggugaucugcucugugagagguaaagacauuuucugauaagggauaaaggaagaaaauggcaaaaagcacagacgcaaaaagaugugcucucuaguuuuucuuuagggcauuuacucgauagcuaacaacagacugggguuguccguguaccguccugaagggagagguguccccaucuucuccaccugugacccagagacguuccuucucuuuccagaucaucauccugacccucuccccugaccauccuuucuccccuucugcuuucaaacaaucacagaucuucuacagcuugaaacagccacugauuagugcugcugcuuuucuagaaaacaucucccucccucaccucccguuuccuuucuucauuacuaaguuugguuuagaaucaauaucucuauuucaucaucacccacccacacacuuugacuuccuucaugagcuggcucaaauucuuuauuaaacuauuuuuauugcuugcauaaaagucaacgacaagcuucccuucaccacagaaacgagccuuccucauagccucuccaggcaugggacaguuuccccugccccacuccuuccggacaugcuccccuuccugcacguccaagccucuaacccuccuucuccucccuuuccuauuggggucuaccguugccccuagugacgcaggggcuuugacguggaguucuuagccuccugcucuuucuucucuaugucuccuuccugaagagccugaaccacugugcggaugaagacaugggggaggcgugucucacgcaccuuugcucuaccucccgggcuuccucagcacucacugcuugagauccucaaccgucaaccuggcuucuccaugcucacaaggcuugcacucccuaaguuuccuaagugucuacgucuauaauacgagcauugaaauaucuuuccugccugauccagagggugguuggaauaauggaaugguuuuuaaaucuucauaaacaccuacaguauuggcauaucaauuauccuaccaacccccugacucuaaauaacucuuuuuauuaagccacaagaucuaaauccucuccaauuuguucucccuucaccucggugggauggugaaucuccagguccuaggguuuuccucugaugugucucacaagcccauucuugcccguccaguuccucuuuccucacucuuucugcccaggucuccguccgccaggacuugcugccugcaauaguugccuaauucacacauuuccaauuuucccucuuugauccauucugcuacccccagaauaaucuuccuaaaccuuaauuucuaccacaucucaucccauucccuaaaaugauuauaguucccacuauggccaggaaaauauccaaacucuucuggcugacucucaaauucucuacaauauaaccuuuucucuccagccaaaauuauuuccaagucauuccaaagccacaacccacaacccacuacuccuaaauguaaaugucauaacucccuuugcagcuccaugugugugccugugucuacguuuuaaauuuauuuugcauaauucacacugugcaguccacuguugacugagcauguaguuuugauccacuuuguauugaaaacucuaagcaggguaauaugaucauaaaauauaauuugaagggcauuuugguuuaaauaaugacucaccaucgagcccuccauuggggagucaggcccagagccaaaccaaaaaaaaugagcgacaagagucaaugcauuaguuagaggcuucagcucaguaugacugaucuggaaacauauccugaugccugguuaagaaagcuuuauggcagaaaaaaaagaaaaauuugaacugauguccucugucuaaaucaugaauaggaaagcaaaaaagcuugaugugucuguuuuaaaaauaaaagaaggcuaaauccauuaacaggugaaacaacugacaacggacccacaucaagccagaguccuucucagcaucacagaaaucuccuuaccuagggccagcugaccaucugccagauggcuagugguucuaagaaauccaccagggaccaaaagcaggggacuauaagauuaggcaucacacaaauguauuccaaauccuggagcuggggucacugauagucuacuacagaaaucaaaagaggugccucagaagacacaggcuggcuucacagucauccaugugucuacccugagaucucagaggucacaggaagacccaaagaucuauccagcagaaacauuuggacagaagcaaguccaagagaauucuuuauauucacagcugcuacaguuggucaacucuugauucaggcagguuucaagcaaguccuucuucccucccuggucugcacaggggugauuuuagggaaucauaagggaagaaggggacguuuagaaaaagacaaagagugacaccacacacagaguuucauggaauguccauauugcuugccuuuucaucacagauaguauuuuaccucauuaguucauucauuugacacacaguuauugggccuuuaugguaugcuaggcauuuuuaggugccaaggauauagcaauaaacaagacagacacagcccuuaguuuguuaaggaagcaggcaauaagucagcaaaugaauaagauaauugcagacagugcuaagugauaugaagaaucuguaagucuacaaagaauggagagugacuguagaguggucgggaacuuuaagcauggucaaggaaggaacaggaaggaggcaaagauaugcccccaacuccucgcucaacucccagagaugagaggugccucuuggcuccagcucugcagccacuucugcucaaaagguacgcugcguugcuuucuuuauuccuuuguuaaaccuggcaccagcaaaacaggcaccucaacaccuauaaaugguuaggaauagaugggcaugcaagcuuuucuccucuacugauuuuacugggcauaauaguaggcuuuuugauauacuugaucugaucagaaauaaacccgaaaacaacacaugauaccuguaauuguuuucccugguuuaccuugugucauuucuaaggcuuagauucccaugacccccagcuguucuccacugagugcucacuguagagaaaguugcucuucuuuuucuuccuguucucuagacgcacuuaccucucuaacucuggucuacgccuccuuaucaaggcacagaugcagcuaaaaagcauuccaccugcucccuagcaaaggacuucuuuguuaagcuuugacauaaggagggaaaacagagaccucaggacuucuacuguguugacauuguuuuaagcaaggugggaaaagagaacagauaagcaagucguucuacuggcuccacuuucccaccaccuaagucaauucagaguauuucccgaacauuuuuuacccauagauucagauuaccccuaagacagaugguuaugguuuauuccguuuugugcacacagggguaaaagucacuuaaaauuggacucaaauuacuucaaaguuugauaccugccaaucaccauuucaucuuggguauacaaaaccauacugcauaagcuccaauugccugauucuaauuuucaauguuuuccccuuuuuagguaaauaccaucuucaguuuuuuuuuccuuuuuuuuuuaaugagcaguuuaauggaaaauaauugcuccagguacaggucuucuaggcacauuuugucucugcagcuauuguuuuaauuagugggccugcuuguucgcugucccuuuguuguggcccgcucuggggcaggggugcccggggaggguuccucuuguggaacgcaggcguuaaugagccauuucaguaauaagaguccugccuugagccagaagucagagcacccaagacaccccaagcagcagaaaugcucaugaauuucugaaacugccuuucuaauuugcauuuaaacauaacuuccaaagaacaauuucaccugugauuuucugagcuggaaagguaagggacuuuagauguugaauauguacaaauuauguuaauauaacggagguaaaugaaagucaaaugcauugucauguaaaauguagacgucuuuucuaaaugucuauuuucuaccaaggcuuguuuuauuuucccccuaagugaaaugugauaauuuuuuuuaauuaagugaaucucuauaauaauuccuauuugauugaaacugauuauuccucauuuuccuguaaccuagacuucggaaaccucagcaagaggaggcuuaguuggugccuggugacuuccuacaauggauugaaaccaaucuaauuuaacaccugugugcucaucaauaaguguacucaagcacaaaagugagcacaguguugagcgauucugacacugacugcaugacaaccacagacucuguauccaaacacucgcagacaagaagcuaauugcagugaugaaaggcacaccacuaaaagcaugaguaaucgcugcagugaugcacagauaacccucucuccuuuacuaccagggugcugcggcauuuaucucaaaccugucucuacccaaucugacaaccuuuugucucucugaccaauggaaaauggaaaugauuuuucacuacuguucccgcagcagugaagggucucuucugaguguggagauuuaguucaacaguugaguauaaaacaaaugcaaaagcugacauuugucauccauggcagaaauaaaaggcuaauuaaugagaucuguuggagucccuucucccagugcacccacuggugcccauggagaaugcacacugccuucccaaauugugacacgugugacaaacucuaccagagugaaugauggucugggaaagguauggcagugcagcuccguggcauggugaaaggaagaaaacaucaucagguuucaauucaaggcagugguaguuaauaauggacuuccugaaaccuguagcucaaucacuaagggaauauuaagauuuuccacuugaaauaaccaggauuaugugggccauccuagaagccugcugaacuggaaugcauucauacccugguaaucauauuaacuuacuguuaggccaaggucaacuugauuuuguguuucaccaaagcucacugggucuuuucucuugacagccauugggcaagugagggauacacgguugacuugaagcuggaauccacccagacccaaugaaucacugaccucucauuuuuaacccuaaugaauugggguagaauuagauauuuugaauuaucauacaaagcagaguaaacccaacaaucuaucaaaauuaucuaacuaucuagacugaacaauuuuacuuggaaaggauauaccugcuuaugaaauacuaaugaugacagcaagaaagucugauuucaaaucuaugggugccaacauucuauguauggucauggaaauacauauguaaacuugauacacugacaagucauuuccuaugacauuuugccaaucaaaauaaaguaaaaugaagaaaauuguuuagaaaaucuggaucuuguuuccuuaagguguauguaggaggaagcaguaggaggcaggaggcauuuucauuuuuauuuuacugcaccaguguuuggagcucagcagcugagauggggugaguaacacaugagcuuugaugagcaauuguggacacagcccuuuuugccaacaucucacucauuaccuuuucccuccacuuuuuuuuuuuuuuuuuuuugccaaaccacccuacuagauuauaacagucugcaucaagaaacauuucauuuaauucuggaaaggcacagccauggaaauagaagauuaaaaugaaaaaaaaaaaaaagaaaaaagaaaaagagaaaacccacacaaaaaaaaugaaacuaagagauucugaaagcagcauuuccuaauuaagaaggcccaagaaggugacagauguacccagguccccacaaccagccaguggcagaaccaccagaagagcucauuuuccuagugccugcccagguuuuuucuacaaugcucacagcauugcaaggaggaguuaacgccaauucuuauucaaaauuaaauucuauuagauauuaaggauuucuggugggaauacuucagaaaugaaaaaguauuuucaauuuaaauuaaauuaaauuuccaauuaagucacagagaacuguacuucaacaggaaucucuuuuacucuaccccuuuacaaaagaaauauuucacuuuuuuucuuucuggucaucaauuaagaguuuuauguaaaaugugucacuuucaucucugauuaaaacgcauccuauuuuagguuuugagauuagaagcugaggcccaaggacucaaugaaauuguauggcaucguucccgcagauauacauacauaugcuccuaggaaaaagguucguagcauuuaucagauuuucaacuggaucuauaacucuuccaaaagauuaauaaguucuguuccagauagagcugagguuuuggcaaagguaaggaauccuuacuaaagaaucuuguuucucucaauagccccuaaaucucuucaacucacauaauugcuuuuaaauucacaaaggaaauccacaaggccuacaaggaaaagcaaauuccagcccccacuaaaacgggaauggacagcaacugauuaauucugcaguaaugaaaauuuaauauaaaaccuuuaauuucauuucagguagccugaacuucagauuggacauuuucaguagaaaacccauuucuuuuuguuccuguuuuuuuuuuuuuuuccuaaaaaaggcuuauauuuacuugauuugaauuuugcuagcaugcuuuuucuucugaauucaagugacuagaacugaaauuauuccaccuggggagaagagacagcugaaagccaauuuaguauugguuuucaaauacaugaaggguacucagagagaggaugauugccaaagaaaauggucuuugaaccauagaaagaaucugagcuugcucuaaaguuaaauuuccugacuuacagaguuuaugacauuaaacugagagaccaagggauccuuuuuggagacuucaaaaauaggauagauccuuaaaugccugagauggcuuggauguggcuuugucugaagucaggaggauaaaucuuaccacugauggucccuucaggcgugugaaucuauggguuugacuggcaugucagaagcuagaaugccagcccaggacaucuagagagucaucucuccaaugcuggguagcagucuaucaaucgcucucacugccucaacaucucucagcucgccuccaccaccauagggaacccaaggccugcuccugucugaggcugauuuccaacguggcagagaacucugcucccucacuguaccacagccuccaccaaucccucggagagccuaaguuuuugagaaaaacaaaaagaagucucaucugugguaguagaaauugugugaaugccaauuuuuuuuaaaaaucaguauuuaacuuuguagcacuccuuuuuccuucuugaggaaagcuaauagcccagcucugcuuccaaaacaaacgucucuaagauuggaccagucuuugcuuuucuuuuugcuggacaaccuugucccaacuuagaaauggaggagauauccauagccuuagaccuucagauugggcucaagagccuuuguguggacccaaaaggggaacccuaggggacacacaaggagcuggaaguucaacucccccuucaucucaccuguuguggccuuacaggcuuagaagugcagaguucuucagggauccuggaaaaccucuggucaaaccucaucugcaaugcaugccccuuagucaaagcucccaguauuugcccagcuccugcuggagcuccuccagaaagaacuccauacucacaaucagcccaucccaacacuguccugcucuaaggaggagaagagcucagcugaaaccugccucuuccucuuguccuuacauguccacuccacacuagucuguaaaacuccugaagaucuaaaugcagagaacguucaccugggcaguaaaguucaaagagagcuguaccaucugcugccucugagguucaggaggagaauuccuauuagguuaaugccauuuccccuuuuaaaaugaaacaaaaucaucugaaaagcaugucugaacaugcuuuauaaguuaagacugcucacagaacucugacucccaggaacuacaaaucuaaauaggauaaacauguuuauaugugagugccuguuguaaagcuaaaaacccagcagauaccaaaagaugcuaauaagcucaauauggaaaaauuacuuagaaaagguuuauguuauggucuuaacauugccaaugccuaaauuauuuauuggucaauaaaaaaacccaaugcaucaauaagaguaauauuaaaguggaaguuauuagcaacuucuaagacaggcccagcagcugacaugacaaauacaaaagcuggacaccaucgggauaacgggaacaucauucuccccccagacaaacccaaggugccacgugugugcauggcauggcagggaagagaugaacaaccacuauaaucucacuaucuguguccccacaaaauucucauguugaauaucauaacccccaaggugaugauaucaagaagaggggccuuuggaaggugacuagaucauaagggcagagccaguugagaauggugcccuuauaaaagagaccccagagaacugccuuacccucccaccacgugaggauacagcaauaagauguuaucuaugcgggcaggcccucaccagauaacgaaucugccaccaccuugaucuuggacuucucugccucuagaaugagagaaauaaauguuuauuguuuacacaucacacauacucaguguaugguauuuuuguuacagcagcccacauaaacuaagacagcaacuaacaggaucaaaggcaggugguggaaggacugacuacaugggcucuucaacugaagagaucaacgcaaugaucucuucaauagaauagucuguugaagaucuggaaguauauaaauagggcauauuguauuaauagauauauuugcuugccucccuaguauccucaaaagaugaggaccgggacuaaguuguucuuguaucgugcaaagacccugcaguguguuauauacaguguggguuuacagcaaagauuuauacugaacuccacugcuuuuuuucccaagggaaaaaucagugccuaagaacuagcucaucuuagugagaggcagccugugagaugggcucuugaagaaaagggguaagaaggcugauccaaagcucagaacagcuauggcucugaggcugagaauauuuagauucaaggagaagucucauaaaccaugagaaaggacuauucagauuccaugaaaaggagaauaaacagcuccccaucuuuagaaauuuuuuuaaauucuuuaucucuuuuuuuuuuuuaaguuagaaacaggcaggcuggagugcagugguauaaucacaguucacugcaaccuugaaauccuggugucaagugauccuccuguuucagccuucugaguugcugggauuacagacaugcaccaccacgaccagcuaauuuuuaaauuuuaacuuuuguagagauggggucucuuuauguuggccaggcugucucaaacuccuggccucaagcaauucccccucuugggccucccaaagcacugggauuauaggcaugagccacugcacccggccuauucuguucuuuaccuuuuauuuuuaaaaaaucauucccuaguucuacuaucucuauauucaaaauccucuuucccacuauaaauccacuaucugaacuccaaauaucaccaagaaccagaauuccauaaaguacaggcaauguagauacgcaaacauggcucugagaaucuuacugccuguauuucucacucucuaugguuuucagcuacaccccucuugccauaauugugugcccuuaauuaaaucuaaguuuccagccauuuuuuuuaaugugaaaacucauaacaauguccuuggguuuauagcaccacuauugucauagcauguuauucaaccucagcuagugcuugacuuaacagaaaauucugaguuucauauucauuguaguaacaucaguuguggaaacaaauauugugcuauuugccuuuccccugcuguuccucgaucucuuuucagccucaaaggcugucugguacacuugguucuugugccaggauggaagacacaagaugaguccucagagacguggugucaaggaguccauguuuucuuuccucuaagugcagacagaaugacucucuggaaggagcauacaugagcuggcaguuagagacagcacagcucagaaacaacugugcuggagggacaugaagaaaggcaaugauuucucuuucccaauauguggcaauuuucagaugucaaaggaauaacagacagauauacccuaugaaaggauuugauuuguggcaacugcuuuucuuuuccugauuccauuaaugccagguuucuuggccuuaagcagagagccagguauuuucuuuuuauuuagugcucccugggcaguuauuaucuguaucaauuuuccuuuauccagguuaauucucuuaaaaauacaugccuuucagucacuguauuguauuuaaccaaaauaucuguugguacaacaugcucuuguaguucaucuaaggcaccuuuaagucacagaguuauuuuuaaaguauaugaguuacuucugauuauaaaaguaauucagguucacuguaacaauuggaaaagagcaaaaagaaaugaauagcucauaaugccaccaaucaagauaagcucuaguaacagacugcauauuuauaaaauugggaucauccucuauauauuguuuuuauauacuuguuuuucaguuaacauaugaaaauuuucuuaugacauuaacuccucuucagaacuaugugguuuuuuguuuuguuuuguuugagacggaguuucacucuuguugcccaggcuggagugcaauggcgugaucucggcucacugcugcaaccuccaccucccagguucaagcgauucuccugccucagccucccaaguagcugggauuacaggcaugcaccaccaugcccggcuaauuuuguauuuuuaguagagauaggguuucuccauguuggggaggcuggucuugaacucccaaccucaggugauccgcccaccucagccucccaaagugcugggauuacaggcaugagccaccgugcccggcccaaaaucauguuuuaauaucacauuagggcauagagauuuuuuccaauuccuugaaguguuuaaugaaacuaugauacauauucaugcacccaaucuuuuaauugucuucacucauauuccaaauugcucuucauaaaguuaacaacuauuuaaacuucuagaaggauacuagaaguuuagauuagaaucuugguucccaauccuucacuuuuucaagugaaggauuucaaguuuugccaguuugcuagauaacacauuaugacaaugauauuuuuauuugcaugucuucauauucauuuuccuacauguuuuugaauaucuggaaucuucuuuugugaauugucugcucaggaccuuucccuauuguuuuuagagcacuggggcuuuuucuaauugauauauaagaguacuucauaucuuaaggauauuaacaaacugucugcaauguuuucccaauuugucaucugccuuugaauuugagaucauguuuuuaaaaaugcaaacaaauaggaacuuaguauuucucacaugagcuucaaaaugccacuuacaauaaucagaugcauguuauguucuuguccauggacuguuaacuacuagagucuuuuuuaaaaaagagagcccugaauugucaacugugggaagacaaaagaagccaguaccuucuguugcuuuuuugccauucauagugccaggaccuggcaaugccucaaagcugcuauuccugcacagggcucuuccucagccuggagaagacacacacaagcaagcgaaggugggugggaccaaacuaccaccuucuggaauucaguuuggccuuccaaggugacugauaugguuuggcuguguccccacccaaaucucauguuguagauuccauaauuuccauguguugugggacagaccaggugggagaugacugaauuaugggggcaggucuuucccgugccguucucgugauagugcaugggucucacgagaucugaugguuuuaaaaaugggagauucccugcacaagcucucucuuugccugcugccauccacguaagaugugacuugcuccuucuugccuugccuuccgccaugauugugaggccuccccagccaugcggaccuguaagucuauuaaaccucuucguuuuuggaaauugcccagucuuggguaugucuuuaucaguaccaugaaaacaaacuaauacagugaccaaaccaaaagaacauaaacauaacagaaaaaugcaauccagcuuaggagcuuaggcaaccacagacacuaaguuaccugaauuuccaaguuucauucuggcaugcucacuacuggaaacauuccuuaugacucucgaggucucaguuuccaacuccccucaugcuauggacccaggauacugaaucgacuagacauuuguagaaaacuuuaaauguggaguuuuuaacucauaaugaaacuaaaaaccaggcaaucaagaaaggaauuaugauuuaaaaaaauacagaaaaucagaacagaaaaaaauuccaaauuaaagaugggaaaguucaacaguggaggaaacagaacauuaugcuuuaugacuuagguucgcucaccuauaaugacccagguaauugccauauauggguaaccccugaggaacaggauguaaucuuagucacaauuuguaaguacucauucauacuucaaguacauaaucaggcauacagaguauaauccauacauaguuuaauaaagacaaaagucucagccccuuaaagaacuauccaggugucuguggcugauuggaacucaagcguaagagauuagaaauguauuaaaugaaaucuaacuucugcuuaaucagaagagccugguacaaguaugugauuaauucaaaguuuuccuugaagaggauggucucgucaagucaucagcuaccagcuauccaauggcagagguggcagagcugacugaagccuauucuucaucuagcccauuugcuccauccugcuuugaaugguuuacaacauuccaauccuucagguaaaggcuguuccccaauagaucuugauccuaucucuguuuuuuuuuguuaauccaagaugauucaauucuuuuucugugugcacuacuucugaauuauuugucaaugucuuugugauuacuauuauaauuauuguuauuaauauagccuggaauaauaucaaauacuugacaacaucucugcuaaccaggcagcgacuugaccuucaagggucugcuguuguuugccaucugaggggagaaccucaagggcaacaggaccagucuccuuuuaucuacugacuucagaaaggcuggaaggcaaaaaacauaaugaucugggcaaucuaggugagaaaaauucacuuuucccugaauucucuguguaaagaggcuuuaauggacugaguuacucagguaauuguucugcauuggucugaguuuaaucaaaagaagaaagaggauaaugcugucagggaagcaguuuucagaagguuuagaguuuugcaauuguacuacagagcuccgaaaagugccagcagagcagaaaaauuaauguaaauaacauuaguuuuaauuucauucauuuuggaaaaaaaaagcaacuucaaaaagguuuuuauaaaacucugguuuucaagcaugagaaagaaaagcuauuuuacauaaaacaaaaaauaaaauaaaaaagcucuuuuaaaaaaacaaaaagaucuuuuacauaaaaugaaacaaaauauagaaggguuuugcccccagauuguaagaauaagcuuuguuuuugcauuuguuuuagucuuuuauuuuuuaauuucacaacauaguguaaauuaaaauuuaaaaugugaaacuucaaguguuaaggcaauuguggcuagagcugaacauaauauggacagugaagaaauacacaauguauccaagauugauauguagguaucaauugcuuccagugaaacaguucauugacuucucuacaggaaaggaaucuaugagcuucuaaauccaguccugaguagaaaauuauaacagugaaagagaucacuuucacucagcuuccauuuccaguuuuaugcgaaguccuuacuuuaguaugcuaggaaacauauugagaggaaauaaauauaguccccuucuguggcagccuggaccaaguauuaagguugcuuaagaacuaaccugaaagaucaucuaaauguguuuuugcuuuguuuggguaaccuauaggaucaaaaacaugcuacagcucuaagaacguaaaaauaauggaauagaaauggaaagaugcauauuaaaaaucuacaaaucuaaagacaaaauaguguauuaauaccaucuguuccaguucuauaugguccaagucugcccaccccaccaaccccccaaccccaucacaaggaucuaguuaauucacaggaacugcuugcugccugaaauucuugccagaacacuuaacagcccccucauuuguugggugguuuuauaggucucuggugcugagcugagguaggacagcuugcagugugugaggaggacagauaaaaccacccugcuguguagauuuaguccauuugcacuggcucucagacagaaaacaaauugcaaccucucacaaagcagccccguucugcacuagcaagccugaaaaaugcaggcaaaaaugaguaaaucaggcaacuucacaucaggaggaaaaaaaauggcuaccacucuaacagcugcucucguaauuaagaacagauuucaucacuaaacucuuccugguuaugucugcagcaaaacaaauacacagaugugaggcauuugcauacuggaaauuguguacuggauaaccaaaccaaauuuacuuuuucugcuuuaaaauauucccuuaaaaauauccagucaauaauaaaguauaaggcaauguccaaaccuaaguacaacuauauuucugucaucaucuugcaacuaaauuuauuuuggcauucuaccaaauucacuuucuuuuuacauauucgaaauugcaauggacugccaugaacaugaccuccuuugaauaaugaaaaugugcuacccauuucuuuuacucauaaaauuugcuaaauuuauugcugccucauuuaucuauguuuuaaaaggcugcauggcacaugcaguaaaaggaaucgcauuugaccuuuuuaaagguaaauugguguggaguuagaucagagaaauaaaacuaaugaaaugauaaaauuacagcaaaaagugagagguaaggauaaauuaauggaaccaccccacuaccaugagaaagaacaauuuaaaauucacacaacaacauggaugaaccccacaaacaaaaugcuaagcaaaaaggccaauaauauacagcacaaaaaugagcaaaaguaauuguaucauuagaagucaggauaguggccacccuuggguggguagggccaucacaaggagggggcacaggagagcuucuucaggucuggucauacuccauuucuucaccugagugaugguuauacaggugugugcaguuuguaaaaauucuucaaguuguauacuuaggauuacuuuucuauauagaaauuguacuuucauaagaagaaaaaaaauaaaaaggugggccaggcgcaguggcucacgccuguaaucccagcacuuugggaggccgaggugggcggaucacgaggucaggagaccgagaccauccuggcuaacauggugaaaccccgucucugcuaaaaauacaaaaaaauuagucaggcgugguggugggugccuauagucccagcuauucaggaugcugaagcaggagaauggugugaacccaggaggcggagcuugccgugagcuggggucaugacacugcacuccagccugggcgacagagcgagacuucaucucaaauaauaauaauaauaauaauaauaauaauaauaauaauaauaauaauaauguaggacaugcacuguguuuucugauuuucagugucaaccauagcguuuacucaccacuuuuagccacaaccucuucaagcggcaaaauccauccugcguuuacacaccuuuaugacacuguaauagcaguguccuuauuagccauuuuuaucaagucauaaguuucacuuuuuaaaugaauaaacuggccaaaugcugaagcuuaaguagcacaauguucuaacagagucccuuauuuaguacuuuaaacugauuuuccuccccaaaggugcaaaugcuacauaauuuucuauugugaacuguauuauuaguacuauauuuaaagcaaagaagcuguuuuaaaccuguaauuuucagucaaaugugguucuaagugcauuuuaaaaaugacuuauuauacuguuuuaccuaaagaacaauaauucauacagaaauccauagauguaaauaagcugauacaaaaguagaaaaggaagaucaugccuauucaagaugaccuaguauguucuaagacccugaauuaaaaugacauuucaguaggguugacugggaguuuaaauaguagagcuuuucauucagaauuguacuuuuccaaguugaaauuaugcuguggaguaacuaggaaggcauuagagggccuagagaaguaaacuuaggaaacaaguggugguuguuaaugaugaggguggugauaaaacaugcagggugcucuacaggcucuuucauccuaguuaggucuuuggugaacgaaaaggccgaucguuacaaacguaaucacacacacuuugcucuaaguggcuucccagcugcacuucucaauuggugaccaucaaugcaugaaccaggggucaaaggcauaaagagacuuucuuuccccuaaaaggagggucucucugaccucacccuuuggguuuguucaucuauuucaauauuguugcaaaggcugaagucauuaguguuuaaaccauuaaaccuaaaagacagggguacggagaacuuuauccacauucuuuccauucaucaaucugggguccucauuuauaagcgaaagucauagacgauguguaccuagcacaaugaagcacuccacagaugaguguucagcucucaacugcaaugacugcagaaaucagacccuauacucugggcuggugcauuaagcuaacguuaguuuagauccauccacagacccuccuguaaugccagucugagaucuagcugggggccaagggcagugccacagcucauuuaauuguauuuauucucaacuuuagcugaaauaagcaaugcuaccuggacuuccccuuaugccuggcugggggcauuuguuuucaagcacuuuuucuguagccacaauuugaaaaaacuaggucugcauccuuaaugaaauuauaagauuuaagauucccauucauucuuacaguguguacacucuccuaccuaucaucugcuaccccaaaggaagguucaccugugagccuacucuuccaaugcccauguuuuaaaaauguauucuaugcuguuuaagaaguuaauguccaggcagaacucugacagaauguaagaaauaaaguguauuauuuucucaaucuccagccucagauaaugcuugcuuauaaaacacuaugaaccuguuaugaaaaagaacugcucugugauuuuuaaagcuuuuuuauuuaauucaacauuaauuuaugaagcaccugcauguuaagcacuguacucagugccaaggauauaaagaugaauaagagagcaugccagcccuccaggagcacgcagaacaauaaaagaggcagcuaugugagccgacugaaaauauaauaugauggauggaugaauggaugggaggaaggaaagaaggaacaaagggaugaaggaugauagauagaugguagacaacagagaagccagggagugaaggcagggggagaagugcuaugaaggaacauagaaagcaacucauuccaugaggaguagaaaagccuucuuggaggcaaugauaaagaagauuuagugccagcuugacuucaucaggcagggugaguagaugcauauuucugguauggagaaauucacgcuaaaagcauggaggccugcaaagugcacagcauguuagggggacaacagucaagcucugaguagcuaaaguauaguguaccuggcacagcauccugagguuaaagcuggaggggugaggugauguaaaggguccuguaugccggacccacaacuccagcuuuuucucuucuagguuaguguuuucuagcauaaguuucccagaauacuaauucuauggguugcuuugcaaaagcaaaaacaaaaaaccauuuuguggccaaguacauuugggaaaugcugccuccuacaaucuccuuucagagauuaguaacauauauuuggucucgagggggcugauaagcguggcaggaaagaaaucaguuuaacuuggacaccauuuuugcagaacuccugacaucccucggcacuggguucuguagaacacaugggggacacugaacacugcccuaggaaagagaggacaaaaggagcuauuggagcaugaauguaacaugaucugauuuauuuuuuccuuuuccuuacuacagaaaaauauuuauuuggcagucuaugucugguaaugauauggagguugaacuaaguuuggaagagauuaauggcaagaagccagguggugauuaaaugcagaagugagagagcccacucaagagacuuucuaggauaaaauuaaaaggaauucacaacggauuagauauggaaugaugggagcaaaccaaagaguaacuucaaagguucuagcuuaggagccagguggaagacucuccuuuaacuaacagaauuacagaggagaagccugcucuacagaaaagguaguauggucagugcuggucauuuuaaguauggaauguugcaaaaauauccacauaggcaaaucaagauagcaguuagaaauauggcuccucagcuuacaaggaaggucaggacaagagauacacacuguaaucacagagcccacagaagaagucaucugaauaaaguccuuccaggaaaacacacaggacaaaagaauccagaauccaggauacccacauuucaacauauaaaauacaaaguuaauccaucagcuuuauggacauacaacauccauuaacacugcaguccuagaucuguguuuaccuuauccagaacagaauacagggcugagcccgacaaugguuuauauuuuuaauauuugucaucaguauauaguauaaaggaaucaaaauauguuuggaauagaauaggaucuaauuaaauacaccugaaggccagagcaauuaagagaauugaccaaagccuuauagcuagucucauuugcaacuaguucaacaaugauuuuuuuaaaaaaagaaagcgugaaucaugggcucagguuugaaaaggacccugagagguccaucugugaauuuucaucaaaauuguauuuuuaauucuaugaaaaaagguugaaaauuaauucaaaauaugauauucucuuucauuuuacuuguuucuaaggcauuugaggaugcaaauaaaaucagauaauucacuugaaaguaagaucauuaucagguauuagaaaagcauuuugcugcuuucccacguuaucuuuuuauuuuuaauugcuaugauagaagagugcuaacaauauuagcuguuuuuuauugauguaauugaguuguguuucaucagaauaucaugggaauuagccuguauucuuguaaggguggucaagaaaagcuguauucuagaucaacaaugaucuuaucagcucacgcagccacucaacagacauuaucaagggccuuacaugagugaggcacaguccuuacucacagaggagacauccaggaaaaggaugaggaaguagcccacucacaacugaguucgaggagguuuccguuggccacuacuuaauugaauauaaugcauucagugaccaguaugaaguccuuaaacacuucaguauacauacuuacaauccugcauuaaauguaacaggauuuacaagucucuuuugugaggaauaaaaccaaaaacccaagaauuaugaaguuuuuuugcacaacaaugugaacagagugaacacgaucuaauuguucacuuuaaauaguuaagaugguaaauuuuaugcuguguguacacauagcauaaaauuuaacaucuuaaucauuuucauacaacuaaaaauuuuuuauauuaugaaauuaaaauaucuuuaaauaacugacguuuguccauaaauuguuuguucuacauccugcaaggauugggagcuugucaauuuuuuugagcugaggaagaaagaggugaaacuggaucuuuaggaggauucaccagauaaugcuacucaggguuuaugaaagagaaauugaaucaguggacacucagaaguuaggaaagccagcaugaaagugaaauauuuaaauaggaagguagcaguaaaauuuggaagaauaugagagaccuucgagaagagcaaucaacaagguguggauaugguauggauacggaaaaagaauccaagacgauuccaggaugucggauuucagcaagaacaugguauuuauuguuacugucaaccugaguugaaaccaagaaaaugaaaaugcccagggcgcagcuggaaaaaggagaccacaguuuagaugcugaaccaccauggaccccaaagauaccaaucugugguguguaccagaaccacaggcucaaaugaggccccgcugcauccaaccuucacgaaccuuuaucuuuacccguggaaccaucauguucucccaaagauaccaugcugcucaccugccccuacccagucuucaccugagguuuacccaagcagggagaagggauuaacagagaaagguaaaaauaauuucacuucaaauuugaugagacuaaagaaauuucuggagggccagaucucuucugaaaauuucccuggcucuagggagacagaagagucaagccuuucacacacuuaacgcucuucaagauucugacaacuguugaucuucuugccauguuugggucuuagcacugcaggaaacucagaaacucucuuguaaucugcgcagaaggucauuugguguaucccgauccaucucugccguguuccucucgauaaaacagcagauuaaauuaauccuugcuguucaacauucacaagacuugcaagugucuccucucuguugccagacuuagagggaaaaaagcugagucagaaugucaugauuugaaguuggagaaucuuauugugauguauaaggagaugaagaaaaagaaaacuguuuuuaacuaaaaccuucagaaccuuaucacaaaaugggccgggcgcaggggcucaugccuguaaucucagcacuuugggaggcaaaggcgggcggauaauuugaggucaggaguucgagagcagccuggccaacauggugaaaccccgugucuacuaaaaauacaaaaauuagccaggcgugguggcgcauaccuguaacccucgcuacucaggaggcugaggcaggagaauugcuugaaccugggagguggagguugcagggagccgagauugcgacacugcacuacagccugggcaacagagcaagauuuugucucaaaaacaaaaacaaaaacaaaaaaacccaaaaaaccuuaucauaaaaagucagucuugacagauuaaauggaacuuuuccacuuacaagaagcauagccaauuucaaagauuaaaaaaaaaaggaacuuggaaaagugaauuuauuuucacuagaauguauacauuuagaguaucuucccuaucucuguccuuuaaauuuaagcuuaaacauuuauuuuuuauuaaaaaguaggcauccuuuaauuucuaaucuaaggaaagaaugguuuaauuaaaauuuuauuuauuuuuuuuacuucugcuagcuauuuaaucuaggaaauacagcucagaaaaaaaaugcagucauaaaaccuguugguauaaagauaagcaguuuauuuaauaucuaauuaaauguggucaccagagaaaucacagcuuaugaaacuuuaucagaaaaagauuaauccauuucaggcuuaacccaaaugucauaagagaacucaugaauuuagauaggaauccacuuauuauccaaagacguuuucauaucaaguuaggugagccuauauuacuagcuauauuuauacuuacuucaaucaaauuuauauacuuuguagcuaucacugauguggggcacaauuaucgaaccagaauaagauaauagggagccuuucugucuuuaucaaaaauuucuagaauguucuaaaacacuuggaguuuauagaucccacucuuucagaaauuaaaaaaauuagacugucauuuuaacugaaaagcaauuccacaacuaacuacuaaacaccuauuagaucuugggcucagguguuaagaaaaugaggauggagaaaaugauuccuuccuuugaagggcucagaaagucguaagugagauaaacccuuaaauaaccacugauauaaaauaaugacaacuguaaggcagggguugcuuguuucucuccaaugccuagucuggacacauggugacccagcuuaaagaccucaugucccagccuaaagcuauagccaggugaucucuggccaguacggugugagaaaaagugguuccugcucuuccagacugcaccucuaugggcaggauaugcccuccccuuucuguuccuucuuccugauggcuggaagggaauauggaccaucuuggaucauguggauaagacuaacacuccuauagguggcagagcaacagaauaaagggaguccaaugucacagagcagaacuagcacacugccucagauugacaaugauagaaaaauaagcucuugucuuguauuuaagccacuguuauuuggaaucuaucccaugaaacagccccaugcucuaauuaauauguaacggagaugcuucuuuuucuaaggauuuuugguucugaaaaaugccgccuuaaaagaaagaaccaaaauugaauaguauaagcaaagaaaaguuuaauuucuaacuuuuucaugaaaaauaacaccuuuaauuaugacaaucaaucuuauaaauaacaaaauagagauuauaauuaaaaucuuguaaauucucagaaaagaauaauuuaaguaaucauuggggggcauaaguuuaaaaauaaaauuauauaaccacaugcuggaacuaauuuuaaaaauuagaaaacuaaaaacuaaagauaaaacuaauauauaaaaacuaaagauaaaaauaauauacaaaaacgagagagaguuggaaacaaaauggacacuucaaaauacaagaaaggcuuaggaaaauaacagugaauguagcuaaaaauacagaucaaagcaauuagagagaaacuaauagauaugaaagaaagacaaaaaugauuaagcauaaggacaguuucaguaagggacaaaucaaaaacaguuugugcaaguaauguguacaaacacuuuaucuuuuuuuuuuuuuuuuuuuuuuuuuuuuuugagacggaguuucaaucuuguugcccaggcuggagugcaauggugugaucucggcucauugcaaccuccaccuccuggguucaagcaauucuccugccucagccuccugagcaguggggauuacaggcgcccaccaccaugcccggcuaauuuuuguauuuuuaguagagaugggguuucaccguguuggccaggcuggucuugaacuccugaccucaggugauccacccgccucagccucccaaagugccgggauuacaggagugagccacugcucccagccaaacuuaaucuuuuuuaaaaaaaaauucccugagcuagaacaaacugauacgcagacugaaagaacacuccauguuucaggaaaugcauaauacugagacauauuuugguuaagcuucagaaaucccaauaauacuuuagggacucaaauagaaagaacgaaugaucuauaagagcaaacagagugggcaucuuaaaagacaucaaagcucaagagaggcuccaaauucgaugaaaccaaagaaacagaaagagagagguaaaaaaagugagacacugucaucucugaaaugaagcucaauucauguuuguuaguuuuuuuuccagauggugggauuugaguugauuuuuaaacuucauuuuucuucauuauccaaauuaucuaaaugagcauguaaccugucaauauaaacaauuagaaauuagacagaaaaauaucaaaaauaagauggaaugcaaauaucccaaugaccaauuuccaaagauuauuaucauuuuuuaauaagaggaacgggccuugaaggaauaaucuggugggaaaacuagaaaaggauauuacuccaggcauacgcaaagacagaaagguaugaaagaaaaugaugguuuaagggaauggcaagaggucugauaaguggauggagaucaagccugggucagauuauaugcuaugcuugaacucauucuaguguuauucuuuauuuuugucacugaucugccugacaucauuugaaccagugaaaguaggguucacccuauauuugagguacagaaacucaaguccagacaucagggacaaaauuauuagagcuggaguaccagcucuaauaggaccccauccuagaagaugacagcccaaagacaagugagaagggaacuguccucagaaaauuugugagaucagaugacaccaaauaaaaauaaauaauaauguaugguaauuuaacacauguggacacuacaggaauugagaagaaaggaaggggcacuuugguggcuggagcaggugggggaagugguaagacuugcacuaggucuugaaggaaggacagagcauuuuaacuuaagauuuccaguuucacaagaaauugucuucauaggugacuccuaccuguggcuauaauuccauaaaaagaaagcauuuuuucuugcugaaauuauagaaaaaggauggacuaauaagucaauuaugcugggauuugacuauuuaaaaauuaaauaacuaaagccucaucuuacgucaaaacaaauuccagaugauaacuuuucaucuauuccuuuuuuuuuuugagacggagucuugcucugucacccaggcuagagugcaguggugcgaucucagcucacugcaagcuccgccucccggguucacgccauucuccugccucaacuucccgaguagcugggacuacaggcgacugccaccaugccuggcaaauuuuuuguacuuuuaguagagaugggguuucaccauguuagccaggauggucucaaucuccugaccucaugacccacccaccucggccucccaaagugcugggauuacaccacgccuggcccaucuauuucuuuuauaguguccuauguuagauuuaacucuaaucuuugguaacagucuuuguaaccauacuaacaaaggaagagagagagauacaaaauuuaauuuguccacuaagaacaaagguuaaucaacaaacuggaaaaacuguuuacaauguaauuaggaaagauugauuuucuuaauauuuaaacaacucuuuuaacucaaugagaaaaaauauauauaaacacuucaacagaaaaauggguaaaggauaugaacaaaaaaugcacaaagguuuauauaugagaauuguuugcucauuuuggaauuauaaauuggaugucuaagaauuuuucuuaggaacaaaucacauauauauacaaaauuuacuuagucacucauugcagaauaauuuguaauacugaaaaaaccuaaaacagcuuagauaaccaacaaaaggauuauacaaauaaauuauaggauaaaaucacugaaguuguccaaauaaaugagaugcugaaccacuaaagaccaaguauugaauguuaccaaaaacuguauaacgacaugggaaagugguuacaauaaguaaggaaaauaaauuagauaacaaucaaauauaauagcuuuaaucccaauuuaaucagaaagaugaaguacagaaaaaagaccagaaggaucugcucuuuaaccaaaacauuaacugugauuauuuccagauuauagaaccacaggugauuuuuuucuucuuuauguuuuuguuguaguuguuguuguuguuuugagauggagucucacuccguugcccaggcuggagugcagcggcgccaucucggcucaugaguaguugggacuacaggcaccugccaccacgcccggcuaauuuuuuuuuuuuuuuuuuuuuuuuuuguauuuuuaguagagacgggguuuugccauguuagccaggauggucucgaucuccugaccuugugauccgcccgccucagccucccaaagugcugggauuacgggcgugagccaccgcgcccagcccuucuuuauguucuuaauguuaucuaaauuuuuauaacgaagaccuguuacuuacaaauucuuugcuguccuuugcagcaaaacuuccagaaagacuguauguaaugucucuaauuccucuucuugcuucuuucucaaacccaaguagacguuggccccaaaaacucucaucaagggaaaugcugaccuccauguuacuaagccuaacacagcagaggugacacugguaauaacucccuucccuucuugagauccccuuuccucguggcuucccgaagcuauacucuacguuuucuuccuaccuacugaucccuucuucucuuuucugcugguuccuucucaucagacugaccccuuuagguagggauacaccacaggucagcccucgucaccugcccucacucccuggguuaugacauccagguucaaggcauuagaugucacguguaugcucacaacucccaaaucuacaccuccagcccagauacagauuucguucuccaaacuccagacuugugggucaccuccacuuggaugucuaagagacaacucaaacucaauaagcccaagugaguaaguaaacucuugcucuugcccccaaaaccugccucacacauaguuuuccucaucucaguugauaguaacuucuuccuuucauuugcucagaacaaauaucuguccucaguuccucugucugccaaccaagcugucagccaaucuuacuggcucuccuucaaaauauauagagaauccaaucuuaccaucuuugcuguccccauggucccagcaacuaucaccccccccccagauuagcacaauaaccugccaagccauguuccacuucuccccugacccauuacagcucauucucagugcaacagccaaacccaucauuuucauaccuacgucagaucaugacacuccucugcuccaaacccuucaauggcucccaauucucacaguaaagccacaguccuuacugaggcuuggcaggccuugcaagacguggccuccccugccacuucucccaucccauguacaccacugcagcaugcugucuuguugcuaucccaggcgaggaggcacauucccacucagccuucacuccagcuuuccauccuacuccaccuggcaugugccuucucccugccaugucuuccuggcuaacucuaccacgucccagccucacuguucuccugcucacaucucaaugucucagugcagugacccagccacccucuugaugcugcacccagcucccacccuccacccccaugggcauccccagcccucuuuccccugcucugcuuuuuccucucucuguaccacuuacugucaacugccaaaagguuaaaaaucaaaauucuaacaggaauuuagguaggcuauggugacacaggaaggcuccucugacuuucaggucugucugguaaaggguggcaugacccugugugagguacuguccugagggacacaguaaggaccucguagguacgaaucagucaucaaagauggaugaaaaugaaaucgccagcaauuaagaaaucccaggggcaugaccaaagcuaagaagcguuaaguuauagauggguugauuuguucaucagcauaagggucagaguugcccaaagaugaaaagggcaccccaggagggcaccauccccuucugcugggggguuucaacaugaaagugggggguuucagcauguagcagcaugagccucagcagggaugccacagagagcauagagcaucccucgggggauggaggaggucuucaucgcugauggagauauccaagaaugggggagaggugggcagagggccugucuauaccuuuugucagggcuuauagagagaaauagcugaaugcauacauuuuucuauuuucugcuguuaauccuuuuguuacacacauaaggggucaaccguuuaguguguauuaaaaacaugccaaggccuauauggacacagaugcuauuccugaagguuaugucugucagauaacaaauacacagagcucaggagacauacacggcuuauguucaccuaaauuaugaaacaaugcagcauucccaugaauaacugaacgaggaaucgugacagaaacaggauugguaaaguacuaaauggcaugcagagaaaaaggcugagagacauucugggaaacagcaccccauggggccaauggguguuucuaagaacucugcauauuuuaggucuuucguacauuaaaaccuaguucauguggcagagacgcuggaaaugugggcucccuccuauauugcucuguuccccucaucacccuccuuauucccacaucaucuuguggccacagaacacgaccaucugugggagcacacgcacagcacacccgcacacacuacccccggggaaggacuucugcucaugaaaaucaaacaaaggagaacaaggaaaaagaggcagagaacacagcgucccacucagagcacugccuguuaaguguuuguuucugaggccagcaucuagcucuaugauuuauuuuauaugugcuguguuuacauacaucaguaaauacgguuuccauuucgcuuuguaacagcagcuauaaauuauauguuggaaguguuuggcuccucucuucccauaaaggucuggcagggauuacggaggccccaacacgggaaggcccaggauugguggggagcaccuucuuucauccauauccuuaaauuaauuaacucacccaauaaguaucuauugagcacaaacuaugugccaggaaccauuagagaugcuucaguaagcaguaccaugaaaaugggacaaaauaaacaaaaaucccugguuuuguggaacuuauaaucuagugaaauucauccaccucucuucaauuucuacauucagagcugucaacccaucugggguuggacacaugagcagguaaaugcaaagcaaauagggccacuauaaauaacuauaggaauuauuaugagugugaauuguuucugagggcuaugugccagccaccgugcuaagcacuguaaguacuaacucaucuaacagucauaaaaaugcuaucaggagguucuaccaugauucugucacagaugaggcaacugaggcaccaggccaucuggccagcaaauggagugaagaaacucagacauuccagcucuagaacccacacuccucgcucugcucuagaaccgggccaauuacagcagagagaggggucccagucaguaucacuuccagaggcaucucuuggucccacagcccacccuuuggucagaacagcaacaggaguguccaggcauggucaacgggugcuugccacaugaguagcuauggaaugggaucugcaaacagcaccagggagacuccauuuucaucuacuguaaauguauugcuaaugcugguuaaucauguggagauaagugauucuacugcucagcccaauuaaacacacuauuuaauacacuguggcuucagacagaucugucucaacaagucauucuaaaugcuuacuaugugaacauuuuaauacuuguccucagcucaaaucuuguugauuuaguauuucauuuaauugggaauaaagcucucaugugauagguuccacuauagauaauaauagcucagaaaaaacaaauacgcagaaaaagagagaaaaggugaucucagacuugaaaauaaaaucucaggagggggcuagcaucaaauaaggaagaauuacgcucacuacucaggauuugugauauuaauccaggauaaucuugguuuucaagauuucaguuauuucuaauacaaaggaacuuguagaauuucaucucucucuagcacgcgcgcacacacacacacacacacauacacaaacauaaaaucacucucaacaauauacucgcuuuucuauuuuguuugcuuuuguuucaaagguguuuaaauaacagaaauguagccaauauuugccaaaugcuuaguauauugucacugugcuaagcauauuacauacgucucauucacuccccgcugcugcaauaacucugccaagcagguaucauuaucauguucuccaccucacacauaaggaaacugaggcccugaggaauuaaaccacuugcuccccgucacacggcugacagguggcaggcccaguucuugcuggucuccauagcugcacccauuccacagcauucuaccucuucccuguauaucugaaagacugcacaagauuucugaccaaagaaaggaugaaagacacaagcuuuucucacgaaacuggaagagugacaccuccuuucuggguggaauaaacacgggaucacacaucacuuucaaccaacuccaaacacagaagcccggggguucuugagcagccccaggugcggagcucaggcccuggaggcugcagcugaagggaaagcagcccuguaaucuguucagacgcauuccgggggagaaagcuuuacgagaacugagaaaguauggaaaauaaagugggcuugcuaauaaucucccuccaggucccacccuccacgcuuucuggucagugguaguuucccacccuugaggcuagaaaacuuggcuuaaugauauaagucugaaggagcccagagaggaaagagaaagcaaaaagucucuagcaccuucacacacacgauacauuuuaacgcacuuucuucaaauuucucaucacaagacuauagaaacugaaacugaaguuuuuucauguuaaaugccuuaccuuuuuuucuguuuuguuuuuugguuuuugguuuuuuugagacggagucucacucugucgcccagacuggacugcaguggcaugaucucgucucaccgcaauuucugcaucccgaguucaggcaauucuucugccucagccuccugaguagcugggauuacaggcaugcgccaccacgcccagcuaauuuuuguauuuuuaguagacacgagguuuaccguguuggccaggauggucuccaucuccugaccucgugauccacccgccuuggccucccaaagugcagggauuacaggcguuaagccacugcgcccagcccaagugcuucaccuuuuaagaccccaauggccaaacauaaaaggacuggaaaauauggaaauauuuccacuugccagucuucauuacgaccuucagaacgacccaucuaaacuacagaaaccaagugcuucccuccagcaucugagaucaagguuugggucuccacucuuucggguauacgcaguacaggcacuccacguucuaagcggacggaagcugcccaucgagcagacaggaggaagcgcagagcguaaccauccgugcuguugcuaugccacgcuguccugagggacguggccuccgacugccaugggugagcgagggugaugggaaagaugacaccacgacagguggggaaacugagucuccaggcuugccacacacccucauuucucccaggagcaaucagauagcaaacuucaauuugaaaacauuauacaucucaaauguaauuaagaaauucgacuggcaugaauauguaauguacacauugcuuuacagaugccuuuuuugcccgacaggcuggugccgacuuucauuuggaagaaauccauuuucauacaaagguaaccaagagugacaggaaauaggaagccuacaucauuuaucuucugugaacuuuagaaaaaaucaguuaauugcuuuucuaggaagcuauuuuauggaaucgcagugcuucaucuuucuauucuuuuucauggcauaaacggcaauuuuaaaaugcccuucaugaaaauucuaugauuaaucaauacaucuuagacuauuuaauuacuuauuuuaacaaauaaaauucugaucaaccauaaaugguuucucuguucuuauagaugaauuaucaaccacuacgaaaacaucuaggauaccacagucuauugauugauauccaaauucaggugucucuuuccuuaccacugacuaagcuaugggcaccagcuccuggcuuccucugcucuccuggcuuaucaaaugaauucuguucccagccacuggagcccucugcaacagcaguuucaaacuaucacuacuuauuaaauugcaaacagaaaacuauaaauguguagguuuuggaauacacugcugaagcuguaacuugucaaaccaccaacugcaaaaggcccaggacacuccuguguugucucaauggcucugcauguuagguuuuucacaccacuguccuauuuugugcccugcccccaucaccuaacauauacauacguauuuuuaaauucuaccaaguuuaggcuaauguaacuuuuuucaaauccaaaaugaucaucuuaguaaugauuuuauauuauuccaugagccaaagacagauacacuaugaaguuaaugaugcuuaagcuucagggucucuaaggcucuggggaguugggggucgggggggugggggugguacuguguuaacacaguuauaugucuuugaaauaauggcaaaggugagauauuuucuauuccuucauuucuaaagaagauccccaagacugcaaauuugaggucccacaaaacuguaucugccucucuagguuaacaguccccaauguuugaaucuggaauuacaugcugagcacaaaauauuaauuugcgugugugugugaacaaaaaauaauucacuucagucagaaauaaaauucagugugcugugcccuagaacauucuagagggcaugcuuuggcuauucguuagucccuggucucucacccaaccauagacagcuuuccaaggggcacucccagggaggcucacuuaaugaggagugguguucagaauaaaagacucagcuacaacaacaaaaauauguuuuucauuaaacacaaaacugagucggaaaaagccagccaagaagcagguguaagaguuaaagaauucucuugaggucuuuaacuucuacaucaaauugcacuggauuuuucugcacuaauuaccuauuauugaagucucaggaauuacugcaaauaauuugccauagcagcagguagggugcagauguuguaagggaaagaaugaagaguuuaugaaguguaaaaccaggcaaagggauucaaaauuuccaaauuuuuaaaaauaauacagaauuguuuuucuacuacaagggugaugaaggugagggaauuuuccuagggcuaaaaggccaauuuuaaacuuaauuuggacuguaaaugagagaaacugcaaauuaaaagcuaugugcugcagucuaauuuauucaguuaauguaaauuucuuggaggcagagauuacaucuuacacuaaaaaaaaaaaaaaauucucucauugcauugcaccuaguuauuaaucugauuuucuuaugaggaauguaccuauacgaugccaaacagcuauuuuuguauggcccuccuuguuuuuaugucauuuuuaccuaacccuuccagcccccaaauucuucacacugugauaagucuugcucuguagcuaacauccucaaaaaccauagucaaguaauaaccuugcagguuauuuucuuuggaaauuucccuaaaaaacccuucucuaccucacuggaaguuaaugucuguacuauugagaggacauuuucauaccagcaguaucuuuauuuuuaaaaauauuggcaugaauauuuuugaaauugucacauuaaaucguuuuaccucuuucaaaaaauaaaaauauuuauucccucaaaaguaaaaucugguugauaaaauucuucagcuucuauguuaugauugugaauuuuauuuuuuuauuuauuuuuuguagagaugggaucucacuauguugcccaggcuggucuugaacucuggccucaagcaauccucccaccucagccucccaaaguacugggauuacaggaaugagccacugugccuggccugauugcggauuuuauuggaauagccuauaaauauugaacaaugcaccugcgaaagaguaugucuuaaucuucucuuggaauacugucaacaaagaucucugaguuugaaggguagaaguaacucacuacuuggcugcugacugugaaauuuagucauguuuuuauugugggaguggacugauuaaacagacaaguguuauaagguucaaauuacaacauuucuccuaauaugcagugcuuuuaacuaugauaaacacugcaccccccuucacaaaaaaaaaaagaacccacccaccaauuuuuaacuuucuucuacaaacaccucuuaucucuucucuaucaaagcaugacuggccuuuuugaaauauucaggacaaaaaguuaggaagagggcaggcucgcuaguucaaugucacuacauauaggggaaauggaacacuucccauagaaagcucugauuucucucagcgugagucucugucugaggcaucccccucucucucugcuaaccagacaccauacacagcauguucuuuccaaucugaguccucaaagggcauccugaaaguguccagguuauuaaugacauacccaaaagccucauaaaaacugcacaguuaucugcuuaaggcuuuacuggcaaucaaaaauucaucuuuuuuuguuuuaacuagaguuuuaugaacucacugaauuccaaaauaaacaaacauguaaauuauuaccuaauaaaucugaaguuucuuugguagauaaaaaccauuuuaacaagaagucaauugagauugaaauaaugaagggguuccuggugguuguaaaagucagucaccacugcucaaagauaugccggaauuuauuugcugcuaccagucauuugaugaugacgaaucaaacagccugaugaauucaguuuuguaagaugguaccuacgugugucuccuacaaacuuuuaaaaacguaaaugccuauagaaauuacauuuugcuuccauuaguuucuagugaacauuuucuagaaucuaucauaaacguguaaucaaaaaaaguuacgguauaccugucacuugaucuucucuacaaaaccaguguaaacaucucauagauuaaaaaagaagucuuuucuaaacggugauauguugauaucccuaucaguccguggugaucucugagaugauaguucagaaauguuuaagcucagccuugucaaaaaugcaacaacaaaugucaaaucauugcuuucauuugguuauuaaaucaaauuaagauacaaagaauauucuggccacacuguuacucagucuuuaaagaauauguuaaaaagagaaaaaacugaacaguuccuaaguauaauguucuagaacucacauuuaauuuuaguuaguauacaauaucacagcaaaaaauauguaugcauggucauauuuuuuucuucauguacucuucacaaccaucaucaauuuggaauauggucugagacaggacaggauuuccaaaacauuugaauaguucaccauauucaaaguugaauaauuuaaacaauuaauuuaaaaacuauuaugagguuuauuugguaaaguuuguguuaaaauauuucaaaacacgaaaauguuaagaguuuuggaacucuuuuacauaaaaauuuaccuuaaauagguaaauagauacugaaauuauagccuuuaagugcuuuucuuacuucugaaucacuuauucacuuauuucuuaauuuuauuuauacccucagugaacacuagcuauucagaagaaaauucucaaacuauagugaaggggacauuccuucccuaacuaauacauacacacacaacugcauuugcuggaacucuaaaaauucaaauuauaauaaauuugagauuuuaagaaaucacuauuuaagucugccuccccuuucagugacugcuacaaauccuaccacaugaaguuaaccacaucacugaaaaaaaagaaacauggaaacugaauucacgagggucaaauugucacuuguaacuaugcaguugcaugugaacggugcugauaaagacucaccucccccugcuuggggaugcugaacuuggagagcuuggccuuggcucuggcaggcuccggcuugcuggcagggacuccccuguaugaugugcagugcacgcugguuuccgaagacgacuucagcuuaggagacucaucaggggccugaucuuggccguccauuggccucacauacgcggucgguuucugcuggaccaggcuggguuuugaagcuagggauggaggaaaguucugaacacaguguccgcugcugcugugcuuggccgccauggcagguggccucuccugggucugaaggcccaccuccacauugcacacuuguuuggcccgaggcugcugucugccaacaccaucuccaagcaagguccugagagagcccuguugugcugaguuggaagaagaagaagaggaagauaaggaugaggggggucgacacauagggauuuucuuuuuucauuauaguucucuggguuuuagcagauuugugcaaaucaagcaaccugugccugugcuuacuugcucucuguuggccgucagagggugggugcccagccuucugccagcccauagugccucucuuacucugcugcacggggacagcugcugguguggaaguuguagugcuacagauagacgagggcugguucugggcucuugaaucugcaacaaaauguucaucgaucuuguucacaggagucugaggaaccccagguuugggaacuccaacgagaugacucugauuggaucuaucaguuaaaaagucuuucauuucaucauaauugccuaaaguguucuggauccgguuggagaguucaucccccuuguuagucuggagaaagaaaaacacauccacgcuauuguuagagacaacagaaacaccggagauaaucaacaggugcccuuaucaaucacagagccaggguugucacaugcagaaugagagcugagagaugaaaucgaaauccuuaucgucucugaagaugucugucagcacuuggugaugcaccagaacaggaagccuguaauggccuuggggugcauaaaaagggaucuauccggccgggcgcgguggcuggcucaugccuggaaucccagcacuuugggaggccgaggugggcggaacaccugaggucagguguuugagaucagccugaccaacacggcaaaacccugucucuacuaaaaauacaaaaauuagugggguguggugucgggcugcuguagucccagcuacucaggaggcugaggcaggagaaucacuugaaccugggaggcagagguugcagugagccaagaucacgccacugcacuccagccugggugacagaaggagacucugucucaaaaaauaaaaaggagcagggggaucuauccuugguacuguguguguugcagcuaaaacagauuaccuggaaaucaggaaaauuaacuauugcaacuuuaaaaaaugaacuggauuaagucuuucuaugauuggauuguccuguaauuguagucccguuagaagcuuuacuugaaaauucagauuuggcucgggauuagucuaaauaucauucuugccagaaauccagagugacaggcaagagaugucaaugugaagcuuaaaggaacauggggcuaaaugugcaggaagcuggaaugacccagagcuccaugccgccuaagguauuugugaaaucugggaugacauuucauuuuggaagcaagguuauauuucuggccuuugguaaaaaugagaaauaaucuuagacuuucuuucucauuagcccuaacagguacucuaauccuagcgugauccauguacgacaaauauguaacacaaccuccuucuaauaguguuuguuuccuacgaucugagaaaacauaacaaaugggauugaccuuauaauaugucaacgcggagaugaagucuguauuauugauaaaaaucacagcaagcagaucucaauaguaaacaaaaguugcauguuacugagggaguggccaguaaagccaugugaaccacacaccucaauuucugggggaagaccccguacuugguggcugagcugucuucccugggcugaacagacagaagaugcagucaaguuuggucggccaauucuuuuagucaaggccaccgucacagggagugagagaaacaagugagagguagagaugaacaacugaaaaccaucuaccuuguagggcucacugaagagagaguaacuagaauuaaacgugccaucauccuguugaguuucuugauuucuucuuucucguucuuuccuccguaaugcauuucuaucugguucauagacacugcaucaggaaaaagaagagagaacaaccacacacacaaauuaaacuguaaagcccaauguaacacuugugugagugcagaagucugguucguggacaaauggugaugacaacaagaacauggaugagacaaaagccagagucaucaggcagugugcuggggugucuaacaauuacauucuuuggggggaaaagaauccuuaggaccaguuccaaccaguacuagguuucucuuccugguaugugaaagaggaacuguuuaagcaacuuugacaggagaagacugaaaguaaucuuaaggcagacgguaauuacagugauguguaaauagaaauuaugagcauauuuucucuaugacagagcuucugaguguuauaugggaaugcuccuguucuuuuuuuuuuuuuccuuuuugcauggcuguguuucugcagugauucuuucauuaacuagcucccuaaagagcuguuaaaacugcaugcugcagugguuuucacaguuaugagccuucuucugaucucuguuaaucagucaagucgucaaacgacuacugaaucaauucuuccuucugauauauuugacacuaucacuccuccuaacuaugaaaaaugugccaggaggaaggggugcaggcaaugaggggagagaacggaaauugaauuauguugugucaucaaggaacuccgccuuuuguugaagaaaauuaauaucuauucucucaaaauacaauuaugaaguggccaggcaccagacaacuggaagaaaugaggaagaaauaaaguguuccuucccccuaauaaggagaaaacaaaggggcuaauucaacuagugaugaggaagugaccuguuuacugaaggaaggaaaugcacuuguuuuucuggcucccuggauaaagaaaucuggccuccguguagacaacagaaccaacacuaccaaucaaaaagagcuuacagaucccuuaagaugagcucuguccuccuuucccagcagaagcagguggguucagugaccuggccaucauucugcuuccagcucccacuuggucuagugggcagaugcugagcugggaguuggcacacucaccugcgaaaugugguucuccccaaaucagcgacauggggauggaaaagccacucggucucucuacgccuuaaugacuucauuacaaagcaggggcguuucauggcacuguuauaaggcuuaaaugugaagguaaucuauaaaauggcuuuggaguagcuuuaggugccacaaaauccaacauauugcuaauaaaauauuguuaauaauaaaaggaucuguggguucaaaggaacuuauaaaaauugugauuuuuaaaagcuaaauaacuaucuuuaguaaaacagaaaguauauguaucauguagcuguagggggacacacaaauuauuguaaaauaaauauugcuuauccuagcucugcccguguggcugggguacaguuuaaauuugcugucuaaggggugaugcgauacuaaacaugcuucuggcaaggcugcugcagcaccuaaggcauuuaauuuaaauuuaagguuagggaauguaaagauauccagaacauggagccuauuagcauuuuaauucauccuuaguauauuacccacaguuauuagauuugggaguccaaccagugaccuucauauaacggggacugcagccucuagaaucuucuaccaacugagaggcucacagcgcuaacaucacgaucacugaucacuaagaacucucugggguggcuguggugacagugaccagccuaaggaaagcaggagaugggaaagacacucuuauucacagaaccagacuuccaguucccaguagaggguaugaugguccugcccugcuuguggacauuuguaauaugaaaccccggcuuucaggaacauuccauggauuuaaaauggagacugcucugaggauauaugacccacacugcagauggauaugaaguagccuuuaaucaacaggagaauucuaguuucauuaugcacuucuagcuuuuggaacaauauugacaccugcaguuagaaaacaaaaagcagccgggcgcuguggcucaugccuguaaucccagcacuuugggaggccgagauggguggaucacgaggucaggagaucgaggccauccuggcuaacacggugaaaccccauuucuacuaaaaauacaaaaaauuagccaggggcgguggugggcaccuguagucccagcuacucgggaggcugaggcaggagaacggcacgaacccgggaggcggagcuugcagugagccgagauugcgccacugcacuccagccugggcgacaaagcgagacucccucucaaaagaaaaaaaagcuugcacagcaugcaucauaacucuccccuuuucccauacauagcagggacucccacacacaugcuugcugcccucagucaggucaacccaaccagacacacaagacuggugugaugcacgaaguggccucauguaagauggagcaggcagguggucauugagaaugauuucugggcuucucagaaggcccccaugcccaaaauaauaccuccugcaucugcuggcugaugacugaaauuccacaacuagagagucauuccucugguuuaagaugucuucaccccugcaagaaauauaaacaccacaagaagcugaaacacuuuaaaccugauuagccuugaguaucuuagcgugcaugagucugucagcauauuuuccagaagccgaggggaaagaauccaagaucccggagggucagaacgggaggcaagcugaacaaaggaagggacaacaguagaugcagccaugaaaacagauucauaaacuccacuuauuuuucaguguggcuuaaauguuuaagacaaaggcaauaggauaaaaaccaaaauuaauuaggcagauaucagacccaauacauuuccagggucugggaguuaugagucauguccuacucugaaaauguuggaggugagagaaaagaugcuccucuuuaacuaaaccugccucaucccccaaccccuuuaagcugaaggauaccccaaagcacuccaagaugcuuuauaaagcauccagauugcuagauaaaauccacuaaugaaguucuacccgcauaaccagccuacagcuccuacuaccaagaaggagugaacacccucaggaccacuuacucauaaucuucuaauagaaauccacuagucgucuuuucaggggccugccaucaugcucgugccaugcuuccacaccauaagaugaacccagaaugacucaaaauggcaacguccccacuucuucaaaggagaggaaaggaaacucaaaaagaaaggcaaugccuucccuuugguuucucuccuccuuccuugguggguagcucuguagccuccacugagcugcuucuuaaaacuaaccuacccauuccuucucuuuaacuagaagcacaagccccccaccacauaucauuucauggcuagggagcuaaaaugucacuugcuuaaagcagaugucacuguaagagaaaggcugggcuucccacccccuguaucucccuaagugucugaacucucaccuuucuaccaauacuaaauguuuugacucauaaagacaguagcuucucgacagugagcccccaucccacuaauuacaagugaaaauugugccggugcucaccagccugcagagugccuuucucuucaucucuugccaugaaagcuuagcccucuucgucccccugccauuugagcaaugugaagaucaugcuuuaaaagcaaagaaagcuuucgccugacaagcugaaagucaggucagcuuccccugggauggcugacuuaggucuaagagaauuccaauucccggcaugccaacauauacauuaaacucaaaauguguugcacguuaugaguuauguuucuuuguuacuagcagaugguaaaaauuucuaucaucugcaaaguugcuccuauuuccauaaaaauuacaaaaaucacauuccucaaauguaugucaccaaauguauuuauuuauuuugcaugaaaguggagguagccaacugcuucaauauuauuuaucauuuguugcagaugcauaacauucccagaaaauaaaccuuuuuaaucaacuccuuuuaaagggccuauuuauuuuuagaauuaaaaaaaauagcaaauaaaaaauguagugaaaacauuuuugaucauuucucacuuauuuguuuuuaaucuauaaauugcgguaucuuguagagcuccagccaaggccaauuauggugguuaaguagaaauagacgucuaaacaugaaacugucaucauuuccaaaauucaucuauucuugaucauacgguaacagcaugaaacuaaauaaaaguaacaucuaugagcccgauggcuuuucucuuccauugagcucaaaacauuucaccuauaugucccuuaauuauccucacaaugccccuuggagaaagacacugauggugaauauuaugacuagguuaacucuuuuaaagaucaagaaacuuaggauaagaguuugaucaucaaaacaaugucauaaagacacacuguguaaaaggaacagcaauguccaaaguaccuuacucagcucugcccagagaacaggagcuauccuggagccaagaagugguggcaccucuuaaacccugaugucugacaagcccaguagugagaaguaguuaacaugagccccagaggcaaaacaggaauaaaugaaauaaggcaagcuauuucccagucagacagagagaaccauaaggagaauucuggaauaaagucucagcuguuauaauuuuuuacagcccccaacugacaaaggauagaaaucagucucuuuccacagcucacacacaaagcagaccuauguaaccuagaauuguggaauggaagauagagaagugaauaaaaaaauaaaaaaugauaagauucuaaaguugcccagcgagggcuacugaugucacuauuuuuaucaagugcuacccauucauuagccugcuccaaucucucccuaggcugcccuacuggugagaaaggugcuggagccaggacagccugcccucuggcugagucacagguugauucagcagacccagccagccagggggggaugaccuccuucccacugcacucauccacaugcagccugaugaaaucugaugaaaugcaguuugcuuggagcacucgcuccaagcaaacugcauuucccauggaggagacuuuuaggcaaggguauaugaagccaauuguaucccuugacuagaaucaucaaaauguuuuauucuuauuuuuaaaaaacuauccaaacuacugauaugucuccaggguuguggggagucuaagaaauaagcaaauucaaggagaagagaaugaaccaccucucaccuaucuuuuggaaaaaguuaucauguuuugcauguuuuuaaaauacaguccuuuucaaauaacaaaaacacaauucacuuucguccaaaagcauuuucugaauaccacugugucagauacuagggagacagggucgugauugagccauccugcugaugagaagacaacagucuggggcaaggagaauggggaaaaggaagaagggcaccaauucacaaucaaacaaugugagcagccuguggucagggcacuggcagggguagcacaaggaaucagcauuguuuccugcaggagaccagcuuugagcuugagaaaacggcagguuaaggagauggaaaagaagaagggcuuagagguacaaaauacauggauuacuaguaaguggccuuugggaguauauucagaggcgguuauguuacucucuccauaccuccauaccaccuugcuuccuuuuuuuuuuuuuuuuuuuagacggagucucacucuguugcccaggcuggagugcagcagggugaucucagcucacugcaaccuccgccucccagguucaagugauucuuuugccucagccucccgaguagcugggacuacaggcaugugccaccacacccagccagcuaauuuuuuuuuuuuuuuuuuuuuuuguauauuuaguagagacaggguuucaggacguuagccaggauggucucgaucuccugaccucaugauccgccugccuuggccccccaaagugcuggaauuacaggcgugagccacugugccuggcccaccuuacuucuuuaacaagguggaauuccucauuuaaaguuucauuuaugugguuuacccacugcuaaccuaucauugcuaccucacucuaaacagguucgucugaucccuuccuaagagcagauuugguuuggagcaaaugcaugaagaguggaugcagaggacacagagaaacacucucccccuuuuuacaguuuauaucaggcugccucuaagcagccuggccacagagaagacaaucuuuucagauacuuugagaccugacaacaugcuaacaugcucccugggcauggaccuggagccaugagggugaggaggaagaagaaaaggcauaaggaggagagaagaacguuccccagaaacuccccugcucuccagagcagcagcguaagcacuguguauaauuaaggaaauuuaaucaaacacuccaaauuuauaacaauuguuuuaaauuuaaugagucaaacuaauuaacaucucuuguuauuuauaaagcaaaugauaaaaauuaaaaauuguuuuuuaaauuagaguaaagcaagguugcugaaguguacuugcaaauucccuucuuaaucuauagacauagcugguggacugaaaggcagaaagacagugagcaugggacagaggcaacucagacagagaaggugaggcugaagguagaacgugguaaaaaggcaagaaucucccaacuggagucuuuugaagcucugaguuguugugguugugaugcuauaggugcgaugguggugauagugguggugguggugauaguggcagcagaaguacuggcaguaguguuggugguagugauggugaugaugguuaugauggugguggugguggugauggugaugaugauggugguuaugguagcaauggugacaguaguggcagugaagguguugugguaguggugguggugguggugauggugaugauugugauaaugguggugaugacagugauggugaugguggugguagugguagugauggugguggugguagcaauggugauggugguggugauggugguggugguagaggugcuggugguggugguaguuguggcgaugcugauaaugauugugguugugauaauggcaaugguaguggcggugaugguggugggggugauggcagugguagugguggcgguggcagugguagugggggugaugauggugguggcagcgauggugacagugguagugaacauguuagugguagugauagugauggugauggugguagugauggugaugguggugguugugauaauggugauggcagcgauggucauggugguagugguggcagugguggugauguggugguggagauggugaugguggugguaaugguguuggugaugaaaguggugaugguacugguggugauaguggugguggcgguagugguggugauggugguagcgauggugauaguauugguggugaacauguuagugacaguagugauggugguggugguaguggugguaauggugaugguggugguggugaugguggugguaaugguguuggugaugaaaguggugaugguacuggcagugaugguggugguggcgguaguggcggugauggugguagcgauggugauaguauugguggugaacauguuagugacaguaguagugauggugguggugguaguggugguaauggugauggcagugaugcugaugguggugguggugauggugguaauggugguggugaugaagguggugaucgugcuggugguacugauggugaugguggugguggugaugauaugguggugauuguuaugauaauggugaugacgguagugaaguugaugguggugaugauggugguaguggugguaaugguaaugaugguggugguugugauaaugguggugacaguagugauggugguggugaugaugacgaugcuggugguggugguaaugguguuggugguggugaaagugguagugaaggugcuagugguuaaaaaucuguugaggagugagaaacagucaacagugcauauaacaaauucuuaaauccuaaagaacaugacuaugccccggcucacuuauccuggauuuuccuuaugagccaaguaauuucaguucucaugaauguucacucuacuuucccccaacagcacuauaacauuggcucaccagcacuccuuucacccacaguguauuauuucuaccauggacuccucaaaaauaucgguccccuuuuacuuguuugucucugaccacaaacaaguaaagguuaucucaaucuuaauucaaucuugaaaauauuuucugggagcauuucuagaucucuacuuuagcuaugcugaccuguucuaccagagcaggaaugagauugaggguggucugugccauaaccacuucuguacucuaucuuuugagaaacuaugacauuaaagggagucacaaagucacaaagacccauagacaaguuuaaaccacagucaccccaaauaauuuucugggucuaugucauccucccaggcccaucuggcccauguuaaauguugcuaguaacaacuacucuacauggacuuuacaugaauuacugcauuuaaaaccccaagaggcauucucccuauuuacaguggagaaacaagaggcucugagguuaacuaacuuguccaagucccauaaccaguaagcgacaucacuuagaugugaagccaggcagucuggcaccagagaccaaauucuuagacucugcuccacugccucccuggggaacugcucacugacaagcuuugacaaaugguaccuucauccuuuguuaguaaaugcuaggcaaaaggguauuaauuuacagaucaugccuguuucaguucauucuuccaagaucugcuaugccuccuugguugauauguguguguguguguguguguauauauauauauaggcuaauuuuaagaauucuucuaaaaccuauaaaauauaacuggaauaugcaauucaaaugacacagcacuagcagugaacuaauacucuagucccuacauuuuuucaaacagaagauuucagaagcuguaagguaaacagacucgcccauuuuaccgauuuuuuagugugaauucugcauacugaauuccuuaagaaauacagaaugccaugguaaguucauuuuaugacagagcuagcacaguugaguugcugcaaacugguauuggacacucaucaguuuuuuacugaucauuuacugagucccaacuccauuucuaguucaguggaacgaugacuguuucaaaucucucucguaaauauacuccaguggguuuucgagagaugacagauaaaugacagcuuugcauuuccaaggguuaaaugcuuuuccugagggauccuaagucuuggugccaugagaacaagugucaggcucuaauggaauuguuccaugauaaauaaacugccaggcuguaugacaagcagcuuucagagucuuucuauauaguauaaacagcagaaguuaauuugaguuucuuaacaggaccuuuuuccuuuacaauauaaaagugccuugggaugaagcaauuacucugauuuaccaucuucuccuugguagaauauaaagaugcagcagagccucacaaaggcaguaacuuaaccaaaugagacccacuugcaaagucccuacuaugcuauuucaaagagcucccuucccggcagcagcacagggccgucaucaaucacaggugucugcgaugagaaggaugcugacucucagggcuuuucaugggagagccaauaaacuauuuuuccuccaacaaaugcucaguuaaauuucauuuucacuuuacagcaccaguuucugaacuucagcuccuaggaauuuuaaaagcuaucuacacaaugagucauauuuuauaacaugcuuauguuuuaaccaugaugcccuucccugcaauccuugcuguggccacucaggcucaugggcuggugccugaagucagaagggagaagggugucugaguccucucauccaauccccauacuucagguuggucagucucacggacccagaaagcccagagacccucaacguuagccguaaaaaaaggcucaugcucuucccgaauccaacucgacuucuuuuucucccaggacuacuaaggagauaggcugugguugaaaugggguuucugaaaaggacuaagagucaccuugaacuacugcuauccauugaacugaaucaacuuaccugugagguagagaacaagcccuaggcuagaaagaagauaaauggaaccgacuuuucaaaaaggaagaauuaaaaggagauguauggccccaaaugccucaugauagcuaaucacccugacaggccaaccaucacgguucuccacggagacaacacagguggaaaccaacagaauaagcucacuaauguaccugagaggaaaggacacccugugugaagagagaaugaccuguuuugguacaggcaguuugucagcuuagcuggaagucucagcgggucaagaggacacagaagagagaaguaagacaauaaaaauaucagaaucuggaagagaacacagagcagccccuguggucaccacaaaagcagaaucgggaugugaggucaggggcucgguuccgcagucagcaguggucagaugcgccucaauuucccuccuccaaccuucccucaccucagucuucacgcccuuuccuccucucuggggggagcccuuucuccuccccaggcuaacucucccaccugggcucugaggccuauccccccaaccccaccuucccauagaugccacuuucucguguuugcucuuggucucaauuggcuuuuuugaaucagcaaauaaaccuggucaaggccucucuguauuuagaaaaagagaaugauaggcccucccugacccucuuucuugccauuacaccuucucuuaucagccacaguuuucugcaaagcugucuauacuugcugucucucuccaauuccugguuucccuaaacaugcaaucugguucuccuguucacggccaggcuucaacuuccucauggggcaauccguggaugcuuuucacuccccuaucuccccuuggcuagcacugcccuucagaggucuccuucccuggcccucugguaccaugagauuguggucucccucuugucucuuuggcugcuccucagucugcuugccauuuuucccuccugugacacuccaggcucugugcaaaaccuggucucuucucaagugacagucuuuaugggagaugucauucauuccuugcuuucaggugccaucuuuauguugauguuguacaacucuccaagacucacucaaaucucucuucucagcuaccaauuauccaacucccuauguggccuucucaagucagguuucucauagacagccugcauguccagacuuagcucaccaccacaccgaccccaaccccagccucuacuuguugccugugucagcagaccgcagcacuacccaccuaguugccugagucagaaaccugggcaucaucuggacugugugauuucccaugccccccauauccaaucaacccucucuagaccugucaacucuacuaccugaagacugcucauacuuguccaacucucuccuucugcacugccaacuccuuggcccaggccaccaugggcucccuuccagcccccugcagagccuccuaaaauguaucucccggcugcucuuccuaccccagcccauucgcuccuaccccagcccaaucguuccucccccgucaagccagggugguguuucuuuaaaaaagagcaguuuggucaugccacugcccugcccucaggauagcaucucaaucugguagcccugcucaucugcucaaggucagcucccaaucuucccaguuucuauguuauggcuccuuccugugccuugaacaccucugcuguccaccugcccucuuccuccugauccugaaggucucacuuuagugauuuuucccucuugggaacauucccagacuccccucaccaaaucccggggcccuauauaagucguacguagaacccuccacucuccccgauaauggcacuucuuaugcuaauuaucugaauccuuuauuaaaccauaccauaagaagaaagucuacaucuaguuucuaucaaacuguauccucagcacauagaagagugccuggcacucuaauuccugguuuccugaaacacgcaaccugguucuccuuuuacacacuggcacagagugggcacugaauaaaacaguauaagauacauuaaaaauaugugguaaaugaacguuuguuucaugcuuuuuccuuccuuuucaaaauuuaggcuguaugcauaucaccauuugaacacacagaacuaaaccccauucagauccugaguccuacauuuuauuuaugguuauagaauuuaguaauagugggaaucauaauaacaguaauauugagcaacugccuggugcuggaaagcuuguaaagaaaguuuauauuuguuauuuuauuuaccccucaacaaaccuccuuauuuauacaaaacacaaacuuuuaauaaaaggauauaaaucuaaaaaugauacaagaucugugccauaaacauuauuaugcucauuuuauagauaaaggccuuucaucaaugaaaaaaguggggcuuagaaaauuuaaacaguuugcaaaagucacacaauaaguauuagaaucgggauucuaaguugcauggaaacuguggauauuaaaaacaauuuaaguucuaaaaaguuuaugcuuuucaauuuaaaaaauauuauuuaaugcucauuauacacaaaguaccagcuacacaggacaaaaaaugucugugaccacaacuuccacacaaguacugcggaggacauuucuguaacuuccuuuggugaaaacucuguagucaaucaagcuugacucagaggaagacauuaagaauuaugaauuauuugaauuccacaguucuauaauucauucugugcuagugacacuaaagacgauuaauucuaaauauccauauaacaaugucagaaaaccaaggggucuuccuauagcuguggcaucacucacaaguucccaauuucaguuagacaccuaaucuaucauacaaauauuuuacuugauucccuagaacauuaggaauguuauauaucauggggcugccuaagcaugauaauuaucacaaaucuuuaagaaauguugcaaagaggacaugaagucuacucuaacaauguguuuguuuccucuuaccuuaaaauguuucccuuuuuuucuuuuccucccuuccccacuuuuuuuucgggggagacagagucucacucuauccccccggcuggagugcaguggugugaucucggcucacugugaccuccgccuuccggguucaagagauucucaugucucagccucccaaguagcugggauuacaggcaugcgccaccaugccuggccaauuuuuuuuauuuuuaguagagaugggguuuugccauguuagccaggcuggucuugaacuccugaccacaagugauccgccugccuuggccucccaaagugcuaagauuacaggcaugagccacugcgccuggcccugucucuuuuuauguuucccauauacacccacauacaacacagcaaguccaaugccacaggcaauacaggcagcuagcucugugauauggagauaaauuuauuaaugugaagagagcccaugaagacggcucuucuuccucgaaacacugcacagaacaacagacaagcuaggguaggugggguugggcauuuaguuguauacacaggaagagauagggggagacacuucacauuucuccccauccuugaucucugccaacucaacaucaauuaguccucugccgaguuagcaggccuccauucugugggccuccaucuggguuucccagcugucugggcccuuuggggucuccauccacuggacuucagagaacacaccucucagcuuagcugagaacaagcccuggcuccccguaagcacucaauuaccauuuguagaauggauggaugaauaaguaucugguguuccuucucacugaagcccucccuucacugagccaguaaggauaaacaauacgugagauuugccuggucuuccaggacaguuaagcgcauacuauaauacauaaagcugcuucagguacauucuggaagcagcagccucaaggaguagaucaagcuagcuuuuaccaaauuuuguuuaugacuggcacaaagaaacauggaagugucaacauuguccuuuuggaauuaaaauucuacaugcauuaacagaagauacuacauaauuucugggaaacauacuagaaaauuacuaaacuugaagaugucuucaacaagaagcaaaugauuccagaucaucuuagaauuacagaagagggagaaacagcaaggccucccauuaaacaagaagaauacuuccuaucacugaacgcauaguuuccaaggagcccccucuaccuccaaagauauuaacauugugccagaaaugagaagauucagcuaagguccaagcagagacaagucaggacucugugccuuacccccucaucucaagcaggguuaagaaaccaauccauacauugugaucagugguuggcaauguuaaagugcucugccaagguaaaauaucaucaauaccuaaaugaaagacgacuaacauagccaccauucagaaagaaacacuauuucuccaucucagacagguggccuggguaggcugucauuaaacacugacuucgaaccagcaauagcauauuuaggaauauacuauucauauuuagaauuucacuacagaggccgggcacgguggcucaugccuguaaucccagcacuuugggaggccgaggcgggcggaucacgaggucaggagauugagaccauccuggcuaacacggugaaacccugacucuacuaagaacaccaaaaauuagccgggcgugguggcgggcgccuguagucccagcuacucgggaggcugaggcaggagaauggcgugaacccgggaggcggagcuugcagugagccgagaucgcgccacugcacuccagccugggcgacagagcaagacuccgucucaaaaaaaaaaaaaaaaaaaaaaaaagaauuucacuacagaauuauuuauaauuauaaaacaggccgggcaggguggcucaugcuuguaaucccagcacuuugggaggcuaaggcggguggaucaccugaggucgggaguucgagauggaucaccugaggucaggaguucaagaucagccugaccaacauggagaaaccccgucucuacuaacaaaaaaaauacaaaauuagccgggcaugguggcgaacgccuguaaucccagcuacucgggagucugaggcaggagaauugccugaacccaggaggcggagguugcggugagccaagaucaugccacugcacuccagccugggcaacaagagugaaacuccgucucaaaaauaauaauaauuauuauuauuauuauaaaacaaaaauaauuguaaaaccaaugaaauauccauucuuaggagacugguuaguaaauuauagcacuucguacaauagaagacuguagacauugcacuggauggaguggauuuaaauguauagauauggggaauauccaagauacaaauauuaagugaaaagaauaauuuguagaaaagcauggauuauauaaucucuuguacauaaaaugugugugcauuuauagacacaugaaaauuuuaaaauaguuaucuugaggugaaggauagaguggugaggaguggggaagaauuuauauucuucugcuuuaguuggggguuuuacugcaaauauuacuuuuuaaauacaaagcauuauguuuuaaaaauaucgacaguguaaguuuuaauuuguucuuucccuuuaaacuaucuauaaacaugaaaaauguaaaauuaagguaguaacuaucaaauacagcacaggauuaugugcuacacuauaccaggauccuggcuuucccuaccaggcuaggccuauuuucuucauucuucuuccuuccuaaccaaccccuuccuuccucacuccccaaaaaugaacuagaccauucaguagcucuccuauacaccaacagccaccaagcagacagucaaaucaggaacucaaccucuuuuacaauagcugcaaaaaaaaaguaaaauacuuaggaauauaccuaaccaaggaggcuaaagaccucuacaaggaaaacuacaaaacacugcugaaagaaaucacagaugacacaaacaaauggaaacacaucccaugcucauggauggguagcaucaauauuguuaaaaugaccauacugccaaaagcaauuuacaaauucaacgcaauccccaucaaaauaccaccaucauucuucacagaauuagaaaaaaaauucuaaaauucauauggaaccaaaaaagagcccacauagccaaagcaagacuaaguaaaaagaacaaaucuggaggcaucacacuaccugauuucaaacuauacuauaaggccguagucaccaaaacagcaugguacugguauaaaaauaggcacauagaccaauggaacagaauagagaacccagaaauaaacccaaauacuuacagccaacugaucuucaacaaagcaaacaaaaacauaaaauggggaaaagacccccuuuucaacaaguggugcugggauaacuggcuagccagauguaggagaaugaaacuggauccucaucucucgccuuauacaaaaaucaacucaagauggauuaaggacuuaaaucuaagaccugaaacuauaaaaauucuagaagacaacauuggaaaaacccuucuagacauuggcuuaggcaaggauuucaugaacaagaacccaaaagcaaaugcaauaaaaacagugauaaacagcugggacuuaauuaaacuaaagagcuuuugcacggcaaaaggaacagucggcacaguaaacagacaacccacagagugggagaaaaucuucacagucuauacaucugacaaaggauuaauaucuagaaucuacaacaaacaaacaaaucagugagaaaaaaacaaacaaucccauaaaaaagugggcuaaggacaugaauagacaauucucaaaagauguuauacaaauggccaacaaacauaugaaaaaaugcucaacaucacuaaugaucagggaaaugcaaaucaaaaccacaaugugaugcuaccuuacuccugcaagaauggccauaaucaaaaaaucaaaaaacaguagauguuggcauggauguggugaucagggaacacuuccacacugcugguaggaauguaaacugguacagccacuauagaaaacaguguggagauuccuuaaauaacuaaaaguagagcuacuauuugauccugcaaucccacuacuggguaucuacccagaggaaaagaagucguuauacgaaaaagauacuugcacaugcauguuuauagcagcacaauucacaacugcaaaaucguggaaccaacccaaauguccaucaaucaacaaguggauaaagaaacugugauugauauauauaaauaaauauauauauaaauauauauauauauaauggaauacuacucagccauaaaaaggaaugaauuaacgacauuugcagugaccuggauaagacuggggauuauuguucuaagugaaguaacucaggaauggaaaaucaaacaccauauguucucacagauaugugggagcuaagcugugaggacaaaaaggcauaagaaugauacaauggacuuuggggacuuggggggaagggugggaggguggcaagggauaaaagacuacaaauaggguacuguguauacugcucaggugaugaguacacaaaaucucacaaaucaccacuaaagaacugacucauguaaccaaacaccaccuguaccccaauaaccuauggaaaaauaaaaacaaauaaacagagaaaaaaagugaacuagaccaauguuuccacaaaccuauccuauaggcuuuaaucccaaccaaacuccagguugauuaaggacauuccaagucucaaaguaauuccucuguacucaggcaggcgaaaaacaaaaacaagcucacuguaucuauucugauagcaccuaauuugcaucugcuccagaauaaugguggucucugauaaauaagcugcauuauuccccaggauaccucagaagauagcaggucuucugacaccaggccugggggcuucucuuuauaaacucaacuugucuccuuccaagagauacaggaccuccagacugaacuugcagacugaacuuggguaccaaggcuucuagaacuuuuuaauuuauagauagauaacaauuuacggaacugccaaggccuuccaggaagucugaauucuacucuccuggcuacagauuuacuaaccgucuauuccucuuccuuauucaucccccuaaccacaucucuccuaccuuuaaaauuucaucaguacucuucucaguuuuugcauaaaacuguauccuuuacuccuaucuaguuaaacuuugcuguuugauaaacaaguuauuauuucuucccaaguaaguauguaauaaaauuagaacuuuagauaaaaauguguucccuguucacaaauauuuacauuuuaagcaguuuuuuucugacuaguauuuaccagucuuacauagcaaggaaaucaucauuaauaaauguaacaccauuucuuaauauuaauguuaagcauauuauauuuucuuaaacauuaaagguuguuaacuaauaguaucucauuacuuuacuaugaaaacauugguaauucugcaaauucacuguccauuuacaauccaugugaauuauuuuagcaggcacauuaaauucacaaaagaaugauaaauaucugaaaacugcauauccucauuaaucaucaaggaaauacaaaccaaaucaaggugaaaccauuuuuaccugcaaaguugaaacaguuuuuuucaauuaguuggaaagguaauauucaauaccagugacagugguauuaggugacaguggugucucccaggcagcuugaggaaguguaaaucagaagaaacuuccuaaaaacaauuuuguauuuuguagaacauuuucagaaucuuuaaaaagaacacuuuacuucgauaauguccuccuaggaaucugaccaaagaaaacugucagaaaugcucagauuuauguguaugaauuuccaucagagaauuguauguaagaggggcaaacuagaagaaaccuaacauguaauaaucagaaaauaauuaaaacauuauguagcuauuaauacucauguaccucaauaauauuuaaugacacaggaaaggcucauaauguaauguuaaaugggaaaaaucacauaauaauauaaaauguuuacauuauauaaauggauagugugcauauacauauauauaugaauauauccauaaaauaaaaucuaaaagaccacuaagauguuaacaguggcuauucuugagacacagaagaaauaaaauuuuauuuuuccauuuucuguucuuacuauuuuugaauguuuuauauuaaacauuuauuauuccuuauaccuauuaggauggcuacucucaaaaaacagaaaauaacaagcauuggugaggauguggagauauugcaaagaaacccuugagcacugcugauggaaauacaaagugggcacaacuacugugcaaaacagcaugggagguuccucaaaaaauuaaaaguagaauuauaauaugauucaauaauccuccuucuggguauauauccaaaagaacugagagcggggucuuggagagauaucuacacccccacguccacagcagcauaacgcacaguaaccaagagggggaaacaacucaagcguuuaucaguggaugaacagauuuuuaaagugugcacacucauagaauggaauauuauucaaccuuaagaagaaagaaaauccuaauauguggucaaugugacaggcugaacuauguccccucaaaagccauauguugaagcccuaaccuccaguaucuacuguauuuggagacagggucccuaaagagguguuuaaguuaaaauugggucauuagggugggcccuaacccaaucugacugguguccuuauaagaggaggaaacugagacagacauagaggggcaacagggaugcuugggcagaggagaaaggucacaugaaaaggcagcaagaggccaucugcagccagggacagaggccucagagaaaacuggccaccaccuugaucauggaauuccagccuccagaauggugagaagauaaguuucugcugucuaagccacccggucgguggcauuuugugagggcaucccuagcaacuaacgcauacaacacggaugggccuucaggauaugaugcugagugaaauaagccagucacaaagagauaaaugcugugugauuccacuggcaagaggaaccuaggguagucaaauucauugagacagaaaguagaaggacggccacuaggggaugcagggagugggaaaacagcauuuguuguuuaauagauauaauuucaguuuugcaaaaugaagagagauugguugcacaacaauaugaaugugcuuaacgcuacugaacuauauacuuaaaaguaacugguugggcacaguggcucaugccuguaaucugagaacuuugggagaccaaggcagguagacugcuugagccugggaguuucagaccagccugagcaacauggcgaaacgcugacucuacuaaaaauacagaauaauuagccaggcauggugguaugugccuguagucccagcuacucaguaggcugaggugggaagaucaccugagccugaguggucgaggcugcagugagcugagaucaugccacugcacgccauccugggcgagagagcaagacugucucaaaauaauaauaauaauaauaauaauaauaauaaugauaagaugauaaacuucuuguuauauauauuuaccacaauuuuuuaaaaguagacuugagccuuaaaaauuguuucacaaugauacauguugacacauuucauuaauauuucagauaaaacaccauguaauuuuccucacuagcuaucaguagcaaaaugacaguauucuagaaguuuaccucaauuuuacaauaagauuugucauuagggaguugcaaaauaaaacaacgagauaccgcuacacaccuauugugauggcuaaaauccaaaaagcuaauguacagcuuuugggaaagaugcagagcuggcuggaauauaagcagcuggauauggcggcuuaggaagauaguuuggcaaguucuuagaaacuaaacauagucccaccaugcaauccagcaaucaagcuccuagauaucuacccaauuaaucugaaaauguacguccauauaaaaaucuacaugcaaauguuuauagagauuuauucauaaucaccaaaaucugaaagcaaucaagaugcacuucaauagaugaaccauuggugguauauccauaauggaauauuauucagcaaugaaaagaaaugagguaucaagucacaaaaauacacagaugaauccuaaaugcauauuguuaaaugaaagaggccacccuguaaagcuacauauuggaugauuccaauuauacgacaugcugagaaaagcuaaauauagaguaguuuccagguuggggacaggaagguagagaagguugaauguagaguacaggagauuuuuuagggcagugaaacuauucuguaugauacuguaaugaugaauacaagaaauuaagcauuggucaaaauucauagaacuuuauaaacacaaagaguaaaccuuaaaucucauucaggagauuagggaaaucccaggaagaaaagcagaaugagauuauacauaugcauuuuaaauguauuuuaaaaaccucacuuaacaguaugaggaaauaaaauccugacccaaauaauaacuuuagaaauaaguggagucuguaaaaaaaagacaaaaggaacuucauauaaauaucauacucuaguugauaaagcuguuucccgauggaaguacaggaugauaaugcugaaacugcuauacaugcauacuggaauuaaagauguaaguaaauagauggugaauaauggaaccaagauuucucaauguugaagugggugggauuacacauaugcaacggaaggaaguuagaaugauccaugugauaaauggauuagagcuggagacaucaggaugaacucaguagcauauguauuagcuuacuauagauauagaggguuacauauagaaauguauacauacacacagagagauuaguauacacacauguauuuccuugcccuguagcugagugacccuacacccaguagcaaugaguacaccuagcauccugaucuucauuucuaauagaaccagggccacuuggaaaaauggcugauucuaggacuggggcaaaaaauauacaaaauaggucugaggcaccuuguagugcagaaagcaagaaaaugcucacaacaacaauaacacaauaauggguauguaucaaaggguuacaggaggcaauugaaagaguuuccaguggcuaaagccagaguaauuugagcaacacaauaaaguaguauuggcuuaucaccugaaguauaaaacaaauauccaugaguccacacgguaaauaaauaaauggggaauagcugaaucacccauguggaagaauuccaaauaauuuauguagauauuccaagcuuaaggaggugaagcauagcgcugcacucuuuaagaauuacagcuauaugcaacaacaucaaucucacaaacauaauauugaguguuacauauugaaaguaugucauauugaaagaagcaacacagagaagaauaccuacuauauaacucugugucuauaauguaccaaacaaguagacuuauagucuuggaauucagcauauaguuaccucuagagaaaagggaaaggguaaugauuagaaguaugccugagagaggccagguaugguggcucacgccuguaauccuagcacuuugggugggacaaggcagguggauuacgaggucaggagaucaagaccaucccagccaacauggugaaaccccgucucuacuaaaaauacaaaacaaauuagccaggugugguggcgggcaccuguagucccagcuacucaggaggcugaggcaggaaaaucacuugaacccaggaggcggaggcugcagugagccgagacugcgccacugcacuacagccugggcaacagagugagacucugucucaaaaaaaaaaaaaguaugcccaagagagauucugggauucuagcugugcucuguuaaacuugaucacugaucuaaguucugucgaaguucucaaaguuauaaccaauucaaugaauuguguaccucacacuguauacaaaccaacuucaguucagaaaaagaaaauaugaacuuaauuuugauguaaugaagauaucuaguacaauuuuuuucacauggugauccaauugacccacuaaugguuaaacagaucauuauuuucccacugcuccgcggugccaauuuuugucaaaaguuaugucuucauauaugcuugguucuguuccuggacugacuuuucaauuccauguguauauuugccuaucccugcaucaacacugugugucuuaauuacuauaaauuuauagcuuacuuaucuaccuauuuacuauaaguaauaagaaaaauuauuuauuauaaguaaugaguaauuaccauaaguaguaaguaauaauuacuauagauuuaagucuugaugucaguagaguaaguccaacaaccuuauucuuuuucaagauuggcuuguuaugccuuauccucuguacuuuucauacauguuuuggaaucagcuugccaauuuccacauacaauuuuguacacaacuguuggaaacuaguuugggagcaaguacgucacauccuugcauaugccauacccauauuuccuuccuugccaaaucuggaagcauggagauggaguuucucuuugccugagucccugagugaggccaauguugcaaagagccuucacccccaucaacacauuacaaacauacaggguuagcaagaaauaaaccucauuauuaaaaaaaauuaaauuauauggcccuaaaacuuuagguaagaggaagcauuaaaagagaaagauuugagauuaacuguggauuuauuuuaaauaucugagcuaugauaagcuuauaugcacacauacacucauaaacacaaaugugggauacgugaaucguuacuucuauaugaaacaucugaguuacuugcaacucucugaaauuaacucaaaccauuuaccagaugguaaauucuggagauaaauuuaaaauaugcaaaacaaugcuaucugacauuucuaugaaacacagaguaccuaauuguaacuuaacauuuuaauuuugggaagaggaaacaauauagaauuuuuauuucuaauauuagcuuugaaugauaaucaauucugauuugcaaaacggucuauguuuuguuaacaaaucagcauuucccacuugcuguuuuuauuggacaauaaaagccauaugggcuaagaauucaucacgauuaauaaaaaagaugcaaauucuuauaauacaauguuccacauaacuuuauaagaaccucugcaacagcuuuuguguauaucaaauuaaaauuuacuauauaauaaaauuauguaguaauaauuuucaaccucuaacuaaagucauaugauucuucaacauuuauccacugcuacaccacaguacauaaaucaugcaggcuaauucucacaauacauauuauauagggcacagaauuauuuugauuuaauucucaauaagaaccgaagcaguaacuuguuauuuuagacuggcaaaucaauagcaaaugcuuguucuaagauugguuaucacuccagucaugcaaguagcuuaaaaacugacauauuagcauugacaaaaggauugcucuauuuguuuuccaaaggcuuucccgcaugacucuauacuuaguuuuaugccaaagaaaaucaaucucuuuauucaacuugucaaucagaaaacacauguagaaacaauuauuuuauugcaacacauaaaaguacacugaaucauauaggaugaaauagaaauaaaaugccaaaguauuaacaugccuguaaacagaauuaagacuuaaaugcaaaaauaaaauuaaauauagaaauuaaaccuaaaggauaaaaaucaguugaauagacuuacuccaauccucaguuuucaaauacaccaaucucuuuucauuucagaauuuuaaaaacucauuagaaggacuagcuucuuccaacacaauggaaguccauaaaaaccuaauuuucccuuuuuuuuuuuaaucugcaaaaacuaagcuuucuagacagaugauaaugcuggcacauuuauaucagaauaucaaugaagaaaacauuucucuuuacaacaaggauuuugagugauucuaaauuacacuuuacauaacaaagaaccaagaaauacagaugccuggcuuuugaucuagugccuauaaaaagagccccagaaaggucuacauggaauaccaagguagaaagcaacauaauacacaagaucuaaugaucaccuaaguucccccgguuccaucaaggucacucaaguucacaugcaugaaguauucaaugucauucacauuaacugccucauguaaauuuuccuuuguuuuaauggaugaguauuguagggccugguuguaaaauaugaagucugaccuaggaaaggagucaaaucuuugucccaguguccauuccccuggggauccucauguccccagacuucagcucccuguauccucaaggccaccaaggaggcagcacaccacuucacaccaccacaucauaaacaauacaccuguccaaccauggcucucucugcuauggcuacaaucaacugccuccauuuaaauuuuagucucugggcaccuguggaaucacacagaugcacaaaguggcacaugcuuugaagacgcucaggccaagacauaaccucacuuuacaccaacucugucaaaacaaggcugcuuaugaagcauauuucacucaaguauuagcauccuacauggagccuuuuauuaugcuaaagaaaucgucacugacuuagacaacacuugucccuauccaagaauacuguuggugugcaaggagcuuccaagggugaauagaucacauuuacucaacaggaguaagcagacaucccaaugaugaacaaaaaugauugcugcagacuaugaugacuaaggaagaccaucaaauucuuauagcugaagcaaccuacuaacuuuuuugaucagccuuagcgaagaagcacaugggagcagacaccacaaaguaugguguagcagaaagagcauuacuuggaguccacaauacgggcuuuauuuccagcucugccuuuuaguuuacuuaagcauuugaagagcaaaaaccuucuuuucaucuauauauccucaguaccuagcaguguuugcaaaacugugaacccucgaugaguauuuguucaaugaaagaacaagagaauauauaggauguaugugaucuuaagcacuuaacaucuuuggguuuaaguuuccaaaucuuuaaaaauggggacauaguaaggcaaugcaugccuuuuacacuggguugcugaaagaaccaagcaaacuagcagauaugaaaguuaucuguuaaucauaaagucuguuacaauaguacacugcaaguaaagaagcauucuuugaauugggggugguggaagcaaugaggcuacuucaaggaauauggccuugaaaagcccagauuucuccucugucccuugaauccuuuaaucuaccucuuggcuuaaaaggguguucaacucacugagagagaaaauugauaugguucuaaucaaaaccaaaaaugugugccaaguucugaaaaauacagugcuaaaaaaaaaaaaaaaaaaaaaaaaaacaacuuucucaaagucuuuccuggcaacagucacccucaugaauuuccccacuaacacaauggcaccacccugcucacaaugugccagcccuuucccagccaccccagguccuucuacuuaauaauccuagcauugcccacacguuacccuagcacccauuaguauccuaccaacuuuucuaaaaccuaacuucauauaauuacaaauccaugaagaaaagugggcgcuucaaucaacuuacuuuuagauuucagaauaacagguaaaauauuugggaaaaaauacauuuuauuccuaccuugcauuuaaaaaaaugaauuccaauaaauuaaagaauaauuauuuuuaaaugaagccauuaaaaaacaagaaagaaaggcaggggcuggcauuucuuaaucauuaaagcaaugagagagaauguaaaaaaaauggacauauuugaucaugcaaucauauacacauaaccacaaaguuacaaaauuaaagauaaacuaggaaaaagauaugugacauauaagagaaggggcaguagucucaugauauauauaaagagcucuuacaaaugaaaaugguugaaaaucagagaaauaugaguugggacaugaggugggggugaagagggagagaaaguagucaaacaaguacaaaagcagcagccuacuccaaacagaaaaaaaaaaaaagaaaagaaaaaaacaaaaacaaauaaggaaauaccauuuuuaccuaccaaauaggcaaagaacuaaaaaguguaacccucaauaaccuacagacagcugugcagagcggcaggaggucucaugcgcuccuggugacagccaaacagguaaaauccuucuggagggaaacuuggcaauauaucaaaagcguucugaaagcucacguccucuaaucaguaauucuauuguuaaaaacuguuacuaagaaaauuaacagcaaugugugcaaugauuucugcacaagaauguucaccauagcacauguucauguaacagccaaaauauuagaagaaaaaaaucucaagguccaagaauaaacaaguuaugguauauuuauguaauguaguuuacaaauguguuuucaagaaaaauaugguauuuaauaauagauguuuacaauacuagugaaaauguaagauucaaaacuauacaggguaugaucugaacaugugugaaaggcccaaauaggaauacacauauuuuauacauacauguaugggggguauauuuauuucauauauauuuauuuauuuauauauaaauauauauuuauauuuuauauauuauuuauauauaaauauauauuuauauuuuauauauuauuuauauauaaauauauauuuauauuuuauauauuauuuauauauaaauauauauuuauauuuuauauauuauuuauauauaaauauauauuuauauuuuauauauuauuuauauauaaauauauauuuauauuuuauauauuauuuauauauaaauauauauuuauauuuuauauauuauuuauauauaaauauauauuuauauuuuauauauuauauauuuauauauuauauauauuuauauuaauuuguguauaauauauauuauuaaauauaauaaauauauuuauuuuuauauauuauauaaaaauauauaauauauaaaauauauaaaaauuaaucuauaucuauuuacaaauaaacauauauaauauauaaauauauguggguguguauauauauauaucagcgagaaggucaaggacaguagucucaacuucaaccuugaguguuuuuguguuuuuaauuuuguuuuggaauuauuggauuuggaucucugcagacucugaaaugacgauggguaaaagaaaacuuuucaaggucaauuauuauuucaaauuagaaaacucuaggcuuuauuucuuuguaccugggaaguccucaucaagccauuaagggaagaggagagggugaagacacugcagccaucaguccccugcaaugaagucuaagacagaaggaucugcaggagacgcccaaggacaccucagcugggcuggcacaucuaagccccgcccgcuuccccaccacucuaagcgcuaaagucgcugucuggucuuacucccgcagauuaaaaccacaugagccaccuggaccccaaccccauucacuuugggauuccagccuuccagcaacaaucaaguugucuuauauuuuccucaaauuaaaaaaaaaaaagggcucauuuauaaaaaagagaagggcugcucugaucaaaaaguguuuuacagaaagacaaagaguaaacaaucucaaccauuuugugagcuaauaacacaaagagagcuuugauuuuauuucucauauauuuuauaaacacaggagaggguggguaaaagacaucauguggcuugcaguugaggggacagaggcugggcacggguccaaaaucuccccaugauguuaccugugacacauacaugcacaaaaagucugccacauaacgaagcauuuaaauaauuuaauuuguaucuaagggucaugggacuaugcagcauauuuauuuucuucuucuucuucuuuuuuuuuuuuuuagacagagccucgcucuuguugcccaggcuggagugcaauggcguuaucucagcucacugcaaccuccgccaccggguucaagcgauucuccugccucagccucccaaguagcugggauuacaggugcccacgaccacgcccggcuaauuuuuuguauuuuuaguagagacgggguuucaccauguuggccaggcuggucuugaacuccugacaucaggugauccaccugccuuggccucccaaagugcugagacuacaggugugacccaccaugcccagccuauuuucuucuuuauaguuuuucuacuuuugaauuuuucugaaauuaauuguuuuacuuuuauaaugagaaaaaggucagcagugucuaaaauuuuuguaguuaagugaaauaccaacuucacuauaucucuuucauccucaaaaaucuacaauggcuuccccaauagcuaucuuaucgaauucacaguccuucaaguguuuucuaccagaccugauguccagaauuuuggcauaacauaaaagguccccuugggcagcgcacaguggcucuggccuauagacucagggcuuuaggagaccuagacaggaggauugcuugagccuagguggucgagaucaaccugggcaacacagugagaccccaucuuuacaaaaauuaaaaaacuagccaggugugguggcuugugccucuagugucugcuacuugcgaggcugaggcaagaagaucacuugagcccaggagucaaggcugcaaugagcuaugauggcaccacugcacucuagccuggaaggcaaagggagaacuccucucuaaaaaaaaacaaaaaggcccucccccauggccaaugaccuagccugucucccuuauuagcucuacccguuaaucuucugcguggguccauauucuugauguccgggcuggcucccuaaugggucauguuccuuuacauccauaugccuucgcucacuuucuaacuuuguuugaacuuccucuucuccccaccacaucccacuuacuggcuggcucuggugaaaguuccccuccucuuggaaacagucccugaggugauugccugucgcuuccuccuuguuccaggcaccuugugcucacauucaguacagacuaauuuuccauuguucucucuaggacaggaacuccucuuugcuguccccagcacagagcucaaugacuagccucaguggauaaaugucugucaaauuguguuuucaucuuaaucauucuuucuuauaaauuuccaaugcagauucacuaccucagccuugcaaucaucugccucagcauuaagaaggacugcaaaacccaguaacagcaugugccaugcuuccucacuggaauuucaucaaccuaaaugacccauaccuuugcccccuuuucacgacccuccacgcucuugucacaagaagccuccccucccaguguuauuaaguaauaugacgauuauugcuuacaaccuacccuguuagacugcaaucuccuucaugaaagaaaaugugacauauuaucuggaauuccaucucuccugagucccuauacaguguuccacccaaagaaagaccuccaacccaaugacugcagcacuacuuugcuccaggaaagaguuccaaccagcugagauacaauuauuuuacuaauuuggccaauauacaucauugaguuucaaacauuccaaauguuccuggagaccauccucuucucaguuaagaggcagagggaaaacaagaucaugaaucccuuuucuaaucaugagcaauaagagaaacaaaaauguccugguuuuaucaguuacaucagaggaccaccaugaaucccugaugagagcaggauguugaaggagcgaccagggcugaugucaggucgccugccuaugagagcaaggcagaaccagggcucuggcacaccugcuuuguuccccugcuaccgacaggcuugcuauuucuuucaaagauuuucucauggaccaucacaagugaaagcaguguuagaaaacagcuucagggcuuggggaggcagcguuguuuuagacuggcuggaaagucaugcugagcagcaagaggacagaucucuuuuagaggagacagccccaccuggcugcacccuccaaggaggccacagggcauaucauccaggugggucagguggcacuggggcucacagucaagccaucaucagguuacugccucuguuucaucacugugaaaguuaagccaugauccaggucucugggucuuccugagcaagucaaugcagagccaaagccugugcacaaaugaauaaccucacaaggaugagagcugugugugauugauggcucuacacaaaccaucucagcaaaggaguucaguaagagccuugugagcauaugacacucuccagcucuacuaaagugauagauggguucacacggaagcuacuaaaugggccucauugcaaaggcauggcuucaaccauagcuggacuucagggagcacaguguuuucaacauauaccuuggaaaauuccucacucauaaguaaagauuacauaugcaggggcccagugaaugcuugccuaaaagacaguguaaugcuaagcaaaauagucuguuaauaggaaaagaaauaucaugauuuuaauucuggagugcuaagucgccuaaucuucaauguucuguguucagaugacaggcaggaagcugagcuagaguuuaugcuuguccaauuaaucaaauaaccuccaugccacuuauccuuggaacuggcauuagaaaagcccccacgugcccccaaaucauauaaauuucacaguuuccuagucauuaaauccagguuggccuaaugcugacgugucauauuuugacauguagccacaggggauauacagucaaaauuaagaggagacccugagcuaaaacuggcaugcccuacucggaggaacaauuuaugcccacacauagauaaaacugcauguaucuucuccaaaugaugaauauuaaacuguuagaaacauagggagauauaauucauugacucauuuugcauaaaacauuucuuuuagcuuucaaccaaacauauagaagggauauuugcaucaucacaaguacacaggcuauuauuacauguaauuacaugcagacuuucaauacuacuaucacaaugguauuuauugaauaaaccugcagcauuaauaaaaucauauuuucccuggcuuuaaacccuacauggcuuccccaugcacuuacuauaaacguuuauccaaccccucacaucgccuccaaggcucucugagcccaucucuaccacccccacaccaucccaaccucuccagcccccggcccggccccaccaucacucauucugcccugccacacuggccuucuuccuuuguucuuugucucuugaacaagcuaagagaaaggcccuuguccccgcuguuuucuuuguuugaaaggcuuucucccgaaaccuccgugcaguaguuaacucuccgaucucaggucaaaugucaccccacagagggcccuccgcagccaccccagcgagugcugccuuucaccugcaaucaccauuaugcgccccgcacucacuucauuuucucuagagcauaaguauauuccaaucugaaauauauuguuuuuuuucugauuauccggaccacaaauauauaagcuccaauaagaaaguaguuugcuuccacuacagggucuagaacugugucugacacacaauagauccaccacaagcauuuguuacacagaugaaugcugugcuagaagguggauaaagcaaguuacagacauggcagccuacccacugggugcuaaugauugagaaacaaguggacaaauagccaagaaacacagaaaaaaaaauuuagcagcugcauacuuaauuaugauuaaguaaucaaaguuaguugaacauaucaaacgugaauaaauuauuaagucaagacaugucauauggaaaugcuaaugaccuaggcugggaaagcucucugagguuugagaaugaggaacuuuaugaaguuucuaacauggucccugcuauggcaccuaacugccuagaacaucagaguugcuuaauaaauacugcugaauuuugcaauucuuaaacuaagaaaauguuaaaauauuauuuuagcuuucuuagugaauauuuuuaaagaccacuugucuauaauucguacugauguuuuucucggcauaaauaccagauauaugaguaugaaacuuaaauaguagaaaaaucauccauggaugcagguaagacacaacccagaagaauuuuuuuuuuuuuaaacacagagaauuuuuuuuuagccugacaaauuucaaagaggcuuugcaagugcaaacagacuucagcuuuuucacauuccuaugcccagaaacugggacgugaaaaugccaggaacccuuucaauaacuagacuaugugauagaugcaggagaaacucuccaaccaccaagauuacuccuauggagcugccaaagaaccagaugcuuccuucaaaagcauaucaauuuggcggugaaaaacccuguggccucagcuccagucgggaagggcaggugggauggcauggugcaggaugccuguucccacuugccucagcaaccaucuucuucugacagcaaaacuguguuacucccaggcuugaaggcaugagcaaaauacauggcuuugcuauauauaaggacgggacuuggaaauauuuggucugaggccaugcaaaaugaauuccauacauggggagacuguaauaucgaaaaagaugaaaauaguuucacugcacuugaaauuuuuaucuucaaagaaauugaacauagaugaaggaaaaaauagcugcauuuaaaaaaaaaguuucauaaugcaggacguuagaaaauaaaacuuuuuuuaaccaauacauauaacaaagagcaauuguuuuuaugacugccaucuaccaaaccaucaacugugaaaucuuucucuuuaaucacgaguuuuuaaaggcucuauucaugugcauccauuuucacaaacucuugugaaacuagcaugaccuggcuugaaauaauaaacccaaaggguuucuguuguaguuguuguugaggcauuaguguuuuuauuuuuuuaagaaagccaggacuucauuucugcauaugaagcuccucgugguguucauccucacuuaaauuugcagccaaaauuauuuuuucagucucuuuaacccuggugggcccccugagagcauguguguucugggcuuuuguaauuaggcagcuugcaccugagcgucuccaucucuaguaauuagagcucaccgcggcaguuuccuucccagccgaucuggccauggggccaggaaugaacacauggaggagugaugaggguggugugcggcugucuugaccucuucugcaccuuacccuacuucaggauggcaggguucucaguuacaccaggggugccugaaaggcaggacccgcauccuccauucuacccucucagcaccgagcaggauccccucucguggaaaacagcucaccccguguauucaugcacagcuauguauuuugagggaaguggcucuuucuguuuucaucugucacuguccacuaagauacaaauaaagagaaaaccucugcaucucuaaaugaaaacacugaacguauucagaauagcuccguuucacaacccccuuccaucuaucuacccaagucauagagugcaaugaaccucaaugucuuuuuuucaagcuguuuuucauucuaaacaccuaaguugacuuuccugucccacugcaguagccaacagcuaaaaauaaaaugaauuucccugggcaauauauagaaaggcauacucucucacuuuuuuccuucgugggcuagacagaugcuugcugguucacuugccaauaaugaucgaccuggcacucgacugagccuucaaaacacuaaacauaucaaaggccccagguuaaccucugagauuuacuuuggaguaauuaauagguuuauaguccuuaaaauaaucuauggaugugccaaagaaaacuguacaacaguacuguccguuuagaggccccaucaaacaugggggaugucugauggggccucgaaauggacaguacuauuucuaaaccugggggauacuccacagcagccucgcuguccagcaagucagaccaucacgucaagcagacaugaagagagagaugggaacaagcuagggggauguggacaagacggcaaucugcuuugggaagaagagcaucagcccacagcaucuuuuuuaaucuuuccaacagaggcuccaaagcaccuccucagcccaaccagccucccugaugaaacucagggcuguggcuggucaggaagagaaaugaaaggaaggggagggggacuggccauggcaacagagguggggaaggggaggagggugaggagcuggccguuuuccuuaucaaguggucagugguagagaagacggugaggucacucagaagacaacugagcuagggagcagcugagugccgcaguuacuacccgccagcaacagucgcauguucaccggcgcucuuuucuucucguucugccucuaagaggcacagaaaacagacaagcaacugcagacuaauguacuucuuaauaagaacagcagcucccgugacugcguucucacccuaugucagauacucugcuaagaacugccuuaugucuuccccuuuaaggcuaucaaugaauauuuauuauuuuaagugagggcuuucaaaaauacaguugauccuucaacaacauggauuuuaaaaacugcauggguccacuuauuguagguuuuuuuuuuuuuugauaaaaguuacagcaaaugugccugccucuccugccucccuuuccccucccuccaccuuucccaccucugccaguccugagacagcaagcccaacccuucuucuuccucuucagccaguauacuccacaggaagauggaaagaaugaagaccuuuaugaugacccacuuccacuuaaugaauaguaaacauauuuucucuugcuuaugguuuucuuaauaacauuuucuuuucucuagcuuauuguaagaauaauaucuaucauauauuaacaguacauauaauacauguaacauacaaaaugcauguuaaucaacuguuuauguuaucaguagggguuccagucaacauuaagcuauucauaguugagccuuugggaagucaaaaguuauaugugaauuuuugacugcaugaggguuggcaccucuaaccccagagcuguucaagggucaacagcacacacuccugaguuccaagaauagucuaccacuugcugaucacaugaucuaaggcaaguaacucaaccuucaaaagaaaaccuuucuugaucuguaaaacaggaauaacagaauuaacaaugcauguaaggcauguacuuagcuggugcagacaaugauucugauaacagcuaauguuuacauuauccuauaccuacucuauagugcucacacacaaacagaaugaggcacaagagaggcccaguaauguguccagccccacagcuagucagcgguaacaucaggauuccaaccuauaagucugguaccagaguccauguucuuaaaccauuaaucuacgaugccucucaaguaaauagucaauaagugguaggugugaggcuguaggaaaaagaggagacgaagggacaggaaagcaguccucauuggaaaacuagguuucgacuggcacuguuggacugggcugcaguuuagguccucccacugcugaguucccucacuucaucuccuggugcuucugguuucccauuuauaaaaugcaagggaaggauucuauuuaugucacaaggugcaucuaaggaguaaaaagucacgucauguuugaccaauguuagucagaucaagauuuauuuuagauaaauuaucuguuaguuuuaauuaccaugacucaguuuuuauguucacuuuuuggucaaagcuaaauaaaauauauaaauauauaaaaucugggcuccaaccagacucccacacacucucagccaggcaucuugagcagguaccgucccucuuguccaauggcuguguaaaagugagggcaggaauccgccuugacaaagaaaguucaaccgucuaaacucaguggauuugaaacuauuucagaauaggauuucucagaaugaaaacaaaucuaugacuccucuuaacagccaaaaaaaaaaaaaucuugaaauaaugacuuuaagaguaagacuuuaaaaauacagaucuacacuuuccacuguaacagccacuaaccacauauggcauuuaaauguaaauuaauuaaaauuaaguuaaaugcuaagcucaguuucuuggucccgacggccacguggagccaauggcacccgugcuggauggcucggaucuagggccucuccaccgucgcugaaggcgcucuugagcagugcugagccacaugcuacguggacaagucaauuuuccuuuaacaugugcccaauguacuuuauuuaaaacacugaacuucuuauaauauuugucacuccuacauuauuccauuauuuauguaguccuucccuuuguuccuuggcucugucauaguggugacagaaggugaaugcaauuacugauuuacuuuucuaucuccccaaggagacggugaguuccagaacucgguaaaugcugagucuuacaauucucaaaggcacaacacagaccccguccuuauuacauuaccauccuacaccacgaggauaaacuccagacaaucugaauacaacuugaaaacauuuuuaauuacucaaaaaauaauccguaguauauauucucaacaauuuuuuuaaacaagauacaguuggagugauuaaaaucuugaguuaaaaaaagucagcgauuagcucuaagccaauguuuaggcaaugcaguaaugcuuaaguucuuuauucaaccauuaguauacugaugaaauucucuguaaggaguaaaacaucauguccucugugacaaauuaagcuacaaagcuguuuccucuguucucugcuuucuagcuuguauuaacuagugccauaaaagaaagccuuuaagauaauauuuauuugcagaaacaaacacugauucaaggcacuuagaagcacauaugugcaaugaggggaacacuugagggaauccuaauauuuuaucauguccuggauauuacugccguuguaccugcauaucuccauacucaucccacucucgauauuucaugucaagcucuacucccaaccaaagacguucugguguuauaccugcagauuacccacaauaauggcaccaguaaauaucacgucucacccuuugucagaacugucuaagauuacauaaacaugacauauuuuaagaaggaaugcaucccuguuguuuacaauguaacaaagauaaugccgugacaaauauccuaagcuauaaauaaagacauuuaccauuguacugcacuuacucaucucuggguugaacaaauguuaauuauagagaauuugaaaaugggacuuguuaaugccauuuuuaauuuagcauguuacaguguaaauguuuuccauuguguuaauuuacaccuguuaucacaagcuucauuauuagguuuauaguggagcagcucuccgugacucugaaauuugcuuaaaauggcagaaacaauuacuaauuagaagggcauguuuacuuuaauuauauuuauuuccuagucuaguuuuacauguaauguacuauggaaguguaugauuuaauuagugaaacccauuuaugaagagcaauuucucaaaugaguacugcuuacaaaauacaacagauucuuucaguguuucguaaauuccuugggugauauuucuacagagagauauccacauggaaaucuuucacucaugaguucagagcauuucccguuuuuguuccaaauacugcaauaauuaccaguaacaagaauucagcucuagaaauuuuuaaugcaaaucuuaauauauggugugcaaaauguagaaauguaugaguauaaucuuuaaaaaucuauaaccaaaauuaacaugggauuucuuuauugauguucacgcucacaaauuucaaauccuauuuuaucaaauccuacugacagucacacucacaaauuuaaaaaucccaccuuaauauauaaaaagcaaauucgguuuuuuaaaauaaaaaagacauggcuuuuuuccucucugaagucauuucucuggcuuccaaagcacaacugccuuuuguuuuugucaaauauugaggcacaguaacuaccaaugaaauaaccaauucaggcaaagaucauucugcgaaagacuacggggaaugggauauucaccuggucucaaaagaucaccccacaggcuccuuaaucacaaaaggaagaaagaaccuuauagcacagagaaaucugguggccacagccuuauucaugugaccauacaucccaccaaagggauagugugacaccguguacuuccuguggugccacaggggaaggccacucugucuugaugggauauucucgcaucuuauaggaggaaacaauuggaacugggggacauuccgcaagaccuagccuggacuuuucaagaugcuacaugucacaaaagacuuugaaaaagcuggaagacuauuauagauucaaaaugaggcuaaugagaugugacaacuaaacauaaugugugaucucuggcuagauuucggacuuuagaaaauaacggccauaagaaaaauuacuaagacaauuaaggaaaucugaauauaaacugugcacuagauauuauuauauucagguuaaaguguccugaguuacacuagaaauguuuagggauuaacuguagugaccucaaagagucuuucaaauguucagaaaacaaagugagagcuaucaagagaauguggcagaauggcuagugaaugugggugaugaguauucgcccaucuccaugacaccauuuuuuaaacuuuucuauauacuugaaauuuuaaaaaaucacaguugggaaaauauaaauaauccaaugggcagagugggaggucaaacuaggaguacuccucauacaacaucuuacaccccaaacuucaagaaacauuacugcccuauucugaauguaagcuuucuagcauuaauguuaaacccauuaaaauggcaguuacucggccaggcguaguggcucacgccuguaaucccagcacuuugagaggcugagguggacaaaccacgaggucaggaguucaagaccagccuggccaacauggugaaacccugucucuacuaaaaauacaaaaauuagccaggcaugguggcaugcgccuguagucccagcuacuuaggaggcugagacaagagaauugcuugaaccaggggugagccgagaucacaccacugcacuccagccugggugacagagcaagacuucaucucgggggggaaaaaaaggcaguuaugcuugcaaauggcuucacgguugucucucaaaauauuuagucacaacauucccaugaagcacauucuucacauugucacauaaacauucuuauguuuuauuuuacuuuuuauuuuugggauagggucuugcucugucacccaggcuagagugcaguggcacgaucauagcucacugaagucuugaucauagcucacugccgucuugcaguucaagacuccuggaucgaauauucuuguuuuuagaucccagaaagaauccaugccacagagcagccaagauguuucuuguauaaagacucaugcaucuugccagcuuaggugagaguuccuguacuugcugucuagaaaagauguaacugcagaguguguuucaauuuuaagauccuuacuauaagguccacuacacagcacugugcacaagugugcaaaaacacacuuucuuaaaggaaaguaaacgucagugcacguaggauuuugucugaccgagagaaauccccaagcacccuaaagggcagaucauuacccccucaucucccagcagucccugcuucacauuuccacacugccccugcagaugcagaugggcuugacugaugcaccaauuuccaugcaggagcugaugcugacaaccucuucuggggaugcugcuauugacuaauguggaguaacagccaacaagggaacagucccgcggaaagaagaccugccagaagaaugccacauuccagguucccugucucccauccucuccuacccagacagagaaacugcccaacaugcucuccgcuaauccuugugacugacacaaagcuuuccagcaaccuaugucguuuuuagaaaugcuggggaaguuauuuacaagaguccugauuucuccccacggcaaagcccauuucuuccaccucaaauagucauucagguagucuucuuuaaaugugguuauccugccgguuagggcagacaucaagccccuuuguuuaaaugcgcacccacucccaccccagcccuggaugaaaccccugggguagaccagcccuaauaagggagguaaaaaguauuuugaaagagagcuggagaauacgagcugagcccacgcaacggcucccaggaagaugucgaggggcuuccaugaagaacuaguuaaggcgggagcugaucugcagauaaaucagcagcucagcagcuuucaacucagucuucaaacauacugcucuugcaauguucugaggcugaaaauagauauucugucuccagaaaaggaagaauuaggaugaggccaagcuuguuaggagaaacaagagaagcugguauugaaccugauuagacaggagcaucuugcuaguccccuuucccaagcuguaaaaaguuaagaugaaaaaaaccagcauggcucacauuucuuaucuacuguuaauauagaguuuaaauuaaaacucagggggucucuacauggacagaugacuuguaaguguccgccucuguguguucacagauguacaacauacacuguguguguguguuucaagaagggacagcccagauaaagggagguuacugaagcaggcuaaguuucagcaaaauguaaccuucaccuuagaaaccaggaaccagaguaauuagauuacaaucuuuccaacacuaugggagagauuugaucaauuaaagccaagaucaguuacauuauuugguuuaccuaaguaauggacccuuaaaugcaaucaauacuucucuaggcugugagucuucaagaccugagaugcauucaaaaaacacaaauggauuuucaaagggccucgggauguucaucacaggcugaggaggaggacugcagaggguggggggcagaaggaaacagacaacagaccugagcuugcuguaugaagucuucauuuccuucccucacugaugugcugcuuucauguucauuuuguaguucauguaugaauuaaauuuguuuuaccaaagaaccuuaaucuagggaugagcagccaugucacucaauucauuuuaaaauugcagcauuaaaacucauuuaauaggauaaagaauacgauuaagauuucuauuuguguuucugaaaauccacaaaacuuacauugggaaguuacgaagaaaaaggcagaaguagcucuagaucuucuaccucgucccccaugccaucccuuccacaacauggauuuagggaaggacaaugacccaguaugcuugggacccagggccaugacccaguaugcuugggaccuaccuggagcugaccauauccugccuucuagaacuacccuggcuuagaguggauccauaacagucccguguuaacagcaaacuuucacaccaccuauacuccuuguccccacucuaugugcagggucugucuccaguccucccuuacccagacagaggaacugcuccacaggaacccaggaaaugcuccuggguuuagagauugugauucaacuugguggguccauuugccaaaucauacuguuuuaaagccuaaaaauaauguaucuguauguccagauagaacacugcccaggccacucucaguccauucacuaaugaggacuccugcaggggcagggcaggacagggcgcugcaccugcucacauuuccuccagccgccuuccccaguacgagcuugagcaugcgcaccugcaacaugugaggcucuuaucagugauuuuguuuaacacacuuguaauaauuagaaagugaagcaacuaauuccugacuuccccaagagcagggcuucuguuaaaagguguggggaaaugugacaagaggggaaguggagagggggaaauugauccugagaguuuacucugcauagcuuugaagucucugcaguaaugaugaagacaagcuaagguaaucuaaaacaacagguaaucaaaaagucauuuauguuuaccuuuuaucaucaauuaucuuccucuuggcagcaguugaaaaauuauguuuuacucaaaagucaggcuguugacuuuauuuauacaacacuugaacuguguugggugucagcguguuagccacuguggaauuucaaauucugcuguuugacaguacccgagaguugacucugagaguggucuucuaauaacuguauucuugguuccuaaaaugagauguuuuagcucagugccaagagugugaaaacacaugggggcauuacauuagaaaccugggaccugucaauuaauaucauuuuccuccaacaugaagaaaauacauccagagcucagucuucucauuuauggaauggggauaauaauguguagcuugccuuucauaguugucuuuuagaccaggaaagauaauguauaagaagcaccuagaaucaucuuugacauggggugggagcacagccuauuaugaugagacauaucccugaaaaagagucccuuugagugucuucgucuuuccggcugaaucaucugcugauucaagaagaggaggccauaugcagacagcacaaagggaacucccccauggagcuucagaugguagcccugcacucacuuaauuauucacgccagcaugaaaucugccugacaucccucuuccucauccucuugacagcaacagcauuaaaggauuaaguaguauuuggggcucugaaggggccugaagaguguuuguguacaaaaggaagagcucacaauccaaguacauaagacagcggacaucacuuggguuuacauugaccuccucuguaucuaggcaauggucucuucaaaaucaagcaccacacccccaauggcugcaguucuccauccugguuaaggccucuccuucugaggaaugacuucuuccauuuaacagucagucuaacccugagggcuggagagggccacagaggucauuaacacaaccucuacaccugcugaacaguguggcaggaagaacauagggcuguggagugagaagaccuaauaacccaagagcuaccuuggccacugaccaagugggggcaccuugggaaaguuacauccucugagacucuguuuucucauccacaggaugaggaaguugcauuagauggauuuucugugucaucuugcuugggccauggggugccacacauuuagucaaacauuauucuggcuguuucuggauagaaguaacauuucaaucugaguaaagcagguugcccucccuaacauggguaggccccagacaauuggcugaaagccagaacagaaucaaaaggcagaccccuccuagauauaagggggaaucucuuucugcuugacugccuugagccugcgacaucaguuuuucccugccuuuggacucaaaaugaaacacuggguuuuccuaggucuuaagucugccagccuuugaacuggaacucacaccacuggcucuccugcaucuccagcaugcugagucauucugcagaucuuggaacuuguugaccuccauaaucacauaagccaauuccuuauccuaaggauuuacguguauuguuuuccauccauccuauugguucuauuucccuggaaaauccuaauacaauccccaaagaugaacuuucauuucuaaccccuaccaaauggccaucugauccacuuguacaccucuuagagacaagacugcacugcucccuguggcaccucacccugcucuaagggcaguggaggucagccucuugggaagcacuaccccaggugacuccaaagcugaaccagccacauucccacccacaaagaguguuucuccaacaggugugauuugaccugagcagauacaguagaaauuuuaucccugcuuucacuguaauuaugucaauguaggcugagauugccuugguuguuauuguuggguuuuaucucguuuuggguuuccugguuaucacauacuguucguuggcucauauugagucugcaguuaacccuuaacucauuuucacauccauuucacuggguguggccaaaucaccaccugacacuucugaaagagacuuuuaguacauagggaaggccuuuauauuuuuuacuauaccaacaucaucuuguuaccuuagggccagaauuuuugcaguucuuacccugucaucuaaagaaccauguccaccucucccucugugucauccagagauuggauugcacaguacaucauuaacccucauaggaaacaggagauggcacacacgcccuugcugcacuccccacuagcacccucccuccuggccaguggucuccagcucugacuucacauuacaaucaccuagaaaucuuaaaaaaaaaaaaaaaagaaaagaaaagaaaagaaagaaaaaugccaggcucaaccucugauucugauuuaguuggaggggcugaggaggaaagaugcuugggcauuaguaagaaugcuuuaggugauucuaauguacagcaggcugagaaccaguguucugucuaggccagagaucagcaaacuuugucuguuaaagagccagaaagcaaauauuauaggcuuugcgggccaaauggucucuaaagcaacugcucagcucugcuacuguagcacgaaagcagccuuaaacaauacauaauaaacaaaugggcacaacuguguuccaauacaacuuuauuuauaaaaacaagcaacaggccauuuugccccagaagcuauuucauuaguugaucaaucuguucaucacccaguuuuaaaauaguugugggcccagcacaguggcucacaccuguaaucccagagcuuucagagucggagaaggaaggacugcuugaggccaggagaucaagguuacaaugagcuaugaucaugcacuccagccugggcaacagaguaagacccugucacuuagaacaaaaaaaaaaaucgcugucucucucucacacacacacacacacacacacacacacacacacacacacacugguuauggcagcaaauauaaacucaucaaacuguauuaucacgcuagucacaucucuccaucuugucugugacaccagagacucucaaaguggcuggcugaaaucaauauucacucucuauccggcauucccuucauguaucagacgaaugaucccaucuaaacaagaaaaagacuuguucuuagaggauccuuucugucucccauuacucacugcugccuuauuauauguucacaaacgucugcuuaauauugcuucuagaauuccucagaaacugacuuaagcucacccaucuguaguuuccaaaccaugcuuucccccuugaaagcugggacauguuugucaaaaucauuuacaaucuucuggcauccuauucuccuugauucacaaaauauuaucuaaagugguuccacaaucacaucugcaaguuccuuccgugcccaggaggcguaaaggcauuuuuuuagucauucucauuaucucuucuaucuuggguuuuaaugucuccuaaccauguuuauucuacccuuuccaacuuaaagaucauuuuuccugauaaagaugauaaaaucaaaauagaaguugagcaguucuguuuuguccaugucauuuguuuacucuauaccaucuguucuaaauaaggcuauguccuuuuuuguggggagugcuccaaauaguauuguuuuaaaacucuuauauacaggcaaccacacuuucugguucaccucaggcacucugguauauacugucugcccugggguaaauacgaauagaggccucuuuacucugaaaagugucugguuuuuugaacagcugguucaauaaguaaagcugaagaaaugguaaagcacuccacaggguucaugggcucucaggucuuccacacauucaagaaaaagagaaaacuauuucuguugaaaacuuuggccacacugggccaggcauggucacaccuguaaucccagaacuuugggaagccaagacggguggaucaccugagaucaggaguucgagaccagcguggccaacacggugaaacucugucucaaccaaaaauacaaaaauuagccaggcaugguggcgggcgccuguaaucccagcuacucaggaggcugaggcaggagaaucacuggaacucgggaggcagagguugcagugagcugagaucacgccacugcacaccagccugggcaacagagcaagacucugucucaaaaaaaaaaaaaaaaaaaaaaaacucuagccacacuggauucauauccuaggccugccacuuacuaguucuaugaccacaggauaaguuacccaaucucuuuaacucucagcucaacucacuggaaucucugugccuauuuaauacuaaaugcaugauuaaagcacauagcauuuacacauaucacaugauaaaugcucaagaccaauuaucauugccaauauuacuaucaguguuauuaacucccucaaccccuccacagcaacaugguaucugugacucucuauuggugcaguuuguccuuccuuuucagaaugucacaucuuguuuucucaccaaucucuugcuacugguuuaaacucaaugcuaccuccccacaaucucguaaagucuuucucaucuugacaaagaaaucuuugucuucacuagaaaucuggaauacuccaaggaaguuucuucucuggcaaagaagcaaccagcauuuauaacaaacauaauuugugagcugcucuggaaagaaaugcaaacguguauuccaugaaucccucagcaacugucuuuccuggaaucaagauaaacuauuauucuucaugguucccuugggaacacacucugaaaacuuaggagacugcaacucucaaauagcuugaguaaaucacccuagcuagaaaauaaaaugacauuaacuuucugagaaaaggacugacccaaggcauauucaaauaggggaaucauaaaagggaccacacaggagaaaaaugagugauagcuacaguuuuaguaucaacuacaaaaacaguaaccauuuacugaguaacuaagauaugccaagaaauggcauaccaggcauuuuauaaacaugauuucauggauucuucucaacaauuuugcuggaaauugaggcucagaggaagcacuugcccaagggacauaacuaguaaauggcagguacagcacuuaccacgggucuucugcacucuaaguucaagcucuuucagacauaccaugcuacguguauuuuuuuacugaaggugcuccaaacuaguuuuugagacaguuaaaaauaaaaggacaucaugaaaaaagcaaaaauaauauuuacauacauuuuagaaaaaaaaauauauaaacauuguugguuaaguggauagcagaccuuuaauuagcaauuuugaaugaugaaacagccacauaggugcaaugcuucuggccagggcagcucauuagggacucaguauccgaagucuuucuuuuuuuuuggauggcuagccauguauacacacuguauagccucuaccaaaauuacauaccacuuagcacgaaugcaagagaucccuuccucguacuauaaacaaaaauuaacucaaaauagaucaugaaccuaaauguaagagacaaaacuauaaaacucuuagaaaauauaggccuugauuagcaaaaccuucuuagauaugacacgaaaaguacaaguauaaaaaaguuuucaucaaaauuaaaaccauuaucaagaaauugaaaagauacacacagaaugggagaaaauaucuguaaaucauguaucugauaagggacuuguaccugaaauauacacugaauucuuacaacucaauaauaaaaagaaaaccuauuuuaaaaugagcaaacauucuuggccaggugcaauggcucaugcauguaaucccagcacuuugggaggccaagggagguggaucacuugaggucaggaguucaagaccagccuggccaacauggugaaaccccaucucuauuaaaaauacaaaaauuagccaggcuugguggugggugccuguaaucucagcuacuugggaggcugaggcaggagaauagcuugaaccugggaggcagagccuacagugaaccaagaucgugccacugcacuccagccugggcaacagaagugagacucugucuccaaaaaaaaaaaaaaaaaaaaaaaaagcaauggaucucaauagacauuucucuaaagaagauaaaugaauggcaaauaagcacaggaaaagguguucaacaucuuuagucuuuaaggaaaugcaaaucaaaaccacaaugagacaccaccacacauguagcauugggaugccuauaucaaaaagacacauaauuaaaaagucuuagugaggcuguggagaaacuggaaccuucauacaccacuagugggaguuuacugguagggucguaaagauauucuaaaauuauggugauggcugcacaacucuguaaauauacuaaagccauugaauuguacacuuuauauagaugagguguaugguaugugaauuauaucugaauauagccagcgugguuguuguuuuaaagaaaaugguauguccucauuucuuccaaauccaaggcaaguuagcaaaggcauaaugagaaaaagaggucuaauuuucauucagaggccacaucagugcuccaucuggacaaagagucagccaagaagccaacugccaggaguggaagaugaccacuuccaggaucuggcagagagacuuugcaagugccuuugaaagaggacaaugaaaauguaucuggcaugaaacacagcaggauccaaagaacaggcuuugauauugccagucaugaugcgugucuuuaagaucacagauaacguucuguguaacaacaaacacaaaaugccuaugacuaaguguauccuucugauccacucgugugcaguuagagaacacccaaggggucccacacacacacgugaaggggacacucccaacccaugagggaaacacacccuccauccuccuuugguucaaccccagccuccgagaacagguaauuucauaggagcuugcucagcucuguguuauccacaaacuugucaccuuuauagucacuugaagaaguuggaaaaauacagugaaaguccuggugcuacaacagagauguagccuaugccagauaagcuuuacauguguuaccucauuagucacucaacacagggugaucaucuuacaggaagagauacugaggcacaggaaugucaacuugccuaaggucacaaagcuagaaggaacaaaauagggcuucaaacccagucauuuuggcuccaaaggcuaugccuuaaccacugugcuaagcgccgccugcuuaaccgggcuaccuuuuccaccacaauuucucaucccuucugaaagauggucacagguguugcugaaauacagguaacacuauagauauauaucagcucucugagcuauuagauaaaugauuuaaauauuuauuuuuauuuaaaaauauuuaaaaauucuacuuaaauagaauuuuaaauaguuuuacauuuagggguacaaaaacuuuacaaagauagugcagagaacccuuguauaccccucacccccuggauaccccucacuugguuuauucuguuguuaccauugacauuacuacguacaucugucacaaugagggaggcaacacugguaugauacuauugacuacacgcuacacuuucuuuggauuucacaacuuuuuuccccuuaauguccuuuucugucccaagaucccaucccacuacguuuagagcucauggcuccuuugccuggccuggucagugacacuuugcucagacuucccuuguuuucgaugacguugauggucuugaggaacacugccaggcauuugguaaaauaucccucaauguagguuugacugaugcuuuucucacucaucacuagacccagauuauggguuuuucaggucacagagaugaaacauccuucucaccacauccugucaaggugugacauagucgaugugaacugaucacugggaugagaaacuguuugccagguuucuccaccucuaaguuacuuucuuuccuugcccuagugugauguuugaagcuaagucccaaagugcagcccaugcuguaggaaugaggaguuaagcuccaucuccuuaauggggaguaacuauauaaauauaaccuuauuuuuaaugaugguuaauccguauggcauuaaaaaaaauaaaacaacaugccaagugacaguguacggcccuucccuauuguugcugacucugcaguggcuguaauggcuuccugaucaucuuuaugucucagaaucacaggagguaagaagcacuaucuccaaggugacaaaaaaguaaaacaacuggccagcauggaaagagggaaguccauuccauucuagaugauguuuaacaaacaacaggagucagagaaaggagaaaaaacuaucccaugauggaggcaacacaugcugcauguuuguaugggcagguauuaaacuggaaguuucaaguaaguuuccaagcaaugacagauauaaauuuccaaagugaggugccaggcucuccaaaggagcuuuucaaaguuaaugugucauaacuagauucaugauuuuuuauaccccgaccuacucugagugagaaacagaagucaacagagaauuuuguuuuucuuugagggggaaaaaaagagcugugcugugauccccuccaccaucaccaaagagauggguagcacaguggagggggggggggugccgacucucaaguccacugacagaggcuucaaagcagaaaugcacagcacuugauauaauuuccguagaauuuuggaggccugcuggacuggcagcugguacacagcuaaaagauagaggcuagcuaaaauugcacugggaaggaccugaacugcauucucccucugaaguggaggaaaggcaccuuaauuugggaagccagauguagaauuuaugauggggaugucgaccaaggucauccugcccaagagauuucuuccagggggucagauggacccagcagggucuggaugaggcagaucucauaaaaucagaagcugcgagcaaugugggagcaagggaaggcaaggcugccagaguaagguggcugcaguuggaggggcccagcagaggagcacacggagugcccauguggaaggcccuuuaaaaccagcucaggcuuccagaaguauggcagacuaauacucuuguuguuuuacugucuaccaguaaugaaugaaugaaaaccaauuauuauuguuuuguuggguucagaggaaaugaaaaaaaaaugucuacaggggcaaaaaggaaaaggaacaaacaguaacaaccaaaaaucccugggcagugagccucagaaaaggggaacgguccugugaggacauguggugaucucacgugaucucugggaggcugggccucagcucuguggcugggugggggaacuaaacuaaaauuccgggguuacauggcagcaucuggaaggcaauggaauugucucaggaccgcaguacccccgcaggacagcagcacccuaugacuacuggcaaaagcaaaagcaaauacucugagaaaagcauccuugacuuaggccccaagacuuuuucuacaauuaggaucaaccaaauaugagcuagcaauuaagguuuacuaaacagacagggaaacgaaacaucaggagugagagaaagaacagaugcaaagugccaaggacuucagaugcuucaguuaccaaauacugacuauaaaauaacuacauaugaaaggcuaaagaaguaaaagacauaaucacaaaaauaaauaaguaacaagugacuaucaaaaaugaccaggcagggcugggugcaguggcucacgaccguaaucccaccacuuugggaggccaaggcggguggaucaccugaguccaggaguucaggaccagccuggccaacauggugaaaccccgucucuacuaaaaauacaaaaauuagccaggcgugguggcacuugccuguaaucccagguacucgggaggcugaggcaggagaaucacuugaaccugggaggcggagguuucaguaagccaagaucgcgccacugcauuccagccugggcaacaaugagcgaaacuccaucucaaaaaaaaaaaaaaaaaaaaaugaccaggcaguuucagcuuugcaaacugaaaagagcuguggagauuggcugcauaacaacgugaauguacuuaauauuaacugaacugcguacacuuaaaaauagcgaagauggugaauuuuaugcuauguguauuuuaccacaauuuuuuaaaugacaaggaagauuuuaaaagaacuaaaacuuuuuaaaauaaaaacuaugauuauugaaauaaaaaaauuugcuagcaagauuauacagcauuuagucaaagcuaaaaauagaauuagugaauuggaaggaagaaaugaaaaaauuaccuaaaaggcaauacaguaagacaaggaaaugaaaaauauaaagaaauguuaaccuaaauggagaauacaaugagaagguccaaaauaugucucaucggagaccuagaagaaaagaauagaaaggaaggaggaaagggaauauuuaaggagaugauaacugagauguuuccaggaguguuaaaagacauaaauccacagauauacuaaucaggguaaaugaaaagaaauucaggcugggcgcgguggcucacaccuuaaaccccagaacuuugggaggcugaggcggguggaucaccugaggucaggaguucaagaccauccugaccaacauggagaaaccccauaucuacuaaaaauacaaacuuagccgggcaugguggcaugcaccuguaaucccagcuacucgggaggcugaggcagaagaaucacuugaacccgggaggcggagguugcagugagccgagaucgugccacugcacuccagccugggcaacaagaacaaaacuccgucucaaaaaaaaaagaaaagaaaagaaaagaaaagaaaagaaaagaaauucaaucuaggugauugucauaaaacugauaaacaacaaugauaaagaaaagagauguuaaauugcaacaaggcccagaaaacacaaagccagcauaugaccagacccagugagaaaucccuucuauuucuuacuaucaccuaccccuccucuacuccuuuucuccccagcauucacucaaugagaaagaguagcuggagcggguggggagaguaucaauaugacacuaaaccuaccuccucccacauaaucuggauggaugccuacagccaugucuucaaugggcaaggaaagucuuacuuucgcauaagugaaauuucugaaguucucauuaacauauuaauauucuugacugaauaucugaauugcuacuaaauuaagaugguguguuuucaacuuaacacaacuguccaauguaggaagaaagagagacaugugaguuagccuuccucaacaaaaagcuugugauaaauuccuguuaccuaugcauugcaaguugcagaagaaaccaagucuaucucucaccauuugcuuucccagggucaaaaaccacaaucaucuugauaaacaaggccuaugcaaauacaaaaauacaucgucaugcagcgauaauuucaaugccugcacucaccuccaucccauuucuaauaugcaacguauuaacugccaacucauugugaaaagcaucuacgcuguucucuuuuuuauaaauucuauagauucauuaugauuagauacucuccauauacaucagcuagccagaaaaggggaggagauaaugaauaauacccaagggaaggaaaaucccuuuuucagcugguuuaagucaugccgauaaugugcacacagcacuaugcauuuaccauaaagcuuuucaauuaguucauagacaaguuaaccuucuaacucccagaaaauauaauucacgcacauuuuauaccacacagcauccugcuagcuauuauccaucauuuacaaguguuauuugucuauaaaaaugacacuaaaguuuugaaaaacgaggcugcucugccuucuucuggcuguguuuuaacaaaugguaucaaugcaaaaggcuuauaaaaagucauauaaaaagcaauuagucaaaagagcaauaaauuuuuuuaaaaggauauaaaugacugccugucuagauagccaaaugucugaaggcugauacacaaugaaauaaggguuaacauaaaagaguacacuucauuauuuauuguuaauaaaguuaaucaaauucaguucuucuuacgcaugcauuuaaacagaaacacaaguacgauaugcauauuuauagaaaacagcccuaaagaucauuaucucuaaaagaaaauccagcaaaaagagaugcauaaaauguagcuguuacccuuuuacaacauaaacuguuuugcuuaaaacacaaacauuuauuuuaaguaaaacuauuaaacuaaauaauauuuuccacaacugacaaccaugacuaaaacaugaauucuaggauuaacauuaaaauaauuuugggacagagggaaacagaacccuuccauuuuucuuuugcugguaucuuauccaccuacacuaguuuuguucuuccacucaaaaaucuauucucaaaagauauauuagaaucuuuuuaaaacaaaauuagauaagcauaagcucaucaaucagcaauuucuaaaugcauuaucuucaaguaguuuggucuuuuaugucacuuaucugcuuaaaauuaaguauaaaagaguuuccaagaaaagaagauauaaaauuaacuucauuucauaauaaguucuccaaucaugccagcagacagcugacauuauuacagcucacacuuauaaaucagugauuauauacacuaguuaagcaagaaaagaaaugaagaaggcaauuauauaguggugaaauucccaagaagcacauuuguagucaauguugcuaaacaguaguucacucgugguuaaaauaaaagcccccucccccugccagauauuuuugggguugugaguuuugaggggaagaaaguagaaacucuaugcaauuuguuuuacaaauaaauuaaaaagccagcaagaaaucaaugaacuguaauuuuaacucauuuuacuguuuacuuuggagcugaauucuaaaacuuccauaugacauuaagcuauaaaauaguacugaaucaaacggagaguagaauacuuuggaggaaggggugguaucugaauaucuauagacauuugguaaugaacgagccagugacgaaugaagacacagggaacugagcugagcuugguuuccacacccucuucuguucccugccacuugaauaagagccaaaaugccacuucuaaucuuauuuuccauuucuuaaauguguuuuauuaacuccucuuuuauugcaaagcuaaauauucuaauuggcacauuauagacauacagcuacuagaugucaauuacacuuuaauguguuuguaaugcucugcagcagugagguucuggcagacccagugaggucccauuuauuucuucacuuguaauaauggcaugauaauacaaccugaguagugcaucagaacacaguaguuagcaucacugcaagagaaacacucucuuccaucuuaguuauauugcuuugaagaaaucagauauccuuucuacucauucaaaaggagaaccgaacaaugcugauuauuccugaaggaccuuuugauuuucaaagcauuugcuaguaaucuguuaauuaauccacgcagccccuccgcaaggaaaacuagaggagaacugcgcaauacuguacuaacauuuuagagacaacaacaggaggggacagauauuuggagaaccugacaaaagucugagagcuucuacaaacacaaccugcagaaaaugucacuugauucauaucuucaacuccaggguuaugcccugaaggaaaugcacucaugaugaugugaacugcaauucguggacuuguaucuucaucuaaaccaucuuacccauaauucauucccccuuaccuagcacacuuuaagaucuguucaugcuuccacauaguuaaaaaaaaaaaaaaaaagguggggggaggguguaguucaaaagacagacagauaauccuaaaccccuuucgucccaggacuuagaaagcuuauuuuuuccaguccaauauacagccaaaggaaggagcaggauaaucuacaagggaaagugccucuuaucuguuuccuuccugagaacaaauggaccaagcauacagaugugaguguacacaugugugcacacaugugccccucucaaagugcaucugaaguaaauuaaaagaauccuuucugagugaucagucuguucccugaaaggucagaauuuucugguaaauauuuuuuauaacuccacccugucuaaacagcaacaacgacaacaaaaauuuuagcuaaaagcaugcuugaagaagagucuaaauuccauugauaagccaauaguggcauuaauaauaauggcaauuaauaaugcacacuagcaugauguuguuuucuguagcacauuuuucuagauaucuuaagacucucgguagcccauauuuuuaucaucccucuccaugagguagggcaaggguacuuauuaucccuauuucacaagagaacuauguccuagaaaauuaaaagacuugucuaagcucuaaacugguaacaaggcagagacaugaauuugggucuccaaacucucugcuaacuaaauaauggcccagaagacauacaaaagucaacacaaacagagugccagcuguuauuuacacugccuacaauaaauguuuguuccagaaaaaauaguucaaacaagaugagaaauaguuuaaacacaaaaggcugaaggguucaauauaggagaaaaaauauguuugcuuuuaauacaguggaggaacuguucaggaacaguuuguucuucuguaaaggcuggccuuguuguacugccgaaggccgcaagaucacaagcuacguggaauugagacgccagcucgcuucggcacaaccaacuucucucuuaaugcucuaaguuccugucuucuucauagcuuugaccugaaccaugaaugaucuuuuugacaaacaaaauuuaaauguguguuauaaacagggagcaaguguccuaauuuugauacagggugcuaagaaauacagaaaacaaaggaaauuaacugggagauccagggaggcuaagaaacaaucugccacugggagaaacagccauagcuucugaugagcuaggaagauuuugugguugauaucacagcuguuuguugaggcuguggugggauuucuuuuucaagagggugaagggagauuugaacuuggcgccugacacaauuauccuaaaguaggaaagccucaguuggaagaggaugaguuucuuuaaauagcccaaaggcugugaugcguaaaaaaggacuugacuuauucuggauagcuccagagggcaaaacuagcaaguggccagcaggaacacacauacucagaguagagcagagcuugcuaauaauuaggacugccucauccauagcaaggaacacucagaggcucaucuccucugaacuacuuccagcugggacucccgacgcccaccaucaaggaugcugggagggaaaucccacauuaguaaagaugauggacaagauaaacgcuaggacucuuucaacuguuaggauuugagggugauuuucaagguccccaugacagucacuuccagacuaugagguggagagucacacagaacugagucccaaccucaguucuaucacuuuggguauuuuuuucuccuuagaugguaaccaaaccuuguauuuuuuaaguuuucuuugaaguucagggguacaugugcaggucuguuauacaguaaacuuguaucauggggguguguugaacagauuaucuugucacccagguguuaagccuaguacucucuaguuauuuuuuuuuuauccucucccuccucccaaccuccacccuccaacaggccacuaaaagaacaagaucaugcccuuugcaggaacauggauggauuucuaucauuuuuuuuaacugugugauacugaguggcucugccacccaagugugaccuccaaaucaagguguuuauuagaaucaaauggggaaacuacuuaacucuaaagauaaucagaucuauaccccagaacuucaaaaucuuacccuccagagggggguccaggaauguccauuuuuucccaugaguugcuagcaguccaauuuuggaaaccaccaauaaacauuuuuagccuaugaauucauuuguaaaauaggaaacaugauaguuuuugccuaaaugagucauggagauauuuaaauaacacguaaaauaccuaguaugaugccucuaccuagaaaacagucauagucccuuuaaaaaacauuuucugcaauauaugaucaagcuuaagagcauucacugauuaaaaaugaggacagaauggcuuacauagaguuaauguuuagccaucuccuauuuucuugccuguuuuuuaauccugucuuguucuucaagcaacacaaaaucagaaagaaauuugauacgauauaacuugaaucaguuuaaucaaaugccuuaucuaugugaauaaugccuuaaaauuaauguaucaucaacacgcauuuaaaaguugaaugcaguaauagaaagccuaugauuuuuugcucuuuuauaauaaucagaagcuccagauauaaacuccucacucaaaaaaguuuaaaauucauacauaucuccccauucucagguaaagauaaaagaucccaugucucuucuccucuguaucacgcaguuacacucacuccuuuaaaauccugcaagguauugaaguggaagaaucauccuguccugacauuuauaucucuacaaauggcuucaguucuuuaauugugaaguugcuucuacacauuagggugaguguuaagauacucccagacagaaaggaagagggaagguaauuggaguaauuuguaucaagugaaaaaagugucuccuggauuucuguauuccuaguugcaaguuauuagacuguuucuguuugggugguuuuauaaaaaaaaaaacuguaaaacgugguugcguaagcacaucuaaagguuaaacuccaagcagcuaaucugcaugugagaacaaguaacugucaaacauuuaaccuuuugcagauuaaaaccgucugacuaacagaugugaaaccaucguugcuauaauuguuagaaguagaaaucugagcauuuuuagaagauacaacacuuuuuggagcagucauguuuaugcuccaggucaacuuuccuguucaugacugagaugcaaucauagccuuucauuuauuuucacacugugauucuccugaauuauuauacgauguucauaguuuauucuacagacaugcucuuagaaaguuauaaguugaauucuaaucgucaguuauauuugcacaccguuucauacaugauaauuuuuuuuccauuaaaacacuuaguuuucuuaacaguacaugauaauuuuaggaaggcauuagcuucauuuccaacugauccaaacuggccauggcuccugaagauucucucuucccuuccauuucucuacgcucauuucugucacauaauuacaagugucagcucaugguagaugcucaaccaagaucuguugaaugaaguaauuaucuuuaacaccuaaaagaucuacucccugaagacauuuuuuucacgaaagccuuuuuuuguauugcaaauugccaucucuagugaacuugcgugauaauuuuuaauuuuaauaaaugagauuuuucuuauaauaggauauauuguuucugguuuucaguauuaaaauugcugauaggaaugaacauuuuguaauauauaaaaggacgugacagaauaauacuguagcuaaauacuuauccagcacaguguagauacucaaauauuuguuuaaaauuacucuacauuucagaaguuguggcauuaaaacauuugacuugaaacacacugcaauuuaaugcuacauuucuucuugucaaccagggucuaacaguauaugaccuguuucuaagaagaaauagaauguaugcaaaagcuuuuaauucuggaaaugucaucauauacaauagagaaaaaaauuuaaaauaaaaaugucuaauacuagaagaaaucugagauaucuuuuacacgaaaguauaaaagugacaggagggguucaagucuccgaauucugagcuuuuuaugugaauagcauauaaaacaugaauugugaaauauacaguagaccaucugugaguaagaugacuccaugaugccauacuugacaaacacggacuuagaucugaaaaacacacaaagcaagcauccacuuuacccacgaaacacgucgggagagaggaagugugguucugugaggccccuggucuguagaaagaaaccaccacgcucuggcuccugccugaagcugcacaaaugagcuggcucaguauuagugucuucuuuuaaagguuagcaccuuuaaauugcuggcauggcgauuggugggagcuagaagggguaccccuaaaaauucuucgagcaaaaccguaaauaccaaauuacgacauaaaggggcugcuacuuucuuuacaaaaccucggcuguggcuuguuucuccuccgugaaucaacugucuuuuuccaacaaagacacccacuucaggguuucaagggauaucuauucaaggcacguacuguacagcauaugugguuaucuacagguaguacagccuguaaaccuaguuugcucaacuaaauagcauuuaucauguauuuuuaugccuucugacaucugcuacuaaauacaaacaaugaaagcaucuccaaaaacuagagauuucuacucuaggagaugugguggcugguaaaaucaccugcacuuuaaccauggaacaagacauuuccccuccccauguccagcccaugcccagacuguccucuaaaucagggguccccaacccccagaccauaacaguccauggccuguuaggaacugggccgcacagcaggaggugaguggagggugagugagccugagcuccaccuccugucagaucaccggcggcauuagauucucauaggagaguaaacccuauugugaacugugcaugcgaggaaucuggguugugcucucuuuaugaaaaucuaacuaaugccugaggauaugaggugguacaguuucauccugaaaccauccccacccucaccuccucguccauggaacaacugucuuccacgaaaccggucccuggugccaaaaagguuggggauuacugcuuuaaaugaacccuuggccuuuaagggcacaugcugcacaccuggagcuggacccauggagagcugauccugaguugggcuggggcaggcuugcuggccgggcuauaccaugagcuagcugccuguccuacugguaaagccugcaaccccagagaaagugcccauuucagaccaagaagggaggugcucacaacaaacggaaacaucucugcagucacaccaagagcugcacccuuguuccucauguguauuaagugcaggauuaaugccaugaaugcuaggaauccaccauaucacaaacacugaccuguugggucaaccaguuuccaaaauaaccucauugcuguuucuucucguuuguauuuuaucuuugccuuuucaccuucauuucccucuuuccugccaucccuuuuaccuuaacugaguucuuuguuuccuauuucuguccccauauuaaaugacuuggcuaguucacucguugauuaaaauacgaagaaguuauuguuggaaugagacauuguucacugcaaugucuuuuuucgauggagaacaagauaaaggccaacgcugugagugucaauguugaggacagguucccuaacuucagccucagaggaucuucccaugcuguagucuaacaugcuguuacagguugaauugugucccugcagaccccacaauauucagaugcugacauccuaaucuccaaugcuucagaaugugacuuuauuugaaaaugagguuguugcagaccuaguuaagaugaggucacucuggaguagggugggcaccacaacccugugugacugguguccucaugaaaaggggacacguggacacaggcaugcacacaggcagaaugcccagaaaacaugaaggugucgggugauacauccacaagccaaagaacgccaaagaucaccagcauccaccagaagcuggagaggcaugaagggauucucccucaccacccucagagggaaccagccuugccaacaccuuccucucagccuuccagcccccaggacugccaggugacacacaccugcuguugaggcuguccaggcugugggacuuuauagggcagcuucaucaaauuaauacauaugccaugcauuuucucugucuacccugaaauucaacaaaauguguuauuuggucaaauaaaaugaaacacagagcaccaaauaacuaagacacuaaccucuuucucaaauaaaggcaaguucauauaucauagucagaaguuaaaaauuaaaagaacaauugucguugucuauaaucuaaagguugcugucaagggcuuuucagaugaccucuucauaggaauccuguuuauucuuugccugugaaaauuuuguguugcaccuaaguuuaaaauuguaaauaaggaaccuaaugugcaaaaugcaacacuuuacuucauccaugacuuuacggaccugaauaagagacuaaugaaaugagaaauuguuaaauuacaaaaaacaagaacacgugaucuguauaauaggguacuauaaacacagucauaucagaggaacuaaucucucacaagucagaaggagacugaguagaaaacugcgaacgaccaccaccccuggucccuuguuguaacucagccacggacccaaugcugaaucgcugcaagccuugguuuccuugugugcauccgucaggugucucaggcaaggcugcccgcuccacugucucccgaucuaacggagcucaaugacuuugcugcguuuuacucugcugaccccucacuccuuggaauuucccacuuccugagcuccuggacuuuucugccuccuggcccuccuccugcucuguuccuccuccaccuguccaaaguauuccucaguacccucuuguucuugccacucucuguguucucccaaagggagcugguccgcuauuucccugccugcauguccaacccugaccucucgccuaccaagagcagucucuaggacagcagcuauguuaauaaucaugauaauaugcuugcacuuacguauauuuauacugugcugaacacuacgauuuuacaguggauccauacaguaugaagcaauaaggugacuuaaaaaaugguuuguuaauagauuaguuucuuuaaaaaggucaacauaucccagcacuguuuacagaauucuuugguuuaacaagggcuuuuaucucauuuuacuuggugaaaaguuaaagcccaguuugucucugaauucuaaauuagacgguacacaauaggcaaagugcuuucaauugcauccaaggugaggaugugcagguccuuccuaagacucaacacccaguuagagauaauggacaaagccccagccgagggcuuauugaccuuauuuaugccaauaacacaaacucugacucuggagaauuaagggauguuggaaacagucacugccacuuggaggucaauuaaaguccaccuuugagcacugguggagaggaggcaggaagccugcagagauaaaaguauccuaauuuaaauguuaaaaggaccauuacaggaucuuaauuccuucuagcaaacagagcauguacuuagaugacaaugaguauaaauacaaccacucuagaaagaaaagacaggagcucucugcuccaaagaguauuacagcuuucacaagaaggaccugagcuaacuucucauguuuguaggugggcgaugggauaaguuugcagaagacccauuuacggggaccaugggcaaacagaagcagaccaugaacuaaguuaaaauucaaggcccccagguaaaccagggcaaacaucccugacuccccaauccaccucuucuaaaacucucuuaagaaacaccaugaucagugucuucauuuagcaaagacgucuucaagaaccacagcucguguuuggggcaaucauuuugcccccucuagugagggggcauuucuuuauauuaaagcccugagaauuaaagaaaaacaauaugcagaaagugcaacaaauuauuauccaggcugugugcuucucuuucucagaacauucuauuaagauucuucacuaaagaaugcccuuccacagagcaccaccagacaagagcuuggagaauaaguacuuauauuuccuagaaacugucagaccagaauaaucccauuucuagaaacggcaacaacaguggccaaaaaaacuguuuauuagggaaauaauuauggaaauuucacuauaauuagggaaaaucucaaauucuguauuuuauguuuccagcuuuuacuuuuucugauagguucuggccaaauucccagaaugcauuuaucugaugaugucucaagugauggcaaacacagaauauuauauuucaguuguuugcacugcuuguuucuccauaguucccacccucgaugagauguuuugugccuuuggaggcauagugcuguccaaaugcuuuggggcccguaggauggagcuuggugugaccuggcuacuuaagacacagccacacccaaaggcagcucagauucuccuuuaagacccuggccagugucucucugccauuccagguaguguuaaaucugguuuguggacagguuagcaugcaaagcaaauuagaauacaaaaaugggcugcagacauguaaaugucucaggaaccaagugaguuuccucugaugacaugaaugucuacgucaaaucaggguauggaugcagagcagcugguguucauggugaaaaagaugugacucaagugccacugacugcuucucccgaacucugccuuauccucaauuaugucuaacuacaaaccgagauaucuucuuaucuaaugcagugacaauuaaaaugucacccuugagauaguaagaguagggcuucugcugcagagaacucuaaagacagucaguaucacauucagacugugugcaggaauuucuuccccacagaggaugugacaacuucccagggcuuuaaaaaagccucgauaccugaaaguaaauacacgucaccccaacauggaaggcaauguggucacugcaggugaacucucaaaauguaaaaccuaauaccucaccaaguugccuaagagacaggucucaaaacaccuauggcuccagccccgggaacccauuucccuuuuccucugcaccacugaguccaaguaaacagcacacucugcuucugaggacacugagguugacuccauucgagcugauaaaacugccuccccaacauguaguucuuuuuccauuuucuccccuuuuuccuuuuaauaaauucccugcugugguacaagggaccggaacaguaaagcugaaagucucucauuaauuauaaaaaugauuuaaucugcuggaaauauuuauuuccagagagggaaguguggugucccagcucuguaaugcuaucaacguuauguaugugcaguaaguagaagaauggcuccccaaagaugcccaccuccuaaugccugcaaccucugaauguguucccuucuaugacuuaagagacugugcagauguaaguuaaagaucaggccuggccaggcacaguggcucacaccuguaauccuagcacuuuggaaggucaaggcagguggaucacuugaggccaggagcuggagaccagccuggcgaacacagugaaacccugucucuacuaaaaauucaaaacguagccgggcaugguggcaggcaccuguaaucccagcuacucagggggccauggcaggagaauugcuagaacccaggagacagagguugcaaugagccgagaucauaccauugcacuccagccugggcgacagugagacugucucaaacgaaaauaaaacaauuaaaauuaaucuuaaaaauaauaagaucaggcccaagguagucgcuaaggcccuucuaagcaaaagaaggagcaggaagguuagacaagugagggccagagugaggagguuguuggcuuugaagauggaggauggggccgugagucagaauguggagcuccucuagaagcuggaaauagcaaggaaacagauucuccccuagauccuccagaaggagcacaggccugccaacaccuugauguuagcccagugaaacccacuguggacuucugauuuucagcacucuaagauaauaaaugugugcuguuuuaagcugcuaaauuugugguaauuuguuauagcagcaaugggaaacuacaguaucuguuacuuccuccuuccugaucuaauccaaucuaggaguuuggggaaguggagggaggaaaucuagcuaauacccaaauucucuuucucuacuauuuccacuaccaaguaucuguuccauuaucagaaacuaaccaagugaugguuuauuuaucuggaaaccacucagcaucauagaguuuuuaaggcuggauaaacuagaggccauuuaagccaagccucuaauuuuauccaagagggaaagaaaaaaaagaaaaaaggacaaagaaggguucaaggaaugcccuuggacaccaguuaaugggugaauuuugcuggcuuucuaauccaguucucuaaauuucucaucucuugcuaguauugucgacaacucacuccuucagaagcauucuuccugcccuaagccaguucccuuggcaaauuuuccuuuaaaaugaauauuucaauuaguaaacuacacauauuuugcauauuccaacuagaaagcagcacagacuggccagcaaauucaugccaagcuagacuggcucaaagagcuucaguucauaugacaacauccguucacaggcucagcccagguaccacauuaucaaagauugaaauuuugaaaccuggugaauucagcuucugcugaaaugcagaagauacuguaagcgaauauacagguuugucaaggucuaugaauuucauccaaaauacuaaggagaguuuuuacuacccuaaacucacagcuuuuacagggcuuguuuuuauuuauuuauuuuuuugaaccaaaaucauagauuuagaguuggaagugaccuuugugaucauuauuucaauccuuucagagaauucucucugcaggaauaucuauguaggacuuggauuugacccaagcacauacaaugucucagagggcucucugcuccuggccaagagcaucaggucuuguuuuuaauauaaucaguguuguaaauuauggcacagagaacaggcucauucagcuguggaaugaacugaguuaaauggacuuguaaacaucccuaaaugaaagaauuaaaaagucaaaugaggaauuauauagccgucccuugguauccucaagggauugguucuaggaccccuggggauaccaaaauccuaggaugcuaaacucccugauauaaaacggcauaguauuucaauauaaucuaagcacaugcucccauauaccugaaagcaucgcuauagauuacuuauaauacuuaauacaauguaaaugcuauguaaauagcuguuauacuauaguuucuuuauuuguauuauuuuuuauuggggcuccuuugcugaauauuuucuuuuuuuuuuuuuuuugagacagagucucacucuguugccuaggcuggauggagugcaguggcgugaucucgguucacugcaagcucugccucccagguucacgccauucuccugccucagccucccgaguagcugagacuauaggugcucaccaccacgcccggcuaauuuuuuguauuuuuaguagagacggaguuucaccguauuagccaggauggucuugaucuccugaccucgugauucgccugccucagccucccaaagugcugggauuacaggcaugagccacagugccuggccuuuugcugaauauuuucaauccaaguuugguugaauccacagauguggaaaccgcagauauggagggccaacuguaucaugucaaauguaauuaaguuuuacuuacacaguaguauccugaaucuaaaauuaauuaauuaguuaaagccaacuagaaacuagcaaacuagaaaacagauuucaagauucucaacuagguuacaaacuccuugagggcagaugcugucuaaacauacuucucucucuugccugcugcaccuuauuuaaccacaggugcacaaucagcaugggcugaauucaacugguauacacaguuccugcuuagcucccagaaaugaaucuagaauacauuuccuaggaaucuagaaauaugaagcaauaugaugaacuguacuuucuuguggccccccaacagaacucacgcuuccccagcucauaaccacuugcagacauaauuuaaauuuguccuaauggcccagauuccuguacaaacaccagauuccuguacuaguguuugcuccuuggucugaagcuuauuuuucucaggguacaagaaaggucugaugccgcagauguuauaucugcguucugggucaauagacucaccacacaaaaagaagaguaacucagccuccuugacgucugauguuccucaagugccuggccaugaagacagaacuuccugaucuuauuuuccuugcucuuaacucacuauguauuucacugugacucuugucacuaucacuucagcagaguucaucacacagcagcacuccaguggccuagcucagacacugcaaaccaaccaagaauaagaaccagaauuuacaguuuuuuaagagaacuguacuauccuuuagaauagccagagccagagugaacaccugcuuugcugcaaaucagaauggcaugguagaaugacaucaggucggaugucaaauucaggcugaaaccuaacuaugccuugguuuccuuguauguuugauagaggcacugugucugcugcauuagguuauuaugaggacuagagagaauauagguaaagaugcuauuauuaguaguuagauguuuauuguaauuuuguuuagcucugucaaagaauauuacuuuuaauuaaaacguuaauauaguucaucuugaagauuuucuuuuuccuuacauuuuuaucuggggccuuagcugaaacuaaaaacaaacaaacaaacaaacaaacaaaaacucuaugcagauuugucaccucucuuauaaaucauuuucauuuuccugaaaccuggagacaagaggcaaaaugaaaccuaccaucucuucuaaagggagggagggaggaaaggacagucuauuagcaaaaaaaauauauacauauauauuaaggcaagacuccagaaaaagaaaaaacacaggcaugaaccaagcacuaaccagugugccucaauguuuuacuugagggaaaugaucuguauguugcccccacccccggccaggaugcagccaaaggaccuggauagugaacucugcacuucucuaaaaaagauggcucucaagaagguggaaaccuaggaugacagccaggaaaagguuggaaccagagguggggucuuuauugggcugggagcagacuaaguuguacccaguagcuggcaaucaggaucaaggaagaggcuacaaagucagaucacaguagagaucugggauacacacagaggucaaggaaaagcaagguucagaaaccagcaaugcagccugaaccacaggcagaaagccacagcaacacuaagaucugaugcuucuaaguuuucugcugggggcuggagccauccacaagguaagccaagcccacaguccacaaguggaaucaggucacuguccucaggaaguagggcgacaaggguuaggaauuacucacuggguacaaugucugucacucaggugacggaaacccuaaaaucccugacuucaccacuaugcaauauaagcaaguuacaaaauuacacuuguacuccauacauuuauacaaauauuuuaaaaaagaaaaagucuugauacagaggcccauuuucucuaaccaggaaggaguuuccaaacuacaagucaauucuuucuaaaagcaccucucucuccuucacucagaucuggagacagaagaggaugccucugggcagccaacccaagcagagcugggcaagcgagaaaaucgccaccaugucagugaccaccugcucacccaggcacuuccuccaacagaagaccuucuguugagccuccacccugcauccggcauuccugaacguccccugaccugcacccccucaucaucuggcuuaggaaccauuuggccucugacccacccauguucuauauucacagacaaaagaauagggagacuguggauuaggaucacagggccucuauaauuaacucugauucacccuucacacuuucugacacacagaaucauugggggaaaacucuucugauuuauugaggguugaguguaagguacugucauagguuagcugugaaaauucauuuaauucucacacaaccccaugaguuagacaggauaguguccccauccucacuuuauagacaugaaaauaaaaaaaucagauuccagugaguggcauggucagaaguaaacucacauuuggccucugguugaucaacaguucucaguaggcagccucuguagaggaauuaugucucuuagggauaaaacugagauguaaucucacagaaagcucuugugcguuuuuuaaauuccuuuaaagaaaaauuuguauugauaguucuucccuugauuuagggauuuuuuuaauaccugguuucuugaaaagcuuuuuaagaggaucugccaaauuacauaagcauuucuaguuuuucuuaauuuuaauucucauuaugagauuuucucaucaaaaauaauucagauaguucuaaaaaugucccguaaguaaacaaugucaggaaaaagugagauauguugaaauacgaacaaacgaaugaaugaauggacaaacuucagaacaaacuaucuaacugcagcaagaacugggacuggaaacaccuaaccaaugacagccccauagugguuucuggaugcuaaauauagacaagguccaaauucccaaagucuaacucuggcuuuaucacacauacuuggcaaaagaauguuauccugauaaagcccuccugucuggccaugcuuaaguaaaugucccaacauggacugucuuccaccuagcugccaggggaaaauggaucacuucuguacucuugguguguagccagacuauauuaaaaaguccuucauccugccucagcaacaaaaagugcacugccaucaguuacguuaaagcuguugugugauaaauuugaauauugcauaauggaggggaaaaaaucaaggacuuacacuacagcuauaaaagggauaugugaagcuauuuagucaugauuuugucauggaguagugaccuagacaacucaaauuccaauuaauacuugaaaagcccuugggacauagugugauaugcauuccuauaaaauggcucuuggcugggcuugguggcucaugccuguaauccuagaacuuugggaggccaaggcaggcagaucaccugugguugagaguucaagaccagccugaccaacauggaaaaaccccaucucuacuaaaaauacaaaauuagcugggcauggugaugcaucccuguaaucccagcuacucaggaggcuaaggcaggagaaucacuugaacccgggaggcggagguuguggugagccaagauugugccagauagugccacuguacuccagccugggcaacaagagcaaaacuccgucucaaaaaaaggauaaaauaaaauaaaaugaaauaaaauggcucuuaaaauaaugcauuugaauuccuaaguauuuauauacaacauugcccccuuaauuuuauuuuaagcaaagaacaacgguauuuuucauuuagcaguugugacuugcuacgaggaagucuaggucaaucagccgguuugcaguucaggcaaaucuaagcuaccugacuccacugugccaugaggaaaugacagacaagagaacgcccuacaggcccugagguuuuccuggaguaccuuccaaaccauggccugcauugugcuuaugaccuggacaggucaccgcaagccccugcugguccaggcagucaagaagggacuccacagugucuucacaaucaccgcacuucugccuggcacaacggcuuugccaagcuacccucuucgugcccaccguuuccuuugcugcuagaaacacucacaaagcaauagaguucuuacaguucucugagcuccaccucagcgccugcucauaauggaaaacggcugcugccagagccacuuccacccucacggaagcggggucacggcugccuuugggagucugaugaaagcuguaggcugucuucucaggaaagacaaaaaugaaagaaaggaacagaaaugcagagacgaugagagggauucccugaccuccagguuaaggauccucagcuuuacaaggcuaagggaggaagaauggagggggugguggaaggagaggcagagagggagagaagggaguacggagugagccagcuccagggaccagccacugaacaaagugcugcccuugucucagccuggaaucagacgguauggguucuggcucaggcucgagauucccagugaaagccacaaaguucuaugacuucaucaaaaauguucccuugcccacagugccauuagcuauuccacgugaccacaccaaucuuuuugaccaaauauucucucucacugauuaaacuauucuacuacaaauuguugaugccuuugggcauauacaggauggaaauagcuuagaaaaaaaaguauucuauuuaacaaaacuuuacaguaaucgguacagucccucauuuagucaauaaacacucggcgaccacaugcuaugugucaggucauaugccagcuacaauuaauaacaacuuaaaaaguaaucauagcuaaacacauugugcacuuaacuguacuaaacacuuuacgcauauuagcucauuuaauccucacauuaauccuuugagguacguauuauucuuucuuuuccacuauucacaauagacaaaauagagcuauccacagcuagcugguggcagagcaggggaucagaacucagacuaucugguucacagucuguguucuuaaucauuacaguuccugccuucaaccaacccacacaacaaggagaaauguaacaguaccaaaaagcacugcuuguguuugacaguucgacagugaaaugaacacaaccagacuugaucauuacacgucguaugcauguaacaaaauauuauauuauacguacccuauaaaaaugugcacguauuaugcaucguuuaaaaauaaguuaaaucauagaguuaaauuucuuagaaaaagaaaaugaacacaaccauaaaauaugcauagguauaaaauaguuuuuucauaaaaggggaauucuguuugaugucuuauuauacacauuggagaaauaaaauuuauuaugaaggauuuauauagauuguccaauuucguguaucuuuauaauaucaaaaguuccauaaagagaauucacuuugagaauaaaauuauuuucaaaaagaauagcuuauagauguuaaguguuuucauugguuguccauaguacaccucuuuauccaaauauauuagcauauugcauauaaauuacuuuauuaccaagaaauucggaaacugaguauacaaaauuaucaguuucugucucaacuauuuugagauggcagugaacagacuaacuaugauuugaugauaaacuaaagaaaaauaucacgcuuugucgaauauaaucaauuuggaauugaagaauuaauugugaugcaauuacauacuuucuuaaaacuaaaaaaaaaaaagucaaauugacuaucaaaaugucuuuagcagaaauauacucacagcucuuuuucaaagcaaauguacaaaaucuccuacagccccuugcuguccaagagagucacgugacguaaaacaucuuccucaucaccucggccacaccaguucccaauuccauaugcucaccuaacugcaccccuguccccaaaggcuccagucucccucaaucuuaccugcccuuuaugcaacaucauuuccucccugaggcucuuucuuggucuuucacugagcucccaaaauccuagauuccaaaaccacucucagccuguuaccauucccaaauccaauaagcaaacuauaggacuuaugaacuccaaaauaaauaccugggucccuaccccaggcacucuggauccccagcugauucugggaagcagcuaaauuugauaagcccuggacuacaccauagaaauaagcauuuaguuauaggcaucacuuucucugcuguacauugagggaggugggcuggaaagaugaucucuaagguuccuuccagacagaucuaacaguccaagaguccagacucuauagcuauuucauggauacugguuucucuccacacagacuccaugcuucuucagagcaggggccacauuacuuuuucacuguccccaagccagcaugguguguuaugcauagaaggagcucaauaaacuugugacucguggguuucuaugacugugcccgcugacugaggguaacuaguaagcugagccaggcacugcuguggcagggcuacuuggcagaucuugugcagacacugaguuacaucuugcuccaaaggaaccucccacaaaggcaucaagaugucaacacuggauuuacuguggucagaaaacuguagaaaucaaacucuuucaaauucuaguauaccaaaauacaacaaguucugacuuucuguuuauauguuaaggaaaccacagaaagcccucagagauaauguaucugguuuguaagaauuaugaugcauacugccauagugucauaagaauucccauaucuggcugggcgccauggcucaugccuguaaucccagcacuuugggaggccgaggugggcagaucacaaggucaggagacugagaccauccuggccaacaaggugaaacccagucucuacuaaauauacaaaaauuagcugggugugguggcacaagccuguaaucccagcuacuugggaggcugaggcaggagaaucacuugaaccugggaggcagagguugcagugagccaagaucacaccacuaaacuccagccuggugacagagugagacuccaucucaaaaaagagagagagaaaagaaaaaagaauucccauaucuaagagaaccuaauggugagaagaacguaucauggaucuuuuugcuggaaugacaguggggugauccagguaacaauucaaguccaggaaguauauuaaaugggcuugaaucuauuaccaagguuauucuacuauugaaaaaagauguuucuagcuggccuucuggaguuguccaaugccuggcuacuaaaccuucuuaacaagaaaaucaccuuuguugagauaauagaaaagcuaagauuuauacagagaaacaacauuccacacauuuauaaaggacuuaauagcuugaaucauuucuaucuguuaugccauuuaaaccucuuacaacagcccuuagaguuaggcaagacacacauuaucugcauuuuacaaaugagaaaaugaagcuuuggagaagguaaaaaccuaccccacaguggagcugaagcucaacccuagggccuuacacuucaucagugacccccugaaugagggauucuauagaggcagauguaugaugucuggccaagaaaguacagguguggguguguguuguuuacuguauuuugcuuguuuugcuuuucaucugaauguauugaagcaagguaguagagcuucaaauggaccacaagccccaucacauccaacugugauacuguuucagacauuuauuuggucuacuuggcccugaagguauuugaauuuuuuaccccugugcuaaauaauuauacuuacauacuuauauaaauaauuauaucuucccaucauguaacaucuuaugagcauauucacugcauauuuuauuucuuccuuauaauccuguuuacucauuagaggacuaagcuaaaaaaaauugaaugacuugcacaagaucaggaccuaaaaucuaaaugugucauauaagaaauuacauuaugugagaauuucuuaagcaggugucaaguuaaaauucuucagaaaaucauuacauaaaaguuucugaacuugaguacucaaguacucaaaucucuuuugagauuugauuauucuuacuuacaggacuaucauucagagaauaugcagaaacaaugcuuucguguuuccaugggcauguccugagaaagucauauuccuuuauuuuuaucucaaguguucaugaacuuucauuaucaaagaagaaaauaggcaacuguuucugaaaaaggaagucauucaacaaaauacuagcaaaacaaauccagugauauauaaaaggauuacauaccauaaccaagugacauaguccaggaaugcaagguugguucaacauauaaaaaucagucaauguauuaaaguauauaaaaguauauuaauagauuaaaguauauuaaaguauauuaaaguauuaauagauuaaaacccauaugaccaucucaauacauguagaaaagccuuugacaaaaaucacacauccuuuugugcuuaaaaacacucaacaaacuaggaacagcaggaaacuuccuuaaccugauaaagggcaucuaugaaaaaccaacagauaauaucacacucaacagugaaugacaaagcuuuccuuucaagaugagaaacaaaccaaagaugucuacucacuccacuacuauuuaacauucuccuggagguccuagccaggccaaucgggcaagaaaaaaaaauuaaaagcaaccagauuggaaaggaaaaagcaaaacuaucucuauucacagaugacauaaucauguguauauauauaaaauccuaaaaaauacacacacaacuauuagaacucaugaauacacucagcgaggucacaggauacaaaaucaauauauaaaaaagaaaguaaaaauaucagugauccauguuaccaucacuaaauaaucacuggcaccuaaaaagcuuccucuuuuaguuuuauuacucucaaccugggauauagaaaucuaaaauccagaguuuacuuuagcuuuuaaaacuaucuaugauaucagguuaaaagaaacauuuccuggcagaugcacagcucuggaaaauuuuguuuuccaaacgucuggaaaacaaaaggaaagcuuccuuuguuuacauagccaagaagguugagugaugagaaucagaaaagauuuugaagcaauacaagaucuucuccuagggccauuagagaucagcuaaucuguucaaguuuuaauucucuucuaauggguuuccucaaaguacuuuacagcaguugcaaucaguuccaaauauugcaucgugauacucacauaaacuggaaaguaacggcuacauuuccauuuauuucauuuauauuuuuacuuuggccagucucguaaagauuuuaaaaaccauuaaguacuucacaauauugguggggacuguuuccuucuucauuuucauuagaauaaacacagaagugguaucuauccuaauaauacagaacaugcuucuuagguaauauaaaccaaacacaaauagaaagaagcauuguuauacauuuuaaaaaaguguuacacuuauuuuucugcaggccugaauacagacccugccugcucuaaaagucacgagguauaaagugugaaccuaugcucugggggcuccugauaaguuccaggaaacuccuuucacagccucuaucucagggccacaucaaauacacguucacucacuggccucaacagucgauuaucacucccuauuuauuuguagguucacauauuuuugccauuuaaauuuuuucaaaaauuaaaaccuggcucaaguuacaaguaaagcuuggguuaaggaaagcauucaugaaacacuuuguuuucuguaaaucagauaguuuauugccugguucccuuccaauauauaugugggcuuuacucuccauucagaauuugauucuaauuuuuaaguggcaagcaaagucgaauuauuaauuaaagaaucaagacauauaaguauaccuuacucucuacauggugaaggcaaacacuuucaaagacaauuucccuaauauuuuaaaccuaucacaugaaaacuuuagcccuuuggauggaaacauuucacugacuuucuucaucagucccccuuuuuugccauaaaaauucacgagauaauaaauuccaguaaaaagaaaaccacacaguaaggcacagaucuuugauaguauaaaagaacauuaucuaauuuaauccccauaacaaaucagugacaguauuaucucauuuauauauaaggaaccugaagcucagagaugcugaguuacuaaagauggcacagcuaguaaauggcaugucagaaucugaacccauugcuggauggcucugaacccuuugcccuucccaacauuaauucgugccuuucuggaauuuugccagccaaguggauuuuuuuuaaccuaacuuaaaauauucaaaaauaacuaacguuauuuaacgucuuauucucuaagauuuuuuaaaaaaacauuuaaaguuauuuuugucaucuguuuuaauaugucccaaucccuuaagcuaagaaucuaucauuuuuacuuuacccaacuaucucgugauauaaauuaagccuguuuacucuuuccaggucacugaagcaaugcuucuuucuagaauuagagucauacaacuagaagagauggucugacuuuguacagaccauuuguacaccauguguaguuccauuucuaagaagaaacagcaaaaugaucuacaugaaaaaaaaaaucaccuuacaauuucagaugacuuucaugaagugguuuuauaaauuguauugcuguaccaucauuauuguuauuaaugaaguuacauuuagguguuaugguagauuugaccagauguggcaaacaguuguuaccauugucuucauccauaaaauuugucaaauuagagguuuuauggaguauacaacuaauugcaagaaauuauauaggcaguguauuuuuaacauuuuaaauacuaacaaaaacagcaggacuuaaugacagugaacuacagacaauccaugcacagugaagccuguuuaauuagaauuccacuagucuaaaaucuguaauagcuugaacacaauauacuauucauucugaguuugaaaguucaaaauaaaucucaagauguuuuuccauauauaccucacuguaccugcuggagaccauuuacauacauacauacauauauauauauauguuuguuuuugagaaggagucucgcugugacacccaggcuggagugcaauggugcgaucuaggcucacugcaaccucugcuucccagguucaagugauucuccugccucaggaucccgaugagcugggauuacaggcguccaccaccacgccuagcuaauuuuuguauuuuuaaauuuuguauuuuuaguaggcaggguuucaccacauuggccaggcuggucuggaacuccugaccucaggugaucuacccaccucggccucccaaagugcugggauuacaggcgugagccaccacgcccagccuauaucacauauauuuuaaggucgcaugggaccucaguacucaugcccucugauucugucauuaagagauacauauuacaggauaguggugauguguaggggcucuggagccaggcuaccugcauuaaauucccagcucugccuuacuaacuaugggaccuugggcaaguuaccuugugccuuuguuuccuucucuauaaaauggggaauaguagaauccacccuacagguaaugaagauuaaaagagauaauacauaccugugaaaggcucaggacacuucuuauguguaagaaacacaacacccugaggccagcuggccuagaugucuuuccaaggaaaaucugccaucaaacguuaggacaacaucgugggacuccugucuuuucuauuugaaaauaguuuuuaaaaauccauuuaaaacagcccacaauuagacaagcucacuaauuuuuccuggcuauguaccuucaccaaauuacuucucaaucaaaauuacuuuaaauuacagauaguaugacauagauguaugccaaaggggcuuaugcggacuuuuaagucauauauucaaaaauaacuaggaagaaccuacuaguuucccuuuacaaucugauguuucauauuacccucuucuuuguaguuccauucugugaaacuuccauuucucauagguauuuuguuaaauaucaccccuacccacaagguuuaucccaaaguaucuacacagauuccacccucgcguucuuccucugauucugggccuggccugcccacaucuccucugaggccuuccuccaucaguuugcccaucuuuccccucaagagugggaacacgcauagccgcccucccaccucccauccauucuuucacccucacugccaacuccaaaaagcagcuggucacagaccccacuggcucauggccucgcccuggcugaucuuuccuuuucaacccucuucaccggcugcuuucccucccacuacaccguggugccugcagccuacuucucauucucuccuccuccgcccuagacaaucuuguccaaucucaaggcuuucaccagcaccuguaugcugauaacgcccacuuauuuccauccugaccuuuucccuaaaugucaggaucuuuaguaaacuuccuagagacaauuuuaucuucaugguccaagggcauuuacacgcaauacauuuaaauccaaaggguuccucuuuccccacucagcuugcucuuccuccuacuuucccuaucucaucacacaagcuagauagccucaaagcacccucauccccuucuacccagaaaaugagugaauacugucugugucaugcccccaacagcucucuacucccucuccuccucuccauccucaccggcccaggcuagucagcccucacuccucacugaccuccugaccuucagacauggccucucacaaccaccagacucauccaucuauagugccuucuagaaauaauaaaaaaaugcaaacgugaccauuuugcuccccugcuuaaagcccucaugcaggccaucaccuacuggaaaauguuugagcuccuuagaaagccaugcaaggcccucugagagcugcucccagcuccacugcccaaccucccauccugccauucccaaccugaaugccagggaccugaaacugaccugcacuggucacugcuauuguucacaacuugcuaauuuucaccucuuugccuuuccuuacauuaucguaccugccauaucccuaccccgcucccagccuggcuaacucuuauccuuccuuuaagacugcaaucagaugucacuuucucuaggaaaucaucccuaaaauaccaugcugaguaggguacccccguacauacuccacaggauuuggggcagguaaaaagucuacuuagacuaaugaaauaaucuguucuuauuaccaggcuaaaauauaaacauaucaagggcuagaaauguggucucuucacuucugugucuggcucaauaaaaggaugcucaucucaacccagacaccuagaaauccagaggaagaaaguuacaaagagcagcuucaagcccucuauacuguagacggauugcguuacauuauuauauauuuuagggcucuaaaacauuaccuuuuuuuucuuucugagacaaggucucucucugccauccagacuggagugcaguggugcaaucauggcucauugcagccuugaccuuccaggcucaagcaauccucccacaucagccucccaaguagcuggaaccacaggcaugcaccacgauggccagcuaauauuucuguagagauggggucucccuauguugcccaggcuggucucaaacuccuaggcucaagucauccuccuuccucggccucccaaaaugcugggauuacaggugugaucagccuguaccaccaugccuugucuaaaauauuacuuuuguccugcugaggaauaaaaguaaggaaaagaaaucaauuuauguaacuaauuauuuaccuaacuauuagaaaccaacauacccuacuuccucucagacuccaaagaauuuucucagguguuccauucauauucaaagauuaaacucuacuuauugaaaaaaauuaaaggaagucacuuacaaggauugguucucaaaagcagcuaugccauguucuggggaaggaacuaccuucaaugaaaggaacacaaauaagagaguccugguguuacccgcugagcuguccucuccugcacguagacaugcuucugcaaaaaacucagcaggcuccaagucaaacucuguccugggcucuacaauaugccgccgcacgugaugaucacuggugcucaggcagaacggacuuuauccacaucacuguaaccugagcccagacuucauccuagacagucacacagcuagggccacagguggcacaccaugguaaaaacgugagaccaucugauuauccaucaaaacagagggccuacugcacauagacauagaugugaguuggaguaguguggucuucccauuucugauguugccaucuauuuccucgagaugacagacagcucauauauuuugcucaaaggguugcuagagcuguauccuccuuuaaggugaauccucauuucuacucccacaacagaagugguccucaaccucuuuggcaccagggaccaguuuuguagacgacuuuuuuuccauggaccagggguggagagaugguuucaggaugguucaagugcauuacauuuauuguagacuucauuucuauuauuacauuguaaucuauaauaaaauaauuauacaacucaccauaauguagaaucagugggagcccugaguuuguuuuccugcaacuagagagucccaucugggggugaugggagacaguuacagaucaucaggcauuagauucucauaaggagaaaccuagaucccacacaugcucgguucacuauaggguucaugcuucugugagaauauaaugccagugcuaaucugacgggaggcggagaucaggcaguaauguuagcaauggggagcagcuguaaauacagaugaagcuucucuugcucgccauccacucaccucccacucugcagcccagguccuaacaggccccggaccaauauugauccacagcccgggggcuggggaccccugcacuccuuaacagaagaggggccuggcaggauguuucagaaaguggaaggaaguaaacauuugaaucuucggcacacugagaaggccuggcaaggaaagucuaccugcuucuucccaggaugcucugagcuucuauuuuaguaaacuacagagucuauggccagugaagauaccuacuucacagccugagauaaaguccucggccuccaacuguaguuucuaccucagcaguucugagaaaggacacuagaagccucccugccauggaauaugauuggugggacaagaagcaagugggccaugugggcaaccuaucuucucaaccaaggcagggucccagggcaaaagcccagacaaugcaucuaaaggucagaaccuaccugaccaucaucaguagcuuuuucuauucuuaaggaacuccugaaugucgcuucuugggacccaacagaguaaaccucugagucugacagucuuuuuuuuuuggugugugguggggggcggguugucugaaucaccuguuauuuguacuauuuauugauaguaaacuguauuuucuuaaauguaaaagaaacuguauuaauuugaugacacuaguacugaagcaauaaucaaauacuugcuuaucuuacuacgggccugaccuaccuucaggcuugagggcaacuguuuuccucucuccucccccacaaucugaaggaagaguuagaacaguggaaaguaauguugcauauuacaagaaaugguuaaacacaauuagucagaucauauaauggacuaugacguauuaaggcaguaucacggcuaccaggaguacagauaccaacuauggccccaaauaaugcuaaacacuauugcaagaacuucauccacgaguucacgugucucaagacugcaagauuuaaauuugcccuacuauucgugaaaauucaccuuucuuuuccaaaucuggaauaccccccauuguuuaaauccagucuggguuucucuugucaguagcagucuucaaugucuacuucagagaaugaaaauguguguaugugcacucaugugcuuaugugcacgcacacacccuccuuagaaagauaaagucaauaaacuuccugucaguaucacagaacaugcaaagucaauugugcaacauuuccuugcauuauccauccuauaugcaaacauucuaaugaaauagaacuggaaauuacacauggaaacugcagcuaaguuuggccaccuaauggacucaggguacuccgguaacggcgcagagagaagaagguuggccgagcggggaugcaagguccccaacugaaguaucugaaaccuacuauggguuccacguagagucuucaguugugauuucucguaggacacuaggaaaguugcaauuugcagcuauggccacgggguagugcaauaauucugcaaauagcugaccccacccccaacacucccauccccccaaccccagcccucccaaagacagaauggcuaggagagaauggggacauuuggucugaauccugggcauccacagggguuacugagagauucuccacaaauccaaaagugucuguaagacuauacaguuacucucagcauucgagcccgauacaacagaaggucccgggcuuugaaggaaugaugagaacugagaggcuauaaaaagugauuagccuauuuauuacaaauuguguuuacuuagguuuuuauguuuacuucccaccauaucuccaccagaauacaauuaaccacccccucacucaucagaauuguauuagaaagacucacaaaaauaaaauaaauacugcaucuaaacgcaaccgucaagcuuuauggaacuguacuguuauuacacaaagguguccccaaaacagggagaaggaaaugcaaauuuugaaaggucuucuuuucaaaggaaauuuuuguccauuuaguccuuacaagucaaaguuuggucuguggaccaaaacuaauacuugggagccaguuagaaauguggacuccugguucuauuagauuagaauguguauuuuaacaaggccucuagauuauuuggaugcacauggaaguuugagaagcauuccccgagugagagcuaagcauacugaccuaugcucucaaaacuauuuucuacacccugggucuuuucuucuucuacaagcauucuacgugaaaacaaauauauuuugaaauuuuaaaacaaaaacagauuauuucccagaacugguggugauccacuacaguaaagccucuuccuaucuaaauugccagguaacuaauuaacaugucaaugaacacuggcugaaauucuguucugucacuucauaacgcagguaaacaguacagauaugagaagaaaaauuuaagaccaacagacucacaucaugguccucuaggggauuuucgaaacuaauuuccugcccauauaaaaggaaaaauaaaauuauuuccaguaucaaguuaagcacauaacucucuaaauggaguugcuauguuaaaguggucuccaaauuacagucauuuuuguuuaccuccgcuaacaaugagccuccugggaagaaauuaugugaagaaguuuaaguacccucuaugccuuucuccacaggugaguggggaaauugcagaggaaaaauacacaagugaauacaauuaaugacuucugcacucuuugauuccugcuacccugugaggggaaugaucauagaauuuugaagcuggaaggaaucucggagauagccuauugcugccgcucugccuacccaggaaugucuuucuacaaagucagguaauuguuacccuuugagacagcccacaucacaucacuguuaaaugcucucacacccacugaucuuacucgugcccuugagcaacccagaacaacucuauucccacuucccagcuaaaugccuucaaacacuuaaggccccuaucauaucccgggugguaguuuccuuagauugaacccauuuaguuccuuggauugggugguguccucuuacucugauauaaacacuguguauuuuguuuccagugaaacuaaauuaugauuagccugacauaauuuaaugagacccacagugccaaaugaagucauucgauguaaugguugguaaugcaauacauucucagugaaacauaaaagauuauguaaugguuaauagaucuacauaugugaguaguaccaccguaaguaagagcauauuugucugcuggacuaugaugcacgacuaagaaaagcuaccaaccucuacucaaaaccgucccaggguccuguugccagggacagaacgcugcaccgcauggacugcugaaucugaccuuaugcggccuuucuguauucuuccuuguuuaugaaaaagagacauuuuuaagaaagcaaaggguauagaagagcuacauuuggcauucagagcaauugacacuuuuauuacuuaacaucacaaccuuaugagguaggccagucuaagugcugucauuuuauaagugauuaaaccaagacugagaauaggaaaugagaaaaaucaugagcugcccagggccaaacagaaagcaagguuggggccagcugaauucagaaaccucaauuaaauuccaagacaaaagggaacagccaacauugaaaauaaguuuuauggauuucacuuugaaauaaaacaacaacaaaaaaauuauguuaccauuaaaugauauuaaaaucgucuuuuauggggccucgauuuugccaccaaggcuuuauucccaaaaauuaaaauaaaaaaaaaaucaaacaggcaaaucuauuccagguuaaaaauuccacuuacacacaaaaucuugcauuccauauugagagguuuuuuuuucuuaauuugccuauuaaucuguauuaagccaaaggucuucguucaaguugcucaagugucauugauuagacccauuguaguuaacaaggacauucucccaaaauagauucuuagcauuuuaaaacccuccuacauuuucacaaaagagaaucuggaacacaggaaggaaucauuuccccacacacaauacucaucuucaucgucauccagauacauuugguuaaaaaccuauccacacauuaaggugcacacucccuggguuccuccucccugguauccucuggggccccagcccagcuggaguccccaaguucucggcgcccugaacuaaccagucucuccacccagcuuucuccaaaacacaccccacacgagggcugagcuccuccacagcggaugcaacacuccacugcuucccaucgaggcccccugccuccuccaggcugaugagcagccccuuccccacugcugcccacagcccuagcccuggaagccucucuucugagaaggcuuugccuccucguaccugccgaggccccuccaggcccaugcugagggccaaugagagccacgcagucaacuacacggugaccuucggccagugugaguacacgcagcucugcagagcugcugucuaccaaucagcuccaggacaccuggggcucagacaggugcacucuccuucugcccuuucuuuguacucuguuuugacccauaaggacugaccaaaaggauaggaauaggccuuaaaauguuugcuuuacugcagcuggaggaaaggguuagaggcaccugaaggucaagaucagggaucuguagcauuuucuggcacuaugaaguaaagucuaaaaaggccuggaggaagccgcccacuggccugcgcaugcccccuggcaguugauuugaagacaagcaaaagcaucagcgggcacuacuaggcagcauccuuagggagacuaaacugcuagugccucugcaucccucccugccuguguuagccuaccuucaccaaacaagauccacacuuuauucccuccauguuucuauucacagucuucccaccacgugguuuuccuccuuuccauuuccuccugaaauucuacuccaggacccauuucaaaugccaccccaccaugaauaucuuacuuucaacaggaugugcccaugcccccucaagcaggcagugucagccuuggauuacagguauuuauggguauggcuuauucuccuauuaaguucccaaaaaacacacuguccuuugcauccuguacagcaggguuuccuaaacugcagguuucagccuaugaaugggaaauucuaaaaaaaagaaaaaagagaaagaaagaggauaggaaauauccaaguguaucacacauaguaauaagcguuauuucaugaugcucuuguuucacuuacguguaugcauguucaaggggugguggguggcaguguuaaacguguauuuguuacugggggucauggucugaagcauuugaaagucacugcccugaugguaccucuccucugucuaauauucugugaaugcuuauugaauugaacagguugaugaguaugaaaugauccauguauuauaacuucaaaggcuccaacuuaaaggaauauaaagaauaaugccuaucugaacaaaaguguguggauucuggcuuauaugaagcuguggaggaauggggugagugguagggaagaucagaauauuuauuauacuguuguauguugauagacuuucucuccaaugauuaaaauguguuaacauuuaaggaagaugaaauacaaguucauuuuggaaaacuuuucucauucacugaaacuaccucaugacuacaaaguucugcaucuuuaaaagagacaguauagguaauuccaccaugaugcauaaaaugaucuuuuagagacaccaugaaagcccuuguucaaguuuucuuugcccaagaugucuccauguacucucaauacccccacccacaccaucugucuuccaagacuuaguucaaaggccaccuauuucauggaagccuuuguuuuuuaacucaauuuuuccucuuuccauccuccacccaagucccaaauauggucucuuuucugaaucaccaguguugaaaacuuccuuuuucauguguguucuugucuuaauuuccucacuugacaauaacacuaauauguacaaccuacgccuuacucauccuugcaucucccacagaaaccagcacaaggucuucuacuuaagagaugaucaacaaauauuuguuaaacgaauuaaaugaaagcaacaguuagccuguuaaaagggauggucauuauuuuaaaggcccugaggaauggcuuauaugucuagcaccuaaucaaaagcugguggaccacagaaggaagaccagggaguggagggggcagccuugugccucugcauaucugcugccccuguaaacucacggaaugcccaacucuucaagacucuacagaacaaagcuacaguguugggugcugaaugaacaccuuaaccuuuuuccaaguucuccagucuugcuucaaaccagaaauuggaaguggaauuagagguggaaauuagggccauccuuuucaacuuuaagguauggcugaaaaaguugaaacagccaucuggauaauucaggcucaaaaaacccauccugaagaguaaguauggauguuucugaguggcaggaagagugugcaagaaggcaaaggagguaguugugaauuaucaauugauuguguauauugauuauauucaacagaacugagcuuuucccuuuuuauuuucuauaaggacacucucugugacugcaagaauaaacuagcucagauucaaagccacagucaccacuaauaaauuccaauuuguucaauuggaaaaugauguccaucaauuagaaaaaguucuuagggauuaagauucucuuuugccauuaaucuguaccuccuccuuccuccuucaaaaaaguuuuucuaugaucaaucaaaggaagaaguuuucaauggucuuuaaaauguauauugcucuaauacaauaauucauaauuaacagguauacuuuccuaacuaugguaguuuauuuucaaauuuuuaauuuuaauaccauuuagggcucucucucuuuguuauuuuaguaggaccuuaacuuccaguccaucgagguuuuguuuuguaauuaauuucagagcuguccuuauaagcugagagauauuugaaguacucuagaaaauggcaauugucugaccggauuugaagucagaucacugggcuuugaagcuaauuucugguugaaauauggcugccccauuuuuagaugugugacucugggcagguuacccuaucuucccaucuucaauuuuccuaucuuuaaaauggaacuaauaacaguacuugcuuuauaauuaaaugagcuaaaacauguaauguacccagaacagugucugauaaauaauacguguucagcaaauguuaguuuuaaaaagucugcugucaucuguuuuaugaccucaguaaagucauuuaacaguucaaagcuucuauuuccucaucuauaaaauggaacuacuaccacuuacuuacccuuuccaggauuaagagauucaaauaagaaaacaauggauaugaaaauauuggacacacagaaaguucucaaauauuaguuauuuugaaccaucuauaagcuuaaaaguaaccauaaacuuaaaaauuuacguaaaccauaaaacugagaacauagcauccaaaaauucaucugugagaaaaugucuaaacauauuagaaaugcauacucaagcuugguuuuucuuuaacuuaucagaaacauauaagcuuuuguaaaauguaauucuacaucugcaaaacuagaaacccucccggucaagccaaacuguccuaguauauugugaucaagaaagucuacaugccuucauaagccaaaacucgaugcacugauuaaaaugugauugcacguacaucaacuuuuuaaaaaacguguaaguuuuuguuuuuuuuaaaguaauaaauguacugcuaauguaaauuucaagucaauucaacagauauuuauucugugacacugcuccaggguaauucagcugggaacuaaggaugcaaaaggaaacagagcucagguucugugcaggaagaccccacaaauuacgcugauaaucucaaaauauuacuuaugaaagucauaaggggguucgcuuugagucagcaagcagacaagcagcauaaaaauauaccgaaacaguaaguucuucccuuugacugaaaaacugccuuuuaaaagcaaacagcauuuuaaaaguacaguugcuaucuggaaagcuauugaauuugcgccagaaaccaacauuucuaaauguaaaccuauaaaauaauagguaucuguaaaugaaaggcugaaauaaccccaggagcagcaacacaguaauuagcaacuuuuacacagucauaacauguuucauauucuuucugcccuggcucuuugaaguuuccagugcaauacguaaaaguuuuauuacauuagggcccguccuuguguguuuuacaggcaccaacauuaugcagagcaagcuguacuuacucaucauaggaucuuuuauaagaaaccguuugauaaugugcuagcuuuguguccaguuuauuuuguuacaccugucuuuaggaaaauaaaagucacuggaaaccuaaaucacagaaaauacacacagauccacauaucaucuauauguuauaaaucauaaagcaguuuagcuuuaaaauuguacauugcauauucaugugcacaccacuugcaguuuuagacacaugugaacucuuuacugaauuaaagcaaaaggaaaaaaaaaaaagcucagcucuacaauaagcgauuaccagaggcagaacagagugcaguuaauaugcuuguuccagcagauguucauccccguaaauauuaaacauaacacaaguuccuccaggaauaugcaggcaguaauuuuaccaccugaauagugcugguuggaaacauuuaagagauagugggggguuggggggagcagagaaagaagggggaauaagacagauacuaaagcagccaaugggauuuuuaagacacccgcaacuggaauuaaacugcuuccagcggcgauuuaccuacagcagcuccccagugugagaucccccgagaaacggaaccuggagugccccccgggcugcgagcugugagcguggcauaaagggauacccggggcgcccgggugggguggggaggaggagugcaacugugacgaggugugaagaaagggcccagaggaacugugaaccccgaggaaaggagucucccugggcuaaggccucuggaauaccggcacggagaaacacucguuuccugcccuggauguucacuuuuccaucucgguggaagugggugggagagacagaaaggaugcagccgagaccgggcgcaggcggggaggcuggagcauccucuaagggcacuucgcagcagcaccaacuccagggggucgguggugccagccggaggagggagggggcgcagucggagggaaaggaagugagaggagcagggggccgacggguggauccccaggcauuagugacacagucuucaaaucgcuucuuuuccuccccacggcugcgcucugccccuggcuaccuagaucaccagucccugggcuggggcgggccgccgcgagggaggggaacaggagagggggaaacagacgggcaggcggccacgcaucccacccggggaggcagaaaagggcuggcgaggcaggcgcccccgacccaccccacccccacggcggccggccgcccggagcccccggcccaggugaggacgcgcgggccgccgcggccgccccucgccgcucccgcccgcccgaagcggccggcacggggacuuaccacagugacucgaggucccauuccuggagcagggcuaagucgaagcuguccauggugggaggugucagcgucgccgccgccgcuaccgccgccgccgaggcucgggccgcccgcgcgcugcaacgaaaggcgccgcucaaggugcaucccagccgcgccagagcggccgccgcccgcccaccgcccacccccaggucggggcucccgacgccccccgcccccgacuccgggccggccgggcuggcugcagcggccggcgcacucacccgcuccccggcuugcgcgcaggcacacucaagagagagcagcgagcucgccgcgccgccgccgccccccgcccccggcccugcgcccgccccuccuccccucccucgcggcggcccggcccgcugcugcagccgccgccgccgccgccgccgccgcggugcucugcgcccgcccgcccgccucuuucuccuccgggaggcgcgugugcgcgggcgaggccgaggcgcgcgcgcaccgugagccccgcgccgcgcccgccccgcgcgccccuguacuccccgcgccgcuccucggggucccgcggcgcucgcaggccgcgccgcccugccgccccucucucguggcuuuuacggcccgcccgccccucagcagcccuggggugcccggggcggcccugcaagcgggagagagcggcgaggcggcggcgccgagugcggggggaugcggagccgugcccggcccugucgcaucccucggccgcccgcccgcgcccggccccgcccggccuugcccgggcugcacgcacuucucccgcggcccagaauccacuugacccugcugggcgcucccgcgggcggcggacccgggugggugcgggggaauuccccggccgcccaggcgcggggagagugagcugugccgcccgcagcagcgccccaaacaaaccguuuaaggucucuggagcccgcaaguucagcgaaauaaagcggcggcgcggaggaaaccucuuccacccggaccugcucuccguugcgguuuggccuccagugguggucccacccacccucuagcuggccagcccuggaaaccaaccuccuuucuuuuuauuucucaccgggaagggggacaaacuggccucugggugucgacuucaaacuugccgcccgucuccggucuggaaaggcaggugaucagcuagaagggugauaagaguaucaucguggcuccuaaagaguaauaauaaucucccucauuguaaagacagcucuucccccuggcuuacuuuuuuagacaugcugagaagcgcaugucuccaucagggcccuaccucugcuucuccacaguuggccuagaaccggaagccccuccaaggcccccugacucuccugaccucuuggccacagcuccggauucucaccagggauuccccagaauuccuagagagcagcucagagcccugcaguugugccucaccacgcgaaccaaaccucgcacuccccgccaaaagggagucccuuccagcacucuccccuuuguuccuuuuucugggcaagaaccgcugacuggggcugccagaaauguaaacccugggugcaagugacgggaucccuccagcgucaagccgaagagucauccucucaccucacccaccuccgaaugaggauuaacaaacucaauucaggacacagguagaagaccaaaaggccaaugagacuucuuuccuauuugagaucggauuugagaaugcucagccuggcucccuucuucccccagcucugaaucaauccuuucuucauuagcauccauaacuaaugugcaaaauguaaaacgcuaaauuaagacagaguuggcaucaacauagucugagaaaaugaaauuguuauuuuacaagcugauaacucucagcccucaaaaaccccucucauuagcugaagguagcaaguagcaagaagauuagguaaaaacauagagaauaugaauauaggaaaaaguacaggugugaagggcuggcugcccaaaucccaaugcacaguguauuuggaaaaagaaaaaaaagaaaaagaaaaucugucuuucuaauauccccuuagcauacgccuuguuggaaauguuugcuuuggcgaaagugagaucgagacauugagacagcauucccaggaacaaaggcuggggguggaggguggaggagggagcaggaacagccccugucuggaagaacugcaaguucugaggccugaacaagaaauguguccuguucccgugcuccuggcugcagcugggaagcuucuucagaaaggagaccucccggcccucaccgggaucuggcuuuccuucccuucccaccacaucuguuuauacaaaggagggccgcugaaggacaaacauaaccguguuuacugcgagucccaugcugggccuggagcucagauacagauuugcccucaccauggaggcugaagauaaauagaugaucccagaaaaggaaagagggaaggcccugggaugguauagagcugguugagggguuuacucaugaaaggccucucccaaaaagccauguaguaacgggcagauuuacguuugaauuuaaacucuggugccuuguguuaauauaugagagugugugcaccuaaagcaauugcaaggcggguauuuaaaaauguuucuuuaggaauagccaugauuuucuguuuggggccucuaacauggggauaguuggauugauuauuuccaguguuauguuuucauguaauagugucuuggagaaugaggacuuuugaggaaacccaaauaguaguugcagauccuguuuuuuacuaagcugucauggagauaaauccaaaauaguuuuuacaaguaaaauguagaacaguuagugagagccuuuaugggagaucuuuauuauuuaucugguuuaugaagauguuccuauuauccuccagccucuggguaugcaaaccaaaacaagcacuuaaucuaguugucaaaauuuuaacuccuuaauacaaagcaaaaaaaggguuuggacuuuuggggauuagaaugucagaacuaaaagggaacuuuuuuauguaaaagagaaagagacucucuaaaaauaaaaauguuagagugauguuuucuaugaagcugccuuagcuuuugcucauccuauagugcuugugaccugagggucuuuucuccccacauggaugcaagcaacaccccugggagcugaaucaaaccacccagcuaaggggagggcugcugggggaagcugcuaaaugagaggagcugcuuggcuucccgggucagguugguugguugguguagacuaaauguaccaaagaaagggacuaacaaaugaauccugcucagucuggggcccuacucacauucugccaaccuagugcuggaagccuccuaaauaaauccagaagcaaaccuauagcaucuaagaucucccuucagauaugauuugauagaagagaagccuugcauggcuuuaauucaugccuuauccugaagacgcagcugcaacucagaggucauuuuuguaaccaagugggauuuuuuuucucucuuuauaaucccaccauuccccuagaaaaauaugucuggccaaaagcuggcucugcaggugguacugcuggaaggugauaggagcaucaucaagcugccucagccccuacagcaucuccuccagcuuugucccuaaggacacuacucucuccuguuccagcaaagcugcagacgcaugacuccaucugcuucuccuuccagaggcuucuuggguguuuguaacuguauccagggauugcaggauaaaccuucuaggcuuucuccuugcaaauuacaugcuaauauguugaaccccaggacagcguagauuuuagauccacccaggaguucuugugucuucaggccuuucccucucucuccacagguaucucugagugguucuaaccuaggauucgaggugccuuucuuucuguauuuuuucaucauucaccaggucccgagcagaugguguggcugugcugacugucaucacuccuccuauguuuccauggaaacauggggcauagggaccaucuccgccuugggcucucugacaguauccucuggcgaagaacuucaguacuugugccccuccccccagccuguccacuguccuagggaguuggagaccuuucuggggcccuagaagccagggucauuucagagaucaucuaaggacauacucccugcaaaugguuuugaacuggcugggaaaaggagggaggguagaaagggggccaauaccccggucgagggcugagaacuguuuuagaaggcaacauauuuggacuaucugucccugcagccagcuuccauaauagcugauuauugcccagaugucaaaagagcugcuccuaggguucagucugcucaucagacaacagauauuuauugaauguaaguaguugcugagguuuuaugcuucacugacauucuacacccugggaaugaguguuucugggaaugugcauuucuuuccuuuuuuuuuuuuuuuuuuuuuuuuuuuaacaaaaccagguuuuucccuaaggaaugcaccuuccccaaaguuucccgcauccuccugccuacauaauucacuuauauagucacuaugacauuaauuagauucagaagucuguggaaacagcagagcucggcagggucagagggcaagcagggcagagaaaagagaggggaaaaugagcuccgggagaggggaaggaaguggagggaaguuuuucaugcccuucaaguaccaaacaaaacaaagauaauuucaaaaguggucagccacuauaacacugcuuagagaauuaaaguauugacaaauugaagagugcuuuaaaauaaaguggauggggcauaagcauguaugucuugguguuaguugcuccuuauacagccgguacuaaaggcuggugggugaagcuuaccacauuuuaaaaagaaaaaggcaggcacacauacuaaaguugaaaaugcaggcaggaaggacauuuacuuuucauaaaagcggaucagaaaagcaucuccuaucacagaucauguauuuuaugccaugcugaccaauguugggggauaaucucauuauuuugugauaugagaagauccuuugaugcugguaacaagaaccaaucauccugacuuaaaucuuaauauccccacagguucuuugucaugcuucuucaagaugugcccuggccauucaugcaaguuucaaggacucugaaucuguugagaauaggacauaacuaaucguaucauuagcaaacaugucuauauuacugucaacugggugcuguucuaaaguaucaacuccauuuaguccucccaaaagcacaugagguauguugccauuguuuuuauuuugcaggugaguaugcuaaggaacagguaagugucacaaacccaagcauggcagaucaggaauugguaugguauuacugguagcugugauaccauacuccaccucccacaacuuuugccuuaauuaucuauagcauuggcgcauucucaugcucacaggcacugaaauaaugaaaguaauacagucccagucggaaggcgagagagagcccucuaccccucucugcaauucuccugccacccaguuuugccccuugaguucugccauaaccgcaccuggagugaggcgcuccuugucucuagccucaacgucuuccuuugcaacaugagaaggcuggauuggguguucuuugucucugucaguuuuugucucugacaguucugaaauguuagaggucuguuuuuuucaguuguucuuccugagcacugccagacaggaaucccuggaguaugucaagagagucauaaaccuuuucuuguuuaaagguaggaccuccuucuuggcuuaaacaaaucucaagguguuggucugcuucaaacaggagugcugugcuaucugugaaguauuagcagacggcaagaggaauguguucaggaagaggacacuuagcuuaggucugggggaagcauggggaagaagucacaacacaacugugggugucaggcucuuuucucuggggcaccagagaguauucaagcauggauugguaguccccaugcagcccucggaggaaaccgaagcugcaaaugcagcaauuauggcuuacagccugaaaauggugacauuccaaaauugcaucuuaauggguaaaacauugguggagaaagggcagcagaagauccccacaagguccuucagguacaggcaucucccacugcucagaguccugcuggggguccccaagucccaaacaagaagaagcagagagcagaguucaccucuucaggagcuuaagauaaacaaguucaugcagcagacacggcuggcugcccacccaacauccaucugcacuuguccuugauagcaaaaccugagucugguuuggggaagucacaagcccagcugacauaacuguauuuucuagucucucuuauugcaagaacugggcauaugacuuaguucuggccaauaagacacccguuuaugucagucaggauuucucagaauguuuugcuucccugcaguagacaccaccccuuccucuaggucacuuucuucuuccuguccagaaagguggagaagccaucaucaauuuuaggagcaaaagccacagacuaaaguuggcaagucugaaguuaaaaggaggcuagguccuugaugacugcuucauauaacccuaccaucuuuggaccauccuacccagaucuggacuuuuaggaacaaaauaagacccuauguggcuaagccacucuagcgguguuuugaauauugcagcuaacccauuagagaagucacagucccuuaaaugugccccgcacauugccguguauagucaggacuaccagauaucccagccuauaugccccaaugggggcagcacugccaaagaauuaagugugauuuacaaaaaccugugauuacuuccuuacauguaaucuugacuacuucugaguucacuccaauuguaagcaaguuaauuaauaagaaacucaugcucaauugucugaagacugauuaaucuggcuccagcauuuuuugaauauuccauauuauuuguuucuuuauuuucauguuauuuguuaaccugguuaaguugcugugacauccucacagggauaccaacagauggcauuuacgaaaaacaguguaggaauaauaauagucagccuuucuuguguccuugccacauacacaaaaauauguauguuucagaguuugucauuguuucuaccaauaaacuaauuaucacuguaugaagcugauuuacuucagaagaaguuuacgaaaacaacuaauuaaguacaguauguugaaauauaaacugcauuacaggguuagaacccuauaauaagaucgcagaagcuugaaaguugggagaagccaucaagucucucucuagcuaaccugcuacccauugcagcaguucccuccauaucaacccugcuaugggcagucuccacaugaauguuuccagugguggggagugcgcucucugaagagccucccuguuuuacuuuucaagggcucagcucuagcuggaacaacauucuuccuuauauuuauggaucccaaauugauuucccuguaccuucuuaacaugucacaggcucacaguaagcaugcaauuagagcucagcuuugcugaacuccuucuauugguccuccauauauugagacuuacgggcucaaguauuuccucagcacuuugguaagugaaagagcaaagaaagaagucuuugcucaguggaauaccauacagagagggcgagucagucucuuaagaggagcacauggccauggagaugagagaaaccccaccuucuucuaauuuguaguugguuucuuggaagaagggagcuucauaaagaagcuagagcuggccacaagaaggaaaaugcccacaacaagauaggaggcaggaaaccccuggaaaagaaagauaccuaccugcuaguucucagggaagaggcugggccaggcaugguggcucaugccuguaaucccaguacuuugagaggcugaggcuggaggaucacuuaagccaggaguucaagacaagccugggcgacauggugagacccugucccuacaaaaaauaaaaaauuagcuggccaugguggcacacacuuguagucccagcuacucaagaggcugaggugggaggaucacuugagcuccaaagucaaggcugcagugagcugugaucacacugcugcacuccauccuaggugaaagagugagacccugucuccaauggaagaaaaaaagaaagaagcugcacaaugggagguagaaagcaggagcccaaggucgugagaggaggaaagugagugaaggaaggggcucugauuagagcuacaggcccgagggccugcccugcuccaccacuaucuauaaugagagcaacucuuuccagggauggcucccaguguuuuuccaaagcuccuacucaccugugaugcuuauuauaauuccauauacuuggcacagacaguuacaauuuuaugaauuuagcauugcuuucugucacucucuagacaacaauaugagguuuauuacaacauaaagggaaauucauccucuuggacuugacugagugucagcccaaauccccaugcugucaucucugucaucuucccuugaagaaugcaaccucaagucagggcugaagucauuggggauacauucccaaaccaggguccuggggucaggccucaagaggauaaucucaaugaucacauaagucauuucagauauugauuuacugaacaaacauuauugaacaccuauuacaugccaagcagugagcuaagaaagaagaugagaaagagaaguuugaaaggccaaaaagcccacugucuagaagauaaugcacacacaucuuaaugcacuuacucauccuugaauugaacaaauacuucuugauucaguuaggugcuuagaacuaugcuagguacugaguuuauuaccaaagugaaacagacauggucucaugaaacaggccauauacaauguuguuuuaauaugcuuagugcuaugaugagagaagugcagguacucagggagaucuuuccagaaagaacgacugauuugcauuccaagucaagaacugaauuaucaagacuaagugaauaggggggaauggaauagaacaaacgccguguacuauaacguauuaccugcuaugacagaagcaugucuguggagcuacaggagcaaaagaaaguggaugaugaccaaggcacuccuaaagggcuuaauacagccccuaacauuggguugggucuaacggaaugaaagucaaagugagagugaggaggcagugauggaagagcauuccaggcagagggaaaaccacagaauagagcacagaggccagaagaagcaugccauguuccccuagcagagaagguucuauguggucaaaguguugccuugagguggggggguuguagaagucaguaggucaaauggggguuaggggaagaagcagaaugaagggagauggaaaaggagccaaggccagggcaagagauuggggccagauggugaagaggccuguauugauguuguaaaaacauuuucaaguaagcaggaaaccaagaucagagauucaguaaagcagcuagugaacacccagcugccaaacccaggggaacaacugagaguugaaaagaggaaaugucuucugagaagccagagaaaguauuucacagaggauucagcccagggguuuuucuuuucuuaguuguaaaauccagcaagucuggaaaccccuucccucugcacagagcuggcccagagcacagugaaaaugugaagugccuuguucaucaauuauuaagaauucaaaauguugacagcagagcuuuagacaaagauagcacccuucuaaggguacggcccugugugacugcacaggucacaggcucaugaagccagcccugcacuguguuuuucugagacagagucucguucugccacccaggcuagagugcaguggugugaucucagcucacugcaaccucugccucccgaguucaagggagucuccuaccucagccucccgaguagcugggauuacaggggccugccaccacgccuggcuaauuuugauauuuuuaguagaaacaggguuucaccauguuggccaggcuggucucgaacuccugaccucaagugauccacccaccuuggccucccaaaguguugggauuacaggcgugagccaccacgccuggccagcccugcauuuuugcaccaucaggcauccuuucacuaacagaaagggugggugcuggcucccuggagccuggagucacaaggacuagaugagcaacacauugagagcucagcacugaacucauaacaucaugcaagcccccguguugaguucauuccaaaaugaaaagcuucuuuuaguuccugauuguauugauaauauacacacaggaagacaauucaagccaugcacagcaguaaguacgugauugggguggaaaugucaaauuauagguauguauuucaauuuuuuucuccccuuucuaugagagaguccucaaaaagacuuuuguuuguuaugcaaggugaugaucaagaugaaucuuagggaaacugagaggaggaggaaaugguuguacaaaauuaacaugugggauuuccuggugaucuuccuaaaauuggcucauagcucaauugcauuguaaucacagagcagacucuuuaucuaucauuuggauacuuuaagacuuguugagauuugcucugugaucccaccuauagcuaauuuuguaaguuuccaugcaugcuuaaaaauauguguauaccagccaggagugguggcucacaccuguaaucccagcauuuuaggaggcugaggcaggcagaucacuuugaggcaggaguuccagaccaguuuggccaacauggugaaaccucguuucuacuaaaaauagaaaaaauagcugggcauggugauaggcaccuguaauuucagcuacuagguacuugggaggcugaggcaggagaaucucuugaacccaggagguggaggcuccaguggguugagaucauacacuguacuccauccagccugggugacagagggagacgcugucucaaaaaauaaaaauaaaaauaaguguauccugcuauuguugguaugguauuccuuauuuguucauccguuauauuuucagcucauuuuuuucagaucuuucuauucuuacugauaugaugucugauguauuaugucuaucuuaucuaagagguuugucagaauaccaguauuuccuauguuuccacuggugaagaauucucugugucuuuuaguaugggaauaucaacuuuucuuuuguuucuuucagucuggaaauaucaauuuuauguuuauaauugaaggguauuuuugccagguuuaaaaugacagauaaacaguucuuuuccuuaaguacuuugagugcugucaauuuuauuguuguuccuaugagauguuugucaacauuuuccucuauaauugaagguuuuuaaaauuucuucuuauaauuuuuuucaaguuauucuuuacauauuugaaaucaugcuauuaugugccuaagauuuagaauaguuacaccauccuguugaacuggcccuguuaacaaugaugaguggucucuccuaaucucuaaugaugauuuuugccuuaaaaaucuacauaucucauacagauauaacugcaucagcuuuccuuggguuuauguuuguaggaaaaguaucuuuccauacuucuccuuuuugccuuucuauauccuuauguuuuauaugugucauuuguaaacaacauauagcucuauguuugcuuuuuuuuuuaacucagccugacaaacuuugccuuuuaauuaaagaaauuaaucuauuuacaguuaauguaauuacauuuauauugggcuguaagucuaccauucgcaaggagcuauuuguucugaucguucuguuccuuugucuauuuuugugcuguccucauuuggauuauuugaguauacuuuuauuguccuauguuccuucucuauuaccuuggaacauacauggcuuuguuuacuauucuuuacuguugaacuugaaaguaaaucaugaauucuugacuuaucaaaguccaauauuaauuguuauuuuuauuuucuuccaggaaaauucaaggaccuuagaacuuuuuaaauccauuuacucuucucuauauuuguguaucauuguugucauguacuuaauuuucuauauauuaaacccccaaagacauuauuauuuuauauaguuaauuuucauuagcauuuugcuugcccuucauucauuccugcaccucuggucuuccauuuaggauaauuuuucuucuccuuaaagaauaccaguauuuccuguguuuccacuggugaacaauucucuguuucuuuuaguaagggaacaucaauuuuucuuuguuucuuucagucuggaaauaucaauuuuacauuuauaauugaagaguauuuuugccagguuuaaaaugacagauuaacaguucuuuuccuuaaguacuuugagugcugucaacuuuacuguuguuccgaugaaaauaaaaccccuuuuuccucugucugcuuuuaagauuuucuuuuuguccuugauuaucagcaguuuuaccauaauguaccuagguguggauuucauuuuauucaucuuauuuggaauucauagggcuucuuaucuaaguuugauagcuucaucaguuugggaaguucuuagccauuaucucuuuaauuauuuauuuuggcccauugauucucuuuccucuucuucugagacuucaauuuuaugcaugcuagaauuuuuagcugucuuucuaucuuuuacuuucucuugugaaauuuuacauuuuugucuuuugaaagcuucuuucugaauauuuuauucuaaugugucuuccagucaacuaguuucuucuucagcuuuaugucaucucuuguuaaacccauccacugaguucuuaauuugggguaucacgauuuuuugauucuagaauuuccacuugguuauuuuuuauuguuucuaggccucugccaaauucucaaccuuaucuuuuugccuuuuggagauuguaagcauaguuaucuuaaaguuugggucuacugacucuuuuacguggagcgcauaggugucuauuucuccuaucuguuguuucugcugacaacauuucauuaaucuccuuguagcuaguuauuucgaauuaugugaucaacauuguauuugaaaaacaguaauaugcaaaaacauuugagaccuagggugauauuauuuuucuccagagagcauguccaauucugccaaguacuugggggcauuagcaauucaagauuaucuuuacauaauuucacaaguucaggggauuuuaaaguauacugcaaucccuuuagggacauguauacuuucaagaccucauuucuucuaguguaugcuuucaguauuccaacccaaaugauagagauucacuguacucgaguuuuccccauuggacccucacuucauugccucaccugagcuccagaagacugucaagagcauaguuugccucucuuccaccaccuccaaaaccagggaaggccaccaggggaaaagugauccuaaacaccacauuuacuuccuuugauuucuaucuuuucuggagcagggugcuguaauucuuuacucaguuguuagauccuuaaugcccuuauauccuaauuauuugaaaacuucuuuuagaugaacuaaauaaaugcauauauugcauuuauaugcacauuuauccaaauaaaguuuuauuuggauuugaguaacuugcucuuccacugacuuucacaggaugccugcaaacuauccugugaaugggcuaagagcacaagauuuagagugagcaaaucugguucuaauccuuguuaugcuccuagaagcagugcaauuuuaggcagcuuacuuaaacuuucuaauuaccacuucccugacugguaaagggagcugaugguuauagcuccauuguugauaaaucaaugaaauaacauugcaaaguuauauuacagugucagcaucuaguguaagcacucaucaaauagcaucuauucuuauuugauaugagccauuuaaauguaacauuuaccaaggauaaguauuuuagauugaaaaugguuauaaugaugggauuuuuuuuuucuggucguuguauuucaggaaggaacucuuaggucaucauuuuuggccccugggaauaccugcuucauaacuuuccuaugcccaaaucuuagcacuguuuaugcuguagaacucagcccuuuggaauacuuccuugcauucuuggaucaauaacaaauuccaacuaaggaaaauucugacuuuuuuuuuuuuuuugagacagagucucgcucugucgcccaggcuagggugcagugaucccagcucacugcagccucugccuccuagguucaagccaaucuccuaccucccgaguagcugggauuacaggcgugcgccaccacacccagcuaauuuuuguauuuuuagcagagacgggguuucaccauguuggccaugcuggucaugaacccccugaccucaggugauccgcacaccucggccccccgaagugcugggauuacagacgugagccaccacaccuagcccuaauucuggauuuguauacacauagucuuaaugcauaccuucaugcagagaugugugagaccccugcuuaugugucucaguuucuacaauugcuccaguugucuuaaugccuuuacuagcucccuuuuuacccacagguaaggccaaaagugcacugguaaagucccugugauuacccucaggggcuuuguuguuacagcccuacuuuaagccacuugucccuguuuuacaugucuagagauuauccacucuucaggagaccauuccugcuaauucccacuguugggcauuugaaagcaugcucauuuaaacaucaguaacuaggagucuucauuggccucaugcugcuuaauuccuaaccuggucuugaccccagagucaaagcccugugaaaagucaauacaagcagcaaacaaugguauguuauucuuggccgacuuugcaaaacaaugaaagaguucaacaauaguuaauuauggcuuaauaguugcuaacaaguauugaguguuaauaaaguggcaggcaaugugcacacauucucucauuugauucacauaacaaccaaaugagguaggcacugucauuauccccauuuuacagggaagaaagugugguuuacaggggacaaacuauuuaaucugaggccucaagccagcaacaguguugcaugucagccauucccggagucugugugcucccccacauagaauacuugccugagaaacacagaccuucagugcauuauggaggaagccauugugaaguuuuugaaggaaugucuaacagugaauaagucuguaguuauuaacagaaucgcucuguuagaauggaguagauuacgcuucuaaagacuauccugauggggauagagccugaggaccaaauuaaagcaaacagguuagcaacaucaaaaccaacucaucacaauagggggagaaaagacuggcagcaaagggauaucaucuagucacauuagugaugauguuuaauacauaguccauacgagaaguauuaucaggucuugagaaguagcuucuuagagaggcuuacgauugacaaaauggaaggcgacacaccugccaguguaugccugugaaaaaucagccuucuaggcccagcuagaauauguauuuccacaggaucucugacuggacacauucagcaugaaaccguggucacagaauuuacccccauuaaggauucuaacagcucagucugaggcuucccacagaaaucauugcauuugaguaucuuuuauggaggcaaauuaaaauaagaaaaaaaauugguaaguuacuuaguggucugguugccuugccuucuuaggaaagguuuucuuuuuuauuuugcuucugcacccccaacccccacccucugccuugugaauacuuauccaaccaaaagccuguagccaaaaggcugagauccacauuuacccaaacaguuuugguuauuacauaucugaggaagggaagaaauucuccccuuaacuuuuugaggcaauuaaaauguagcuucagaaaauuauuaugagauugaagagucccuucacuccaccuuagccauuuuuuuuuaagagauugggccuagcuccaucacccaggcuggagugcagugaugugaucauagcucacuguagccuugaacucuugggcucaagcgauccuccaugccuccaugccaccauaacuggcuaauauuuccuuuaaauuuuguuagagaugggagucucccuauguugcucaggcuggucucaaacuucuggccucaagcgauccuccugccucagucuccaugaguagcugggauuauaggcaugagucaccaugccuggccaccuuugccuuuuauccuagucucaccaaagucuaaguaaggauagaaauagauucagggacugugaaugucaagguuuaggugugaaggugaaaagguccgaaauauuuauuacaaaugauagggacaggaggcagagaaauucugggagggcaggucccuggugagggccccacucucaagcugaaaagccugauaccacagcccaaagugagaacugacagcccuguuuuccugcuugaauguugccuuuuccaaaaccacccaugguccacccugcccaccauccagugcccauagaaaccucaggcucaaccagcagagagaggagaagcagcugggcuucggagaauauaguugaacaucggagagaagugguuugacuucagagggacagcuugauaguguagcuuuggagaggaguccggccagggaugggaauauccugcuucacaaagaugguggcaaugaaggagcagugguuauauaggcuaaagcaguggcuucucacagugaagauauggaagugaaauucucaauaaacuagcucuguacacugccaggcaguaauaccuggcacacgaagugcucaaugaaugcuugcuagguaaauaaauugauuuugacagugucugagcuggccaagcuuuucagcugaaucuuaaaggaugagcuuggcaaguggagaggggauggguucaaaucaaagcauaugcaaaggcaccuggggugaggaagaccuucaaguucuuguccaggcaguuaggugggcagugguaccauugauaaaaaaagauggcagauggaggaggaggugucagucaaauuaauaacaagcauauggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggugacagagcgagacuccgucucaaaaaaauaaauaaauaaauaaaaaauaacaagcauaugcuauuuugccacaaguuggggaaauuaauguuuaagagacugguacaucaugacaaguguuacugucuaaaguugcccuucuccauauugacacaacuuacaucauucuacagucuuuuuuauuggugcauucuuugacuuuccuagagcccaucuuuuaauuuugucauuuagcacaaugggauauuauuuacuaaagauugagaugaucaugagagaaccauccaaaaucagaaacuuuauuucaaauuuauuuauuaucaccuuccuguaauagcuaggcugucacuuuauuuaauuucuugcuaaaaccuauguguuauugugucaacauuuuguagaugcagaaacaaaagcauuaaaauaaagcaucacucaaggaugugcagggcaaauuaagagauggucgcagcagagaggcagagagugaagacuauaauaauaagguugcccaacccaaaguuguaaaaacugaacauaugagacccugaauuggaaaaugacaugccugagagucauggcccaggugcgugcaauugagaacaaguaugucucuagagaagagaggaaagcaaaauggcuguuugauaaaugaagucaauguuucucaaaaugugaguuuucuaaaaugagcauuucccaaaauguacauuuuucaaauuuuaaaucuuuagagauucacaaugcauacuggcaaugagagacucugagaauaccggcaacaaagaaaacuauuuaacuucauuuaacccaauguggaucaaacuaauuugaccuuggaaugcauuuuucauggaacaucuauuaccaccucccaggaaagugugggaaacacugaguuaaaaaacgaauguuuaauuugguagaugaucaauaaaugcuuauuuuugaauuuuuaugaguaauuuucuaaugaaaucuguaucuguugucaacaguuguucaaaaauggauguaaaaaagugaaguagccaugaccuucagaaugagaagaaaaccuuagaaguaggaggaauauggcuuuacuaacauccacuaaaauaaugcaaaaaugucuaccauuuggcuuggccaacccagggauaaauuauucccucaauuuuuguagcauguaguuccucugaaacugcuaauucugcuuagaugccuucugacuguaagcgaaguuuaauuauuucauuuucuuuaauagcagaggguugguaaauuguuuaagaggaacaaacaaugucuuguuacauagguggaaggaugcagaguccuggugugcuccuggugacaugacugucaaggcauaugaaagucgauauuaacaaaaaauagagcuaaugauucauauaacaccauuuuucacuuuacauugaaauguguuggguuuguagaaugagaauauaugugauuauugggcauacuccaguucaaauuuuggcuucauuacuuguagcucuguaaucauaagucucugugcuuccguuuuguauuuguaaaacggcaucgauaguguugaauaguguagaauaaaggccuccucauuuugacucuuagaaaucuccaggagagcauagcucaucaucauccuacccugaagcaaaauauccuagcagacaugccccaccccaucccacucacaguucuaaaggagagaggucagagccaaaacauagaccugcuaacaguaagcacgugaaacacagucacuuaaucccacucccuuagauagaaaugcaaagccaaggaaccaccaggcacauaaagagaauggcagcaugaaagaagaagaaacaagaaugccuuccccccugaaaaaaaugacaaccgaggaacagaagacaacauuaaaagugcucuaauuaauaugccagggggauuugggagaaaauauuacacucuuaaaagcagaacacaaugcuaagaaaaagaaacaaagaauaaaagagaguguucacagguuuaaaacagggacuaauuacauuuuaaaaauuuaaaauauuuggaaaauaagcccaagaacucucuuuccucucucagaauguagggagagaaagacaaaggaaucgaaaacuaugagagagauccuugaagaugcgucuaggagauuuaacauacaaggcuggaguugaaaaaaauuaucaaagaaauacuugaagaaaaaauuuccaaagcugaaggacaaaauucuucagacuuaaaaggguuuccugagugcacagaacaauuagugaaaagaaagcuugccuaggcacagcuuugaugugucagaguaccaaggauaaaaacaaacaucuaaaggcuuuuauacccagccagauaucaaucaagugugaaggcagaauaaugguauuuucagaaagaaagaucucagaaaguuuauuuuuuauacauccuuuuuuaaaggguauuauagacauauuccagaaaaacaagacugagauaggaaguugugggcuccagcaaauugugguuccaauccagaccccugauagcaguuagaagaaauuuacaacauggcaauugcauugcugacauagagggcagccaguacagguggagcagaaggggggagauggggggguguaucaggucuucaggaaaagggacuuaaaaaaaugacuuggggaaaauuaaucaagggcaacuaaugcaagaaaacaacaucagcuggaaacucugaaaaucagguggaugaauguauaauaaaccugaauguauaauaaggucauaauucauauaugaagcaaacuaaaauguggcaaaauuagagcauaaagacagagagaaauuccacugaaucaugauucugggaaccuugaucagcccaggggucaugaccuuaagacauauuaaaaagaacacauuccuaauacaugacuucaucagucaaugacagaaucauagcaacuugguugcaauuucaacacaaaaacaaaagguaaacauguaucuggaaaugggacaugaaugguggggauagaacguggagaagaggagagggccaucaauaacuuuaucuuuuaaagugggaaauaaagagacauauuguugaaaguugauaaaaugagaaauggagauuuagcauaacaccuuacauuacaacaauaaacacaagaagaacagagauaaaaaugcaaaugucagacccuggcaauguccaagauucugggaggagaggggugguauuauggagcuauauccucaauuuucauauuauggagucuguaaauaucaucuauuauugacagauuaaaaaaaaauagagguauaagcauguugucuaugugaaggcaagaccagaagaauagagaauggaaaaauggaaacaagcucgcagaguggggcccaugccugucucauuuguucaacguuguaucccuagagccuagaaugguugggugccgggaauaccugcuuaaugaaugcaugaaaagaaguucacccugggcaaugguacuggaggugaagagaagggccaggggcuguugcuuuccaacacugaguaguugcagauggagguauuauuuugguuaaaaaaaaaaucuguaauugugaaaacuauggaagaaugaggcaugcuguaaaggggguggucaccuuggggaggggaauguaggaagaacucuggaggaggagccagccaaggaaggagaggagguguucccagcugaggaaauaguguggagacuccaaguggaaggaagacagauccagcuggcuggagcacagcagggggugggugacaggcuccgcgugagccuggggagguaggcaggggccagguuuacacaggcaugguaggccacauucaggaugcugaugaacugcucaagaaaugcucugugcacacacuugggaccagggugccauggcauucuguucuuaacugaucaggaauggccuggaccuuuggauuugauguaugggaucuaauuacuuugagcaaccaaaaaaagagaagaaaaugcuaccuauuagauaacugaauaaauagagcguggccaacuucucacacccauccugugcuuauugcaugaggcgaaugagaugugcugggaaugccggggaaauggcuggauuuucuccucaccaagguguugcuacuugucaggaaguugugacacugguuuagcacggaggcagagaaacacgaucaggacaauuuaggcauugaucaguggcaaagcauguucuguucgagaagccagaggaguguuuacugggcucucaggagcaugaggccgggccagcugccaaggauaauuguaaagauaugggcucuauucugaagaagugcccauucuuagaagacagaaauagauguggaugcacacagauccagauucucacagagcacaaaugcugcacggggauuaggcuuggugcucugggaagcugaauuaacucuuccaacccacuaggguccuuguuagugcaucgaagcaguaauuuacucaaugacaagaguucacgucgcuuucuaaggcacuuaacuuacucccaggauguugguugcacaccaggggaaucuggcucacuaaucuuuaauacuugucauaauuauuuuucuuucaauaauacuauuucccccuugagaaacucaaaauuauuacauaagaaauguagaaauauaagugugugauauuuuuuaauaaaauguagucaguggccccagggaauuuuuguagcaaaagccucucaaaucaauuauguuuucucauuucuguuuccaauaauugaauauuuuauuucuauauuuauuuaaguucuuucaaaaugaaaagguggaguuguguugacacacugggaaaggaggguauuauuaauuaaacuuguuuaaagucuaagauggaaacagugcugaugcauauacauuugcuucaaugagcuguuggcugcucugugagguuacagaaauauuauuggcaguugcgggugguggcaccauuauaugcaucauuccauccucucugggaggucccuggugguggcccuccaagaggcaucauuccaucaucucuaggagguaacucugcaaucacaguucauccagucagagaaaaaaugaccgaggcuccccuagguguuuaguguccaugacucagcgguuuagaaaauccaggauuacggacugcauuugucucauuuuaaucuggauguucaguccugcucccucccucugucacuucaacuggcccucacugucaugugccuccauugucucaucugauucuaacauuccugcugugaugugggugggggugaaggucauuccccuuucauagguaaggaacacaagguucagaaagguugaggacauuugcccagggucacaaggcugcuuggugucggagucagaacuagccugggguggggaaauggggucuucugguuccuugcggucacuuccuguggagucccugaccuccgguccuguuuugccugaccucucagcuucaacugcucuuccaugccacugcugcacaaaugcucugaauguuugaauaaacaaccccugagaagaguagcccaaggaagucccugcccagagacugaugaguuguuacccagaggccuggagagcucccaggauggcagacacugccugcaggaguuggcauucaucagaaaacaguucuucacggaguagguagaucuucaacccugucuggcuagcucccuuucuaagcuggaggugucagaggcgugugaaccagagcaacuccaucuugaauaggagcuggguaaaugaggcugaaaucuacugggcugcauucccagacauuuaaggcauucuaauucacaggaugagaugggaggucagcacaagauacagguccuaaagacguugcugauaaaacagauugcaguaaagaagccggcuaaaucccaccaaaaccaagauggccaugagagugaccucugaucguccucacugcuacacucccaccagcaccaugacaguuuacaaaugccauggcaacaucaggaaguuacucuauaucaucuaaaaaugggaggcacgaauaauccaccccuuguuuagcguaucauccagaaauagccauaaaaaugggcaaccagcagcccucggggcugcucugucuauggaguagccauucguuuauuccuucacguuuuuaauaaacuuguuuucacuugacucugugaacucgcccugaauucuuucuugcgugagauccaagacccccucucuuggagucuggaucgggaccacuuuccuguaacagaggcuccuuuaaaacagguauggauaauaccaccccuaguucucucucuuuccucuagcccagccucauggggaaaccucuccagaggccucugauuuuuucugugguugguuaaggaagaccagagugaccuacucaaggaaguuaauuucagaggucaagcaaugacuuucccagagucugccucuucaaacucaugccacuggagauuaauaaacguugguuauuguuauuuggccccaaggaggcuuugaaugcggagaauugcgaccugcaugccuaggucaaccccauagccuuagaucgagccacugugacaccagaaggugaaaugggacacaaggguagaaauuacaaagaggcugccuucaguuugaaauaaaggacuuucaaguaauuagaacucuuucaaaaaggaauggcccugucaaaagguuucguugccagaaguaguuaaagaguuguugacuacaugucuaagugugcugggaagggagaggaugguuagaauagaugaccucuaaggucucagcacggagauauuuaauuuguauauccuuccuguggacacauuucuguguccuggaguacacagggagggaguggggucagaggucagggccaauggucagggggcuccagagcaucugccucuggacacaacacaggcccacagcucauaggccuggcuaccuucucaguuccccugguuucaucaacauugucaccauugacuggguuagcagcagcaaccgcuuaacguaacuaaaauaucuauucugaugagauucuggaacaaaaaucccaaaugacuuuuccccucgaaucauaggaaacugcagcagagauaucacuguaucacuugaauguguaccugcuugccaguuacuccggauugaugcuucccgauguaaacaauggcugaucguaaggucuaaaucauaugugugaaacuuucugcaaaacaaaagcgauuggguauuuaggcaaaaacaucaguuuaguaguuucccuggcaaauguccuauaacucuguguguguguguguguguguguguguguguguguauacauauucauguauaaaacaguuugcuuuacaagcaaguaauggucaggucauucugcugggcaauuuacucucuaggaacccaaaggggccuguguuacaugcaugcuuuuuuacagguuacucagagccauuuagaaaauuacuauugugcuucacaaaaugccccaccagccugaggaauuaacccucuucccaauacgucuaauucacuuguucuucagguaaucggcacauuaaagcugaugcagauccagugucuauauaauaaaaacagcuaauuuuuacugagcgcuuagcauguucccggaacucuaaaugaauuggauacagcuucaauaaauccucacaacaacccagaugagaguuccauuauuguccccauuuuaacugaagaguaaauugagacucagagagaaaaguaauuugcucauggucacauagcuucuagugccuggcauguaugaggccugcaaugagugaugauuaauauuauuuuauagugggaggcacaguugggauuucaguccaggucuaacacucaaugaagccuuuacacguggccucuauguaguccugccucauagaauucauauugugcaugaaaaggaggcaugccauggccaagugcugccagcgggaaucccuguccuaagggaggcauauuguguaugucacacuuucaguagcucccugucaguugacagcguguggcacguaaagcagaaugauugagauaggagucuccaaacucagguaggaugcgugaaguuuccagaaguucaugaauacauucaguguuagugcaaacuauggcuagguucauagcuugcagaugucauccuuccuaaaacugaugugcccgagaaugcucugcaggcaaggcuccaugccagcuccacguuucugcaccccagguuucugccagaccagauacucaccucaucugggccuguccucugcgcaaaaguaagagacacccgcucugaagagugcaccccaugggcacagggcucgaugagaugccaaugcauuugugagaauuagaaaacagauuucccuuucucugagcaagagaagugugggcuggauuuuagucuccauccacgggcucagccgugugcccacaggcacaucacugccugcccaaaucuuauagcagugcguugccuaaguaauaaaagccccugggcaccaaaggggcaguuucaaauacugauuuccaggaagcuucggaguauggaguuuccuguaguucuuuuaggagguuugugagcaaaaucacuggcugcaguguggguugaugagaucacugggcugccaucgcaggucccuggggcaugagcuaccuccaggacagccccacagagacagccccacagagacagagacacuagcaguaccacaggcuucucagcugagaugacagagggcaccugcuaggccagaagguuaaccacucacucuucauuuccaaacaaagauagucaagcaucucuuaaaguacaaaaauauaacugcaggccagacaacaauaaagauugaauaauagacucauaaaauuaauggucagaaacuccauagcaauauuuucagcuccacguuucucuagccccagauuauaaacaccauacuuaaaacaacaaaaaagaugcacucaacuuuccagccacugcuuaagaacggggcagcuuacuaauccugggaaacuuacaccuggggacaaaguuuauuauugguuuaaccaaacugagaaagugcugguuuagucucucuaugguacuuucucaucccuuaagcuacuugaaugaguaugauuuucagguuaguauuaaugauaugaugugagugcaguuuucgugggagaggcugccuuuuaauauagguuucucaagaauuaaagaacuucugcagcacccucuccauuauauauaugagucaaauguugauauaaagcaguguugccaccaaagacuaccacacaccccagggaucuagggaugaaugagugaaagaauaaauaaacuuuuuuuaaauuuuuuuauuuuuauuuuuuuuagaggcagagucuugcucuguugcccaggcuggagugcaguggugcagucucagcucacugcaaccucugccucccggguucaagugauucuccugccucagccucccgaggagcugggauuauaggcauguaccaccacacccggcuaauuuuuguauuuuuaguagagacgggguuucaccauguuggguaggcuggucuugaacuccugaccucaaguuauccaccugccucagcuuccuaaagugcugggauuacaggcguggauaaacauuuuuaaaguuccaucugugugucauacauggcauuagaagauaauaguaauguuaaaagcuaauguuuguugagcacccacuauauccuagaccuuguucuaagaaggguucauaucuuugcucauugaaucugccauccccuuuuacagaacagguaacuggcucacccucacucagccaggacauaaaggagucagggugggauggagugccugccuugagggguacauugcucccagcuccgagggaggaccggcccgccacacacuccaccuccuuuggcagaacauuuuuaguuccacaucuuggagaauugguuccccaucuaaacccacagguuguaccuaggauucugcuguugaaauugaaggaugccucaguuagacaggaggaauaaguucaggagauccaucguacagcauggugacuauacuuaagaacaauguguuauaugcuugaaaauugcuuagagaguagauuccaaguauccucacaacacacacaaaauaaguaaaugacaaguaauacauaugaauacauauguuaaauggcuugauuuagccaucccacaauguauaccuauaucaaagcaucaugcuaugugccauaaauauacacauuuuugucaaucagaaaauaacucuagaaacaacaaaacaaagccaacacuacuaaaaagacaaagaauguaguuaagucuuuuuucugcuuaaucaagagaaagaucaauaagauauaauaacuuaaugaagagagaaaaaagaaaaagacuagagaaauuuagaaaaguuucuugaaaaacaaagggugcgguaucuuuuuuccucuucauccucagcuuuaguugaaaauuaagugaaguauaaggcaguauacauacacuaaugccaagugaauaaccagacucucgcuguccacuaugguaaccacuaaccacaugugacugcugagcauuugaaucauagcuaaucuaauuugaagacuuaguacucaaaaaaauguuaaauaucucauuuccuguuuuuauauugauuacacauugaaaugauaauauuuuuucuuguuuuggauuaaguaaaauauauuauuaaaaauuuuaaaaaauugaaugaugcuggccuuuucaaauuugaaagaagaaauuaggucaauggguuggguuuucucaauguucuguuuuuguuuuuuuuuuuuagauacgggguuuugcuuugucuugcaggcuggagugcagaggugugaucagcucacggcagcuucgaacucuuggggcucaagugauccuuccaccucagccucccaacagcugggauuacaggcaugcacuaccauaccuggcucucauauuuuaaaagacuauauugcugucugggugcgguggcucacaccuguaaucucagcacuuuaggagguugaggugggaggaucacuugagcccaggaguuggaggcugcagugaacugugaucaccacugcacuccagccugggugacagagccagacccugucucuaaaaaauaaaauaaaauaugagaaguaaaaacaauuaaaaaaaaacacccugcacucauccacaauuccaucacuggaaauauucacuuuaauguuugaaaauguaucuccuaguauguauguuucguuguuuguuuuuuaaccagagugcagucauacuacacauacuacuuuuuuuuuucuuuuagaggcaggguuucacaguguaguucaggcuggagugcaguggccacucacaggcaugaucauagugacuuacagccuggaacuccuggacucaagcaaucuuccuuucucagccucccagcuggaauuacaggcacaugccacugugccuggcucucauguacuacuuuuuauccaacuuuuuuucacuuaauaaaauaggccgggcacaguggcucaugccuguaaucccagcacuuugggaggcugaggugggcagaucaugaggucaggagaucgagaccauccuggcuaacacggugaaaaccugucucuacuaaacauacacaaaaauuacccaggcaugguggcggacgccuguagucccagcuucuggggaggcugaggcaggagaauggcaugcaccugggaggcggagcuugcagugagcugagaucgcgccacugcacuccagccugggugacagagcgagacucugucucaaaaaaauaaauaaaauaaaauaacaauaauaauauaaaggggccaucuuuauauuucaaaagaaauauauaucaggauuuuacaugacugcauaguauuucacuggacuaauaugguacaauuugcucaagccacucucuaucuuuggaaauguagcuuguuuccucauuuuugcuaugaugaaacacauuaugauaaauaucuuugcacauacacccaucaggagaaauaucuaguuuuuaaggcuuuugacagcuacuacaggggauuacccacaggaaaguuuguaccaacaugaauucauauaagccuuguauaaaaauaugcauuuuccaacacuaauacuagcauuaaaauuucaucaauauuauuguauuucaauguguagcuuugguuuacuaauaaaguaaaauuuuucuucccaacugcuuauuaggcaucuguauuuuuuuucugaauuuauuugacagagcuccuuauauaugaaggauaguaagcugucauuauauauugaaguauuuuuccagguuugccauucaucuuuuuauguuuuuguggcauuuucgacagagucaaagcuaucuuuauuuucauuuauacuuuauuuauuugguaucaggcuuacaaaaaacuaucaucccaagaucauuuaaucuuuaccugaauuuuucccuagcaauuuuacagcuuuauuaucucacaugacgauccuuuuagaauuuauuuugauuuaauacacuagguuugcaucuagcuuuuacucuccucuccaccacccauagcaguuagacagcgucucaauaucauuuacugaaaaguuauccaaucguucauuuauucaguaaacaguuuaucuaagacccauaggaccaggcauuguucuagguccuugggauacaagaaggaacuuucauucuaauggaaacagcagauaauggcaacuaaauauauaugguaaauggagcuaaaugcagugaacagggagaggcuggcuauuuuauacaagguggucagggaagcucucucugaaaugguggcauugggcagagaccuaaagggagugagaggugaccuaugcaucuggggaagagcuccaaggugcuaggccaugacauaggaguguucaagaaaugaugaagagaccacucuacuggagcaguaccacaaauaagggagagagcaccagaacaguucagaggggugacaggagccagaucauguagccccugauaggucacagugaagaccuuggauuuugcacugggugaggguaguggauuguauuucccaaagauggccacagcagugugugugagaucuuuugcaaugugacauugucacgccucccucaggagguggaaccuauuccucaaccucuuugagucuuagcaggccuggugacugcuuuugucaauagaagacgggauaaaggcugcuguguauuuuaggagcaacucuuaacugcuguggcagcuucugcuuccugccucuuagaaaccaaucacaaugcaaaaagugcaaccaccaaaacauggccauucugugagaagcccaaggcacagggagagccugggagaaugagaugccacaugaagagagagagcgcccaaggagcuccaaggcaccagacgugugaguggaaggggauccuccugcucagccagcccagacaaccaaauacccagauucaugacccaugacaucuugagcaaaugcggaagguuguuuugagccaccaugguuuaggguaguugguuaugcggcaagggacaacuggaacugugaaauagggacccauaggagaguucugagcagucauauauuuugacuuaaguguuauaagaauuccuccagcucugcgcuaagaacagugugaaggagggagaguguggaaagaagauuacuuuggagagcaggggagagaccauaggaucuaggaccagggaggcagaggcuaaagugcuaagaagcaauucaauucuggaugauuucaaagaacacacagaugggauuugcugauggauuagcuauggguugugaaggaaagaagugaaggauggcuucaagguccuaggcugacacuggaagaaugaaggggcuucguggggaugugagaaaacugugggaggaacagggcuggaguuagagaaauuagcaauucugcuucggacauguuaagacguaagguugaacacacauucaaaaggagagacugaguguugugcgagagcugggucuguaguugggaaagaagucagggcugggagauguaaguuugggcaucguugguguuucaguggucacaguggaccagaucaucugggagcgaaugcagauaaagcagggccaucgggggacuggggcgcuucaccacccggagaugugggagagguggagaaggcacccaaaagggaggccgagaaggcgcggccagugugguaggaagagaggaagagaaugaugaucugggaggcagaggaggaagguuuccagaaggaagaagugaaugugucaaaucagcugaagaaucaagucaaaugaagacugacaauucucacuaugacuguccucauucuugaaauuacugauuugaaaaggggcuuuucccauauucuaaauggacacaugugggagugugugugcacuuucacacuuucccuucucccccauugaucuguuuauccauuuggagcuaugugaccgcugaagcuuuuguaucugacaaaacaaguagcacacuuccucuuuuucucaucuuuuuuucaaaaguauccugguuauucuuaucuaaaauuaauuugaaauuugacauuugaauuuuaucaaguccucucccuccccaaaugcauuggaauuuuaauuuaaucuuuuaaaauaaaaauugguuuccugagaguugauauugaguuuucuaugugguauauguuuccauuuauguauguuuuacaucgcuaaguagauuuuauagauucuuuuuauauaggucuugugguguuuccucuuaaauucuuuucuagguauuuaacuuuugaugccuuuuaugaauugcaucccauuuccccauugcauuuucuuacugaccuuuuucuuuuugccauaaggaaucuauuuauauauaaagaauucuauuauuuugaauuauuuuacugcugauacaaacagauugcaacaccuuuauuauuuucaccgcgugggaucccacauguaugaaguuauauaaccgauguauaaggcuguccuaaucucugcuaguaaaaucguuccuaguuuggaggaugggauuuaauaugacaggauuucaugguguuucccaaagaacuucaugauuuccaggugcucugggaaugacuguagccacacaucucagaaugucccagauauucccaauuucaaagauuuuucccuuuguuaacccaugagucagaccauauguccuuugaucuuugcuucaaaaaauauugccaugguauuuagaaacagggacagcccaggcaaaguuguaacacaugggauguuuuuccucugagccccuaacuuaccccucaguacucuuccugguuaugugugccuggugcgugcaugugugcacgugcacacgugcauacacacacacacacacacacacagacacacagaggcauccuggaggaaagggauuuuauucaaauacaaccacaugaacugccuguacagccuagacucaggaucgcccuaagggaguuggcauggaagauuucagagcugggcagacugggcggggaccucucaucuguguuuccugagggucaccuagccucuuugagccuccguucuccauaggugaaaggaguguaucauaucugccuugcagggguguugugggacucagaagauguccauaacaucuaugcccaguguagaguaggaacugggaaauaauauccauuacugugauuuugugaggaguuccagauaacugcucaggucuuuaagagaauuccuuggucuucauacuccacucccagcuguggaagcaaagcaaucagaaugaggaugcaggaagcaugggguggccaucugccaguucucccuuuuguaugccuauuucugcaaacaaacccaccaacgauuagauugcccaugauaacaagccagccuccacucagagcucaccgugcaaugacuguguggaagacauuugugauuuuuuugcugucaccaccaacuaucuucccuuccuguuaccaccgcagucuuccuucuggggaugccucaccaugcauagaugugggagauaggccggaagucuaauggagggucuaccuuuccucaaggggcaagcaugugaucuaaacaggggucaucacucucuccccucuuucugggauuuuaaauaagugacaucccaauauggggacaauugaggucauaucugucacuguggcagccacaucauguggcccagacuguugccacauuuccauuccugugguucuuaacgguguucuuaccuuugcuugcugcucuauuuuaagucaaucagcccccaauauuguucugcuagauugacauuuuguucagcauagccugauucaguuucugucuuuugcaacaggagcacuaucugauacaaccagacuccaagaggaaaauagaaaaagggagcucauaccacuuaaaaagauuucucuuuacuguggucaucauccagggcuugggagaaaggugaaaucuuaaaagauaccaguaggccgggugcaguggcucaugccuguaaucccagcaguuugggaggccaacggggggcgcaucaccugaggucaggaguucgagacaagccuggccaauauggugaaaccccaucucuacuaaaaauacaaaaauuagccaggcgugacggugggcgccuguaaucccagcuccucaggagacugaggcaggaaaaucacuugaacccaggaggcggaggcugcagugagccgaaaucauggcacugcucuccagccuggguaacagagcaagacucugucucaaaaaaaaaaaaaaaaagacaccacuaaaugggacacaacaacugaguugaaguuaugcaucauuacauuagagaggauuuggggguagaaugccuuucuguuugccaauuuaucaucaaaggggcaagaggaugaagggcggaagggaaguggugaauaucaacuuauacaaccaccacucaaacacaaacucuuugcaugcuuuuaggagaacuugaaacaauuucaauuuucaggauggggaaaaguaaaagcccuauuugcccuuucucucuucauuauccauggucuccacauugcuccuugguccugagaaagcugccacaaagcauuuuacuaguuaucugauugucauuccauuuaacauguccccuggucugcuggcugaugguaguuuaagcaggaucuaauugguaacauauugccgauugaauuaagugccauaugauagagauuuaaaccaugguaauuuuuccauaaagaaaaaucugucaacaggcuauaggggaggaacagcaauaaaucaaauugucguguuuauuaguuauugcaggagucuaguugucuuguauucauuauaaccccccauuuuuagugcagauaaaaacuacaaagaggaauaucugugcaagaugcuuuuuaauagguuuguauuuguacacaaacaccugcuuguauuuuaaugaugagaacaauggugccauuucacuuugaaaggagcauguauuuuuggcuguuuucuggaugaagaauaauguuuuuaguuuuugucaaagcuauguuuuaaaacauugagaaucaacucacuaauaaccaaaaaaaaggcaaaugaaagcagaaaugagauaugacuuguuugucagacuuggaaauacuaaaagaacagauaggaugauugcacuaaaggauuucuagaacagucauugcaauuuaacuugugauauucaaaaaccggaaaucaacuaaauuuucauauaugggaaugguugcacaaauuauggaacaucagcuccagagggugcaaaugggucauuugaaagaacaaguuaaaucauaccuaaugacaugucauuaagaaccaacauuauuuauacuuuucauuuccauuuaacuugccuuuaccgaagguggauuucaacacguuuuccuuacaugacucggaaauaauauaacagcauuuuacguauguagacucauugagcccucauaaaauccugugaacucuguaggacaggacauuacacccacuucacagaaaaagauguggaagugcagaagauaaaaguuauuuauggaaggguccauagcugucaaccuugauaggcaagacaucagguccuuccucugaguagugguguagaaaaaaugguuggaauuuagaaaccagcauccagcuccucaccaugccuucagcuuucucugugacuuugaacuuguuucuuaaacucucugaaacuggacguccucacuggucacguuuuguuacuacuugcuuuguauucugggugugaugggugggggauugggacacagaaucuggagauggucagaucccaacgcugcuauuucccugcucugcacucuuaggcuaccuaccaaucucuccucuaaaauaagcauaauugcaauggcucagauacaauaacaaaauguguguaaaaugccgagcaccacgucucacaccugagaggcacugaaugcauguuauauacuaucauuuggaugucaccguuccaugugccuauuuccugguuugcuguacaagauguguaugaguacaugucaucaagcccacagagcuccagaacauguuccucucacaagcaggccucauagggagggguguucugugcuguuccucuuuccugcucacuacuugucuguagcuacaguguaaggacuguaaugucacugcucuggccuuaagugucaccccccaaacccauuuuacacacaccaccucccaccuuucaccuuucccaaacucuuaccaugucccuucaaguuugauggcuuaauuguacaaaagguagugaugaugaugaugaugaugaugacaaugauaacagcugcuaauacuuacugagcccuuucaauguuccaggcacuugucuaagcacuuuacauguauuagcuuauuuaauucuuaagaggaagggauuacuaucuacuauuguacuuguguuacagaugugggaacuccgaugcagagauguauagugacuugccuaaaaccaucauguuagagugggaauuuaaaccuugaaaucuggaaaauaagcaauguauauauuuuucuauuuucuaaaugcaaaucaaauauacauaugcauaacaccacuaaacacuaagugcaguuacgccuagaacaagggaauagcaguugacagaaacacaaccaaaacuaagaauauuaaaugucuguauuacuuucacuguaaucacuucacuucaacagugagaugggauagcccuagguaaaggaaggugcucuuguaguuagaacauucuuaaauuuugcaccaaggaacacaugcuuuuaauaauggcagagacaacauuuuuugauggauuauuuaguuuguacgaucaacauucaaagaaugaguuuaccaccacuuuguuauuguaaacacuugaccuuuagcuaccugaaugauccccucuuugaauaaaaggaauuaugaaacacauguguagacauauuucauuuuuauauaugugagacucgaauagcaaggaaaucacauauuaggaaaaaaaccccuuugucuugcuauuaguucucuuugguuucaaaaaucuggucacuguguauauugcauuauaucauauguguguguacauauauauacacacauaaacacacauacacacaaugucauguguauaaauacaugauguguuuaugcacauacacagacacacacacacaaauacacacauauacaauguuccauccaagaaauacaaauauagugcuguuagccccuaacagugaggaggucauuauuccaagucauuucugcagaagugacgguggccuuagguggaacugcccaugaucucuccuugcaagcucacucacuggggccauugacugggauccagucuguggccaugucaugguuucuauuuuugagguuauagcuaaugagcaacaugagguuaagacacacuuuucauaaggccccagccagcaucauaaauaugugugugagcauguucacacucagguuaugucuucuuuaugugcacccucuaccacacacacacacacacaugcacacgcacacacacugacggcuucagugaccaacuuuggucacaucccaucucuuccuucucaaucccucuggcuguucaccagggccuggaccaucucggugaggcugaccaagaaugcucccccugcccugaccagcggagcaugggcacagcuacuuagagcgccacccuucaggacacaaagucggggcuaccucucuuccaggcaaggcauccuagagggcccgcacacccuccaguuugaucuuaccucucagcucccguuccuuuucuuucucuccccaguaagucguugaacgucuuucuucugaggcugagcguggagcucucuucucgcuggcgagcuuucu

SEQ ID NO: 21197 - RNA, 18296 nt, Homo sapiens
uucuagacauaaacuuuauuacauuuauaguuguaucccuuugugugauauaguuaggauuucucuauuaaguaauuaauccuaacuauauccuugggcugauuugauuucugcccccacccgacagacugacccuugucccccuuccccauuccagcucaaggcacuuaauauuacaaagaaggcaguggcuggcuggagagaugggccucaagucagaaaucccccagugcaacuuaagacaaacagagagaagucaccuuccucuuaggacccucccuggguuagcagaaggaaagaacccagaagucuucaguaccacaguaggcuucgguaucucccuagccaggugagggacccccaggcauucucccugcccgcaccgagucucucuucacccuggcuacuuccuggccacacguaugacucugccccuuacuuucugcucugagcugccugaauacaggaagcaagaguucacucugaccagagauccagaagccugcaaggaggccccagcagcuuucaagaauggggagcagauggccacauguggccugcucugucuuauagcgucacaagccaggagcaagcccaggggagaugcuguuccaugcuggccuguauagguuacuuugcucguucuguuaucugucccccaucccuaacccagauaaacaauacauaugucacugaaacaagaagggauugaagcaaggagacccaugggcacagaucucuucuaccuuccugagcuaaaagaugccaagccaaaggaauacaggauaauggccuauguguccaggaggccggggacaaagcucucuggcuuugcugggggaagaaauagcuccaacuacguagucaagaagccugugacagaggugggaggggaaccucgugaccuugaagucacuucuaccuuucauauucccuucuagcuaucgaauaggcucuuuucauauuccucacaaccccagcuguuaggaagaauguggugucauacaguagguggcggggagaagacacaucuucagccuagucccugccaagcccaccaagagcaacaguuagucccuagcuccuccguccccaccaaguacccacacauccauagccagagaggccaccugucuccaggacagaaaggaaacugggcauguuacucaaggggaaggaaaggggccuaaagcccagaccacagucauagggcccagcccucuagcuuggaagggagagcccaggaucgggugaaaaugggggcuugcuccuuaauugcgaucccccaucagcugcagcacaaaggugaagauguagaugaugucuguguaaaucugcagggcgccagugauguaguccucggggcugauggugugcuuccgguuccccaggaccagcugugugucguaagccaggaacugcaaggauagggaagccagaagugagaacucaggcaucaguguccagagcucauuuuuggucagcagauuugucuugggggccuaugcgccacacagugcuuagggccacauuaacgcacagcauaacauaugggcucuauacuguagcugcucacagucuaggaaaggaggcagacacaccguucucaauauggcugacuaguguucuaauagcaggcagcuugaacaagagauggcaagagugcccacaaaaaucaauggaaucucuggacaguagugagaggaauggccugcuauggccccauucccugccucccaggcagucuaaauucaugcccccuucccuagauuccuccccucauccccucagcuccccuuccuagaguggggcugggacuuaccagggugaaacaaauggcccccagagcagcauagagcauguggagccaguaaaccuggagaagaaggggacagagaauggcauuagaaaccucagcaaaccacaggcccacaggccccagcuucccccgggauaguggcaugagaguggguagagcugggaagcuagcucuccaugaaaggcuacugccuuuccagaucuuggaggaaauuaagacuggugauauauccagcagagaaagcagaggccauccugcaauggcuguauaaaaccaaucuccaaagccagucaagguacacaagugucuacuauacuucuagaaaaaaagcaguugaguuacagcucugaaaggggcagacccagcauucaauagaccaguuccuacagcccagccugggagggguagacuaaggaagaagggaggccccccaaccccucuggugaguaucaaaauccgggagcacccacaggacagcccacaugacaugcccacagguggccguccacagaaggacagagcuggcccaugggcaggcagcccucguguccccauccuuccccuucggcacuguucucccccagcugaacagaauaaaggaaauaauuggauccagagacccccgcaaggucccuuccaccuaggcccaucaucucaguccucuggguuccucucccagucugccuccgagaaccugauucucagcugccagccagauugaacccaccccuuccccuaggagugcagugaugcaguccagggcuucaggugcucuggcuccaaggccgcccaucuccacacagagagucuacccucacccagaaggaugcugccuccacguuggugccuuugcuagccagucgagagguucuggaggucagagccugccccggggaccuuuggggccugcgagaccaugcuauauaggaagucugcccugagcacuggguucccugaccccagcucuccugggacacucacguauuggaaguagagcacaaugcuagugacaaucccagucaccaggagcacaauucccaggacacagaagaggccugugcacgaggugaaguccaccugccaggaagcaagaaagaggcaccugucagauggcugugacaaccagcccagucagacuggcccugccagggagucccagugcugccuccuaggggguaugggaauguccacaacauucuaaggacagaaacaggacacaguuuuguaggugcggaugaggagaaggggaucaggucucuagggaacaucccuagugugccgggguccgggccugauaagaaaggggagucggggggccagggaagggcccuccaugcccucaccuuggucugaaagcagaagauggugacugaaauggauaccaccgcagugaugaucauugcaaugaugacggcuuugguuugguacauacuggggagaagcaggaguuacagacaagaggcauuaagccacguaugaaugacuucaaaaucaccacuuccagaggggaccugcccagaauccacccacgcagcuggcugccggcccaggaacaccccacuccccacaauacacauuucccaagaguggugcuuuaucccugaauguaccuggaaauggugcccgucaugaagcccauggcaaaagucuaagggaaggagagagacaagaaugaaacacuuaaaaaggaaggaaggcagggugcugggggaguggccaugguggccucugccagagcuggggaacgccaccaaguuggaaagaggcagccacagaggagaucagaacaggcggcccagauaagguggaggagacagccaggacauccuucugaaauggguccccaucccuucccugggagcagucucccucacagcaucuccacacccuccugccacccuucuagacuuacaaaaagggucagcagaaugauguuccaugggaaacggcgucugaagggaaagagaagccuugauuaaaugacuuggggccccucaggcgucagaggcuccuacagcagaaggaagcgcuuggcuccugugccuggaggauuaagccuugacuccaaggagggagguuggcauggccuuuggcaccuguucaggugugguacgcagggacaacaugggccaaugagacagaccuguguuguggcgccagaaacaccuggauugguuugcaacucuuaaacugacugccugugugauggggagaaaguuacucagccucuuugagccucggguucuuccuauuuguuaacuggcuaaaaugcuaccugucuugcaggguuacuauaagagugacagcuaguuagcuccuaaacacacaugguccuuuguauacaccugaacaguagcugucaucgucauccuccuccucauuucuuguaaguuuccauucagcugcuauaaaggaauccuucuuuccaaaauacucggcccccaucccaaucccugucaccccucucacuguguuaagucucugggacucaccugggucccuggcagcaggcaaggaucagguaggugacaacgaagacagcacuagggacaaagagauggggaagcaguucaggcccaaaucugccccgcuuggcagcacacaccaggccagugauuuggggcccaaauagccguuuggaagucugaggggaagcaacucaacaggaagcaagaacgagauuacccccagccagggucacugagaugcucugaagcaccaggcuccggccaggaaggaggucuggggaggcugcagcugacgggcugagaggacaugggggcugcagcgcagcgugcacgccaccaccagcaggucccacucuugcucucgaguucuaggggucugcuacucaucugggcacgcacacccacacccucuggcacgggaaacuggcaccaacuugggggcccucucaaaaagcauuuugauccugcccugagcaaagcuggucaccuagaaacagaagcugccaccccugccucccugcccaaccacagaggagcacacacucacuaggacacguaguagacagccacauuucuccucacaaaggcgcugacagguucccuguggggcacaggaggacaggaguagucacccugaggcuugucugccccacccaggccagccaggcagcccuggcuucaccuucucuaauugcccauggucacccugagagcagggcccaccgccacccacacccccagcaggugacccugaacccccagggcaguaggaguggguggcaaagccuagagacuuacacaaaggugaagauagcaaugauggccacagugaugagcagcugcacggagaugauggaguaaaccuggacacagacggccgggcaugggucaccauccggcaccccuggccugccccaggaagcugccagcccccaguacuuuccucccacucaagaacccucccuagcugcagccuggcccagaggcgaccccagugagaugccuggcucagaggcaaugugcacuucuuccucagccccgcucccaugcucccugccaucuccccuccuguccaacaccagccucggugacuacugacuugcccugccuggccaccauacucuaccaguauggccucugcacucccagcagcucagucugcacgcucuaugcagcugugagauggagaggguggguuacaagcgaguaggaucauuucuggcuccaagcugccuauagucuaaagggagaaagaugucuggggaaggcgggcgcuguggcagaacccaccuaggagauucucccagacugaauguguccucccaaaacauggucaagaagagaggugcaaaaagagagggaacccugggguuagagaagccaggugccccucugagaagcagacaaggcuagagaagacaggcagccaguguauuucauggaauugaugcccuggggcuacuguggccuacccacuucccauucccacagccugaggggccccagguacacccaccucccagcgcguaucuuaccuuucggauaaaagugugucgcacuuuccggucaucccacucuccaggcccgaagcuaucacucacugcucucuccuccccaucauagccauggccugggccuagggacagaugacacuugacucagcuggggaccugagacauguggcgucaaucccaaagccucccugacaaucucaaagucucagggaucuccagccaaaagacaaguguuauaacaggaacucuucucccaagcuggggucuucuagacacccucagagugacccagagccggccugucacgagggggcuuaggugggaaacguuccucacgugcaucuguggagggcuccugugugcccagcccacgccacuggggguucacuggggggucacgauguaguggggaagccaggcaggagcagguaugggcauccacuggggcagccagccagggcagaacaggggauggggacagaggguaggagaaaaggagggcggcagagcgcaguuugugcagcagcagggauagaggugaagacagggaucugcaucagccucacagaggcaggugugcaaagggugugcgugacugugcaggacccaugcgcagauccgcaccagcgcacauguccaggugagagcuggcugacaccccucugggguucagagaugcugcagggcugcaaacauucccugaaugccugaaugccugaaugccucuuugggaacuacuuuuaaaauccacgcuugagccacccaggaagacucacugcacucuaacuucaccucauuuccuuuuuuuuuuuuuuuuuuuuuuugagauggaguuucggucuuguugcccaagcuggagugcaaaggcgugaucucggcucaccgcaaccuccaccucccggguucaagcaauucuccugccuuagccuccugaguagcugggauuacagacgcaugccaccacgcccggcucauuuuuuguauuuuugguagagacaggguuucaccauguuggccaggcuggucucaaacucgugauccgcccaucucagccucccaaaguguugagauuacaggcaugagccaccguacccggccucuuuuuuuguuuuguuuuguuuuuuguuuuuuuuuugguuuuuuuuuugagacagagucuugcucuguugcucaggcugaagugcaguagugcgauccuggcucacugcaaccuccaccuccugggauugcaagcgauucuccugccucagccuccugaguagcugggauuacaggugcacgccaccacacccggcuaaguuuuuguauuuuuaguggagaugggguuuugccauguuggccaggcuggucucgaauuccugaccucaggugaucugcucgccucagccucccagagugcugggauuacaggcgugagccaccgcggccggccucaccucauuucugaccaaacacaagcaugucccugccaugauguuuaccaaacuuggcuccaaaugucuuuugcaaaagucagauuucacuuuaaaggaugaggaaagugguucagguucccaaaggaguuccuaaggaagucgacaggucugggagguggcagcagcuuguuggccgcuuguugggaaacagagcuggugcccugagguaaccccucaggagucauuacuuggcccagccccauucuccugugguguguacguucugggacaugccucauggaucuccuugaacaaagggggcagcaaguggcugggggccaguugcugaggcaaaaaguggaggguaacaaagacagaaacagagggagagaucucaacagagaagaugagaaagggauuuaagggaaacuagaagagaaaaggggcaggaggcgguggccucaucugcuccaagugcugucccucccacccaccuuccaucugcccuuccaggacucaccguaguucaugggcaucggguggguggggggcaugggcuguggguagccagcagggugaccguagccaggcugcggguagccaggguaggcaggauacccuccuggcaggacagauggcugcccauagcccccagggggcggagggccuggguacaggggguugcggucuucauauggugguggggcgcugggguuggacauggcugcucacgggcugagggggaaccccagcugcugggaccugaaaugggagaggagaaaagcaaucgugaaugcccaggcccagcucacucagccucaugggcccacuuccagccuuguccaggcugccuccguggagaggaacaccaccuauuuucuccuuagagggcagcgugugauuugcuguccacaggccaccuccccaccaacugggcuccugucccuccugccuuugcgccugcuucuuguccacaggccucucacugugcagcuccccagccauaggaaagcaggaggaaggauucgcugaggagagagggaaccagggagccugggaacucccuguugugguuuaagaaaaccuuccaguuuugguggcuugauggcagaaccagcgaagaagccagaugggccaggcacagccuccuggcgacucacagggccagcugggacccucugaaagggucagcucugccccugccacagcugacggggaugccaggccuggaagccagagcuggguuggagccaaggcucaaaguggagagccgggggaagaaguggaggaaaacaagcuagccccagugccagagcugccaggccccgaggaggaagggauccagggacccgggggccaguggcaggcugagucaggaagccugagaagcaggagugggugguacaggggcugggggcagggaggcugugccaaagggccagcuugagacaggacuuucugguuccuucaaauaacagcgguggcgugucagaaaggcaugcggcagccugcgaccacagcugcucucuggccuugcuagggaagagagagugagugcacggccccucgcccucccccuuacccccacccuggagggggagacagauguucugaaucccaggcucucugugaguucuaccugucuuccaggugcagugcuagcagggaggacaaagagcugaggagucaggccacaaggucaagggaaugccuucccugcagcaggaagagccccauagccaggggagggccaagaaaccagggggagggaaccccaaacuggaguuggaagggaccucagggccauaagccccaaaugcucacuucagaugagagaaugcaggcccugaacagggaagugauuccccagaaccccagaacucgcaggucaguggcauaaccaggacggaggccuuccagauccuggguccagguccuucauguuaugcggugcucuuaugccuccucugccaguuacuguccucugggccuggugguccccucugagguagcagagaugcaggcuuaggaggagcuaaggaagccccuagagggccccugcauccccaguaaggacaagcccuggcagucugggcucgacagggccaccaccucuucuagagcaucuacagggggcuuuaggauccccaaggaggacacccccagaugcaggucagcagacaccagaggcucucagaggcucugcuggaagcaagagagaccagcgucucuuuuuagggcacauugcauaguucggggaucaaauaaaggacugucuuaucucuucucuuuuaugacaacugggauaauucagagaggggaagguggcagggaggguugaggagggggaauugaauaaaaguccaggucucuaaguggguuauuuugaggaaagcuguucuucaucucccuagaggggcugggauagaaccagggcaagaaugucaggucagaaauacaaagcuggcagggugcgguaacucacgccuguaaucccagcacuuuagaagacugaagugggcagaucaugaggucaggaguucgagaccagccuggccaacauagugaaaaccugcucuacuaaaaaugcaaaaauuagccaggcaugguggcauguaccuguagucccaguuacucaggaggccgaggcaggagaaucacuugaaccugggaggcagagguuguggugagcugagaucgcgccaccguacuccagccugggcaacagagugagacuccaucucaaaagaaaaaaaaaaaaaagcacuggccggaaaggcucugugggcagaaaccccaaccgugaugucaccaugacgugucccagcaccuccucagggugcaccucugugaaauaaggugggggcgacacgaccucuaagcccacugcccccucuaacaacagacuaugauucugggaacucggcucugcagggccugaccuuugcucggccagagagcugccccugcucccuccucugagccaagcagggcaaacagcuaacuuuccagaccaagggacuguggcagccaccgggugaaaggugccucagagagaagggucagccucggaugggccacggggacuccaagguucuggugcagcucagcgggugcugacucagagcuucacuccugccucucuugccccucccuuucaggcuuuugguuucagaagcaugugcuaguaggccugccugcacugcacacagcaguuuccaggccaguccuucggguaccucagccaccagcccauccacaccagaaacuaccaugaccauuucaacucacuaugccucaguuucuucaccuggaaaaugggucucacacuaguaauaguacccuccacgggguugcuauaaaaauuaagugagaaaauacacauagaaggcugggcacaguggcucacgccuguaaucucaacacuuugagaggccgaggcagguggaucaccugagaucaggaguucgagaccagccuggccaaauggugaaaccccgucucuacuaaaaauauaaaaauuagcugggcauggcagcaggcgccuagaaucccaguuacucgggaggcugaggcaggagaaucgauucaaccugggaggcggagauuccagugagccacaaucgugccacugcacuccagccugggugacagagugagacuuugucucgaagaaaauaaaaaagaaaauacacauaaagugcuuagaaugaaacccgaccccugaucaauggggauaaagguugguuauuuucauuaaauccuuacaacaguccagcaaguuaauacuguuauuauuauucccauuuacaaaugaagagauugaggcacagaagaauuaaaucacuuggccaagauaaccuagcuagagugugaugaagucaaaaugagccccaagacugacucccaagccccugcucuuaaucccuaaccugaaaacacccugucuauccaaccuucucaucacuucugccauagcuuccaucuaaaacccucucauggguuuuagccucaacaggaggcugacacaaguggaagccaaacuacucaggcccuccacaccaccacagggcucacagccuggccaacggccccaggagaagaggguggcccaggcuuggagauacauaaaggucagagcuggaaagaaacucacccaaggacagccaaccccucacuuuaccaacuagacagccacagcacaggaaccuguccuugguuaccgagcugguccuggggacaggacgagauccuagcugucuacauagagagaccugggcacaggagaggaaaccccagcauuaacgcuagccaggggaguugcuaaacucagccacacucaccucugagcagugccaagaacacugucagacuggcaagagccuccggggaccagggcugccggguuuggcagcuuuagagccugcucuugggcuucugcccagccuccaugagggcccuggccacuuccacaucagcaaggccuccacuagggaugagguuuggggcuggcaucugccuagguagcagcaaagggggaaagggucaguguuuacuuucguagcuaugucuaaggguggaggcuagagaagaauggaggguaagggaaggagggagaaggggagagagaucacgagacugacacagagugaggacuagaaaucagaucuggguucugccagcagcuacuagaggggcucacagucugcagggacuuuaagguccccacuggaagccugaauuuucccaaaauacaguaggcauucaccuucugcuuguuuuuguuuuucuuuuuguuuugguagaaacgggguuucaccauguuggccaggcuggcaaacuccuggccucaagugauccacccaccgaggccucccaaagugcugggauuacaggcaugagccacugugucuggcccaccuucugcuugaaggaacuccagcaacauggagcaagccccuugucugcagacagcucgauuagaacauucuuccuugccucacaaugccuguuaucaaggcauucagacugugcccuauccuugcccauuauagaucuaaguuugcuccucucucagggccccagucccccauuaggaaggaaccagagccccugcuuucuaccacagcagcggcacaagugggugagcucagacagcaggacuugcugggugucaagguuuucagaugcagaggcggaagcaccuccuccccuggagcccucucagugugguaauccugcugucugccuacugaggccccggcuggggcucuccuggggguauuugaaggguuaaggcuccggaaucugcagaggaggccugagcuacugggguuacagcaagaggagaguauguguacuggagggagggauggaaaggagcagcugacugguccaggcagccugcccuccucccugccagagacggaugcccagaguggaaaaaaauagcucagaaugcacaucucaggaaaccccacccagcaggcgcaggagcacagcccagaucugacgauuuguuccccucccuuuuccuuuaucugcccccacaagaaaacacuuuauccuccuaccccagggcacagcugaccucauagccacgagagcaaaugaguaaaaagauacacccaggagugucugggcaagucaccaggccugauucugcaccaagggggcccagaaucaacuaaauauccuuccaucagccuggacuuugggacuaagaggaugaagccacagggaucuaaacacuaaaauaucagagcuggcuuagacuuuggaucucaccuggucauuugacagacaaggaaaccccagagccaagaaaguuccugcuccaccccagaacagcccucuucuucgucauggguuuggaacuucccuucccagccccgcccacucucugagugauagacaccagcacacacccucucccaaggaggggccagaacaagcuaccauucucucaguucucuagugaccucucagcucagaaacaguuaagaccgggccgggugcaguggcucaugccuguaaucccagcacuuugggaggccgaggcagguggaucacgaggucaggagaucaagaccaucguggccaacauggucaaaccccaugucuacuaaaaaauacaaaaaauuagcugggcgugauaucccacaccugaagucccagcuacucgggaggcugaggcagggggaucgcucgaacccgagaggcagagguugcagugagccaagaacaugccauugcacuccagccugggcaacaagagugaaaccccaucucaaaaaaaaagacagccagcccucgacuucuggcccccaacucgaggccaccccucccagcccccucucuagccaggguggccucucucuggacccauggagaccgagggguggcuccaagcucccaggagggagaggcuguccuggggaucacgagaggacccaggcaccgcagcuccgccacccuugucuggagcagaauccugugaucagaaugguaaucucggguuaccccacccaagucaggauggccugggaguacagauaagggaagaggaagccauuagcaggcugaugcuauaauacuucugagcacagucccuguucacuuccuucuuuguuucaucuccugucuuuucauugaacuucaagauuaggaggggaaagagacagacaaaggagacugauaacuaaccccaaaaaagaacuagggaaggggccaggcauggcggcucacgccuguaaucccagcacuuugggaggccaaggcgggcggaucacgaggucaggagaucgagaccauccuggcuaacauggugaaaccccaucucuacuaaaaaauacaaaaaauuagcuggaugugguggcggacgccuguagucccagcuacucgggaggcugaggcagaagaauggcaugaacccgggaggcggagcuugcagugagucaaaauggcgccacugcacuccagccugggcaacagagggagacucugucucaaaaaauaaauaaauaaaauaacuagggaaggaagggaaccacuuagaguaguugaaccacuuccaguacuuacuauauaacuaaggaaguacagguugaauaucccucauuuccaaaauccaaaaugcuccacaaucuaaaacauuuugagcaccaagaugacacucaaaggaaugcucacuggagcauuucugauuucggauuuucagauuagggacgcucaaccaguaaguauaauauacauagccccaaauccgaaaaaauccaaaauccaugugcuucugccacuguagaugucugcccccauggcuaucgugacuauaugcucgaguaggagaguaaaguguuuucuuggggguggaagggaguugggguggguaaaagaaaagggagggaaggaaauugucaaaauggucccauuuuggauaagagacacucaaccuauaguaacuaaggcacaucugauccuugcaacagugcugugagguauucuuacccucaucccacucuauagaugagauaacugaaauucagaaaaaaagagaucuagggucccacagcaggcaaacagcagagaugaguuuaagcauagaucucacaccugauuuaaaauucagccucuuugcuuuuauaucaggcaggaguagaagccccugaggcaucuguagcacgcaccugcgugaauaggcagcaccaggguggggccaaggcaguaaagaucaaaacgauagauagaaaggagcugagcaagcuguuguugcuaccauuauuucuuuccccugcggaaaguugaucugaagccuggguccugggcuaggagguggggaccugaaguucuuguccuggcuuugggacucacuccacugugagagccacaucucuagacccaguuuuaacaucaguaagacaauuccccucaaaugaaagaauggccaggcgcgguggcucaugccuguaaucccagcacuuugggaggccgagccaggcggaucacuugaggucagguguucgagaccagccuggccaacauggugaaaccucgucucuacuaaaaauacaaaaauuagccgggcaugguggcacaugccuauaaucccagcuucucgggaggcugaggcaggagaaucacuugaacccaggagauguagguugcagugagccgagaccaugccacugcacuccagccugggcgacagaaaaaaaaaaaaaaaaaaaaacugaaagaucaaaguccacucugccaguuucugauucugaaugaacagccuaacaggaggcuucagggcagaauggcauggcuccccaagaaccuacaccagggggucacuacugaugugcaacuguuuccaaggacaucuucagaggcagaaguacauggcauguucucaguauggggcuguccacacccucccaaacuguccccauaaugcugucuggacccuacggccagcucuuccugggugaucaguuacgcccgagcuaaacaguauauaacacucuaggaaagaaagaguaggaggcaggaaguccacugaccuggguucaugaacuagcugcaggaauccaggcaaaugaccuccccuggccuccuuuuaucccuaaaucagcccacgugggggaaaggaguagggacuuguuuaugggagccacaguggagaaacagaaucaccuagccaggcauuucccagacuguucuaaagaacacgccccaggagacguuaaugaaugagugcuggaaacagaugacucuugagaaacaauccacacccccuucuuggaaauucacaauggcauauucugccccugagaaguccugcaguaagcaacccuguucagcuuuguuuaacccaguguuccuucaaacucccuuaagccugagccacuuuuaucgaggcaaaccuauuaacacccugugggaugcugacccaggccaccuuuguauuacagacacccaacccugagaaucauucauauccuaacuccucgucucuuauaaccucugugcguacacccagcugccccucagagcagucacaugaaguacuagacaugcccucucacucucagggggucagcccagugccaggaucucuggcgaggguccuccccuucccccauuccacacagcugcuaucccaccgugggauuuacugccaagggccgggggacauauccagcuaccacagaaccaggaaacgggcaccccuaaccucaccucugugcaacggggcaaagcacaaaucauuacagacaaaagugggagcucauuaauaucucccuucccaccaauggagguaccugccacuguagccugucgacuucuggauaucauuucuacuucaaaacaagacccagguuuuggccuagaaucccagaaucuuaggguuggaagauucugucaaggucaucccuuccacuguguccccaacagaauagguccagaaggcccaugucaugaucagacauguuguuagcagaacuucuucccagagaauuguaugagcuuccacucucuggucgucccaguucagcccucugaaaacacacaaguauguguguuucccuucucuguggcuucugcuuuuucugaaaggcccagggugaggccugcgguuggaggugcucugagguagacagcgucuggcugaggcacccauucccaggggaggaggcugagcccagguggcuauuaccccagcucaugacaugaggcucucccaacacuuacaggauaacccaucauuaccucucugaagggcucauuuuuacaagugaggccuugaggucauagcacagaaagacagggccccugacacugugguccugccucuuccauuuaagcuauaaacugguucucuggauccucaugacuggagagacagagagaggaggcaggugagaaggaaguauggcucccccuuugcgccaauaaagcagccccaggaggcaccuggcuccccugccaccacuggccagcccaaagucgccagcuuggaaaccaaagcucacuaaugagaugaauauuucagagcccagagaacuggacaccugagggcccuuccaugacaucuggcucugaccugcguucccaggccuacuuaucccauguccagggugcucagguagaaccccaaacuccuggguaccacguagaggccacagaggagggagaggagauggagaccccauaggacaagaauuggugccgaccccacaaggccagggccuggccucccagcagccucccucugcuuccucccacuggucccuggcuccugccccagucucuccacuugcuuucccuuuucccguuucucuguuuuguuuucacucuaacccaaagaagucacgaggaggauguuacuccccuguaguucugugaacccagccgggaaacaguggcuggaagugggacuggcagagggcaaagucauggugauagagguggccacuuccccaugccaaacacuugagcugcucauuggcuucugccccagcugcaagcuaggacccccccuuccccaccccuuaaauauucaccugucuacaccgagacuggccucagcgcgugugggggcaaccugggguccgugccaggcccuggcugucuccccucccucuucccucuucucaccagcugagggccaugaaagcccucaucccacacagcuggccacucgggcuggcaugguggauaggcccugcgacagagaggccacucgugcccgaaagagggaacacgaggacacccccagacccuggcuccgcucaccagugcccacaacacgcugcugggcucccaaggcuaaccaggugccacagacccggccgcccacccgcgcgcccagggagagcgaaacgccaagggccaggaggggagauccccaucuggaacgggcuccuugggcccaggagcgggcaagccgggagcgcgcuccgaaaaguuuaggcgccccggcgcauggccgccccagcccuggaccaguccccaccgcccacaguccccaacggcgccggccccggcccccuggcuugccugcgccguuccagacggagcguuccuggccucg

SEQ ID NO: 21198 - RNA, 18296 nt, Homo sapiens
cgaggccaggaacgcuccgucuggaacggcgcaggcaagccagggggccggggccggcgccguuggggacugugggcgguggggacugguccagggcuggggcggccaugcgccggggcgccuaaacuuuucggagcgcgcucccggcuugcccgcuccugggcccaaggagcccguuccagauggggaucuccccuccuggcccuuggcguuucgcucucccugggcgcgcgggugggcggccgggucuguggcaccugguuagccuugggagcccagcagcguguugugggcacuggugagcggagccagggucuggggguguccucguguucccucuuucgggcacgaguggccucucugucgcagggccuauccaccaugccagcccgaguggccagcugugugggaugagggcuuucauggcccucagcuggugagaagagggaagagggaggggagacagccagggccuggcacggaccccagguugcccccacacgcgcugaggccagucucgguguagacaggugaauauuuaagggguggggaaggggggguccuagcuugcagcuggggcagaagccaaugagcagcucaaguguuuggcauggggaaguggccaccucuaucaccaugacuuugcccucugccagucccacuuccagccacuguuucccggcuggguucacagaacuacaggggaguaacauccuccucgugacuucuuuggguuagagugaaaacaaaacagagaaacgggaaaagggaaagcaaguggagagacuggggcaggagccagggaccagugggaggaagcagagggaggcugcugggaggccaggcccuggccuuguggggucggcaccaauucuuguccuauggggucuccaucuccucucccuccucuguggccucuacgugguacccaggaguuugggguucuaccugagcacccuggacaugggauaaguaggccugggaacgcaggucagagccagaugucauggaagggcccucagguguccaguucucugggcucugaaauauucaucucauuagugagcuuugguuuccaagcuggcgacuuugggcuggccagugguggcaggggagccaggugccuccuggggcugcuuuauuggcgcaaagggggagccauacuuccuucucaccugccuccucucucugucucuccagucaugaggauccagagaaccaguuuauagcuuaaauggaagaggcaggaccacagugucaggggcccugucuuucugugcuaugaccucaaggccucacuuguaaaaaugagcccuucagagagguaaugauggguuauccuguaaguguugggagagccucaugucaugagcugggguaauagccaccugggcucagccuccuccccugggaaugggugccucagccagacgcugucuaccucagagcaccuccaaccgcaggccucacccugggccuuucagaaaaagcagaagccacagagaagggaaacacacauacuuguguguuuucagagggcugaacugggacgaccagagaguggaagcucauacaauucucugggaagaaguucugcuaacaacaugucugaucaugacaugggccuucuggaccuauucuguuggggacacaguggaagggaugaccuugacagaaucuuccaacccuaagauucugggauucuaggccaaaaccugggucuuguuuugaaguagaaaugauauccagaagucgacaggcuacaguggcagguaccuccauuggugggaagggagauauuaaugagcucccacuuuugucuguaaugauuugugcuuugccccguugcacagaggugagguuaggggugcccguuuccugguucugugguagcuggauaugucccccggcccuuggcaguaaaucccacggugggauagcagcuguguggaaugggggaaggggaggacccucgccagagauccuggcacugggcugacccccugagagugagagggcaugucuaguacuucaugugacugcucugaggggcagcuggguguacgcacagagguuauaagagacgaggaguuaggauaugaaugauucucaggguugggugucuguaauacaaagguggccugggucagcaucccacaggguguuaauagguuugccucgauaaaaguggcucaggcuuaagggaguuugaaggaacacuggguuaaacaaagcugaacaggguugcuuacugcaggacuucucaggggcagaauaugccauugugaauuuccaagaaggggguguggauuguuucucaagagucaucuguuuccagcacucauucauuaacgucuccuggggcguguucuuuagaacagucugggaaaugccuggcuaggugauucuguuucuccacuguggcucccauaaacaagucccuacuccuuucccccacgugggcugauuuagggauaaaaggaggccaggggaggucauuugccuggauuccugcagcuaguucaugaacccaggucaguggacuuccugccuccuacucuuucuuuccuagaguguuauauacuguuuagcucgggcguaacugaucacccaggaagagcuggccguaggguccagacagcauuauggggacaguuugggaggguguggacagccccauacugagaacaugccauguacuucugccucugaagauguccuuggaaacaguugcacaucaguagugacccccugguguagguucuuggggagccaugccauucugcccugaagccuccuguuaggcuguucauucagaaucagaaacuggcagaguggacuuugaucuuucaguuuuuuuuuuuuuuuuuuuuucugucgcccaggcuggagugcaguggcauggucucggcucacugcaaccuacaucuccuggguucaagugauucuccugccucagccucccgagaagcugggauuauaggcaugugccaccaugcccggcuaauuuuuguauuuuuaguagagacgagguuucaccauguuggccaggcuggucucgaacaccugaccucaagugauccgccuggcucggccucccaaagugcugggauuacaggcaugagccaccgcgccuggccauucuuucauuugaggggaauugucuuacugauguuaaaacugggucuagagauguggcucucacaguggagugagucccaaagccaggacaagaacuucagguccccaccuccuagcccaggacccaggcuucagaucaacuuuccgcaggggaaagaaauaaugguagcaacaacagcuugcucagcuccuuucuaucuaucguuuugaucuuuacugccuuggccccacccuggugcugccuauucacgcaggugcgugcuacagaugccucaggggcuucuacuccugccugauauaaaagcaaagaggcugaauuuuaaaucaggugugagaucuaugcuuaaacucaucucugcuguuugccugcugugggacccuagaucucuuuuuuucugaauuucaguuaucucaucuauagagugggaugaggguaagaauaccucacagcacuguugcaaggaucagaugugccuuaguuacuauagguugagugucucuuauccaaaaugggaccauuuugacaauuuccuucccucccuuuucuuuuacccaccccaacucccuuccacccccaagaaaacacuuuacucuccuacucgagcauauagucacgauagccaugggggcagacaucuacaguggcagaagcacauggauuuuggauuuuuucggauuuggggcuauguauauuauacuuacugguugagcgucccuaaucugaaaauccgaaaucagaaaugcuccagugagcauuccuuugagugucaucuuggugcucaaaauguuuuagauuguggagcauuuuggauuuuggaaaugagggauauucaaccuguacuuccuuaguuauauaguaaguacuggaagugguucaacuacucuaagugguucccuuccuucccuaguuauuuuauuuauuuauuuuuugagacagagucucccucuguugcccaggcuggagugcaguggcgccauuuugacucacugcaagcuccgccucccggguucaugccauucuucugccucagccucccgaguagcugggacuacaggcguccgccaccacauccagcuaauuuuuuguauuuuuuaguagagaugggguuucaccauguuagccaggauggucucgaucuccugaccucgugauccgcccgccuuggccucccaaagugcugggauuacaggcgugagccgccaugccuggccccuucccuaguucuuuuuugggguuaguuaucagucuccuuugucugucucuuuccccuccuaaucuugaaguucaaugaaaagacaggagaugaaacaaagaaggaagugaacagggacugugcucagaaguauuauagcaucagccugcuaauggcuuccucuucccuuaucuguacucccaggccauccugacuugggugggguaacccgagauuaccauucugaucacaggauucugcuccagacaaggguggcggagcugcggugccuggguccucucgugauccccaggacagccucucccuccugggagcuuggagccaccccucggucuccauggguccagagagaggccacccuggcuagagagggggcugggagggguggccucgaguugggggccagaagucgagggcuggcugucuuuuuuuuugagaugggguuucacucuuguugcccaggcuggagugcaauggcauguucuuggcucacugcaaccucugccucucggguucgagcgaucccccugccucagccucccgaguagcugggacuucaggugugggauaucacgcccagcuaauuuuuuguauuuuuuaguagacaugggguuugaccauguuggccacgauggucuugaucuccugaccucgugauccaccugccucggccucccaaagugcugggauuacaggcaugagccacugcacccggcccggucuuaacuguuucugagcugagaggucacuagagaacugagagaaugguagcuuguucuggccccuccuugggagagggugugugcuggugucuaucacucagagagugggcggggcugggaagggaaguuccaaacccaugacgaagaagagggcuguucugggguggagcaggaacuuucuuggcucugggguuuccuugucugucaaaugaccaggugagauccaaagucuaagccagcucugauauuuuaguguuuagaucccuguggcuucauccucuuagucccaaaguccaggcugauggaaggauauuuaguugauucugggcccccuuggugcagaaucaggccuggugacuugcccagacacuccuggguguaucuuuuuacucauuugcucucguggcuaugaggucagcugugcccugggguaggaggauaaaguguuuucuugugggggcagauaaaggaaaagggaggggaacaaaucgucagaucugggcugugcuccugcgccugcugggugggguuuccugagaugugcauucugagcuauuuuuuuccacucugggcauccgucucuggcagggaggagggcaggcugccuggaccagucagcugcuccuuuccaucccucccuccaguacacauacucuccucuugcuguaaccccaguagcucaggccuccucugcagauuccggagccuuaacccuucaaauacccccaggagagccccagccggggccucaguaggcagacagcaggauuaccacacugagagggcuccaggggaggaggugcuuccgccucugcaucugaaaaccuugacacccagcaaguccugcugucugagcucacccacuugugccgcugcugugguagaaagcaggggcucugguuccuuccuaaugggggacuggggcccugagagaggagcaaacuuagaucuauaaugggcaaggauagggcacagucugaaugccuugauaacaggcauugugaggcaaggaagaauguucuaaucgagcugucugcagacaaggggcuugcuccauguugcuggaguuccuucaagcagaaggugggccagacacaguggcucaugccuguaaucccagcacuuugggaggccucgguggguggaucacuugaggccaggaguuugccagccuggccaacauggugaaaccccguuucuaccaaaacaaaaagaaaaacaaaaacaagcagaaggugaaugccuacuguauuuugggaaaauucaggcuuccaguggggaccuuaaagucccugcagacugugagccccucuaguagcugcuggcagaacccagaucugauuucuaguccucacucugugucagucucgugaucucucuccccuucucccuccuucccuuacccuccauucuucucuagccuccacccuuagacauagcuacgaaaguaaacacugacccuuucccccuuugcugcuaccuaggcagaugccagccccaaaccucaucccuaguggaggccuugcugauguggaaguggccagggcccucauggaggcugggcagaagcccaagagcaggcucuaaagcugccaaacccggcagcccugguccccggaggcucuugccagucugacaguguucuuggcacugcucagaggugaguguggcugaguuuagcaacuccccuggcuagcguuaaugcugggguuuccucuccugugcccaggucucucuauguagacagcuaggaucucguccuguccccaggaccagcucgguaaccaaggacagguuccugugcuguggcugucuaguugguaaagugagggguuggcuguccuugggugaguuucuuuccagcucugaccuuuauguaucuccaagccugggccacccucuucuccuggggccguuggccaggcugugagcccuguggugguguggagggccugaguaguuuggcuuccacuugugucagccuccuguugaggcuaaaacccaugagaggguuuuagauggaagcuauggcagaagugaugagaagguuggauagacaggguguuuucagguuagggauuaagagcaggggcuugggagucagucuuggggcucauuuugacuucaucacacucuagcuagguuaucuuggccaagugauuuaauucuucugugccucaaucucuucauuuguaaaugggaauaauaauaacaguauuaacuugcuggacuguuguaaggauuuaaugaaaauaaccaaccuuuauccccauugaucaggggucggguuucauucuaagcacuuuauguguauuuucuuuuuuauuuucuucgagacaaagucucacucugucacccaggcuggagugcaguggcacgauuguggcucacuggaaucuccgccucccagguugaaucgauucuccugccucagccucccgaguaacugggauucuaggcgccugcugccaugcccagcuaauuuuuauauuuuuaguagagacgggguuucaccauuuggccaggcuggucucgaacuccugaucucaggugauccaccugccucggccucucaaaguguugagauuacaggcgugagccacugugcccagccuucuauguguauuuucucacuuaauuuuuauagcaaccccguggaggguacuauuacuagugugagacccauuuuccaggugaagaaacugaggcauagugaguugaaauggucaugguaguuucugguguggaugggcugguggcugagguacccgaaggacuggccuggaaacugcugugugcagugcaggcaggccuacuagcacaugcuucugaaaccaaaagccugaaagggaggggcaagagaggcaggagugaagcucugagucagcacccgcugagcugcaccagaaccuuggaguccccguggcccauccgaggcugacccuucucucugaggcaccuuucacccgguggcugccacagucccuuggucuggaaaguuagcuguuugcccugcuuggcucagaggagggagcaggggcagcucucuggccgagcaaaggucaggcccugcagagccgaguucccagaaucauagucuguuguuagagggggcagugggcuuagaggucgugucgcccccaccuuauuucacagaggugcacccugaggaggugcugggacacgucauggugacaucacgguugggguuucugcccacagagccuuuccggccagugcuuuuuuuuuuuuuucuuuugagauggagucucacucuguugcccaggcuggaguacgguggcgcgaucucagcucaccacaaccucugccucccagguucaagugauucuccugccucggccuccugaguaacugggacuacagguacaugccaccaugccuggcuaauuuuugcauuuuuaguagagcagguuuucacuauguuggccaggcuggucucgaacuccugaccucaugaucugcccacuucagucuucuaaagugcugggauuacaggcgugaguuaccgcacccugccagcuuuguauuucugaccugacauucuugcccugguucuaucccagccccucuagggagaugaagaacagcuuuccucaaaauaacccacuuagagaccuggacuuuuauucaauucccccuccucaacccucccugccaccuuccccucucugaauuaucccaguugucauaaaagagaagagauaagacaguccuuuauuugauccccgaacuaugcaaugugcccuaaaaagagacgcuggucucucuugcuuccagcagagccucugagagccucuggugucugcugaccugcaucuggggguguccuccuuggggauccuaaagcccccuguagaugcucuagaagaggugguggcccugucgagcccagacugccagggcuuguccuuacuggggaugcaggggcccucuaggggcuuccuuagcuccuccuaagccugcaucucugcuaccucagaggggaccaccaggcccagaggacaguaacuggcagaggaggcauaagagcaccgcauaacaugaaggaccuggacccaggaucuggaaggccuccguccugguuaugccacugaccugcgaguucugggguucuggggaaucacuucccuguucagggccugcauucucucaucugaagugagcauuuggggcuuauggcccugaggucccuuccaacuccaguuugggguucccucccccugguuucuuggcccuccccuggcuauggggcucuuccugcugcagggaaggcauucccuugaccuuguggccugacuccucagcucuuuguccucccugcuagcacugcaccuggaagacagguagaacucacagagagccugggauucagaacaucugucucccccuccaggguggggguaagggggagggcgaggggccgugcacucacucucucuucccuagcaaggccagagagcagcuguggucgcaggcugccgcaugccuuucugacacgccaccgcuguuauuugaaggaaccagaaaguccugucucaagcuggcccuuuggcacagccucccugcccccagccccuguaccacccacuccugcuucucaggcuuccugacucagccugccacuggcccccgggucccuggaucccuuccuccucggggccuggcagcucuggcacuggggcuagcuuguuuuccuccacuucuucccccggcucuccacuuugagccuuggcuccaacccagcucuggcuuccaggccuggcauccccgucagcuguggcaggggcagagcugacccuuucagagggucccagcuggcccugugagucgccaggaggcugugccuggcccaucuggcuucuucgcugguucugccaucaagccaccaaaacuggaagguuuucuuaaaccacaacagggaguucccaggcucccugguucccucucuccucagcgaauccuuccuccugcuuuccuauggcuggggagcugcacagugagaggccuguggacaagaagcaggcgcaaaggcaggagggacaggagcccaguugguggggagguggccuguggacagcaaaucacacgcugcccucuaaggagaaaauaggugguguuccucuccacggaggcagccuggacaaggcuggaagugggcccaugaggcugagugagcugggccugggcauucacgauugcuuuucuccucucccauuucaggucccagcagcugggguucccccucagcccgugagcagccauguccaaccccagcgccccaccaccauaugaagaccgcaacccccuguacccaggcccuccgcccccugggggcuaugggcagccaucuguccugccaggaggguauccugccuacccuggcuacccgcagccuggcuacggucacccugcuggcuacccacagcccaugccccccacccacccgaugcccaugaacuacggugaguccuggaagggcagauggaaggugggugggagggacagcacuuggagcagaugaggccaccgccuccugccccuuuucucuucuaguuucccuuaaaucccuuucucaucuucucuguugagaucucucccucuguuucugucuuuguuacccuccacuuuuugccucagcaacuggcccccagccacuugcugcccccuuuguucaaggagauccaugaggcaugucccagaacguacacaccacaggagaauggggcugggccaaguaaugacuccugagggguuaccucagggcaccagcucuguuucccaacaagcggccaacaagcugcugccaccucccagaccugucgacuuccuuaggaacuccuuugggaaccugaaccacuuuccucauccuuuaaagugaaaucugacuuuugcaaaagacauuuggagccaaguuugguaaacaucauggcagggacaugcuuguguuuggucagaaaugaggugaggccggccgcgguggcucacgccuguaaucccagcacucugggaggcugaggcgagcagaucaccugaggucaggaauucgagaccagccuggccaacauggcaaaaccccaucuccacuaaaaauacaaaaacuuagccgggugugguggcgugcaccuguaaucccagcuacucaggaggcugaggcaggagaaucgcuugcaaucccaggagguggagguugcagugagccaggaucgcacuacugcacuucagccugagcaacagagcaagacucugucucaaaaaaaaaaccaaaaaaaaaacaaaaaacaaaacaaaacaaaaaaagaggccggguacgguggcucaugccuguaaucucaacacuuugggaggcugagaugggcggaucacgaguuugagaccagccuggccaacauggugaaacccugucucuaccaaaaauacaaaaaaugagccgggcgugguggcaugcgucuguaaucccagcuacucaggaggcuaaggcaggagaauugcuugaacccgggagguggagguugcggugagccgagaucacgccuuugcacuccagcuugggcaacaagaccgaaacuccaucucaaaaaaaaaaaaaaaaaaaaaaaggaaaugaggugaaguuagagugcagugagucuuccuggguggcucaagcguggauuuuaaaaguaguucccaaagaggcauucaggcauucaggcauucagggaauguuugcagcccugcagcaucucugaaccccagaggggugucagccagcucucaccuggacaugugcgcuggugcggaucugcgcauggguccugcacagucacgcacacccuuugcacaccugccucugugaggcugaugcagaucccugucuucaccucuaucccugcugcugcacaaacugcgcucugccgcccuccuuuucuccuacccucuguccccauccccuguucugcccuggcuggcugccccaguggaugcccauaccugcuccugccuggcuuccccacuacaucgugaccccccagugaacccccaguggcgugggcugggcacacaggagcccuccacagaugcacgugaggaacguuucccaccuaagcccccucgugacaggccggcucugggucacucugagggugucuagaagaccccagcuugggagaagaguuccuguuauaacacuugucuuuuggcuggagaucccugagacuuugagauugucagggaggcuuugggauugacgccacaugucucagguccccagcugagucaagugucaucugucccuaggcccaggccauggcuaugauggggaggagagagcagugagugauagcuucgggccuggagagugggaugaccggaaagugcgacacacuuuuauccgaaagguaagauacgcgcugggagguggguguaccuggggccccucaggcugugggaaugggaaguggguaggccacaguagccccagggcaucaauuccaugaaauacacuggcugccugucuucucuagccuugucugcuucucagaggggcaccuggcuucucuaaccccaggguucccucucuuuuugcaccucucuucuugaccauguuuugggaggacacauucagucugggagaaucuccuagguggguucugccacagcgcccgccuuccccagacaucuuucucccuuuagacuauaggcagcuuggagccagaaaugauccuacucgcuuguaacccacccucuccaucucacagcugcauagagcgugcagacugagcugcugggagugcagaggccauacugguagaguaugguggccaggcagggcaagucaguagucaccgaggcugguguuggacaggaggggagauggcagggagcaugggagcggggcugaggaagaagugcacauugccucugagccaggcaucucacuggggucgccucugggccaggcugcagcuagggaggguucuugagugggaggaaaguacugggggcuggcagcuuccuggggcaggccaggggugccggauggugacccaugcccggccgucuguguccagguuuacuccaucaucuccgugcagcugcucaucacuguggccaucauugcuaucuucaccuuuguguaagucucuaggcuuugccacccacuccuacugcccuggggguucagggucaccugcuggggguguggguggcggugggcccugcucucagggugaccaugggcaauuagagaaggugaagccagggcugccuggcuggccuggguggggcagacaagccucagggugacuacuccuguccuccugugccccacagggaaccugucagcgccuuugugaggagaaauguggcugucuacuacguguccuagugagugugugcuccucugugguugggcagggaggcagggguggcagcuucuguuucuaggugaccagcuuugcucagggcaggaucaaaaugcuuuuugagagggcccccaaguuggugccaguuucccgugccagagggugugggugugcgugcccagaugaguagcagaccccuagaacucgagagcaagagugggaccugcuggugguggcgugcacgcugcgcugcagcccccauguccucucagcccgucagcugcagccuccccagaccuccuuccuggccggagccuggugcuucagagcaucucagugacccuggcuggggguaaucucguucuugcuuccuguugaguugcuuccccucagacuuccaaacggcuauuugggccccaaaucacuggccuggugugugcugccaagcggggcagauuugggccugaacugcuuccccaucucuuugucccuagugcugucuucguugucaccuaccugauccuugccugcugccagggacccaggugagucccagagacuuaacacagugagaggggugacagggauugggaugggggccgaguauuuuggaaagaaggauuccuuuauagcagcugaauggaaacuuacaagaaaugaggaggaggaugacgaugacagcuacuguucagguguauacaaaggaccauguguguuuaggagcuaacuagcugucacucuuauaguaacccugcaagacagguagcauuuuagccaguuaacaaauaggaagaacccgaggcucaaagaggcugaguaacuuucuccccaucacacaggcagucaguuuaagaguugcaaaccaauccagguguuucuggcgccacaacacaggucugucucauuggcccauguugucccugcguaccacaccugaacaggugccaaaggccaugccaaccucccuccuuggagucaaggcuuaauccuccaggcacaggagccaagcgcuuccuucugcuguaggagccucugacgccugaggggccccaagucauuuaaucaaggcuucucuuucccuucagacgccguuucccauggaacaucauucugcugacccuuuuuguaagucuagaaggguggcaggaggguguggagaugcugugagggagacugcucccagggaagggauggggacccauuucagaaggauguccuggcugucuccuccaccuuaucugggccgccuguucugaucuccucuguggcugccucuuuccaacuugguggcguuccccagcucuggcagaggccaccauggccacucccccagcacccugccuuccuuccuuuuuaaguguuucauucuugucucucuccuucccuuagacuuuugccaugggcuucaugacgggcaccauuuccagguacauucagggauaaagcaccacucuugggaaauguguauuguggggagugggguguuccugggccggcagccagcugcguggguggauucugggcagguccccucuggaaguggugauuuugaagucauucauacguggcuuaaugccucuugucuguaacuccugcuucuccccaguauguaccaaaccaaagccgucaucauugcaaugaucaucacugcggugguauccauuucagucaccaucuucugcuuucagaccaaggugagggcauggagggcccuucccuggccccccgacuccccuuucuuaucaggcccggaccccggcacacuagggauguucccuagagaccugauccccuucuccucauccgcaccuacaaaacuguguccuguuucuguccuuagaauguuguggacauucccauacccccuaggaggcagcacugggacucccuggcagggccagucugacugggcugguugucacagccaucugacaggugccucuuucuugcuuccuggcagguggacuucaccucgugcacaggccucuucuguguccugggaauugugcuccuggugacugggauugucacuagcauugugcucuacuuccaauacgugagugucccaggagagcuggggucagggaacccagugcucagggcagacuuccuauauagcauggucucgcaggccccaaagguccccggggcaggcucugaccuccagaaccucucgacuggcuagcaaaggcaccaacguggaggcagcauccuucugggugaggguagacucucuguguggagaugggcggccuuggagccagagcaccugaagcccuggacugcaucacugcacuccuaggggaagggguggguucaaucuggcuggcagcugagaaucagguucucggaggcagacugggagaggaacccagaggacugagaugaugggccuagguggaagggaccuugcgggggucucuggauccaauuauuuccuuuauucuguucagcugggggagaacagugccgaaggggaaggauggggacacgagggcugccugcccaugggccagcucuguccuucuguggacggccaccugugggcaugucaugugggcuguccugugggugcucccggauuuugauacucaccagagggguuggggggccucccuucuuccuuagucuaccccucccaggcugggcuguaggaacuggucuauugaaugcugggucugccccuuucagagcuguaacucaacugcuuuuuuucuagaaguauaguagacacuuguguaccuugacuggcuuuggagauugguuuuauacagccauugcaggauggccucugcuuucucugcuggauauaucaccagucuuaauuuccuccaagaucuggaaaggcaguagccuuucauggagagcuagcuucccagcucuacccacucucaugccacuaucccgggggaagcuggggccugugggccugugguuugcugagguuucuaaugccauucucuguccccuucuucuccagguuuacuggcuccacaugcucuaugcugcucugggggccauuuguuucacccugguaagucccagccccacucuaggaaggggagcugaggggaugaggggaggaaucuagggaagggggcaugaauuuagacugccugggaggcagggaauggggccauagcaggccauuccucucacuacuguccagagauuccauugauuuuugugggcacucuugccaucucuuguucaagcugccugcuauuagaacacuagucagccauauugagaacggugugucugccuccuuuccuagacugugagcagcuacaguauagagcccauauguuaugcugugcguuaauguggcccuaagcacuguguggcgcauaggcccccaagacaaaucugcugaccaaaaaugagcucuggacacugaugccugaguucucacuucuggcuucccuauccuugcaguuccuggcuuacgacacacagcugguccuggggaaccggaagcacaccaucagccccgaggacuacaucacuggcgcccugcagauuuacacagacaucaucuacaucuucaccuuugugcugcagcugaugggggaucgcaauuaaggagcaagcccccauuuucacccgauccugggcucucccuuccaagcuagagggcugggcccuaugacuguggucugggcuuuaggccccuuuccuuccccuugaguaacaugcccaguuuccuuucuguccuggagacagguggccucucuggcuauggauguguggguacuugguggggacggaggagcuagggacuaacuguugcucuuggugggcuuggcagggacuaggcugaagaugugucuucuccccgccaccuacuguaugacaccacauucuuccuaacagcugggguugugaggaauaugaaaagagccuauucgauagcuagaagggaauaugaaagguagaagugacuucaaggucacgagguuccccucccaccucugucacaggcuucuugacuacguaguuggagcuauuucuucccccagcaaagccagagagcuuuguccccggccuccuggacacauaggccauuauccuguauuccuuuggcuuggcaucuuuuagcucaggaagguagaagagaucugugcccaugggucuccuugcuucaaucccuucuuguuucagugacauauguauuguuuaucuggguuagggaugggggacagauaacagaacgagcaaaguaaccuauacaggccagcauggaacagcaucuccccugggcuugcuccuggcuugugacgcuauaagacagagcaggccacauguggccaucugcuccccauucuugaaagcugcuggggccuccuugcaggcuucuggaucucuggucagagugaacucuugcuuccuguauucaggcagcucagagcagaaaguaaggggcagagucauacguguggccaggaaguagccagggugaagagagacucggugcgggcagggagaaugccugggggucccucaccuggcuagggagauaccgaagccuacugugguacugaagacuucuggguucuuuccuucugcuaacccagggaggguccuaagaggaaggugacuucucucuguuugucuuaaguugcacugggggauuucugacuugaggcccaucucuccagccagccacugccuucuuuguaauauuaagugccuugagcuggaauggggaagggggacaagggucagucugucgggugggggcagaaaucaaaucagcccaaggauauaguuaggauuaauuacuuaauagagaaauccuaacuauaucacacaaagggauacaacuauaaauguaauaaaguuuaugucuagaa

SEQ ID NO: 21199 - RNA, 26437 nt, Homo sapiens
aggaagugcgagagagcugagagccaggacucagugcugagcuuggugucccaccgccacaaggaggcagggaagaaacccacuagucccagcuccugggguggcacagacauugcaacuggcccugccuguggguccuaggggcccuuggcuaccaggaggcuaagaacacugcucaugaaugacagugagcccugaaagcucugggggugucacccagucccacaagccugcauccccugcaguggagauggggugagugugcagcgugcggagggggguggggguggaaugaggggccagacaaggggcagcugcagggcagcucagccgggugcaggggugugggcuuguuggcagcggugcucucacauagagcguuguguguggcauggaggugagccaccacgggccaaccacaagcccucccugggcucugcuuaccaacacccaaagccagcgaucagcacccagcgccugcccucaccuuucccggggucuuucucccuggccggagucucaggaguaggagacgcugggaaaggcucccugaacaguuugggaauagagcuggaaacccccagcccagcccugugggggaaggugacaaacaggaaaggguuaaagggcuagggccggcggccuuugauggaggcugagaagcaacugcacugaggggcgccucucauccgcccuccucuuuccgguguagcucagcuccuggacgugccacagacagaaagcauaacauacacucgccaggaagagccuuugccugacucagggcagcucagagugugggguaagugcacuuggccacagcagagcccugaggagggaggggaggggagagguggguggguggugucucacaugcuucacuguccacugcucauucauccaaccacuggcugagggccacugagcccuucuuugcaccaggugcuuggggugguggggggaggaucugcagagcgugcagaguuaagccagaugugccacaaccagagcucccgggcacagaauccaggggcacaccgcuugucugggggucugcgcuuugcaccucacugccuauuaucccagaguccugagcuguuccuugccccaguaucagagcccuuggccuugauuucagccugcugugcuccaaccccagccccagcccccagaccugcuggcugccuccagccucagcggggaaaaccagacccacucauucaugcugagcuacuguguugucuucaggaagccucucaguaccucaguugcuucuguguaauguccgcuccuaccugaucugaaacuaggaguugaccaccgaucucuucaaggggccucuggcucaaugaaaugacauuaucaaggauuugcauuuuuaaaaaagauuacacagagaaaaaguucagagcgaaggaacauaggauuccaggcauggcaacccucaguuugagaaccuguaagauguuagaacacgaagaugccuuuucuagucuagcguuauuuaaaaguauuuaaguggccaggcaugguggcucacaccuguaaucccagcaauuuuuuggggaagcccauguggccggauugccugagcucaggaguucaagaccagccugggcaacauggcaaaaacccaucucuacuaaaaauacaaaagacagccaggugugguggugcacaccuaugguccuaagcuccucaggaggcugaguugggaggauugcuugagcccaggggguggagguugcagugagucaugauuguaccacugcaccccagccuggaugacagagugagaccuuacgucaaaauaaaaaaaagaaaaaggaaaaagaaaguauuuaaaggaugguggcccuucuaaugcuucuguccccagguaucccaaaaaggccagcacuggccuuauuuuucaaagagaaauugaguuuaacuucugaggauacacuuucugguacuaauugcuuuaggagaacuaggcuuuggggaaaagaugaggacaaagaugggaaacagaguuguaggggguuucagauucucccaauggcugaaugaugaauuuugccuccccuauacccugcucucacacacacacccacacccuucuccccaacgcccuacacacauacacacacacacacucucacacacacacacacacacacacacucugaagcagccccaucucucuuggagcaguacuggcccggcugucagcucacagcagcaggaaguggugggccuggcaggcaggccagcgggggcugggggaguggcucuggacucauguugcaauccuggagauuugugguggugugggagaugcucccugacccugggcccuuccuccuauacuguuucuguuuccugggacaaucucaagccuggaugccaaaaccccagaaucuucagugcuggggagaggugguagagacaagagguuugucucugcagaaugaccugccucaggaggggcuucaagggaacguggggagccaggacaggcagcagguggaacaggugccggcugugggcugagggcucagugggggcccucuuguugugcugugcguccuuuuggggaaguuacuuaaccuuucugugcuucacacuucccccgcucccuugcuuguggaauggccacauggagcccuucuuaggguagccuuggggcacaguuacaggucaggccaccagcggccacccugugccaggaauggaauccugggcccccagcaugcucuuucucuaggcagaaggugaccagccagcucagggcaggagaugcagagcacagccaauuaccuguggcacacagaugaccugcuggggcagggggccacugccaguguguacaaggcccgcaacaagguaggaagcaacccuggccaggcccuguccagcccagccuuggcccccucaugccucagaagcuggcccagucagcccccagugggcauugaggguggugggacagggaccucuggauguuguguagcacacucauacuguggguuugagcagaggcauagggagcugaaaacggcuccuugagaggaugccucugucgggcacgaguuggagcaagagaacugugaaguaacaaggcaaacauccgaggaagguaacagcaaauggaaucuaggaauagcagaguggggaauuaggccuuguuuggauuuauccugcgagaauguaugagaugauauccacucugucuuauucaagagugguagccggccgggcacgguggcuuaugccuguaaucccagcacuuugggaggccgaggugggcagaucacgaggucaggagaucgagaccauccuggucaagauggugaaacccugucucuacuaaaaauacaaaaauuagcugggcaugguggcgugcaccuguaaucccagcuacucaggaggcugaggcagagaaucgcuugaaccugggaggcagagguugcagugagcugagaucuugacacugcacuccagccugggugacagagcgaggcuccgucucaaaaaaaaaaaaaaaaaaaaaaaagaauuggagccauacagaccagguuccaaucccuucccugcugcuaaccccagggaguguuagcugcccugugaugauugucaauagcaauuguaauaaugacaacaagccauccccugcagaagaucagagugucaggaucuugucaccucccagugcuggacucucuaccccuugagagggaaaggcggugcggaugggagcccccauccaaccaggcuaaucucugggguugggcuggccggagaggcugaauggaggcccaggagaggguggcugcuccccugugggagugggacaugugcuaaucccaugcugucucccacugcucccuccccaauggcagaaauccggagagcugguugcugugaaggucuucaacacuaccagcuaccugcggccccgcgaggugcaagugagggaguuugagguccugcggaagcugaaccaccagaacauugucaagcucuuugcgguggaggagacgguagguccggugcuuggucagagaauggucuuguccuugacccuuauggucuggggagaaucaggccacaugauaacagagauuuggucccaugcucaucagcaggucagagacagcaggcaaauugcagaagggagcaaagggggcaagggggugggggcggugcacuggaaaggaacgauggacagaaucaguaccuaagcagagggcuuccuggaauaacugacuuuggauuccagugugcgggaucagugugaggccaaggagggaaggccaggccagaagcugggaccuggagaaugggggcucugggcuccaggcugagccacuucuuccugguggguggggaggagaagugccguccucaugagccccucucugucccacccauagggcggaagccggcagaagguacuggugauggaguacugcuccagugggagccugcugagugugcuggagagcccugagaaugccuuugggcugccugaggaugaguuccugguggugcugcgcugugugggugagccccucccugucccugccuccacccucagaccagcggcaggccugggacagaugcugacaggacucaggugucugacuccugcuaaucauuccauuuaaaauuccaacuuaaaaauuaaaccuaaaaaagauuguacaccaauguucacagcagcauuauuuacaauagccaaaagguggaaacauccuaacugugaaaacaaaaugugggagguaccuaaaauagaauauuauucagucuuaaaaggaaagaaauucugacaccugcuacaacauggauggaccuugaugacauuauguuaagugaaaaaagccagacacagaaggacaaauccuguaugauuccacucauacauucauagaaacagaaaguaccauggugguuuccaguggcugggggcagaggagaaugaggaguuguuuaauaaguaugguuucaaguuugaagaaugaggccgggugcaguggcucaugccuguaaucccagcacuuugggaggcccaagugggcggaucauuugagguuggggguuugagaccagucuggcgaacacggugaaacccugucucuacuaaaaaaauacaaaaauuagcugggugugguggugcaugccuguaguuccagccacuugggaggcugaggcaugagaaucgauugaaccugggaggcagagauugcagugagcugagauugcaccacuguacuccagccuaugugucagagugagacucugucuccaaaaaaaaaaaaaaaauuggagaaugagaaaaguucuaagauggauggugugaugguggcacagcagcgugggugugcuuagugccaaugaaguguacacuuaaaauugguuaaaaugggaaauuucguuaugcauauuuuaccacaauugaacaccuaaucaaaagaaguaauacaaagaggggugcugcccuugaggacacagagccaccacccaucuugguuuccuagagaauccagaugguaccuccauacccuaguguccuugagaugcccccuaagccccaugcaugucucuguccuucugccugucccauggcucugucagcccaugggaacuccugucucucuggaugcaaggacagccuucccaccaagaugagccucagacacuagacuguccccgaccagagccagcuaguggccuccccgucuguccccaguggccggcaugaaccaccugcgggagaacggcauugugcaucgcgacaucaagccggggaacaucaugcgccucguaggggaggaggggcagagcaucuacaagcugacagacuucggcgcugcccgggagcuggaugaugaugagaaguucgucucggucuaugggacugaggaguaccuggugggugagcugcucgagacccgcugcccuaugcugagggcuccccuugccuugugagccccccagagcccccaugaggggguguggcccaccuccugcuuccacaggaguuaugucucuccccuguaccccaaccagaagaaugcauucuguucucuaagauggaaaaggugaggcugacacccauuuuuaagaugacaaagaaggauuugaacaguucuguuuucaccugcaggcggugaaagggggucugacaggucucaggcccuugccagcccuccggcuccauggccucauucugguucucuccggcagcaucccgacauguaugagcgggcggugcuucgaaagccccagcaaaaagcguucggggugacuguggaucucuggagcauuggagugaccuuguaccaugcagccacuggcagccugcccuucauccccuuuggugggccacggcggaacaaggagaucauguacggugggccacagggcagggaauggggcggacuggcaguccccuggcccuucccccaccgguccuugcugugucuucugguccccucacacuccauggcccuccucugguccaccccccaacccaggcucuuuguagaucuuuuuuuguuaaugggaucaaacaagcagcugagcucugcccagggcugaugggagucugugaauaugcucuauguuaguucggugcuucacucuagcccucugcucccuuacugcucuccucgucucaaccgaagcucaaagagugccuugccuaagguggaagagcucaccaggggcaaagguggcagcuuccuguucccagguccaaggucuuuccaugguuuugugccaucggacagggaaguagcaaguggcuggagacaguagcggcucccucugagugcacagcccagagcagaggagaugucagcuggcuuagugggaagguugcugcacccaccucagccccgggguccagcuguguggaaccuauaucaggcccgcaaaaggggcagaagaccagcauggauggggguugucagggaaggcuggacucugaagggaaagaaagaggagaggauacuggggccaugcauagcaugggcaaagguguggaggaggcuggccaggcugagggaaguguagcggggggagaggcaguggacagggcaaaggugucucuaccugaagcaaagggcuccaggaggagugcugaggcaaggcgcucucacagcugagagccagguuucucacacuccaucugucaggcuacuuugggguagcugggugacuugaaccugugcuccgagcccuuugugcugagugugucguugcccggcaaugugauagcuggggaucccgcugaccuggccuuccuccccgcagguaccggaucaccacggagaagccggcuggggccauugcaggugcccagaggcgggagaacgggccccuggaguggagcuacacccuccccaucaccugccagcugucacugugagugggacccugcuggggggugaugcuggagucugagcugggugucacuucucucugcuaagucaagacuucugaggccuguuccagcagguuccgggcaugcugcaggcuugggcacaccacuuucccaucugguugcuggaacgaguucuuccagcucuuccuccccaacccacccugccccaccaucuugguccuagcucuucaggauauucucuuagaacgcuccuauugccugcuuaaggaggauaggucugggcccccaccccugacagucuccauguccugggagggcagggggcugcagagccagcuggugcccauccuggccaacauccuggagguggagcaggccaagugcuggggcuucgaccaguucuuugcggagaccagugacauccugcagcgaguugucguccaugucuucucccugucccaggcaguccugcaccacaucuauauccaugcccacaacacguaagugggggcgagggagggaagcggugagaaccuucucuacccaagcagcagugcauguccaaagcagcaucucccacaguacguucugaggaguguguacauaggaacgcuuccagguccaaacguaguugggaaaagacuaguucuacaaaguuaaagcuaaacagguuuucuugcauguacuucagagagucaguaccuuuucuaaugcuaauaugcauuauacaucugagaagugugugcgugguguauguuggcuguacauuucguaaagguacugcucauaguacccuugauuccuggauaauuuuauagaacuagguaaauuuuaauggcagugugacaggaagaggugcagaggcaaaggcuggguauuaggacuccugggaccuguucccacucugucuccaucacuauaagaugugaacucuccccuuggucucuccacccuugaugacagagaaaaccacccccgucccucccucugcaaaacagagcccugucuaugggcaacgcuuagcuggggcuuaggucacccuagcccccugccuugccuacugacacccccugcccucugcuccccaccacggcugugucuaggauagccauuuuccaggaggccgugcacaagcagaccaguguggccccccgacaccaggaguaccucuuugagggucaccucuguguccucgagcccagcgucucagcacagcacaucgcccacacgacggcaagcagcccccugacccucuucagcacagccaucccuaaggggcuggccuucagggaccgugaguagagccaccugggcuggaucuuucuccuccccacauuuuccucugagacaggaguuugcaauccaggccauugguuacuuuucuuuguggguguuucuuuggggccacagggagcaggaggcagauguggguucuaauucugcagacgccucugagaugccacaugacgugggcugguggcuugaccucccuggggcuuacuggcauccucagagcuguggaaagagcuccaguggaaacagggagaucuggauuuaaugcacuuuccauaaucucugauuuguggggaagccucaggcaguuuguguuggaagaagcccaagucugagcuccuggaaagaagggaagggggucgggguccagagcuugggccucucuccaaacucuagcaaaaauguccuuucuucucacuugaacagugcaaguuuuauccucuuucucugaggcuaggaagggguauucaccucaaaaccuguggacaagagggugauuuaguccauuuucagcucuuggacaugaggagguaguucucaaaaguggccgcaagguggcagugagggaucacaacuuuaaguguggcuaaggcuggcaaggugggaggcucagggugaguugugaagccugaggugggagauuggcagugaggggugagugugagcuggaaauaaugaaagauaagccgacccagcaccauacaggcaggccccucagacagggucuuugucugcagcugcucuggacguccccaaguucguccccaaaguggaccugcaggcggauuacaacacugccaaggugaggggcaacccccagguggcagggaggggcaugacccaaggguaggaggugugggaccuggcccugugcaucucuguguuucagggcguguugggcgccggcuaccaggcccugcggcuggcacgggcccugcuggaugggcaggagcuaauguuucgggggcugcacugggucaugugaguaaucaugagggcugggcacagagggggaggcgggcaggagagggaggcggacaggagggggagugggcaggaaggggagauggguggggggugggcaggaaguggaggugagcaggaggagggggugggcaggagagggaggugggcagagagggggaggcgggcuggagggggaggcgggcuguagguggaggcaggccggagggggaggcaggccagagggggaggccggcaggagguggaggccaguauccugggaugcugucugcaugcacggugcugagucccccgaucaaggcagcucugacucagucuccccuuggacagggaggugcuccaggccacaugcagacggacucuggaaguggcaaggacaucccuccucuaccucagcagcagccugggaacugagagguggguguucgccucaggccagcugggaccucucagcccugccuugucugcuccucacccuagauacuuccaacaaugcaccucuucuccccaagccagggcuacugccuucccugcccuccuagaauagagggcacccgcacccuaucccuuauccccaccucaccaaauaacugcaauggcucccccaaaacccagucccucaccugcaggggaaggggcccaugggggcacagacucuccagguaccaagguggccucccuaucccaagaaggggcuuguguccugccaaguccuucucugaaugauuuagagugcucacccuaugccaagugccagcagaacucuagggggaggacacacacccacgcacaguuccuggaugugaccagggauggagauccagguggucucguucuccaugccucaucuccugcuuucucugagucuucaacuuauccuugccuuccuuggguucccugccccaaucuuuggaaccccacucccuccacucccuugucuugggcuaauaaggggggauggguuggaaaaagagagagaccgggcaggaggaagccaaguggaagggucuggagauggggaaugugggaagacuucauuggccagagcacgauugagaaguaggcacagcaccccaaauccuggaaggcacgaggccaugguacgggugagggugggagcucugcagccuagggaugccacuggugacaggagucuuugggaacagaagaucagagacugcccauaugccugaaggcccccuccucccgccacccccagcccuuguccucagggagcuccagggaguuucccagcugugggcugacucaugcagccccgcgugccuccugcuucgcagcagcaacucaguugauggggcagcugggagguggaggagcagggaggaggaagaggagcaucuccagauaacagggauggagucuccauccagacugagccccucucaaauggugacagagaguaggguucagucagcagaacugcaagugaaucuccuuugagcagagcucuguccagggcacagagggggcuccagggguagauguggcauccugucauucagagaggcccaugcuuccuccggagcagcuagcccuuccuggacaugugagggcugaugggauuguuggguaagaggagaccugagauggguagaggcaaccacggaggccuuccugaaggaugaggcuuuuuuuuuuuuuuuuuuuuuuuuuuuuuuugagacggagccucgcucugucgcccaggcuggagugcaguggcgcgaucucggcucacugcaagcuccgccucccggguucacgccauucuccugccucagccucccaaguagcugggacuacaggugcccgccacuacgcccggcuaauuuuuuguauuuuuaguagagacgggguuucaccguuuuagccgggauggucucgaucuccugaccucgugaucugccugccucagccucccaaagugcugggauuacaggcgugagccaccgcgcccggccuaggaugaggcuuuuaaggccagaaagaagaagaauaccucaggcaggaaggucugcgcagagacagagaagaaaagggcccuguucgggggaaaggaggggaugcuggggaggcuuacugaagccacagucaugauggcagauagcccagagcuaagccagaggcggacagagguggaggugaggaggggaggaaagaaggcauagaggcccugaaggaguccagcuagagagagguuggaccccaauaaaacaaccaguagagagccauuguagauucuugaccuggaaagauguguuugggaaagcuuuuugggugucugucugcccacuugcccuggauggacaggcaugguggggaauggcacgcuggccugggucuggcguccuggcauccugguguccgcuggcugcuguuccccuguucuggcucugcagccuccuccaagguggccuccguggugugucuagagagcuggggucaggcaagugccugcuuugaagccuauuucagccucccaucaaggaggaggauggugagcaaaaacaguugugagcagggagccagagggccaggugcagccucuucucuuagucuggguguggcuccagcccauugucaccuuccccuaccugggccucuguguccucauuuucaaaaugagaggguugcaugaucucugcggccucccagcucccacauguugcaagcccauucuugccugaacauccccagaccuguagauucuccuaagggcugaagacacuagcuccacccgcaguggaaccagguauuuucaugagcugaaugucacacuggaggaacccagcaccucaugccaaguggcccaccuuugcccauccuggugacccaccucucccccagugugcauauccugccucagguuccccaggacagguccuuugguagagcaaccuugccuuugucccaaagcucccuggcccuccugggcagcugcugccauccacaggcacugcucaggcagccaggacgggcuuugggaauccuagggcuucccccagccccgccaccaggcaagacauuccaggcaagacuucaucuccaaggucccuuuugaucccuaugaauaucuuauugugucgcaggaaggaaauuugucuccucguuuuauaggugaagagccugaggccuggagagcuaaaggacuaacccaaggucaugcagauagcaaaugccaggacuaggacucgaacccaugucuccugacucccuguggagauguauuggguccagccucacccucuucugccgucaaauuucccaugccuuaaaauccauuugugcacucaguaacgccuucagcauccgugcacugacggacuaccaugugccgaacacguugcuaggcacgagacguacgaggagcaaagcgacggcaccccugucuucaaggagccugcaguucauuccugauucucucuuugcucagcuccccucuccuucccugcuccuccauucccaagccaaaauacacagcauacuuuuuaaaaaucaugauuguuacuaaaauguauauacuaaugguagaaaguuagaaaacagagauaagcaaaaauaagaaaauuaaaaucccauaaccuacuaucuagagacagguuaucacaccuuaggaguacacauccuucuagauauuuuucuacuaugaguaaacauuaaccaacaugaaaugauaguguauuugcuguuuuauaaccuguuuuggggaucacaucugcugucccaccuucuggacucaucuagagcuuccccuugaaguuguuugucuuguccuucuuucucagcauuuccuguaaacugggaaguuuuaaaaauuuuuuuuuaguauuuuauuuuauuucuuuucuuuuuuuucaaggcagggucucacuguguuggccaggcuggucuugaacuccugaccucaagcaauucucccaccuuggccucccaaagugcugguauuaccggugugagccaccaugccuggcuuuuauuuuguauuguauuguauuguauuguauuguauuguauuguauuguauuguauuguauuguauuauuauuuuuguagagacagggucucacuguguuucccaggcugaucucaaacuccugguaucaagcaauccucccacuucugccucccaaagugcugggauuacaggcaugaaccacugugccaggccuaaacugggagugcacaaggcuagauggauuccaguugaacauuuuuugcuagaauacauuauugaugaugccggguauuguauguugacauaccacuggcuggugauggccugauuccucugcuguaccguuacauugucccuguagaagaaagaagcagaguggugugaccuugucaccgugcaaaugcccaccccauuaucaaccaucauugcuuguaaggcuaugccccagagaacgauuucacugggcagcaagaugauaauguucuaacuucugauauaucauugccuaguagucuacaaaauauagcuuuucccucaucagaaagcuauugguuaucaagaaauacaguuucuacuggacaggaacuuaauucuuucccuuuaguuacaaaguuuccugguaaggagaucauuaauagcagccuugcaucaugggcccgugaauuuucauagacucaagguguuacaaucugucucaaccuuuauuauuugcaauacucaacaaugucacaacuuggguaagcagggcccucgucaggauggcgccucugucccaaacacaaaacuucccagagacccggagagccaccaaggcugucccacagaugcuaugcccagcaugugccaacagagcucucugccucccaccuuggcugcuccuaagcccccaaauguggccuuucucuuugcuucccucaagguucagcagcguggcuggaacgccugagauccaggaacugaaggcggcugcagaacugagguccaggcugcggacugugagugaggcuggagggcaagggcuuagcaggaucagagcugggggcccguguuccagccagccugcccaccagugcccaggcugaagaccccacgggggucugccuuugugccccacagcuagcggagguccucuccagaugcucccaaaauaucacggagacccaggagagccugagcagccugaaccgggagcuggugaagagccgggaucagguacaugaggacagaaggucugugggauuuuccuucuuuguggggugggagugggggagugggcagcuccaaagguccaguaaccuuuagccuuuuagacgucagcuugcauuccccuuucucuuggcaagggugcuagggcaugggggaguagagggagauccagcaauaaacaagaaccccccgacugccccagacaccagccaggaggagaaaaggaucugggguccugcacccaucuuggaguuugaggaaugccucgggaaucuuagcaggugcuauaauucugaauaaaagaagacuuuaguucccuuucucugugucaggcccuuggguagguccucucacguacagcaucucguugaauccugaaaacaauaaugaugcuaugauaaugcccuuuuuauagaaccucagucagugagguuaacuuacccugagucacagccaguaaaugacaaaugacagagguggcuucaggucgggucuguccaccuccaaagccuauguucuuggccuaugccaggcagggguuuacaaccuuuaaggcaccacucucccuuuuaacagacauaaaaauaccccccucccccaggccccagcugacuguggggagccgcugccuaccuugccgcuucugaccaggggaugggugguacccagcgcggaccuccuccccauucucugcuggugccuacuguaaucugggccuauccccauccaucaucccauggccucaauucuaaauucaaacagcucugaacaccacaggaguuuuucuuaacuguuuuggccauaaaaccugaccuaaaucgaaugaggcucuuuauagaauuuaucccacuuacggugaauguucuugugguucuuuggagaugugaauguguuugauuaggaguugaugcccugcucgggccauuccacaauacacuguguggguaccaaauugccuuucugauaucagaagacgauucucaauucagagcacauuuggccccguccuuuuggaugaaggcugcagaucugaggccccguccuuuuggaugaaggcugcagaucugaggcccuguccuuuuggaugaaggcugcagaucugaggcccuguccuuuuggaugaaggcugaggaucgagguccuguccuuuuggaugaaggcugcggaucccaggcccugucuuuuggaugaaggcuguggaucgaggccccauccuuuuggaugaaggcugaggaucaaggccccauccuuuuggaugaaggcugcagaucugaggcccuguccuuuuggaugaaggcugaggaucccaggcccugucuuuuggaugaaggcugaggaucgaggccccauccuuuuggaugaaggcugcagaucccaggcucugucuuuuggaugaaggcuguggaucugagcccuguccuuuuggaugaaggcugaggaucgaggucccauccuuuuggaugaaggcugcggaucccaggcccugucuuuuggaugaaggcuguggaucccaggcccugucuuuuggaugaaggcuguggaucgaggccccguccuuuuggaugaaggcugaggaucaaggccucauccuuuuggaugaaggcugcagaucugaggcccuguccuuuuggaugaaggcugaggaucaaggccccauccauuuggaugaaggcugcagaucugagcccuguccuuuuggaugaaggcuguggaucccaggccuugucuuuuggaugaaggcuguggaucugaggccugucccagccacuucaucuuccacccucauguuccuggcggggcaggcuccuucggcuggcagagcccuggaacaagccugugcucuguucagagucaagcuccagaaauagcagagauggggucacuuggaggugcugcagggaggaaguggagcuacauaggccugugggugaggaagaacuuuucccagacacucccgacuucucaaacaaaguguuuguuuccagccugaaaaggggaaggaagaaauaauaaugaccuucaaccccagaacaagaaaguccucgggagaucaucuccccaguuccuccgccuccgggcaggaccgaggccuguugauucauucuuguuuucaauaaggauuauugauucauuauuuauguuaaguuucugcugugugccacacauuggguaaaccaagaagcuauauucuucugcuuuuuccaguugaccagagagagauuuuagcuccccucuauccccagcugucacugccagacacgcucuuagguuucaggggccuaggcuccuucccagggccuagucucacaacuucucagguaguaaaggccacguuccuguugcccguccugcuuggcuuccugucucucuuaucuccuacuuaacucaugcugcgagugcaugugugugagagaggaagaauaagccaugagaacgagagacggcuggcugacuguacggggucucaaauaagccuagagacgggacagccaccuccacucccagacugaucccccaaaacuguggcugugaggcuccuccccuauuccacugccacccuuccccucccucccucuuuccucugugcuauuagauucuuccaacaccuggucccugucuccugcccacagcauccagcagauucagugcuguuuggacaagaugaacuucaucuacaaacaguucaagaagucuaggaugaggccaggugagcccggggagggcagaugccccuucucucuccucugucucccuucuuucgccuuucuuccuuuucacuggugcuaccaguggccacuaaccuccagcuaaguggccgcuaaccuccagcuggugguucuuggaggcccacuaagcggaugguucugugcagcugcucuaggggcaaggccccugucugcaagcugccugcaggccagugggggacaugaaaccuuuacaugccugccuguugccacaugagagacuuggaucacaugguugggggauccagugggccgggaccugggugcuguaggagaggugguccuggaaagagaucucgcaccuuggcagggcacuuuaaaguauagaaugucacuauccguuguguccuugggacacugagacagucagguuuuccagaaaagggggggucaggagaagucccauuuugagucacugggucaggcauuuuggcugcuugauccauuaauccucacaaggaugcuguggcaggggcagcccauuuacaggcucgggggugggaagcugcuuguccaaagugacugccauugugggguagugcaagggugggacccagggagggcuggugaggggguuggagggagccugcggaggcuccaguugacuccucagguuggggaacuaacacaccaggaaccaaaccucccccuccucucccaggccccaagcauuuccuaaucuguaggcugaaggucuugggcuuuauugccaaauucucuucucuccuugggauuaucuaaaaaccacuguccaauagaaauauaaugccagacacguauguaauucuaagucuucuaguagccaauuuuuaaaaaguagaaagaaacaagugaaauuaauuuuaauguguuauucaacccaauauauccagugucauuuuagcguguaaucaauauaaacaaaaucacuaaggaaauaccuuauauucuuuuuguguuaucuucaaaaucccacguguauauauacacauaaauauauaacuuauuuccuuagcaauucuguuuauauugauuacaugcuaauauauauauuugagacagggccuuugucacccaggcaggaguacaauggcaugaucacugcucacugucgccucaaccuccugggcucaagccauccucccaucucaggcuccugacuagcugggacuacaggaugcuuucccaucacuucauuguuuuauauuucacauauauauauauaauucauauauauauuauucacauauauauauuauucauauauauauuauucacauauauauaacauuuauaacacaucucuauugggaaacuaaauuuuauauauguguguauauguguguguguguguguguguguguguauauauauauauauauauauauauacacacacacacauacauggagcugugugcaguggcucaugucuguaaucucagcacuuuggaaaacugaagcgggaggaucacuugggcccaggaguucaagaccagccugggcaacauagcaagaccccgucucuacaaaaaauaaacaaaacuagcuggacgugggcaugcgccuguaguccuaacuacuugggaggcugaggugggaggaucaccugagccugggagcugggaguucgagacugcagugagcuaagaucacaccacugcagcacuccagccagggcaagagcgagacccugucucaaacaacaacaauaacaaaaccucuaggcaucauuacccuccccauuuuauagaugagaaaaccaagacacagaaagguuaaguagcccaaguaaucuagguccagcugcuuuuaacuaucccauuuuacagccucaaaggaguuuuacuucuauuggucuuuaagaguccuuuaauaaaauuaaaaaugaaccccuaacuguuaaaacccagcguguugaaagauaccauuuuuuaaaaugcccgguggucuucaggcucucucgcaugagccucacgggacucccaaguggcaccugugauggauaaggagacaggcucagcgaagugaaaucacucgccuagugccgccugccaacaggaggaagggcugagguuugucccaggucucucggacugcacacaugcucuuagcuggccgagugcagggcccaggagggggacucugcuaugagaggagugggauggggaggcccucgaagugaaccgccaucaucauuucaucuuggggcugccgccacccuggaggcccauuccugcgaagaccaggagggggcagcaucucccuagugcaugagccuuagggcccuucaggaggcagccaaggccaugaaagcuucagccuuucuggcaaaaguggcugggcagagcggggagguagaaggugguggccugauuucuccagcucguugcagguagcgcccaugaacauucagggaugggaccacccagcugcaggcaucagucacucugggagggugcuggauaaggggcuaugguugaccgagccuccuucuaagcccacuucauccaccaacucccaccugaagcaucccccacguccccaccccggcccugcacugcaggcugccuuccccuggggcccucacacaauuuccccauggcuucuugaggcccuggcuuuguccuaaucagcuauuccggugcuagcuucacuccucugccccuccugcuccgcugggcggugaguucccgugaagcagcacaggcugggccgucuucaucuuuuaacugucucucgaccuuugcugcacacuguuucguugacugauugaauaggugacaucuguucugucuguuuccuccagggcuuggcuacaacgaggagcagauucacaagcuggauaagugaguggccuguccuccggcaggugggugggcaggaggguggguguccucagggcagagcgauucucaacgccagaggagaggcagugaagggcccugucccggacugcagcugagcagaguuggggauaacagguuaucuggggccaggggagggaguaugcauagcuuaguuggagggagacuucucagaugcaaucuugaaguaacuggauuuacuucugguauggacaagacuguuugcaggcuuuuuuuuucucuaguuguccucacugaugcaccacuuaccacuuccugcuucugcccucugccugaaccuucccugccuccccccgcuccucugucucccauguuucccggacacacucacguccaggaggcccucccugauuuaaugguuaucugggaacucacucccccaguucuacaagcaccccgaccccuuuuugucucacacacacacgcacucacacaccuucuuuccacggcugccucacuuucccuucccuuuccugaggacuaagcuugagcacauguguguucccugaggacccccugugugucucccacgucucccuguugaugugggcuuugcuggccacugcaaccuucacaauccaagugugugaccguccuuccuccuuucccagagacauagcccugcuguggacgcagggcuugggcacuuacgacaagguggugacggagacugacggagacugagggauggugggcuugugcauagugguucuggcagcucaucugcaccuugguucucugucguucuagggugaauuucagucauuuagccaaaagacuccugcagguguuccaggaggagugcgugcagaaguaucaagcguccuuagucacacacggcaagaggaugagguaacagccccuccugagcuccuggagcccagggccuggccuggcccuucuaggcuucagaggacccagggcuuuguggagcccugaggcagagggaggagugagugaaggggugugagcagaggagugguuuucugucccuggguggaccaggcaguuggcugggagauuucuguagcucagcuuauuuacuccuacaacaccugcccuauacaguagauaucaucacccuauuuccuaggugaggaaacugaggcucugagaacaggucuccucugcacaucacauggcuaguaaguggcagacccaagacucguauguggcucugccugccucuacaaucuagauucuucagggcuuuugagggguaaaaucaaaucaaaucuggauucuuucuaccguuccaccugguuauauugagaagucuccuuuaggagaacacuaggugccccugggauaaggacaguggcaguggcccuuaaguagaaccuucugucacacuguccccuucaggaguuuuggguuccgccuucucagaucaggcccacucuccauccccugccugugugaacacuggccccuccugagaagagaggacaauuucccacgugcuaccacauucugaggccuguaggaccucaccuuguuauggggcugagaccuuggcacucacccguccucauaucagaauaccaaugccugcuucuucuacuccaacccaccacacauucugguguaauugcucuggagcagggcuuggaugucaguguaguacagcuucuccaggugauucuaauguguggcgagggcugaccuccaaccccugauuuaacagcucugggccuuggggaaaauguuccuguuccuucacuccacuuagagauagaagagaauucacacuggaaaugagagcgugggcaguuccccacacugagagcccuggugugggcuauccucugccucucugcagccugacuggugccacgcucaccauagguggcaugcgucacccagccccagccacaugcauguuguuggugcuccacacuacggcucugaagggggccucccagccucagccagcugugugcuucugcauuauugcaguggggcgggcaagcguggagggcacagcuggcagggcagaggcagcgagggaggcaaauacccgggacccaccuguguccauguguggauccgauggcagcuaggcgagcccuggggaaugggcugaguccugcucuaauucuaagucucuguguguucucuugaggguggugcacgagaccaggaaccaccugcgccugguuggcuguucuguggcugccuguaacacagaagcccaggggguccaggagagucucagcaaggugggcauggcagaaggauucuaggugcucuggggaugcaggcuggggcgcuuguuacccaugucuuccccuccuccagcacucccccuacccagccacacauaagcuggcuacuaauugcugaccaaaguauggcuucccugcagcuccuggaagagcuaucucaccagcuccuucaggaccgagcaaagggggcucaggccucgccgccucccauagcuccuuaccccagcccuacacgaaaggaccugcuucuccaguaagugcuggggagaaagcgguuguguaucuguguggaaggggguugcagggagcagaguaugcugagguuagagccugagggguuuggcgucaugccaggccuaggaggcaagauuaaagagacuagcugggugcgguggcucacaccuguaaucccagcacuuugagaggccaaggugagcggaucaacuugaggccagaaguuggagaccaaccugccaaacauggugaaaccccaucucugguaaaaauacaaaauuuagccgggugugguggcaggcaccuguaaucucagcuacuugggaggcugaggcauaagaauugcuugaauccaggaggcagagguugcagugagccaagauuaugccacugcacuccagccugggcaaaggagcaagacuccgucucaaauaagcaaacaaaaaagaauaaagaggcuucuuugguggggcugcagaggagggugggccucccaggaaaagggucugggcagggcaacuuccagccucagccgccucuccugccucugccuugggcagcaugcaagagcucugcgaggggaugaagcugcuggcaucugaccuccuggacaacaaccgcaucaucgaacgguaaggagcuuucaccuuguguaggucagggccgggucuucaagcuacccuugccuggggguggugaagaguccccaagccugcccaugcagguuugaugacacguguccauuuucgaagaagcccuguugaagcuuaggcauuuuccacaaaugaguugacauccucaggagguguaggguucacuuacagccuuuaaaaugugagccuccaugcugucagggagaugggggccuggaggcaugggguuugugccuguguccagcucugcacuccauauguacucugugcucaagcugccccagaugccuccuugaaucacagccauccucaggauaggugcuguuuucauccccaugugcuaccccaggaagccacagcgcagacaccuuggauacgaugcccaaggccgguguuucucuggccuuguggggcucccgucccuccugccaaugcucaugggccagcccggggcugcaggaucaucuccugauuugacuccccuccuuggggugcugaggggucaugagagguuggugugggaacgcaacagggcuccgacucugagauugagauuuugcauaccaguaaaaguucuuucuuuuuuuuuuuuuuuuuuuuuuuuuuuuugagacggagucucacucugucacccaggcuggagugcagugguacugugucggcucacugcaaccuccaucuccuggguucaagcaauucuccugccucagccuccugaguagccaggauuacagguguccaccaccacacgcaguuaauuuuuauauuuuuaguagagacaggguuucaccaucuuggccaggcuggucucaaacuccuggucucagaugaucugccugccuuggccucccaaagugcugggauuacagacaugaaccacugcgcccggcuacguaccaguauaguucuaaaagaaaacucgagaacaacagaguuaccagcugcucacauaaccaaguaagcacauuugaaguaaaaaaaaaaaaaaaaaaaagcccugucaucuaguaacccuacuuuauaaaacacauuuuaccaccaaagagagauaaccucaggauaaaggaugguccuugcuugcccugaaggccagcggcccuguuuauauacauguacacacgugcacgcaucucccacuccugccugucauccucgugucugucauuuuccugucugagaaccaauggcaggguagagucagcagagguuccuacaggauuucaauccugacccugcuuuuuaccaacugcgugacccugggagguguguucagcuuugagcuucaguucccuccccugugaaacaggaguaauaauuucuaccucaugguguugacauagggauuuaaaaaaaugagauaugcaaggugcuugcgcauagggggguguggagggaagggcucacuaaauguuacuucuuccccagaggccacuccagucucacacuagaauuggggccaggagguagggaaaccaggagcagagcuugugguuuguccccagaguuucagaggguccuuggguaagggaggaaucuccucccuguccuguuccagcaagagaacucauccucuuaaacacccacaaagaggacauuugacagcuucuuggaaggauuuuccaaaacagcccucuuggucaggaaguucuaauuuuagugccaacaaaaauugcucuugcugugauaugucaucuauuugcagauagcucaaaacuuuauuuuagugaauuuucacuuccuuauucagagcuguagccaaagagccaaaugaauccauuuaaacuccuuuccccuccuaaaccuuggcuacacacuggaaucaccaggggagcuuuuaaacguacaaaugccugggucuugccccagagacucuggguacagcuugugguuaggauuugcaugagcuuuccaagugauuccaacauauagucagaggcgagagccaguggguucuugucggggagugagggugcuacaaggggagagcugaggacuugaauggcucaguguucuugaaagcuaauugugcugggcccuggaguguggucugcaggccucuccaacaggugggcacugcuagccuguaccuuuucuuguaggcuaaauagagucccagcaccuccugaugucugagcuccauggggcacaugaggcauccugaagcauuagaaugauuccaacacugcucuucugcaccaugagaccaacccagggcaagaucccaucccaucacaucagccuaccucccuccuggcugcuggccaggaugucgccagcauuaccuuccacugccuuucucccugggaagcagcacagcugagacugggcaccaggccaccucuguugggacccacaggaaagaguguggcagcaacugccuggcugaccuuucuaucuucucuaggcucagguacugcuccuccaugcccauggcugggccguggggagaagaagcucucauacgccuucccacucccucugguuuauaggacuucacucccuagccaacaggagaggaggccuccugggguuuccccagggcaguaggucaaacgaccucaucacagucuuccuuccucuucaagcguuucauguugaacacagcucucuccgcucccuugugauuucugagggucaccacugccagccucaggcaacauagagagccuccuguucuuucuaugcuuggucugacugagccuaaaguugagaaaauggguggccaaggccagugccagugucuuggggccccuuuggcucucccucacucucugaggcuccagcugguccugggacaugcagccaggacugugagucugggcagguccaaggccugcaccuucaagaaguggaauaaauguggccuuugcuucuguuu

SEQ ID NO: 21200 - RNA, 8490 nt, Homo sapiens
uuuauuccggaaguugcucucagaggcagcgugcgggugugcucuuugugaaauuccaccauggcguaccguggccagggucagaaagugcagaagguuauggugcagcccaucguauccuacgcaggaugucaggacuaggagguucgggucagaauacggggugcgaaggcgcaggcugagggcaggccugggauaguggaguacggauccacaucccaugagcccccggggcuaccaagacuggaagaaagcgcggguaguugaaccgugaugguggggagguggucuuggggggaccccugccguggggaaugcaggaauggacgcggcaaaaggagggaagagaacuucaggugcggagugaaaacgggaguuaacgguuuugggaaacuccagggggaugaaaguggaauggauguucuuuagucuuuagaagacccguaacgaaugcccagcugggcacuuguuguuugcguaagcaccagaccucgcguuuaguaaacaaaggugagacgggaauagcgucguccgguuguuucaggaagcagagucuaugcugcuuuuguauuuuuuccuuagccacuguggugcagaaccucaucuucagauacuuacaaaauguacguaaguugcuuguuucguaacuacuuuuuaaauaagaggugaacugauuuaguuuuuuguguuaaccugagcgaucgcuguguucuagaauuuaaaaauagauguaacuggagauuggaggguaauugaggggaaggaguacuuagaaagcacuaaugugaugaagugguguguauccaugccacuucccaacaugcaaagaauuguauccauuacuuugcaagaucaaaaauacuuuuuaauuccaaaaaguauuauuagcagacuugaccaugguauuugggcaucaguaguuuuguuaguagugauuauggcuagaacauuggaaccucuccccuuuaggaugaaacauuggaagaaaaacccagccaacuuaaaccaugucaagaggugguguguuuaauaccugugggaaaacuuaaagacgaaaaaaggaagagagaagggguagcuucagaggaguuuaguggcagcugcuuuccuuugagggaaauuuuagcaacuuaaauuuuauagugugauaacacaacugaaaaacauuaauuucaggugauaauaauucuuaaccaccugaauugagggcuccuguccuaguuguuaggugugugacaugagaaggcuuuguuuuggaacuggauuuugcugcaggagauaagcccuuggucauuagaaauuacugcuuugugcuaugcugucaaaaacuuucacucuuaauagauugagaccagaagcaguaagaaauauugagucccaaaaucacaggaaaauuauuagcuuauacaguuccaauauagaacuuauuaaaugaaaauucuuuuugagguuauuauuauuggugaauaauucuuagauaugggcuaauuaguuaaaacuuuugacuuacauucauuacaauuuuuuuaggagccauauuucucuugucguuugaccaaaaugguuagguuuuguauacuucaauuuuuuggggggcggggggcggggagaucuugcuuaauguugcgcaggcuuauauugaacaccuggccacaaagcgaauuauuccgcuuuggcaucccaaaguaugggaacggugugaaucgaggcaccuggccuguuuuucuuuucuuuuuuuugagacggagucucacugugcccaggcuggagugcaguggcgcgaucucagcucacugcaaccucugccucccggguucaagcgauucuccugcuucagcgucccgaguagcugggacuacaggcgugcgccaccacgcccagcuaauuuuuuuuguauuuuuaguagagaugggguuucaccauguuaacgaggauggucucuaucucuugaccuugugauccaccucccucggccuccgaaagugcugggauuacaggcgugagccaccgcgcccggcccuauuuuucuuuuuuuaacguuuccacuuuuaugauuauuucagagaucgcggauucagguguggcucuaugagcaagugaauaugcggauagaaggcuguaucauugugaguauccaggcgauuucaucucauagcaguucggucguagaaaaagacuuaacagaaagugucuagccagaacaguguauaaaaagucaaagauccaaccuaaggaaaguuuuucaggugcugcuguuuagccuuuuuucauuguugauagauaaggauuggguaguuuuuaauagggaaaauaacuuuuaauucauuuucuuuccucugucuauguugagaagaaaauuuguauuugauuuuugagaaagggcuuuguucuguugcuuaggcuggagugcaguggcacaaucauggcucguugcagccucaaccucccgggcucaaguaguccuccugccucagccucccaaguagcuaggaucagaagcgugcaccaucacagccugcuaaauuuuuauuuuuuauagagaugaggucucacuguguugcccaggcuggucucaaacuccuaggcucaagugauucucccaccucagccucucaaagucuugggauuacaggcaugagccacaacgccuggcugaaaauuaacuuuuaaaaauuauucgaaaaaaaaauauugagcgacaauguuaguauggagaggggggacaaaauaaaugaaauuagggagggugggguuauuuguuguggguuaggugauaccugaauagagagcucagugggguuaguuaaauaaggcuucugggauagcaggcuacccuaaauuuuuuuuuuuaaguugggguccggcucugucacccaggugcucucagcucacugcaaucuugaacuccuuggcucaagugauuuuuccaccucagccucuaguagcugggaacuauaggcauacaccaccagguccagcuaauuuuuaaauauuuugcugggcaagguggcucacgccuguaauccuagcacuuagggaggccgagcaugaugaaucacuuuagcuccagaguucgagaccagccugggcaacaugaugaaacccuguuucuaccaaaaauacaaaaaguagccaggcaugguggugcgcccuguaguuccagcuacuuggggggagcugaggcagaagaauugcuugaacccaggagguccagcugcaguaagccgagguugcaccacugcacucuagccuggaagacaaagugagauccuuucucaaaaaaaaaaaaaaaaaaaaaaaaacuuuggguggaaggugggguggggcuugagaagagugaaucuuugaaguuaguuggaguuuuuaucugcauagguauacucauuuaaaaugguuugaaugugauuuucuuugaagauaacaguuuguuuauuuuucuaggguuuugaugaguauaugaaccuuguauuagaugaugcagaagagauucauucuaaaacaaagucaagaaaacaacuggguaaggauagaaguggucuuacagaauucuagaaauauuuuauucacuugcagaauucagugaccugcaacucaguucauguuugaauuuauuuugcauuugagaaguuauuauucagaguaguaguacacuuuugaaaucauccucuacuacucacuccucaccacacuccauuuuggcuucuccacccagagagcucucaccaagggaaccaaagacuagugguauuaaaucuaaugaucaguacuaauccucauuuuauuaaacucucaacagcauuuggcacuguuggcugcucccuccuuaaagcgcuuuguucccgugucugaguggcaggaaaaacccaaguagauuuuucuguuuccucaguugacaauaauuaacacagaagacuucugugaccagauguaugggcauauuuccccacacaccaagcaagcaaucaguucggcaguggacaucagcucagagucgucaaguucaguucaguucuaacacuaucuaccugagauagcgucaguucccagagguugagggcucaauccccaagauugccuuccaugccccucaguccuccaccagaugcuaauugucagcuccagauuguuuuaccugugcuucuuacugacuggcuauaaacugggucccaugaccccuccguugguuugauuaauuugcuagagcagcucacagaacucggggaaacacuuguauuuacuggucuguuauaaaggauauuacaaaaaguacagaugaagagaugcguagggcaaggcauauaggaagggaugcgaagcuuuugugcccucugcaagcucaccacucugggaaccuccacauguugagcuaucagaaccccauuguuuucaguuuuuauguaagcuucauuauguaggcaugacugauuaaauuggccguuggugaucagcuuaaccuucagcuccuuuccuccuccccgggugggaggguggggcugaaaguccgacaucacuaaugccuugguccuuucagugagcagcucccaugcugaaacguuguaggggcugcuggccaucagucaaucauuagcauacaaaaaggcaacaucuuagagauucuaaggauuuuaggaguuguaugggauugaagaccaaguaaauauuuugcaguaucacaccuuggcucuacgauauuauacuuggguuuuuauuuuucacuucuggcuauuuuucagacuuauauauucauucuugggacccaaucacuaaaugaguugcuccaggcuugguucuaggcccuccugucauucaguauugucugccuaggcacuggaguacagcuucaguuaccaucuauaaauacugacucccaaauuuguuugucugggccuauucaccauuucuacuugaauguuucaaaggcuucuuaaagucagcauaucagaaagcaaacucaauuccaacucacacuguuuagagcuauuguauuauuauuuccugccuuauugaauggcaccaguuuccaguucagcuuacuaauugauuucucugcagcuaccuccaguuugcuuuccaggccucacucaucuuuuaaaaacaccagucugaacauaugucaucccuuugcuugaaauacugcaaugacuuccuguugcuguuaggauaaaaaaaaaucuaaugauucugcaaaucuaaugaucuucaugaucuagucuuaucucccucugcucaucucguaucacugccucacuuucugagcuuuagcaacacuugucuuauuucaguucuuugaaucugcagauuugcccaaccauuaaucuuuguauaugauauuccuugugucuguagagcucagaucaaauaucacuucuuuuaagacagcgguccccuaggccaggugcaguggcucacaccuguaaucccagcacuuugggaggccgaggcggguggauuacgaggucaggaauucaagaccauccuggcuaacauggugaaacccugucuuuccugaaaaaaaaaaaaaaaaaaaaaaauuagcugggcaugguggcgggugccuguaguuccagcuacucgggaggcugaggcaggagaauggcgcgaaccugggaggcggagcuugcagugagcugagaucacgccacugcgcuccagccugggcgacacagcgagacucugucucaaaaaaaaaaaaaaaaacagugguccccaaccauuuuggcaccagggaccgguuuuguggaagacaauuuuucuguggacuggggugugggggauggcuuucggaugauucaggcacauuacauuuauagugcacuuuauuauuauuacauuguaauauauaaugaaauaauuauacaacucaccaucauguagaaucagugggagcccugagccuguuuucccacaacuagacagucccaucugggggugaugggagacagugacagaucaucaggcauuagguucucauaaggagugcgcaaccuagaucccucuuugcccgguucacaauagguuuugcgcuccuaugagaaucuaaggcuuccacugauaugacaggaggcagagcccaggcgggaauacuagugauggggaguggcuguaaauacagaugaagcuccgccaccucgcccacugcucaccucuugcugugugacccaguuucuaacagggaccaggacugguacuggucuguggcccagggguuaggaagcccugcucuaaaaaguucaaaguuuaauuugguuuugcuggggaugggggaaggcgggauuaugugcucccugaguuuguaguaaaaccuuuauuauugaaauuauuuuauuagugucucuccuguuaucagaugcuucaccguaaguguaugagucaugccuuuuuugaucccagugugcucaguaccuaacucaaugccuggcacauaauagaaacuaaaaaauauuugaacaaugaaugguauuucuuucuuuuguuuuuggagacagagucucugucgcucaggcuggaguguaaugacgugauuuuggcucacugcaaccucugccucccagguucaagcaauucuccugccuuagacucccaaguagcugggacuacaggcguguaccaccacgccuggcugauuuuuuguguuuuaguagagacgggguuucacuguguugcccaggcuggucucuaacuucugagcucaggcaauccaccugccucggccucccaaaugcugggauuacaugugugagccacuaagccuggcaaugaaugguauuucuuaacccaguuaaugaauggucuuaggauucacgguuucaucaagacacacugaaucauuucuguuaacaucccauucacuugagguuuauuuaggcauuuugucuuuauuuguuaaaugcucacuaauacuuuuaucagugguggguuucaggugucucucuuucagacccucaggauucucuucaaccugaacuagauauauggaaaguagauucugagaagcaguaugguguuucgcuggcugcuuccugcuuagacuauuuuuaugaaagccuggguuuuuuagauuuauuguuauuuauuuauuuauuuuuuuggagacggagucucacucugucucccaggcuugagugccauggcacaaucucagcucacugcaaccuccaccuccuggguucaagcgauucuccugccucagccucccaaguaacugggauuacagggcaugccaccacaccuggcuaauuuuuuguauuuuaguagaagacggggugucaccguguuguccaggcuggucucgaauccuaagcucaggcauuccacccaccuuggccucccaaagugcugggauuauaggugugagccaccauacccagccggguuuuuuagauuuaaagaugucuugccaggacgggcaagcuuagccuuacugaggucauauuauucauaaauuauuuaccaacuguugaauucccaugguaguauuuauccuguagaauagaauguuauuaauaccugcagaagccugggaaaguagaacaguuuaauuacuguuggaguugaucaacgugucucaaaccguucuaccagugaacaccaguguuccugaagauguuuauaaauuucucagaaaaguauugucuuaaauaaccuuaggaaauuuuggguaaaacagguuuguuuauuguaggauggagucuuuuuuuuuuuuuuuuuuuuuuuuuuuuuuuuuuggagaugaauuuugcucuuguugcccaggcuggagugcaauggugccaucuuggcucacugcaaccuccgccucccggauucaagcaauucuccugccucagccucccaaguagcugggauuacaggcacgcgccaccaggcucugcuaauuuuguauuuuuaguagagauaggguggagucuuuaauauacuaacagcuuuaagaauggaguuauaauaugcuguauuucccaaacuugacauacgacucauuuccaaacuuuuauuacaaauucagcauugggaaauguuguaugaggccuauugaguugacuuaguccauagaaaugauauuugucaugaaaugucaucuaccuauguuagucucuugaaaagauaaauguauucuaauggagccagaaagccuuucacuauauggacacuugaaaauguucacauauuuuuauaagaaagcauuuucaaaauauuguucaaaaacuggauacaaaauucugagaguaaaacaucugaguguguggcuauuaauagcuuuuuguuguuuuuguguugcaggucggaucaugcuaaaaggagauaauauuacucugcuacaaagugucuccaacuagaaaugaucaaugaagugagaaauuguugagaaggauacaguuuguuuuuagauguccuuuguccaaugugaacauuuauucauauuguuuugauuacccucguguuacuacaagauggcaauaaauacuaugggauuguuuguauuaaaaaauuuac

SEQ ID NO: 21201 - RNA, 8408 nt, Homo sapiens
gcgucaggagcacguccaggaacuccucagcagcgccuccuucagcuccacagccagacgcccucagacagcaaagccuacccccgcgccgcgcccugcccgccgcugcgaugcucgcccgcgcccugcugcugugcgcgguccuggcgcucagccauacaggugaguaccuggcgccgcgcaccggggacuccgguuccacgcacccgggcagaguuuccgcucugaccuccugggucuaucccaguacuccgacuucucuccgaauagagaagcuacgugacuugggaaagagcuuggaccgcuagaguucgaaagaacuccguggauauuccagcuuucccacaagcacugaucauuaugagccaguuacuuaaccgaucugagacacucucaccuccuaaauagggauagaugauacuaauuugcagguugucauuaugauaagacaggaucugaucaauauaugugaauuguuuauauuuggaaccuuuuuauugaguggaagaaguuguuuuaaauauucuagucaguucuuuccugcucccaggaaagcccggauuauguuuuaagauaagcaaaaugucuuaaaaguaagcuguuuuacuuugaauuuuucccuaaauguugauuaguguacuagauccauuuuaauuuggaaagugaagugcuacuuauuugaacuucuuaaaaaugcuaauuuuaacaucuaaagaguuaacuaagaaaagcuuaguaacaugauguaccaaguugaauaugcuguuauccuuauuuagaauagaaaauugguauuucuacguuuuauccauucuaaggcagguuaaaaaauuguauuuccaugacuaccuauauauuucuugaauuuauuauuguaaaguugauucauagucaaacaauuaaauguuuaaauuaagauuaagacacuagagaaugauuuauuugcuguccuuuaauugcagcaaauccuugcuguucccacccaugucaaaaccgagguguauguaugagugugggauuugaccaguauaagugcgauuguacccggacaggauucuauggagaaaacugcucaacacguaaguuuguccuuugguugccucauuaggaguggggcuggauacaguuaucauuguauagauuugugucuuauaaugagucccauuaauuucucccucccuuucuucgucuucuugcagcggaauuuuugacaagaauaaaauuauuucugaaacccacuccaaacacagugcacuacauacuuacccacuucaagggauuuuggaacguugugaauaacauucccuuccuucgaaaugcaauuaugaguuauguguugacauguaaguacaagugucuuucuaagguuuuuagccuucucaaagaaaaauaugcuuuauaauacuguaagccuaaucuaaaaacauauuuccaagcuuaucaaaaagacuuuaagauagcuuuuaaguuugccuuccaucuuaaucgccaaaaauauugacauuuagucccauccaguuuauacagucugcucacaacucuguauaccucuucuaaccuuuacuguuuggucaguuuguggagguagcaugguccagcuguuuauugaaugcccaugggccacagaauuguucugaacauguagcacccauuaaaauaaauuuggauuuggaucagcaagaaaauaacuuuccaugauucuaaagugggugccauacucagccauuccuuucauaggccucuuggauagugagcagauggcuaccugaaaaaucaauauugccagauuauaaugugcagaguauauguauuuuauuaaagauguauuucaaguggccauuagacuauaaaguguaguuguuuaaaaauagauuuuuuuuauuuuggaguuacauucaaccucaggugccacuuuccacauuuuacaauaaaaauaaugguugauuuacuuaacaaaugagaauaaauaaaacauuuuuuucuuugaaaauuucagccagaucacauuugauugacaguccaccaacuuacaaugcugacuauggcuacaaaagcugggaagccuucucuaaccucuccuauuauacuagagcccuuccuccugugccugaugauugcccgacucccuugggugucaaaggugaguaagaagaauccauuagagauguauuaacuauaagacgggcugcauugcugccaaaaaaaaaaauugaccuuagacuaccauuuauuuauuaacaaaagcaguuuuuacuuuuagcaugguuaucuauggguauuuuuuaaaguaugagucuauauaaacuauuauguaaaagcaaaugagcgucuugguauaaugucuuaauauuuucaaauuauuucuuuagaaaugaaauaauucuaauuaaaauagauaaaaucauucaguaagaaguuguuccaccauaucuuagaacuguuguuuauauuaugauccuauucacaauuguaauucucauauaaaugaagaauucuugguagauugacagucaccaucuccuuucuugaauacauagauggauucuuaccuuagcuuucucauuuuucagguaaaaagcagcuuccugauucaaaugagauuguggaaaaauugcuucuaagaagaaaguucaucccugauccccagggcucaaacaugauguuugcauucuuugcccagcacuucacgcaucaguuuuucaagacagaucauaagcgagggccagcuuucaccaacgggcugggccaugggguaagauagaguuaauaucuuagaguuaguaaaauuauaccaaaucauagucaagggcuaacauuaaaggagauauacagauagauagauccaaauaacuuauccacuuuuuuuaaaaagaagucuuaucuauaaaaaccuuaaaggaauuuuccauuuacuucacuggucuaguaaaauuauacacacacacagacaugcacacacauauauaaacauucacacacauacauauguacagguauuguuauuuguaauuugacccuuguauuuuuuaguuuaaaauguuaguacugcaaaauguuauguccucaaaaacacauuguaccaugauuaugccgcuuucaauauuguaaagugagguuuuugccgcauuauuauuuuuuggauuucaauagcauagcuucaaguuauucguaagaauuuuuuauaaauaauacauuuuuauacuuuuuuauaauuaccauaucaucauagugaaguauauaauauauaugauauaagcucaauauaguauauuaauuccguuaaacacaaagacauaucaguuuguagcuuugguggauaaacaaauuaauuuagcaauucauggcuaugaaaaauguauauuuuauuuaaaaauuuuaaagaaagcuaaaugaucaaauuauuuaaugaugaauuauaugauagacacuuuauauaagaaaaacuucaacagcaacaaauuaaaauuuuuucaucauuuucuagguggacuuaaaucauauuuacggugaaacucuggcuagacagcguaaacugcgccuuuucaaggauggaaaaaugaaauaucagguaugcuuccuuugacuauuaagacuuaguuauuaccgcuuauacccauauuuuaaaaucccuaaaaauguguuccuuaacuuuuuaacugauguuuauuuauuuauuuauuuuuuuagauaauugauggagagauguauccucccacagucaaagauacucaggcagagaugaucuacccuccucaagucccugagcaucuacgguuugcuguggggcaggaggucuuuggucuggugccuggucugaugauguaugccacaaucuggcugcgggaacacaacagaguaugcgaugugcuuaaacaggagcauccugaauggggugaugagcaguuguuccagacaagcaggcuaauacugauagguaaacaagaaaaugauuuauauaaaacccucuuccccagggaaaauuagugugcuaucuuuguuauguuuugaguaaaugacaagaugugguaaaugaaaacucacacauucuauauacauuaaauauguaagcaugacugauaaaauagcuaucuuuugauacugacaaggaagaaaacagaaaugaaggaauagcaaauuuuaaaaauugcauuccaguugcuugaaagcuugugaucagaugcaauaaauguuuuuauuauuuauuuugugcaaauaggagagacuauuaagauugugauugaagauuaugugcaacacuugaguggcuaucacuucaaacugaaauuugacccagaacuacuuuucaacaaacaauuccaguaccaaaaucguauugcugcugaauuuaacacccucuaucacuggcauccccuucugccugacaccuuucaaauucaugaccagaaauacaacuaucaacaguuuaucuacaacaacucuauauugcuggaacauggaauuacccaguuuguugaaucauucaccaggcaaauugcuggcaggguaagcauuauuauugaaaaccaaaacaaaagacuagucaguaacuuuagaauuucugccacggaaauuauuuuucuuaaacuuacuaaaagaguaguuaguuauauugcuaguaaaauuauuuuauugauauaagaagccuaacuuuguuugaaaagucuaaacuuuuagucuagucuacaguugucagacaaauagcaaauuguaccccuaccuuaaaaauauuuucaaaaaguaucuauaaucuuauaggaauaaauauuuuaggcuugaauacuaguguuauuuuugaaauguaaaaaggcaaauuaguucuaggcuggugucccauugaauuuuaagcagagcuccuguugaaauguagguaagcaucuuuccagcaaauaaaaauugucuccgcugggaguuucaguuuuaccugauuuguaccuaaggcaagcugaauacaaacaguaaauaugccuaaaauucuuguuuuacaacuaauuuuacuuuccacagguugcuggugguaggaauguuccacccgcaguacagaaaguaucacaggcuuccauugaccagagcaggcagaugaaauaccagucuuuuaaugaguaccgcaaacgcuuuaugcugaagcccuaugaaucauuugaagaacuuacagguaagaaacaguuucuaaacuucuucguuuuuuguuuguuuguuuguuuuuguuguuuuugguuuucuuuucgagauggagccgcccucugucacccaggcuggagugcaguggcgccaucucggcucacugcaaccuccgccuccuggguucaagcaauucuccugccucaacuuccugaguagcugggacuacaggcucacgucgcacgcauggauaauuuuuuguauuuucaguauagacgggguuucaccguguuagccaggcuggucucaaacuccugaccuagugauccgccggcuucggccucccgaagugcugggauuacaggcgugagccaccgcgccuggccccuaaacuucuuaaaagaaucaggggucaaauggaaacagagaaguuggcagcaaauugagcaaaagaaucaaacuguuuuuuauuuugugaaguuugacauugguuguaucucugucuucaucgccuucacaggagaaaaggaaaugucugcagaguuggaagcacucuauggugacaucgaugcuguggagcuguauccugcccuucugguagaaaagccucggccagaugccaucuuuggugaaaccaugguagaaguuggagcaccauucuccuugaaaggacuuauggguaauguuauauguucuccugccuacuggaagccaagcacuuuugguggagaaguggguuuucaaaucaucaacacugccucaauucagucucucaucugcaauaacgugaagggcugucccuuuacuucauucaguguuccagauccagagcucauuaaaacagucaccaucaaugcaaguucuucccgcuccggacuagaugauaucaaucccacaguacuacuaaaagaacguucgacugaacuguagaagucuaaugaucauauuuauuuauuuauaugaaccaugucuauuaauuuaauuauuuaauaauauuuauauuaaacuccuuauguuacuuaacaucuucuguaacagaagucaguacuccuguugcggagaaaggagucauacuugugaagacuuuuaugucacuacucuaaagauuuugcuguugcuguuaaguuuggaaaacaguuuuuauucuguuuuauaaaccagagagaaaugaguuuugacgucuuuuuacuugaauuucaacuuauauuauaagaacgaaaguaaagauguuugaauacuuaaacacugucacaagauggcaaaaugcugaaaguuuuuacacugucgauguuuccaaugcaucuuccaugaugcauuagaaguaacuaauguuugaaauuuuaaaguacuuuugguuauuuuucugucaucaaacaaaaacagguaucagugcauuauuaaaugaauauuuaaauuagacauuaccaguaauuucaugucuacuuuuuaaaaucagcaaugaaacaauaauuugaaauuucuaaauucauaggguagaaucaccuguaaaagcuuguuugauuucuuaaaguuauuaaacuuguacauauaccaaaaagaagcugucuuggauuuaaaucuguaaaaucaguagaaauuuuacuacaauugcuuguuaaaauauuuuauaagugauguuccuuuuucaccaagaguauaaaccuuuuuagugugacuguuaaaacuuccuuuuaaaucaaaaugccaaauuuauuaaggugguggagccacugcaguguuaucuuaaaauaagaauauuuuguugagauauuccagaauuuguuuauauggcugguaacauguaaaaucuauaucagcaaaagggucuaccuuuaaaauaagcaauaacaaagaagaaaaccaaauuauuguucaaauuuagguuuaaacuuuugaagcaaacuuuuuuuuauccuugugcacugcaggccugguacucagauuuugcuaugagguuaaugaaguaccaagcugugcuugaauaaugauauguuuucucagauuuucuguuguacaguuuaauuuagcaguccauaucacauugcaaaaguagcaaugaccucauaaaauaccucuucaaaaugcuuaaauucauuucacacauuaauuuuaucucagucuugaagccaauucaguaggugcauuggaaucaagccuggcuaccugcaugcuguuccuuuucuuuucuucuuuuagccauuuugcuaagagacacagucuucucaucacuucguuucuccuauuuuguuuuacuaguuuuaagaucagaguucacuuucuuuggacucugccuauauuuucuuaccugaacuuuugcaaguuuucagguaaaccucagcucaggacugcuauuuagcuccucuuaagaagauuaaaagagaaaaaaaaaggcccuuuuaaaaauaguauacacuuauuuuaagugaaaagcagagaauuuuauuuauagcuaauuuuagcuaucuguaaccaagauggaugcaaagaggcuagugccucagagagaacuguacgggguuugugacuggaaaaaguuacguucccauucuaauuaaugcccuuucuuauuuaaaaacaaaaccaaaugauaucuaaguaguucucagcaauaauaauaaugacgauaauacuucuuuuccacaucucauugucacugacauuuaaugguacuguauauuacuuaauuuauugaagauuauuauuuaugucuuauuaggacacuaugguuauaaacuguguuuaagccuacaaucauugauuuuuuuuuguuaugucacaaucaguauaucuucuuugggguuaccucucugaauauuauguaaacaauccaaagaaaugauuguauuaagauuugugaauaaauuuuuagaaaucugauuggcauauugagauauuuaagguugaauguuuguccuuaggauaggccuaugugcuagcccacaaagaauauugucucauuagccugaaugugccauaagacugaccuuuuaaaauguuuugagggaucuguggaugcuucguuaauuuguucagccacaauuuauugagaaaauauucugugucaagcacuguggguuuuaauauuuuuaaaucaaacgcugauuacagauaauaguauuuauauaaauaauugaaaaaaauuuucuuuugggaagagggagaaaaugaaauaaauaucauuaaagauaacucaggagaaucuucuuuacaauuuuacguuuagaauguuuaagguuaagaaagaaauagucaauaugcuuguauaaaacacuguucacuguuuuuuuuaa

SEQ ID NO: 21202 - RNA, 61893 nt, Homo sapiens
aaagcgacugcggucgccaccccgcccccuucugggcgccauagagagcguggcgguaucccggagccugccguccggcccuaccgggaccgaugcccucuaguggcucaguguccagaagccgccaacgaggacgauccauggcaucccggggcuuugacgguaaggucaccagcucuucagggagggccaaggggugacgaguacguauguggcgccaccgugcggacagcgguuacggggccgagauaggagagccaggggagcggggagaaaaacggaagcugagagggcggugcagcauugggcucccggaaaagaaugagaaaaacacuacauuucccagagcccuacaaggccugaaguggguggagcuggaagccggaaaauugggugcgcaagaggaucagggauagccucugagcucggguucccaggguucguagcuuccaacggcugcgcgcgcacuucggucgcgggcggugaggugcuguugcugaaacgcugccgcugaggguggacucgauuucccagggucccgccgcgggagucuccggcgggcgggcgcgcgcgagccaccgagcgaggugauagaggcggcggcccaggcgucuggguccugcuggucuucgccuuucuucuccgcuucuaccccgucggccgcugccacuggggucccuggccccaccgacauggcggcgguguugcagcaaguccuggagcgcacggagcugaacaagcugcccaagucuguccagaacaaacuugaaaaguuccuugcugaucagcaauccgagaucgauggccugaaggggcggcaugagaaauuuaagguggagagcgguaagugagaugcucuuuccguccuugguuuugggcucgacucccgcccuuugggucuggucuucccccaucaaguuggcacuggguaccgcucuguuaaccucacuuccugggcucuguggauauccugagccuucgcuuuccugcuccuuacaguuugauaagaagccuuugaaaaaaaaaucugaaucuaaguucaguagcauuuucuuuguaguuaggguaggcucauacagggacgcuuauuuuccuucguccggcagacgggaaacagacuugauagagucugcgaacccaucucucuaagccuagaguaccuuauauguuuuguugcacuucaacugauaguggcuccgcccuauuuucuaggcaccugcauucuaggccuuugccaaauugaccacucugugcacuuguucuuagugugugcgucgucccguggcuccagaacgaaucagauguuuacaaaaaugaauauuaggugcauaagagcgcuggaaacacagugaaugugcaguacauaaauuuaauauaucuugauuucucuuaaaaaguuggaguuugauagaaaacauuaaaauuuucuuguaauuaccuaaaguaggccuuuaaguaagaaaguuacugacaauaauggcuugaacauccuugaaaaaaauaugaagaauauagucauuaccauuaguaaaauacaaacuucccguuaauguguuuugguuuaccauuuguuuggggagguucauacuguucuugcuaaguugacuggaaauucugaacaaguuuuuacuucaaaaaaaguguaacugucaagcagaauugaccuugaaaauuaguucucugaucccagagcugaguauaguacauugcauucuauuuauuaauuugcaccauaaauauugaaugucuuacauguuccugauacuaugcugaacaugauauucaaucccuucccuuggaaaguuuacacauuuacuuuuacauauauuuaguaguuuuaugcuuucagguaauaucuugacuacuauaaaagaagucuuuuaaaacaaaggaguuuuuuuuugucuaaacaauuuuuucucguguaauaaauacuuuauuuauuaagcaguuuacugaugucuggagaaaauacuaagauaaaugagguuaccugccuugaagacauugauuuguaaagccccuuuuaggccuuauuuuuauuuuuuauuuuuugucauguaagucguuuggaaaugcuuuaaguccuuuucagugcucagucuauuuaucuuuacucagauucucuuauguggagcacaauucuaauacuguaucuuaaguuuuaaaaucaagguuauuagaaauaaauaacaguauucacaauguauguacauguguuugauuuuguuuuuuguuuuuugcuugucugcuguagaacaacaguauuuugaaauagaaaagagguugucccacagucaggagagacuugugaaugaaacccgagagugucaaagcuugcggcuugagcuagagaaacucaguaaguauuuaauucaucuuuguaaguauucucggaguaucgaaaucuucagagacuccuuuauauacuuuggaaacauuugcuuacuaaacaugaaaauauugauuaagcaucauugguuuuuauuauggugauauuuugauuuuucacuuagugguaaagauuuugugagaacacagaauuuaauggucaggaggucuggauucuuauucugauuuugcuauuaaaauugcuuuugccacauguaaaucuuaacaguaucugauuauuguuuauaaaaugguuagacccacaugucugucuaccuagacagcuuuguaaaucaaaugagauaagaguucuugaaaucuuuuuaaaaaggugaaagcauuaugcaacuaaagaaguagagaguggcuuguuuuuauguugaagaaucgaagccuauugauuucauuauauuuauguuuuaacuccauuuuuuaauaauuuuuauaaauaucuaugaaucucaggauauuuccccuuuaaggccuaauuccuauaaaagauugauagcuaaucucuuucuuacuuuucuuacaucauuaaguuuuagaaaguucacaagauguuaaagauccugacauuucuuaggaggaugauaugucuugugcuuugcuuuucccauccaaguucugaccaggccccacccugcuuagcuuccgagaucagacgagauggggugccuucaggguggucuggcuguagacugcuucugcuuuaagaaagcaaacaucagaacauuaggaaagaucucuauaaagguguaauuaauuuuuuuuuuccuuuuuuuuuggagacagagucucacuguguugcccaggcuggaaugcaguggugcaaucuuggcucucugcaaccucugccucuuggguucaagcgauucuugcgccucagccuccugaguagcuggaauuacaggcauguaccaccaggcccagcuaauuuuuguauuuuuaguagauacagugguucgccauguuggccaggcuggucuugaacuccuggccucgagcgauucucccgccucggcgucccaaagugcugggauugccacugugucuggcugguauaauuaauugauacuuaauauaguucaauuuuaauuugauugauggagaaggaacacaggaaguucauaaucaaaugauuaaaauugcagcuuuccuucuuaauggguccaugaccaucaacuauuuagguuauaacuuuuuucagcuacuuuugguacaccucauuuuaaaaacguaauguauaugcauacaugugugauggagcauauauagcuagaucugguucauuaucuauguaguuuugccuagccauaauaaaaagaucuguuuaguaguagugccgaggaauuugagaaaaaugacugaauacagcuuuuacgagaucugggagaagagaaaaagggaugaaccuacagauacaucagauaccuuccugugguauacaguuaaugugugcgcgcguguguguguauuuauauacucuggaucaguaagucuggaaagcaguaaauaauauuaaaacaaaauagaaaauuuagacacauuuaauggggauuuuuuugcuuuaaugguccucuuuaaauagaaguuaagauuagaauuaauuaaaauguauuugcuuauuaaauugccaacauauguauuuuagugaaauacaguuucaaaauguauauuuuuggaaaaauuuuaaaaauuauauuuuuucuaguuagccuauguuuagaagagaaacugcauguaagggaaaagagcccauuuugaguggcaauugagagauugauaagugcguuaucaagcauaauguuuuuucuuuaaaggcucuauuuagagugauaaaugauaggaauugcaaauauucauuauugugauuugcuguauauacauguuauauaguuuaaaugcuuuuucucucuugauccugucuuuuuaacuccauuuucuuacugcuaaguacaguucacuguuucuuaugauauauguugacuuagaagauggcacugaaaaauaaaggaauuacuaauugcaugugacuuuccccauaaauguuggcuaggauuauuauacauuugauuuggagacaggauagcauauuuaaaauuuuggucuagaacacaguaaauuuugaaugcauucaugaauuuggaaugugauguacaaugcagucuuucugggcuucuguuuuuucauuuauuaaaauauguaagguuggcaguugcauaaaaacacucauugcaaguuuuaagcaaauguguauguauucauaaaauuccuuuuauccagacaaucaacugaaggcacuaacugagaaaaacaaagaacuugaaauugcucaggaucgcaauauugccauucagguaagagauauuucuuagaauaagcucauuguagacauuuuacuugaagggacauucuauucugauuguuuaucaguuauuagucaaugggaagauguaacugauguccuauuaggggaagcuaccaacaaaaauauguaaauauaaauuccuuaauuggaucuauguuuuauugauagauuggacaucucuuuuauucaacagaaauuaucuauugaaugcugacuguaguccagguauuauaucaaaugugauacaguugggaauuugggugaauccacauugguagucauuuccuuaggguaguuuuauaagaaugacaguuugaauaugaucacagggauugcugacaaauuuguuaauuaaagugguugcaugcaauuauuuuuuaaccagauacaacuuuauacuuuugccauugcuuuuuuaaaauuugcauuuuauuugguguuaaaagauaauuucuucacauuucugaagggaaaaaaaaauuuacuuccagaaucugaauaggcgcaaaaaagccucguaguauaccuagaaaggcuuuguaagaaauguauuuauaugaagaaugacucaauacccaagaaaacucaaauacuucucugaaaacugugagaauauaccuuuauaaaugaagauauugcaaauuucuggauggaaauguuuuccaaauuaauguguugguaauacauuuugacucuuaaguccaagucagauagccagaaacuuguuaauguaguucuaaagaugauuggggaaaaaaacauaguaauagcuaggaugcuucuaaaaaaaggaaguaucaauuuaaauuaaguacuugcauagccacauauucaaguuuuauaaagcuaugguuauuaaaauauuacaaugcugauauaaaaaucaguacagagaauaaaaggcaguccagaaauaaaacccaauacggagguucuuaaucuuuuggaaagaagcagagcugucacaaaaucuuuauaaaucuuguaaaaacuauggaucuguaaccgaggaaaauagugugcacacagucacauaaaauuuuucagaaaaaaaaaacuaugaagugacuuaaaaaguaauagaauuuauuuaacugcuugguggcugaaagaaagaaacugaaagcuuuuucacuaagauccaaugcaaggcugggaugcccacucaccacuuguauucaguauaguacuggacguaccagcaagagcaaucagacaagaaaaggaaauaaaaugcacccaaauuggaaaggaagaaauaaaauuaucuuuacuuauagauuauaugauccuauauguagaaaaccugaaagauuccacaaaaaccugucagagcuaauaagugaauuuauacaauugaaggauacaaaaucaauauuaaaaaaucuaguagcauuucuauacacaaacaaugaccuagcugaaaaagaaauuaagaaaagauuucauuagaguaccaucaaaaaacaacuuaggaauaaauuuaaccugggaggugaaagauucauauacugaaaauaauauaacauugacgaaagaaauugaagaugcaaauaaugggaaagauauaccauacucauagauaagaagaauuauauugcuaaaauguccacacuauaaagugguaaaaagauucaggccaauccugucagaauuccaaaggcauucuucgcagaaauagaaaaaaaaaauucugaaauucugauggaaucaguuuuaaaaauccugaauaauaaccaaagcaguacugagcaagaaaaacaaaguuggaggcaucauacuucaugauuuagaaaacuguuauaaaacuauaguaauccaaauaguacaguacugacauaaaaacagaaaagugaccaauggaauagaauagagagccuagaaauaaauccaaacauauggucaacuaauuucaacaagggugccaagaagacccaauggaguugugaucgucuccucauuaaugguguugagaagacuggauuuccacauuugaagaaaugaauguuggauguuuguguugcuuacaucauauaccgaaaucaagccaagauggaugaaagaucuaaauguaagaccugaagccauaaaacucagagaagugaacauaggggaaagguucuugacauuggccuugguaaugauuguuuggaucacaucaguaguucaagcugcaaaaagaaauaaacggaacuacaucaaacuaaaaagcuucuacacaggaaacaagaauauuaaaaggcaaccuacaguucugacauagguagcuugagauagauauuucuaacucaaaaacauguagauugccauuguuuugcugggaagcaguuugacaaguuuuuuguuuuugagacagggucucacucugucacucaggcuagagugcagugaugcagucuuggcucacugcaaccucugccucccgggcucaaaugaucaucccaccucagcuuccugaguaggugggaccgcaggcaugugccaccaugucuggcuguuuuuuucuacuuguagagacuggguuucgcuguguugcccaagcuggucuugaacuccuagacucaaaugaucggcccagcuugauuucccaaagugcugugauuacaggcaugagccacugcaccuggcugacaaaauauauuaaaaguuuuaaguaauucaauuuuuaggaaucuuucuugaaaaauaauuugaacuaagguguaaauacagugauauucuaaguuauuaggacauuuccaugugauuaaaagagauaugagaaaaauuuucauaagccuaguaaaaauguuuuaaaaauccaaaauuuaaauagaaacauuggaauuacggguauuuuuuaacuuugauguguaaguuauaagagaaagccagucauuuacacuacagcugauguuaacuaaagugacaauucuauguucgcuuuccuguauugcucuacuugauuuucuuacuuauuacuucuuuauaugacagagccaauuuacaagaacaaaggaagaauuagaagcugagaaaagagacuuaauuagaaccaaugagagacuaucucaagaacuugaauacuuaacagguaugaagaagugcuuguagcuuuuagcuccauuccuuuauuuuucuucuguuagugcuaggaguuagugcucagcccauuucuguugcugauauuuuuuuguuaugguugaguauagaguugucauauccuauuauuucuccuacucauuuaucuuuaaaucauugucaaguguuuaaagaagugucuagaaagugcacaagugaagaacaucucaaagaaguaguaauuuggaccagauuuuacaugcaaagauuuucacuacaaugcuguacauaaugucaaauuggaagcacuuuaaauauuugcaaaggcugaacuacuguucuuuauuucauauggacauccuugcuauauaauaagcauucaauauaagaacauauacucagccuauauuuauaaacagacugaaggaggcagagacauaaaauacauaaacauagacuguaguauauaauacagcugauguagucaggugaacuugacucugaagcaguuaaugguaagaaguuuccuuuggugcccaggcacgguggcugacgccuguaaucccagcacuuugggaggcugagguggguggaucaugaggucaggaguccaagagcagccuggccaagauggugaaaccccgucucuacuaaaaauaacagaaauuagccagucaugguggcacgcaccuguaaucccagcuacuuuguaggcugaggcagagaauugcuuaaacccaggagccggagguuguagugagccaagauugcgucacugcacuccagccugggcgacagagcuagacuccguaucaaaaaaaaaaaaaaaaaaaaaaaagguguuuuggguucuuuuuuuuuuaaugguuuuugaaauuuuuuuauuucuauaaaagaaaggauuuucagauauuuauaucauuauacaauaauauuccauuaguuaaguauacuuucccagucucacaagaguuccuucaaaauacuugaguguguugaucaacaagugguaguuacaacuaaacgaauucauaaaaucuagauauuuaauagauaguuuuuuaaaaauguguauuccauauugaguagguuuuuauauuagugcuuuuuagcuuaaugauuauuuauaaaauuuuaauaggucuuuggauauauaucaggaaaauuaagguuaacguugaauauuuagcuuaacacacuguauuuaaaauaaauuuggauaauucacaaguuuggauacacaaauuucaauuuuuugucauauauuuguagaaauugaauuuguaauuaacuauggcagaaacaaguuaaaauaagagaguugagaacuacaguugacccuuaaacaacacagugguuaggguugcugauuccccccacaguugaaaauuuauguguaacuuuugacuccccaaaaacuuaacuacugcuguuaacuagaagcccuaccaauaacauacacaguagauugucauacguuuugucugugaucuguauuauauacugugcuccuucaauaaaguaagcuagagaaaaaaauguuaagaaaaucauaaggaagagaaaauacguuuacuguacauuaaauggaaguggaucaucacaaccaucuucauccuccuugucuuuacauuaccuaggcugaagaaaagggguuggucuugcugggucagguugcagagguagaaggggaggcagaagagggaggcacacucaauguaacuuuacgaaauacagccuaauuucugucugacuugcuuuuucauuucucuaaaaauguuucuauacauuaccaaucuuccuuccaccguuugcuauaguuucagugcccauguaagagaaggauccaugucauaaaagaaaucaaaagcagucuuggguaaucagaacccuuccaccagauagucuguuaccaauauguuuucugacacugcuaguucuacauucuuuuuccacaucgucuggcacugguuuggaagcacucaucuccauccagucaucuucuguuaauuuaucugauaugguggcuauuagcucuuggauuucuccaagguccguaucuugaaacccuucaucccacuuuuuuugccauauccacaaucucuuucaugauuucuuugauuggcucuguuacaaauuuugugacaucaugcacaacaucuggagaguuuccuccaacaggaauuuauuauuucagccuugauggcuuucauaacuuuuucuguaaugaaaaagaagggauggccucuucaguguguuauccuuuaaaacuuucaugauauuuucucuguugggguucucuuccacaguguugacauuuucuuuucacaaaguaucaucucuauugagccguaaagguccuuaugacuccugaucuaaaggcugaauuagaaacauguuugggagcaaguagacugcuuugacaccuuccauguugaacuccuggguucuggguggccagggacagugucuaaagucaaaagaacuuuaaaggcagccccuuggccagguacgguggcucaugccuauaaucccagcacuuugggaggccgaggcagguagaucaccugaggucaggaguucgagacuagccuggucaacauggcagaaccccaucucuacuaaaaauacaaaaauuagcugggcguggugguaggcgccuguaaucccagcuacucaggaggcugagucaugagaaucacaugaaccagggaggcagagguugcagugagccaagauaaugccacuacacuccagcuagggggauagagcgagacugucuccaaaaaaaaaaaagggcagccccuuuacuagcaagguacuuucugacuuuagggacaaagcaugaguggaaccaauucagagaagggggucugucauuguccaggucuucuucuuguguaaccagaagacaggcagcugguguuuaucuuuuuccuuugggcccugggguuaaaagcuuuauaaauaagggcaguccuuaucauaaaccugacugcauuugcucaguacgguagaguuagccuaucccuuccugcccuaauccuggugcucccuucucuuucuuacuaauaaauaucuuuuguggcauuguuuuuuccagaauaguacacuucuaucugcauuaaaaaccuggugcaggcauauaaccuuucucaaugauuuucuuagcagcaucugcuguuucuugguugacagaaccugcuucuucaguuuuguugacauuuuuauaagucaaaccuuucuaaaauuaucaaaccauccuuuacuggcauuaaauucuccagcuuuagaucugucaccuuccuuuugcuuuuaguugucauauaauaacuuugcuuuaccucguaucauauuagagucuauagguaugugauagcaauccugcaccccauaaaagcugcauuuucaaugcgagauaggaagguauuuugcagaaaugcacuuuuuuaugcuugcuggcguagcugcagugauggcuuuacgaauuuucuuuuuauuucuuuuuuuuuuuuuaaacaacgguccauauacuggauucauuugucuugaaaugguggguaaccaucgcugcaguccucaaucugugguacauaucaagcaauucaacucuuuaaaauauugucgugauauuucccugcuucuuagaagaaguacuuccaacaucacuaguggcaguucuuauggaucccauguuguuauucaagguuuaugguauuguacuaaacacaaugacaaauaugcaaaaacuucaaaagauuucaaguuuuaugguauugcacuaaacacaaugacaaauaugcaaaaacuucaaaagauuacuauuuucugcauuaugcaauuuacugaagagagaaacugcucacaauagagucacacagcauucuauacagacacucaaaacacuugagcuuacugcaguaguaucaggagguggcuaugaaaguauuccaguaauacaguauguauuacaguuaauuuuaugcaguuaugguuuaauaaagcauauuuauauuugcuuauauuucucuugauugcagauaggguuguguaguguuugugugcauaaguuuugauaaauuuuuuaaguuuguaucauggauuugugcauauuuuaaugguaguaaaugauaaaauacacuaauaucuacauauuaguacauauuaugcacuuacaguagcuuuuucuuaguuuguucccauuucugggcugccuggauuggucuguggucucugaguuuuucaaauuguaaguuuuugggaaaaaauuccaauauauuuauugaagaaaauaugaguggaagugaaucugcaugguuccaaucuguguuauucaagggccagcugugcauacuuuguauuaaagguuuauauuccuagaaauauauuuuugauauuugguuccccugaguguuaauuaguuauuauuuuuuaauucucuucaccauucuagaggauguuaaacgucugaaugaaaaacuuaaagaaagcaauacaacaaagggugaacuucaguuaaaauuggaugaacuucaagcuucugauguuucuguuaaggcaaguaccagaugauuccuaaugcauaaacuauagcuuuuuauuaaaacucaccuaaauuaaauuucaaauauaggcaauaaaguaauuaaaagcugcauuuuguuuuguuuuuaaugucagaaaauuaagcauuaggacaauucuaguucaucuguuuugcuuguuugaaauuuaaguuuguuacaguucuuaauguuuucuaguuaagaaucuaugcaaauacuuaauuucuguuuugaaauaaaauucugcuugugucccuuagcuacagacaaaaucuuuugaauaaucauauaucaucuuuaacuguacguguuauuuucuuggauuucuuuaguaucgagaaaaacgcuuggagcaagaaaaggaauugcuacauagucagaauacauggcugaauacagaguugaaaaccaaaacugaugaacuucuggcucuuggaagagaaaaagggaaugagauucuagagcuuaaauguaaucuugaaaauaaaaaagaagagguaaguuaguaaaauuguguuuuucuucauguugaguauaacuuacauuuguaugucaguuuauuaaauauguauucaguaguguguaccugauuaguuguaagaugagugguuaaaugugaauaaugcauuacauuuggcguaaaaaaucaaccaauugcguuuacauaaagaauuuaagauucuuugucaaaucugguuaguaucuacugucuuacgauauaucuuuccuaaaauauguguuuguuuaagaaguggugguaaguuuuugugagcuaaaucuaaacauuguucugugagcaguuacucuuaguuuucuuaaauaugcauauuuuaauugcuuuuucagguggggagggggaguuacuuagcuuuuccuuagcagcauaaaccucaugucagaguaauuucaguuaauaugacauccuuucccccugcucuauuuuuuguuuuuagguuucuagacuggaagaacaaaugaauggcuuaaaaacaucaaaugaacaucuucaaaagcauguggaggaucuguugaccaaauuaaaagagguauauaugaccauuaaaaugucuuuuuuacaaaauacuaaagcacuuacgaagcuguuauuucacaaaaugaugucauuuuuuaaucuguccuuggccccauaaaacagugagaguccuccuuccauaugcuguagcuaggcuaaaauagaaucagaaauagcaauuauauguuauauugaaaauacuaucuaaaaaaugaguauggguuaauuuuauuguuuaauuauuuuacuuugaauuuaaaauauuaguaauauuuuauccuuaauuuaucuuugucaugaagacugauuugaauuugaguguuuuagauuuagcucuuacuuuacaaaaauggaauuuuucaucuugucauuugauaagcauucuaaauuuaguucaaaguagacugcuauaauugggcuauuuuuuucaggccaaggaacaacaggccaguauggaagagaaauuccacaaugaauuaaaugcccacauaaaacuuucuaauuuguacaagguaaauaucccaccacacauguuaguaucuaaauguugcauuguugacuguuagguaacuuuuuaagauuaacuuuuagagugccgcugaugacucagaagcaaagagcaaugaacuaacccgggcaguagaggaacuacacaaacuuuugaaagaagcuggugaagguaaguguuuucaguuaugggaacauuauuuuuguuauuguacucuuuuuuuuuuuuuacccuuguuuuguauagaugauuggauuuagguguuagacuuuauuugggacagaauuagguacagaagaaagaacuuuggauuaggaaauucagaauuauaucuuaagcaaauguaaguuuauauauuuuugaaaauacagacagcaggggguuuuguuuguuuuuuaucuaauaaucuuguauaauuugcugauuucuaaugagaaaguuuucuuuuuugaaacauuuacucugauaauguuugaauacucuuacuuuauaaauaagacauccucuuuauuugcauuuuguaaagucuuuuauuuccucaaauuuuugcuuuuuucaauguauuauauuuauggucuuuuccaauaauuuccuuuacuuaggauuaaagaucaaaaucgaaaucaaagauauaccuagaaccacuuuuuacccuuuggguuuccuuauuuucuuuguggguaagagacaucaaaaggagaaacaccaggcgaagacaauuccaaaauuauaaguagagcaagaacuuucaauagauacugucagcugaagccucucuagaaauuuaauauuaucugcugaggggagaagugacugaucuguugcauuuuguaaacuaaaauuuuaacuguauguuugaauauuuggucuuuaaaauuguuuuuuagccaacaaagcaauacaagaucaucuucuagagguggagcaauccaaagaucaaauggaaaaagaaaugcuugagaaaauagggagauuggagaaggaauuagagaaugcaaaugaccuucuuucugccacaaaacguaaagguauggcuaauagaugcuuguuagugaguugaaauacuacagcuuuccuacauaaaagucauuuaauuucacuaauaguauuuaucugucaugcugugauguaggaaacuccaucgaguuauauuaauagaauuuguuuuaaaauuaauacucuuaccuguaucuuuacagaaucgggcauauaaauaccauuugaucacacacagucuuguaaauucccagguuauugcaugauuuuuuagaauuagauguguuacaugacuuuuugaugucauguauuuaaaauuuuuauaggaauuacuauauaauguacaguacaugucacuuaccuugaaaaauuauuaauggcuuuuaguuuggaauuuuacaaauuauacuagauguguauuuguuggcacaggagccauauugucugaagaagagcuugccgccaugucuccuacugcagcagcuguagcuaagauagugaaaccugggaugaaacuaacugagguaagaaugguauuaaauguuguuaaauucuuuuucuucagcaaauguauacaaaucucuucaaaauuuaauucucccaaaacuuauuuuuaaaaucaucuuauaauuaguggaucauucuaggaaaggcuuucuuugguuccuagugcuguguaacuaacauaguaaacauugccauuuuguguuaguguuaaagaauguuuauuaugaaacuagaucaacuaaauauuugcguuguuaugguuagauuugaaacaacccuuugucuacuuucagcucuauaaugcuuauguggaaacucaggaucaguugcuuuuggagaaacuagagaacaaaagaauuaauaaguaccuagaugaaauagugaaagaaguggaagccaaagcaccaauuuugaaacgccagcgugaggaauaugaacgugcacagaaagcuguagcaaguuuaucuguuaagcuugaacaagcuaugaagguugguuccauuccuaaaauuuagccgugguaacaauacaaaugagaaaugauuuacuagguauuuuuuuuucuuaaggugauugagucagaaaaaucuaaauacgauuuucaauaaacacauuuugaaacuuauuaaacacugcugaucucaaaacgucauaccuuuauuuagcaauuuuuauguauuucaauuuuuauauaaaauugugaaagcauuuuaaccuuuuuuuaaugcauuuacuauguuuuccuuaggauucucaacuagagaauaauagccaaaucuccuaaaacugcucuucaaauuaaaauaaucucuguguaauaaaacucuccuauuugccauaaucauucuuuaucagacaguuguaauagccugccuagaaauaauaauauuguuugaccauagguagaacuccuuuuuuauaccauuucacaauuuggcgugucucuauaugcauuauuuuguuauugcucauuugcuuauuagaaguguuaaugaaauucauaaagauuuuuuccuuuuaagagauacugauggaaaaagagguuauacucugaauguuuugccuuaugguacaacuauuaacauuacugagggaaauugucaagauuucuugaacaaguuuuauggaggaaauucaguuaaaugaauuuauaucuacucuucuaaacugauaaauuguuucccuuuuguuggaaaagaauauaaauauaucccuauuucaaaauuaaaucucuguugcuguuauaauuuagaagucaguuuaaauccaaguacuuuauuauaucagcugguuuuuuucuucuucaucaagugaagucuagcagucccgccugccugagaauauugacuuuuuuaccagcaguguaguuugcaagagagcccuuggauccaauuagaucuuccuugaauuuuucucucuguugaaagugaggguuuuaccugaagcuuguuauugucugaaugagaaauaacauauucaaauuuauacaaaacuucuuuuuuaguggcuacaauauuauguaggauuuuauuuaguguauaaguugauuacuggugguguuugaguauuguaugucuuuauuacuuguauaaauccuagaaggaaguacaaaauuuucacuugaauuuacauuuuaaaggagauucagcgauugcaggaggacacugauaaagccaacaagcaaucaucuguacuugagagagauaaucgaagaauggaaauacaaguaaaagaucuuucacaacagguuagaauuuuuuuguuuguuuuccuacuuuuaaaaaccugacugcccaguaaucuuugaaucuguuugaagguaccuaagauagaacuaccauguaugaaauucuaauuaauuaggaauaguacucgagcagaguugcacccccauuguuucuuuucauagccccucccuuuuuucaaauguuugauaaauuuuuaaauuauacguguugguuguaauaaaugaagaaauaauucaaagauaaauaaaagcuuucuccaauuucuaccccucuacccucugaagucccaaaguguagcuaaguuaacagacaguuguguauuuuuuucacauccuucucuguauguguauauacaugagcauauauaaacauauguaagaauuauuugauuuuacugaaguaagacuggacuguaugcauuacucugacacuuaacaagcaaaucaauaaauuaaugucucauucauauauuuuacccuaauuuguguguguguacauccacgcaaugcacaaauguaaaaauuucacaugaauggcauuauauauaugcuuuuuguuuaaaugucuauuuuucaugcucugcccuaucauauauacaaaagcacacacaaaaaaauagauauuuguggguuuuauuugaucacuguuuuacaaaacuggagccauguuuugggaauuguaauuuggcuacuuuguaauaaguaauagccuucaauacauacuuaaaaguaauuuuauucuauuaaaauuugauuguuuagauuuuaauauccaaggaugcuuuauuuuuaaagauaauuugaggcaguacaaguugaagguuuuauaaguaauguuuuaauuugaaaacuuucauucuaaacuuguccagaauuguaacuaauacuauuuuauaacauauuaaaacuuuguuuuuagauuagagugcuuuugauggaacuugaagaagcaagggguaaccacguaauucgugaugaggaaguaagcucugcugauauaaguaguucaucugagguaauaucacagcaucuaguaucuuacagaaauauugaagagcuucaacaacaaaaucaacgucucuuaguggcccuuagagagcuuggggaaaccagagaaagagaagaacaagaaacaacuucauccaaguaaguagucacauaccucagcuuguugagcaaacauuuaugaaaaccucagcuaggcucagugucucaugccuguaaucccaacguuuugggaggccuaaaugggguaucauuugagcccaggaggucgagaccagccuggacgacauagugagaccaugucucaaaaaaaaguaaaaaauuagcugggugugguggcacaugucuauagucccagcuacucaggagacaggcugaggugggaggaucacuugaguccaggaguuugaggcugcagugaagcaugaucaugcaccacacucuaagugggacgacaggguaagacccuguugcccgcaaaaaaaaucuauguguuccuaacagugcuagauacuugggauauagugauauagggaggaaagaauugagcaacaauaccaaacaaaaaauuucuacuccaagaccucagguuauggguaagacagauguaauaaauagauaauaaaauaggcaaguagacaauuugcauucacugugauuagugccuaucugugggaucauagcgguagaggacuuguccuagauuucagggagcagaccggcuucauggagaaccuggagaaccuauguaagaauuagucagagguuuuuucaaaauacauguauaaugucuucuagaagaggaagaauggcuaagaaagcaagaagacuagaguuuggagugaguggaacugauuuaauuuuuacaaacaaauuuuucagauugcauugguaaguauaaguaccugaguccugugugguggggauuuaaaaaguaguucauaaaauacucagcaugaaaaaaaauaaugagagagacaaaaaugguaugaugaaugguaggcaaagaugcuugguuaauuacaguagaaauuacaaucaguuaacucucaguucaguccugugaauuaggccgacuuuuucuacagaaucacugagcuucagcucaaacuugagagugcccuuacugaacuagaacaacuccgcaaaucacgacagcaucaaaugcagcuuguugauuccauaguucgucagcgugauauguaccguauuuuauugucacaaacaacaggaguugccauuccauuacaugguagguuuuuauaaaguuauuuuaaggaauaauuuagaaauguauauuaagggauuaauuuugcaacauaagcaauagccacucuaaugaugguagcuucaaauuugacuaccauauauaauugcuuauaacaucccaucaacuguaaaacauaccauuauuuuauguauugcuaaaaagaaaugcuuucuauuguugaaaaaggugcauuucagaaucaaugaauuacaguauuuauuuugguuauguuuuaaugaccaaaacagauauguuuuaauaaaacauaaauauggauuauguuuuaacccauaaauacugaauuaucucuaauaaccaucaaaaaaucuuaauacauuguuuaguagauuccuuauuuaaaaacuccuauaaucuuauuguuucauuucaauaaguuuagcuuguuuauuugauaauaguguauuugcaaagaagcauuagauuaaagcugauuuaugaaagccaacaaagcauuuuauuagucuuuacuuuccugaagcuucaagcuuagaugauguuucucuugcaucaacuccaaaacguccaaguacaucacagacuguuuccacuccugcuccaguaccuguuauugaaucaacagaggcuauagaggcuaaggcugcccuuaaacagguaaagaucacaccuuuguccuggguuagguuuuuagagaacacaguguuaccuucucauaaucuccaauauuuaguugcaggaaauuuuugagaacuacaaaaaagaaaaagcagaaaaugaaaaaauacaaaaugagcagcuugagaaacuucaagaacaaguuacagauuugcgaucacaaaauaccaaaauuucuacccagcuagauuuugcuucuaaacgguaaguuuucuuuuguuucaaauuaauuaagucuaaauguuauacuuuacaauucaaaucauuuaaauucaagagcuaauuugcaauaguguugcuuuuuuugugaacuguguuccagaaugagaaccucugguaguucauuuuuuucauauugauuaaugauucucuaggcagugcuaaggguuuagcuuguuugauaaguugaagccaggcgcagcagcucacgccuguaaucccagcacuuugggaagccgaggcaggugggucauuugagggcaggaauucaagaccagccuggccaccauggugaaaccccaucucuacuaaaaauacaaaaauuagcugagcggcaguguugcaugcuuguaaucccagcuacucaggaggcuaaggcaggagaaucacuugagcccaggaggcagugguugcggugagccaagauuggggccacugcacuccagucugggcaagagagugagauucugucucaaaaaaauaaaauaaaauaaaaauaaguugaaguucaugugaggaauguugguaguuuaccuuccuaagauuaaaggacuuguuucgguaggacuuaauucuuuuaaaaaugcaccagaugaugagagaaaugagagcaaauuuuauuccaccuuuucuauucuagguagaagagaagcaagugcuauguaguuuuaggagaauuaauuuucuuggucacauccaaagaaauaauaaauauuucaugauuauuuguuauuaaauucauugaaugcuuguuaguuuaguuuguuaggacaauauuuauuuuuauauaguacaugauaaaacuguuucuguuuuauagcaggcaggauauauugcaggcaguuaccccuauacaucuaauaguucagcaaccccaauuaaagcacuucuuuuuucucuguugauaccucuagccagccauuaugucagcuuucaagcacauaagaaaauaaaacugaggauuauagaagaaaaaaggauuagcaaaaauccaucacuaacccuguauaauaacuuaauuuguauacugcauuguagugggugucugguguuaucaauauugcauugucauuacuuuaaauauaauugauuuuuuaaaaauaagauuaaaaaguuacuuagcaugaaauacuuugcuuacuuagaacuugaaccacuacauuuggaauugggaaaaaagaaugaagguuuuaccuuauuacacaagccacuucuucauaaaucauaaaauuaaccccuuucccauuuagaaaaaaaaaagugcagcuugcugccagcgcucauuuaauuuuacauaagcaugcuguuugagguugaggcaaaucugacagauuuucagugugaaaauaaaauauaaaaacuguuccuggaguuauuucuaagcagaauucaacuuaacagaaauauguaugauguuacauuaggauuagagacaauauucucagggcauuuggggaaauggguuaagcuauugugaaauuucuucaagggauuaagcuaggauaucauuucaguuacuuguagaauuacuuuuuucauaccaguuaugaaaugcugcaagauaauguugaaggauaucgucgagaaauaacaucacuucaugagagaaaucagaaacucacugccacaacucaaaagcaagaacagauuaucaauacgaugacucaagauuugagaggagcaaaugagaagcuagcugucgcagaagugaguccaauaucccuuguccaacuugcauuauaaguugcauuugacauuucuuuaguuuuuacuuugaauuuuacucacugauaggacuuagguauuuaagaaguuuggagguuacaccaaguaauuaauacauaguuugcaaauagccagugugcguuaguggggugauuguuucuauuaagauagaagagggaaaggaauuuguuuuucugcugggcuaagauauacucgcaagucuugcauuucaaaauaaauuuguaggucaguguuugguucuaacaaagacguuuuuuuuuuugguuuuuuuuuucuugagacagagucucacucugucgcccaggcuggagugcaguggcacgaucuuggcucacugcaagcuccgccucccggguuuacgccauucuccugccucaaccuccugaguagcugggacuacaggugcccgccaccacaccuggcuaauguuuuguauuuuuaguagagaugggguuucacuguguuagccaggauggucucgaucuacugaccucgugauuugcccgccuuagccucccaaagugcugggauuacaggcaugagccacagugccuggccagacgaauauguuauucauucuugcucaucuguaauaaaaagcaauauaaaaauuacauugcauugaauuuauauuucugaauuuuaacuugaauauaaauguccauuugaaauuauuacuuuuaacuaaauacuuaguuuugugaugauaaauuuuuuauauaguuuucuuuguuauucaguuaucucuucugucuuugaucauuacuuguaagcuagguauaguugucccccauuuuaccuguguaaaacagacucaagagcuaauguauaauuugccuauuuugggacagucaugagagauggguugguuaggacuugaacccaugucuuauaaugcucuuauaaggcuguauucuuuauuuuuaucuugcuccaacuccauugugaggagugggcagcagcacuuuuucaaacugguagagugaauuuuaucauugaucauuuauaugaaucuguguguaaauaugaguacuuguguguaaauaugaguacuuugagcuuucaaaacacucucccugguccccuugagacucagacucuugggguugaggggagggagaaacuuuaaauagaucaaucaucacuuuuaaacagguacuuugaaaccggcuuggauucuaaaaguuacauaauuuaauaguagucagguaugaaugauuacagcagucaugcaauucugcuuucuucuucucacauauuaaauuuuucuugcuguuauuuuuuaaacuguggauuguuagagcaaggaaccauaaguauuuguaauugaaagauuuuuucauugaugauccccaauaauuuuugcuucguauuuuagcacaugaaacuguuuuguauuuccuuauacaaugaggagauauagucccuaagagcauuaaaaaaaaguagugauguaugaaucauuuuaauuuuauaaucuuaauacacuugacaccauguuuuucagcauuuuuuauuucauuucuacuuauguuuagguaagagcagaaaauuugaagaaggaaaaggaaaugcuuaaauugucugaaguucgucuuucucagcaaagagagucuuuguuagcugaacaaagggggcaaaacuuacugcuaacuaaucugcaaacaauucagguaaccaaauaaaaagccuauguagaaaaaauguauaaaaguuaaauuuagauuuuuuuuauccucucaauuuccuuaauuagaaaauuuauccaucacuuuugucauccauuaugaucauugaauuuugcaguuuauuaagacauuuaaauauuuuaaauaaaauauugaaagagaauugauugaaaccauacauugguaaguccucagguauauuuacaguguccugugcaguuuuacuauuuauaagauuaauucuuugguuuuuauuuucuuuaaaacuuugggaaaucugaaugacgauuauaauacauuccaucucuuuccuguauaauagauguuuuaauauaaaaaauaccagaauacuuucuugauaaauacuguagauuuuagcugcuucauguagaaauggguuguaauauuguaauucuuucuugccuucaauuuuuauuuuuuuguauugccuuuuucuuaagcauaaccaaaaaucuuuucuuugcuuuagggaauacuggagcgaucugaaacagaaaccaaacaaaggcuuaguagccagauagaaaaacuggaacaugagaucucucaucuaaagaagaaguuggaaaaugagguggaacaaaggcauacacuuacuagaaaucuagaugugaguccaucagaguucugaauuucuguaggguguuuauguucaguaauuaaucugguguguggacagucugccauccaagaugaagcaugauuuugaaaaacuuuguuacuaaguuuuucuugccucacucuauacccaguaauuuuuuuauugggugccauauauugugaguuuuaccauguugggugcugaguauuuuuguauuccuuuaaaucuucuugagcuuuauucugagaugcaguaaaguuaauuuaaaaugauuugauucuuuugacuuuugccuuuuaugauguauuaggugggcccagagcagugugcauucuggaacugaggccaauacuuucaugaguauuagugccaguguccauugcaauugugggguuuuuuuagucuggcugcagaacaggcauuauucuugacuuucuuugaguaacagguauucuucacucuuaauuccuuuggacaauucuuccccugucugggguaagcuccuuauauauuugcagcgaucgcuacucugaugaauauuuaaggaggacccucuguagagcuccaggguacucugugugugcaacucuccugucuuauauucugucuuacaaauuugagcuacuuuggucucccuggacucucagaucuguguucucaauucagagagucuccugggcucugccucauuuccucuuuccugugucauagccuggaaacuuuuaaaucaguaaacuaaggcaaucuaagguucaccucuuugguuuucugucucaggaucucgguuguuucauguguuuugucugguuuuuuuuggcuguuucaggugugacgguaaaucuguuuucuguuacucucuuggccgagcuccaaaggucuauaaaaagauaguuugaaccuuuaguuacuuaggaaccuaaagaauguuauaagauuaauguauuuuauagguucaacuuuuagauacaaagagacaacuggauacagagacaaaucuucaucuuaacacaaaagaacuauuaaaaaaugcucaaaaagaaauugccacauugaaacagcaccucaguaauauggaaguccaaguugcuucucagucuucacagagaacugguaaagguaaauaaaauaaguagaccaauauaauuguaaauaaacaaguacuucuugggauuauaauauauccugucaguaaauagccuaauucuuugugaaugcuaguaaaaugaaacaaacacaaaaaaaaacccaacuuuuucuuuauauagugguacucaauuuugggccuaaacuaguaaauuugcugucuuaaaagauucagaauaguucagcuuggcauuugaucaagguauguacccagcuuucuaauucuugaaacuauuuauugauacuuuaaaaauuauucuuucugaagaggguuauuugauuuuuuaacccgggccccuuggaaauaagguugcuuaccaaaucugcaagaauaaguuucucuuaaagaaugaguugauuugugaucuccuuuaaagcaguauucccaauauuugcucguugguagccucagguaaaagauuuguuucauagauuuugcuucccuuuuuaaauacaucuuucaaguucgaagccuuugugucuugauaaucuuucuauaugguuuuauuuauuuauuuauuuuuuuuuuuuuuuuugagagagagucucgcacuguugcccagguuggagugcaguggcgcgaucucggcucacugcaagcuccgccuuccagguucacaccauucuccugccucagccucccgaguagcugggacuacaggcggccgccacaacgcacagcucauuuuuuguauuuuuuuuuuuuaguagagaugggguuucuccauguuagccaggauggucucgaucuccugaccuugugcucugcccgccgcggccucccaaagugcugggauuacaggcguaagccacagcgcccagccaguuuuauuucuuaacacaagggaaauaaauaacuaauaauuguaugcagacuuucugauuuacacaguuuuucaaccuguggugcaaaagcaguacacauucaguagaaacuacuucaguauaguauuuguucaguaaauuacaugcaauacucaacacuucauuauaaaauaggcuuuguguuagaugauuuuucccaacuguaggcuaauguaaguguucugagcacauuuaagguagucuaggcuaagcuauaagcuaagcuaugguguucagugaguuagguauauuaaaugcauuuucaacucaugauaguuucaaauuaugaugaguuuaucgggaugugaccccacugggaguagagaagcaucucucuguaucuguccauauauacagacccauaaauaucugauccauauaaauaauggguguauaauuaucuaguagauaauuauauacuuuccuauugauaucaugugauaaaacauucuuuccaauuuacaguuuucugccuauuuuauguacuuacaauaaaaauugggcuaaauuuuagauuuaagauuuaguguuuuagaguaaauaauguuuaauuauugggagaacacacccccaaucuuucaguguagguucuuucuauuuucuaugagugucggcuggcugagaaauagacaguacaaagagaggaauuuuacagcugggcugccaggggugacaucacauaucuaggaccgugaugcuggccugagucucagaccagcaaguuuuuauuaaggguuuuaaaaggggagguaguguaagaacagagaguaggugcaaagaucacaugcuucaaagagcaaaagcagaaccacugauaaggaucuaacaaagaucacagggcaaagggcaaaagcagaaccacugauaagggucuguguucagcccugcauguauugucuugauaaacaucuuaaacaacagaaaacaggguuccagagcagagaaccggucugaccacaaauuuaccagggcugaguuuucccaacccuaguaagccugaggguucugcaggagaccagggcuuaucucaguccuuaucucaacugcacaagacagacauucccagagcggcuguucauagaccuccccccagggacgcauucuuuucccaggguauuaauauuccuugcuaggaaaagaauuuagcgauaucucuccuacuugcacguccguuuauaggcccucugcaacaagaaaaauauggcuguuuuugcccaaccccacaaacagucagaccuuaugguugucuucccuuguuccauaaaaauugcuauuauucuguucuuuuucaaggugcacugauuucauauuguucaaauacacauguuuuacaaccaauuuguacaguuagcaguuaucacaguggucuugaggugacauacauccucaacuuaggaagauaauaggauuaacagauuaaagacaggcauaagaaauuauaaaaguauuauuugagaacugauaaauguccauauuaagaugaaaucgucacaauuuauguuccucugccacggcuccagcugcucccuccauucggggucccugacuucccguaacauuuaauaaauuaagaauucugucauuucuucauauagcuaacucaguuuaguggaaauauuugauuguucucuuuugaauauccuuuucuuaauuuuuguaacagauuuaaaauauuaauauuugaauuuuuuuguuuuugaggaaguaacauaacaaaguaccugcuuuuauuuugguauucggcauggauugaaauauacuuucuaaauauaucuguauuugaaccuuaaugcuaauuucauaagcucuuuauaacagucaucucuaauacuauugaaaauguuaauuuuaacagagcuguuaugucuuuuaggucagccuagcaacaaagaagauguggaugaucuugugagucagcuaagacagacagaagagcaggugaaugacuuaaaggagagacucaaaacaaguacgagcaauguggaacaauaucaagcaaugguuacuaguuuagaagaaucccugaacaaggaaaaacagguauguauaauucugaauucagaauucaaucucaacacauuuguuaacuuuguuuuuaguaacuagaggacugcuuuuuuaaggcacucguaugaauuagaccagggucauugccuuuaaccuugugaaaguacuugagucucauaagccagauaaaacaaaaacacacaaaauucaugaagcaaggagguuauccuugcuguaggaaugguccagauaaaauguugaggagacugagagguagggauuguuauuugucuacuggguaugcaugccuucacaagagagauggcauuugugcaggcaaagccuugaaugaagguaucuguauaggaaauagaguagaaagguauuuuacgugaugggaacccucagccaugguagaaagucuucagaagaugacaauuuguaaagugaguagugaggggauacaguuauaaauguaguugauaaucaaaugugaaagguuuugaauaucauguuaaauuauauucuguagguuuauuaagagccauugauuuuuuuaacaugucauaaucagauuuuuuuucuuuuuucugguuagaaaauuaaugugguagauuggaagauaccguguucauuuugaaggcuguagcaauagucuagggcuucaauuuuaaaagauccuuuugugguugacaucauuguaaauaaaucaaaaugugugaggaaaauaccuuucgauuguagaauagauggauuuggcaaguggauaugaggauugagggagaaaugagagauuggaaauuucauuucaaaagagaaaaauggccaguagccaagaugaaugguaaaugcuuguagauuuauaugguguuuuugcuuguuguugaaucuucuaaucaccuuugauggauucuuuuuuuaauauacaacaaacauuaauuuuauuacuucucaaauuaguuuugauuuggagaaaauaauuguaugacuuuaaauguguguaauuuuuauauccuacuguuuguaauaugguaaaggugacagaagaagugcguaagaauauugaaguucguuuaaaagagucagcugaauuucagacacaguuggaaaagaaguugauggaaguagagaaggaaaaacaagaacuucaggaugauaaaagaagagccauagagagcauggaacaacagguaaauagguuaaccguauuaauuuuuuuuuuaacuuguaaggauuugaauucuuucaacuaagucauuaguugccauuuaguucaucucaacagaaauuuauugaacacauaggcaaaauuuuaguuuuauguuuuacucuuuucuguaccucuauauacauuucccguugaaauuuuuagacuacuuuacagaaauagguaucacugguucuuuuuaaaagccccuaccugagacuugacuuaugcaaauguuagggaauggauauggaguugcaaaacugauuauaucaggguguaaacauuuuaaauuuagcagcaguuuuuugggcuaauuggaucuuaaaaaaugagacuucaauuuaguaacacuacaauacaguauuuuccaaguaaguuugcaauuaauuuugguuuuaaucuuguucuuucugcuuaguuaucugaauugaagaaaacacuuucuaguguucagaaugaaguacaagaagcucuucagagagcaagcacagcuuuaaguaaugagcagcaagccagacgugacugucaggaacaaguaaguauagccaauuauugagaaaugagcuucgauccuagagaaugauucuugaaguauauuuaugcauuauaagaacugguggaccuuacaaaaauucaagauaauuuccacuuuuguggaacuuagacaagacaaauugaaaaguauagauggaaggcuaaaaauaaauacauagggcaauauucauuaacaaagcaaucuugacaaugggaaaauaaaaacaggacuaggagacuaaaauuuguacuuggcucucauuugcaaaaauuauuuuacuauuguccuucacuagaucugauuauaaaauuacagauacaguugauuagaggcaaccuuugcuaacaaaacaagaaccucuugauaacauuguuaaugcauuaccaaguuugcgcagauaucuauauacuauuuauaaaauguuaaaaaaguaucauuauuuugaguguauguauguaugugcacacaguauugaagcuuuuuauaauuuuuuuaugaacaggaaaugauaaaacaauucaggauucagaguuacuaaaaugguaggaugggauagcaguacauuugagcauauugguaauguucuuauuuuaaguugggugucauguuaauagcuauucauuugcuuacuauucuuuauugccuauauauaugugacguguauauugcuauuuuaaaauguaauacagggaagaaaugcuucaaaguaaauuucauuaaaaucaauggaucuauaauuuaguacuuaauauagcugaguuauguuuagcuucuuauaucaaaaaguuuguccaaauugcuggucuucuaagcuucauuucugacaguuuuauaauauuaaguaacuaaagcauuaacuuuuaauuauuuucuuauuuugcuacauuuagauugucuuuacuuuuauuauuuaaaaaguccaauguguaucuuuggacaagugcuaacuaguuuuauggauuuuuaaucuuugguaucaauuggguaauaauuucuuauaggcuaaaauagcuguggaagcucagaauaaguaugagagagaauugaugcugcaugcugcugauguugaagcucuacaagcugcgaaggagcagguuucaaaaauggcaucaguccgucagcauuuggaagaaacaacacagaaagcagaaucacaguuguuggaguguaaagcaucuugggaggaaagagagagaauguuaaagguauuauuguaaaucugaauagaauguucuguugaauugaaagaguuguuuuuuucuuuauuuuauaauguuuugagauggagccucgcucugucacccaugcuggagugcaauggcgugauauuggggucacugcaaucuccaccugcuggguucaagcaauucuccugccucagccucccaaguagucgggauuacaggcguuagccaccgcgccuggccaaguuguuuuuuuuaaauaugcauuggaaaaucuguuauucugauagacucuuggcuugcaggaugaaguuuccaaauguguaugucgcugugaagaucuggagaaacaaaacagauuacuucaugaucagaucgaaaaauuaagugacaaggucguugccucugugaaggaagguguacaagguccacugaauguaucucucagugaagaaggaaaaucucaagaacaaauuuuggaaauucucagguaaaucauguucuuacugcuucauuucugugguauaacaacuaugaaaugaaacuacaaauauauaaauuagagaaggagauuauacacgauuuugauauaaaguucauucuuuuauuugucaaagaacucauaacuuuuaacauuuacacauauuaaacaagugacuuuaaaguugaaucugauaguaagaacuagagcaguuuucucuugaaaaacuaaaugccuuucagaucauuuuagagauaaacauucuaaagccagugucuauaaaagaaaauagaaauacaucucccauuauuauuuauuauuaaugaaaacguguaauaguuauuaaagucaaugauuuuugucaucuuaccaaauuaccuacguuuuguaauguuggcuuuuuaaaauucacauaaaauuuuaauaucuguauuuuuguagauuuauacgacgagaaaaagaaauugcugaaacuagguuugagguggcucagguugagagucugcguuaucgacaaaggguugaacuuuuagaaagagagcugcaggaacugcaagauagucuaaaugcugaaagggagaaaguccagguagguauacuaagcuuuaagaaagcacuuguuaaaucaaaagagaagcacucauuuauaucucuaccauuuaacguaauguaaaauuuaacuugaaguaagcauucuucuaaacuuguaaauucauuaagcauuuguuaaacacuaauauaguauagugcuuaaaaguaaaggcucuguaaccaaacugccugguuucagauucuagcuucauaccauuagcuguggccuuggguacauuguuuaacuucccugcucuuaguuucuucaucuguaauauuuggauaauaaugagguuuaauugaguuugugcacaugaagcauuuagaagcaugucugguauguagugggugcuuaauaaauuccagcuaucuuaauuuauuauaguuauggauuauacguguggauagucauucuaggauaaagugauuuaaacugcuacagaauaucuuucucacccaaggagcaaaaaguaguaaaaacuaacaaccaaaggaaaagaagcugugguagugaaauggaugauaauaagacaagcuugacuccuuaccccacacuaccacccaaagcuuauuguugaguuacuucauucuuaggagcuacaguaauauacccccaccucuagaaggaaggaaauuaagaucuuaaaacauuuaucuucuuuuaacugaugaguagucaaaaugacuguuaagaagaaaccauuggacagggaaaaguaaauaaugaauuuuaugggauuuauguguucagcaaaagcuaaagguuccagaauuauauccuguuuaauucaaauguaucucaccauggaaauaauagagccuccaguucaauagaguuaauacuuggaggaaaagggacagaaucagagucucuaacaaagacugcauauuguuucagucuuuuccgcuucauuuuuuauuccuuugggcuauagaaaguaaauacuagaaaaugcccgccuacgaaugaguucauagggggaaaccaaccuuaaauacaggaagaagagagucaacaaguaacauagauuauauaaaaaauaauauaaugggccgggcaugguggcucaugccuguaaucccagcacuuugggaggccgaggcggguggaucacgagguuaggagauugagaccauccuggcuaacacggugaaaccccgucucuacuaaaaauacaaaaaaauuagcugggcauggugguggcaggcaccuguagucccagcuacucgggaggcugaggcaggagaacggcguaaauccgggaggcggagcuugcagugagccgagaucacaccacuggacuccagucugggcgacagagcgagacuccgucucaaaaaaaaaaaaaaauuauaauaguaauguaaugucugucuaagcaugaacaguguagcauggcaaccaugaaauaugcuauagcuuuaaaaacagugggggaagaaaguaauaccaagugcagaagauggauaauuauaaccuaugagaaggaaaaaauucuucacagauaauucaguaaaauuucucauggccaaagugaugaaacaauggaucaaaaugagagauuucugaacaagagggaauaaacugaggauuagaauaacauuuuagaacuaauaaauuuagugcagcaaggaaaaaaagauacagaaagguaaauagagauuuggauuaauguuuuuaccuaauguuaauacuuuguuggugggauuuguagcaucuuuucacuuuugucuuuguaauucuuguauuuguuuaaagucugcaguucgcaugccucacagaaaaguaaacgugaacuuucaaaaauuuuaguucuaaaaguugaaacuuaaauccucuuuauuuugucauagggaggauuugagcucauaggaacagguagacuuucaacuauuguuagauguugguauguauauuuauuugaaauguuuagguaacugcaaaaacaauggcucagcaugaagaacugaugaagaaaacugaaacaaugaauguaguuauggagaccaauaaaaugcuaagagaagagaaggagagacuagaacaggaucuacagcaaaugcaagcaaagguuuguugcuuaguuaucaagaguggaagcauguuguuuuuaauaauaaaugaauuuuuacauuuguuguuaaauauuggcaugauuuucaggugaggaaacuggaguuagauauuuuacccuuacaagaagcaaaugcugagcugagugagaaaagcgguauguugcaggcagagaagaagcucuuagaagaggaugucaaacguuggaaagcacguaaccagguaaaugcaguuaaaacucuuccaaaacauggaaacacguguuuuuaauaauaggggaaacuuaggggaauaaaaauauuugaggaacuagugaaaauuacuguguuuauuagugaaagucuauuauguuauuaauacauguaaauacgugacagauguuaaacuuauaacccaauuuauaaaaaauuuugguuauauuauauauauuucuaaaaagcaguuauuuuccauaauuuuaaaguuuuagccuuucauuuuaucucuaaaauauuuuuauacaugaaaauagaaaucugaggccagacacgguggcucaugccuguaaucccagcacuuucggaagccaagaugggaggauugcuugagcccagaaguuugagaccagccugggcaauguagugagacuccaacucuacaaaaaauuaaaaauuagcugggcguggugguacaugccuguagucccaucuacuugggaggcugaggucagaggauuacuugagcccaggaggucgaagcugcagugaguugugaucaugccacugcaugcuagccugggugagagagggagacccugucucaaaaaaaaaaagcaaaauaggaaucuguauaauuuauugaauuuauuaaagcacuuuaaaaagacuuguucacuggaacguuuuuagggagaugaaaccauguaacauacugugguucgaaacuccagcccuuuauucaaacaaaagguuagaaaucugccuugcauguauuauuuauaugacuugggagaguuucuuaaccucuuggagcuuuaguuuucccuuaucaccuuucgugugauaaaaauuuaacaaaugugaagcacauuaccuggcaucuacagaagguuuguguguuuaacuuguaaugcauugucuauauuuuuuuucuuguaaaugucacuucaaugaaauuagguacuuaauauugaaaguuuugauucuucagaucccuuuauuuggcuucauuguaacuaauaugaaauguuuauucacaaauaugaaaaaauaaugaacauuuaaugacauuuuauuuuuuuuuccucuuguauuguggguagacuucuuagccaaacaagccaaagcuuaguuugaucuuaguaucuuguaguuccaugcuugauuacuuuacaugcaggacaccuaauauaaacauaaucagauauucugccauuuuauuauagcacauuuguuucauaaaaccuaaaaaaaucaaguaugcauuuuuguuauucuagcaucuaguaagucaacagaaagauccagauacagaagaauaucggaagcuccuuucugaaaaggaaguucauacuaagcguauucaacaauugacagaagaaauugguagacuuaaagcugaaauugcaagguauauggaaagaagccuuaaaucauauauaauauaaaagaaguuuauuuuacuuauuuacaugacuccccaagugccugccuccugguuuuagaaagaauggaaagugcuagagcaccuauaucugacuuccaucuacuuuguagagucaagcagugauuuaauauuaugccuuuguauauaaaauauauaugagacuauccucauaauuauuucucuauauuuuauuuuuuaaagagcuacucagaagucuaaagcuaaauuuacagcuaucaaaaacuuacaaggagguuuuuuuuuucuuuugguuagcuuauauuugugacucuauaagggaaguggguuuuauuacuuuggcuuuuguguuccuuuuuguggagaacaguguuucccucuguugcccaggcuggucucaaacuccugggcucaagcuguccucccacuucugccucccuaagugcugggauuacaggcaugagccaucaugccuggccaagggaagcuuguaagucuaauuuuuucucacaugaacuaauagcaaaguauugccccuuuaaaauuaagaaauuaaacauuaaaauuaauguuucugguuuaccuuuuguaagcuuuaguguaauuuguccauaucauggucccauuuauauauugcuuuacaacuuacaaauuuuugugauauauauacguacauucucuuuauagcaaucaucuagcauguuaaguaggagaguuauauuuuaaucuuaaaaaugaggagccuaagauucaaaaagauugacuaccuaauucaggccaucugauuucaaguucaguucagaauuaacccauacucuuaauucaggccaucugauuucaaguucaguucaggauauaggacagggguuggcaaacuguagcccauagaccaaauguggcccaugauuugguuuuguacagccuauaagcuaagaaugauuuuuauauuuuuaaagcauuguuuaagaaaaauacagcaaagacuuuguggcuugcaaagcauaacauucuauccggcccuuuuacagaaaaaauuugacaauacucagugcaguaggaagaggguagguuuugcucuuaaagcaagucugaauuaaaaucuggguaccaucacuugauuuuaguuuguaaaauugcgcauguuacuugaccauugguagcucuguuuuucucaucucuaaaaugugcauguaaaccuauguaauaagaucuugccgaagggcuguaaauucguaaggucuuaccuuugaaguauauggguauuuuuuaggauuuucaaaaaaaaaaguuauuaaagcaguauaacauaaaguuacauuggacuucaaacuuugaaaaaugucucauauauuuaaucuuucuucuuuccuccauuuuuuaaagaucaaaugcaucuuugacuaacaaccagaacuuaauucagagucugaaggaagaucuaaauaaaguaagaacugaaaaggaaaccauccagaaggacuuagaugccaaaauaauugauauccaagaaaaagucaaaacuauuacucaaguuaagaaaauuggacguagguacaagacucaauaugaagaacuuaaagcacaacaggauaagguauuuugaagaaacuuaucuuacaaaaaaaaacuaggaugaauguuaugaaaucuuauuucuuuguaauuuugaauauuacuagcuuuuagauaccgaaaucguguaagcauauaugauaucuuuauuuaagauuaguucuuuaauaugucugaaaaugcauuauaaacucacaaauuuugguaaauacuagauaguucagucuucaccuuucaaauacucuccauuuucaaagcuauguucuuauaacucauugcuaauuagaauuguguauauuaaaaaaugaugacuaaucugguuuuguauaguuuuaaauaaauuguuuauguuaaccaccuaucaaaaaaauucagaaaucuuuguuauauuuauauuuugaaucuaaauauuguuuuuaauuccugaagguaaggaauuuguauguugagaauuauguauuuauuucauguuggauuagaaaauaaauauaaagaaaaaaaauucacaauuaauaccccuuuguuuuagccacuauuaguacauuaguaucccuuuucauacauguaagcgacguuuuuccaaagaaauaauauuauaugcuuauauucuuuuguauacuuuuuucacuugauucauuaucaugaaaauacaguuaaguguugaaaauucaacuauaaugcaucauuuugauuagcuguuuaguauucaguuauguggaaaaccauaacuaguuccccauuuuuggagauuacaguuguuucauagaaaauucuguuuugaauaccuucagggauaaaauuucuuugcaaagcugugauuauuuucuuagacaaacuugcagaaauggaauuacugaauauaaauaugugaguguauuauuacuguuuguugucuuagguuauggagacaucggcucaguccucuggagaccaucaggagcagcauguuucaguccaggaaaugcaggaacucaaagaaacgcucaaccaagcugaaacaaaaucaaaaucacuugaaagucaaguagagaaucugcagaagguaugagugugagaacagucuguuccuaauucuuuccuguuauacaccuaaagaaauauguguuaacuacugacacuuugucuuaccaugugggaauggauacauuuuauucuuuuuacuuugaauggcucauguauguaaguaguacccaaucaucuucaagugugcauuuaguuggucugaccaccauuuuuauacuuauacuuccauuuaaucuuuuaaaaagcaaauuaauaaguuauacuuuaaguugcuaccacauacaguuuauauugaaaugauugaauuccauggugaauacuuuguuuuccuuuaaagacauuaucugaaaaagagacagaagcaagaaaucuccaggaacagacugugcaacuucagucugaacuuucacgacuucgucaggaucuucaagauagaaccacacaggaggagcagcuccgacaacagauaacugaaaaggaagaaaaaaccagaaaggcuauuguagcagcaaagucaaaaauugcacacuuagcugguaaauaucuguuuaaaguuugaacuugguagugaaaguugauuauguguugcaggccuaaaacuaaauggaauagaaauaaaagguaucuacuuaugaaggguguuuguguguguaugugugcuuuaaauauuaggaauaauuaguuggacacaaagagcaauccuaauuuucaagugaugaggauauccuugauaugaugaaauuuuucucaauuguuggcuggcaguagauaauggaauacugcuauccuucugcuuucauggauaacaauucuaucuugugacagagauccuuugagcccagaccgugcugucuagaaaccuuauguagacugcauaaagaucuuuaccagcccagggauuuuuuugugccucguuugguggaggaccccucuagcuuuucagggagaguaucaugucaaauuuaugaagaaccuaguucuucaaggcucagggcuuuauucagccuugccuaucagucugcugaguaguuaaauaaaaugucaaaucaguuggauuuuguuacaggcauuuuuuuaaaaugaucucuaagacaguguccuaacaacuuacuugauuuuaaaaguucuugaauuauuuuuaaacagugcuguagauuauaugaaauaaaaauuuugcaauucauaguaaugaauugcaugauacauugaaauauaaacgggcuucuguuaacuaggaucuuuagcuuuuugagauuuuaguuaggaaaaaguaaauuuuuauguuggaguaaguauauuuuauauucuaguaauaaguuaaagcaugaauguacuuagaacuuugcucauugagauguaugauguaucauaacuaauguagauguuauaguaguagaaucugaugugaccaugugccaauuaagugcauaaaugcuguuuuaaauguuugauuauaauauuaauauaaucgccugguuacuucuuuagguguaaaagaucagcuaacuaaagaaaaugaggagcuuaaacaaaggaauggagccuuagaucagcagaaagaugaauuggauguucgcauuacugcgcuaaagucccaauaugaaggucgaauuagucgcuuggaaagagaacucagggagcaucaagagagacaccuugagcagagagaugagccucaagaaccuucuaauaaggugauuagcuaauucugcuuaaguaacaaauuguuuuucuuuguacauuuuacuugaaagugcuuggugauauaggagccuuugucagugaauuuuggcuaaaauucaauauaugcggagagaauuaacaauaaugacaauuuuuuuguggcauuuuuaguggacucuugugggcuaggaacaacaaucaagagcuuucucuuuauaggucccugaacagcagagacagaucacauugaaaacaacuccagcuucuggugaaagaggaaugugaguuuuaguuauuucauagucuguuauuuuucuuuuaaagcucagggaauaucuagugaucuuucuguuuaggaaaaagaaaucuguguauucuauuguaaaaacauacacuaaagaguuguuuucucugcagaacuguaucauguauuugccagcuuguuuucaccauacuuucaguccuaucagaugaagcuuugugacagagaaaacgucucucaucuuuuaguuuacaguugguuucuaaguuaggcugcuacugauuuuccccgugauguuacaugaugacagauagaaaaugcugggcugagacuuggguucagcaauucaacagcuagauacauuuuacauugucaggaugcaccacucuggagcauucccuguguaguuuuuaaugcuuaaauucaaaacagcuuuaauaaggcucugaaauauuuagugaacaaaaaaauggagaccuauacucacuguguuuuuaaaaguauuugcauaauaauuuguuauuaauuauucuuccauuuucuccucuauaagugccagcacaucagacccaccaacagccaauaucaagccaacuccuguugugucuacuccaaguaaagugacagcugcagcuauggcuggaaauaagucaacacccagggcuaguauccgcccaaugguuacaccugcaacuguuacaaaucccacuacuaccccaacagcuacagugaugcccacuacacaaguggaaucacaggaagguuaguaaaauaauacagaucugaugagacugcuuauuuagauuuauuaugagaagaugacaguaauuucaaagacaaaugaagcauccacuacagcugaagucacgucauuguaaaaauggguguuuaauauuugaaggacauacuucuaggaccaaaauuuucacuuguaaugacaaagaauauaugaaauccacuuuggaaaaucauacugaauuacuggcucaauccaacauugcuuucucacugaaacugaccauuucauugcuuucuucaauuuuuucccaugacacucuuguuauucauuacagcaauuacaacuuuguauuuuauucugugguauacaugcuuuuuacuccacuacauugagcuccucaagggcaaaaaucucagcuucuuauuguuuaaucccuuuaccuaacuccacaguagguguucaguaaaacuuugcuaccugcauauuuccuuagauucuuaucuugacaaauguuagaauucaguaaauuauucaaguauuucugugcugugaaaguagagaauguuuuauuucagcuacauccaauaaacuaaauauauuacuaaucaaauuuacuaucuguuauaucaauuaaaaacuaaaugaugcuuaaugaaaaauucuaauuuuacuuugagcuuaauuucauuaauuuuauucaacaguaauuuaaaugaauagaugcaaaaucaguuacagauauuuauuuaauucaggcaacauuuuauugcaugcuaccauaucaauuacauagggaauauaaaaaugcauaauacauuaccuuuaccuacaauguauuugucuaccaagugccaaaucugugugaaaggugacauguaccacagaauaggaaggauaauuucagcuuugauaaaaguagaaggcuuauauucagcauuauaauuauuuuucagcuaugcagucagaagggccuguggaacauguuccaguuuuuggaagcacaaguggauccguucguucuacuaguccuaauguccagccuucuaucucucaaccuauuuuaacuguucagcaacaaacacaggcuacagcuuuugugcaacccacucaacagagucauccucagauugagccugccaaucaagaguuaucuucaaacauaguagagguuguucagaguucaccaguugagcggccuucuacuuccacagcaguauuuggcacagguaaaauuaauuuuaaaaugaagucagaguagaccuaugcauuuauaagaucuugaguguaucuugaguauauauaucuugaguauucuuuguacaaaugaaguuagaauagaccuacgcaauuauaauaucuuggauauaauacguaucacaaguauucuuugugcauacaugcuuucuaccaggaauuagaaugaaugaauauauuacuaacauuuuauuucauguuuacuacugaauaugacuauuuuaaaucaguuguuugucauuaagaugauucucccccuccaguuauuuuuuuuacuggucuuacauauuaaugcaaaacauuguauauaauuuaacggaaguccugaggacuaaaagacaccuaagauaagacuauauacugauuuacauacaguguacauuuuuucuuauucaaggaguccugaguuuuauagaaggucccauguaaacuuuguagauaacaacauaguaauacaaucucagugaaccagauauauuguaaaaauuggcuggcuuuauuaagcaaagcuuggguugguauaaaaacauugacucagagcauaaguugcucuuuguuuacccauagcuuagcagaaacaaauuauguugauggacauugaucuaggaguugauugauuguauuuuaguaaucuguacaauuaaauguuuacuguguucuccuuuaguuaagugaccauauuggguaaacuaucuuuaucuaaauugaguuauuaucaugcucuaauucaagauuuauauaauuucaaaguuucggcuacccccaguucuucuuugccaaagcguacacgugaagaggaagaggauagcaccauagaagcaucagaccaagucucugaugauacaguggaaaugccucuuccaaagaaguugaaaagugucacaccuguaggaacugaggugcguaaaguucuuucuguguauuuuaacuuuuaccaguagaguuaagguacucuuuucagcuacagccuaaagaaaauuaaccuuuuggggccaaaauauauuaucuggaaaacacuuuuauugaacuuucuacaaagauuccacugacaacccagguauuauuaccaacaguguuuuauauucuugcauaucuuuaauugcauuuguuucuauuucaauaaaaaagcucagucauaaaaacauaaguugaauuucaucucgaaguuucuaagucucauggacauaaacuguuaccugcuaucuuuuucuaagauuagccaaaauuauauuccuuuuugugguuaagauuaaauuguaaugaagcagguuucaaaucaaacauuaaggcuacuaaauuaauuguauuagcauguauuaauguucauaaaccuuacuuuguguauacugaggaggaaugugauuauaauuuuuaaauaaaauuuuuuuauuuuucuauaguuucauaaaauauagauuugaaggguuuuuucaaaugagagaacuaacaaaaacagguaacccuucaucuacuacacugauaugguuaauauauuaguguauuaugauacaggaagaaguuauggcagaagaaaguacugauggagagguagagacucagguauacaaccaggauucucaagauuccauuggagaaguaaguaaaaacauaccuaaaguaccacaccguugcuuuucgugaaugaaauuagcuuugacaaauugaaacauuauuuggucuuuuuuuuuuuagcuuguucuuauuauauguaaugaaauacuacuagaauuaaucauugcagagucugcuuucuuuuacuccuaugaguauaguguacugccuucuaaacuuauauuaaagaaauguuuuuguucauauauagcacagauuuccagauuuuuuagaguugugagccaagauuuuucccuauuuuaauuacaugaaauacaagagugcugguugcaucuugaguuaauuuauagugccccauuugcugguucucucuuacuccccuguauuauuucccuuacagaauuaaaguaauccauaaaaggaaaugcauuuauauaccucuucauuuuuugaucucucauugagguuccccuagcaguuuuacuagcggagagaauauagacccugaaguuacaaagcaugaggugucauuccuagcuccaccacuaggaagcuuugugacuguaagcauaucauuaauucccugcauugucucacuugucaaaaaauauaauuuuuaggauuguaaaauaccuaaaguaguaccugccacauauuaggcacucagaauauuauuacuuuccuuucuuccuucugucccacaaaaugagaauucauauugucaucaagaagacccccaggguggcuaaauaguguuuaauagaaaggagagcuuuauuagugauaucauuuugcucaugaggaagaaauagucuccagcguggaccaaagguguucugucuucacacagggcagggacaggugugguuuuaugccucacaggguccuuauuacacaauagagucaugcauauucagcagguuuuggggaaacgcuauacauauuuaugaggggaacugagcauauaaacaguagguaaauauauauaauauacaucccauguucacuuuggggcagcguuuuagcaugaaaaugagcuggaauuuggcucuuuacgugaagagugaacaaaaggugaacuacaggacacaaagacaguuugugcgcagccucuuuaagcagguugaaacuagcuuaaggugucugcaguuccuugccagugcucucuacagucagaguuguaguggucuggauuguaaaucagagauaggagucugauaacuugcccgauaguuccaguuagaggaguuuagcaaaggcuuauauuuuuuuauuguaaccauaugaauuuagaaauuuaccaugccagacaggcccugaacccuugaccuacggguaacuuuuguuuccuuaaccuuaggguuugucuuaguugagaaaauggcaucuauuuuggucucucaaaucacaauguaugauaguaauuaaauaucaauauuuaacacagaacucauuacuauaugccaaauguugaucuaagaaauuuuuauuuauuaacuaauuuaaucuucauuauaccucauaguuacagaaacugauacccagauaaaguaguguaccgaaguucacauagcauuggagcucagauucaaacccaggcuguguaguuuucaacuguccuaagcuugaaacaguacuuuugucuguauaaacuuucuggaucaucuuaugcuauaauuauuuuaucauguaaaauuaaggaauugucucaagcuaaccauaaauagccauaucgcaaguaaauuuuaguuucuuagcugcguuuauuuuguaaguuaauuuuaccagcuuucuuugacugaaaacacuaaacuaaaucuucagaugauuauguaguacagguugaacaucccuaauuugaaaauucaaaacuuuuuaggugccaacauugcaagccacguguguaauguuccacaccugaccucaugugaugggccacagucaaaacaguuagaacuucauuuuauacacaaaacuauuaaaaauauugugucagauuaacuucaggcuguguguauaaacuucaggcuguguguauacaccuuuguauaugaaacauaagugaauuuugcauuuaugcuugcaucuuauagcugucucauuauggauaugcaaauauuccagaauucuaaaaaauccaaaaucugaaacacuucuggacccaagcauuuuaaauaacuuauucagagcguacuauaaaugauaucuuuuucaucuauccuucagagagcauuguuucugaagaacauaacaauuugaaaauaauaagauuuucugccuucuugucagacuugguuaaauuauacugaaaucuucugcaaaagcuuuuucuugaaauuagcaaaauugucugugacuccaaaauaccauuuggauuuuuauuccaccccucuagcauugucuacugaauguguaacaguucauuuuucugauuuucugacagugaagcagacguucuuuucaaguguugcuuuuucugaaauaagcaugucacuuugaggcacuuuuuaaauuauaccaugacuuacucauuuuuuccauuacggcauauguaauuuuuuaugaaugucuuaguuuaaaagauacuguugcuagcuuguauaaaaaauugauuuuagugagugcuuaagccaaaaagacauuuaacuuuugauaguaaauauuauaaaugaaguuaaaauaauaguuuauuucaguaguuaacaaaauagaauuguggaaauagauugagcaaggaauuauuuaguaucugauauauuuauuuugguuugaaggcuuggaauaauuggaauuuugaggagggaagaaguucuuuguaaaaggacaaugauacuaacuuauguauucagugcuuuucuuuguaaaaagacagugguaauagcuuauuuauucacugcauuuccaaauuaguucuaguuugggaaaaccuucuguuuaaacauugcagacccaugaguauuuuuuuuuucuuuucugacuuuggucugcagcuguauugugcacuaaccgcccuggccauugagcaacugaaauauggcuguccaaauugauacaaauauaaaauauacaucagauuuuugaagacuuaguagaaauuuuaaaaugugaaauaucugguuaauaauuuuuacauugauuacauguugaaauaauauuuuggauauauugguuaaguauauuauuaaucaccuguuuuuaaguggcuacuaacaaauuuaaaauuacaugacauauuccugucucacagcacugauacgcgauaucacgcuaguaguuuugaaugcacaaauauuuguuuauauuuuuuucucuuuuucuuauuggaguauuaaccaauaagauuuaugauaauucuucuauaggaagacauuaaggaaacucaaagguucaucuucuuucuucaaaaauacuugaaaugccauuuuuaaaauuaaauguagcuggcugagguagcucacaccuguaaucugaguacucugagaggccaaggugggagaucacuugaagucaggaguucgagaccagccuggccaacauggugaaacccugucucuaauaaaaauacaaaaaauuagccagacuucgugggguggugccuauagucccagcuacucaggaggcugaggcaggagagucgcuugaacccaguggggcggagguuucagugagcugagauagcaccauugcacuccagccagggugacaagagcgagacugucucaaaaaaaaaaaauuaaauuaaaugcugcuaguccauaaguacucauuauucuuuacuuugaccuauaauaauaccucacauauaguuuuagguauguuuauagggcucuuaauucuuuuuuaacuuuuuuauuuuuaaagggaguuacccagggagauuauacaccuauggaagacagugaagaaaccucucagucucuacaaauagaucuugggccacuucaaucagaucagcagacgacaacuucaucccaggauggucaaggcaaaggagaugaugucauuguaauugacagugaugaugaagaagaggaugaugaugaaaaugauggagaacaugagguaaguuugauuugaaaucaucuaguguuuuuaaacuauuggaugaaagugcucaaauccuugggauacuaaugcauuggcuguaaauucugguucccagucagcuuaaauagauuauauuuauuuauauuauauauuauauauuuaauauauuauauauuauauauuuauauauauuauauauaaauauauauauuauauauuuauauauauuauauauauaaauauauauuauauauuuauauauauuauauauauaaauauauaauauauauuuauauauauaauauauauguuauauauuuauauauauuuauauauauaauauauauguuauauauuuauauauauuuauauauauaauauauauguuauauauuuauauauauuuauauauaauauauauguuauauauuuauauauauuuauauauauaauauauauauuauauauuuaauauauuauauauuaaauagauuauauauauuguuuuucuucuaucuuaauuaguucagaaaucaacauuuuauaaugaaaauuaguguagagccagugauggaaugcccauuuuuaaaauuuuguuucauuuuguuuuuuugacaauugaugagucuuuuaggauuuguuaucaauuagaccuaauuuuaagucuuauugauaaaugacuguauggcuuuaaauguaagugcuaugguuuccggagauaaaaagaagaaacaagaauuguuuuuguuuccucuuggagccccauaguucauuuuugucauuuuuuuauauauaaaguguauuuuauauauauaaggucaaauuguuuguuuuauuuugggguuuaauccuauauugacagcuucuuauuuuagauuaauaaacauuuuuuaaauagcuccugauauaguguaauuuuaucauuuucuucaacuccaccuguuuaaauuuagaauuaaacuggaccacuugauauuuugcugacaccugaggucuauauuaucuuugagcaaucucaugcaaacaguuagaauucagaauugaucauuauugcacuaauuccaguaaguaucacaguugugguauuuggugcugcuguacuaaucccauacaacucucaggacaauuccuaucuucugauuaaugagucacuuaaauuucuaagugugguaucuagacaugcagagcaugugggccauauucuaaacuuuuauuuaugccuggggaacuuucuacuaggauuaugaagaggaugaggaagaugaugaugaugaugaagaugacacagggaugggagaugagggugaagauaguaaugaaggaacugguagugccgauggcaaugaugguuaugaagcugaugaugcugagguaacuggcuagaauuuuaaccauucauaguucuuucuaugagcuuucuuucacuugcuguuuuccaaggauauagaaaggcuuaugaaauucacuaaaaccuuugguuguuuuguucauuuguuuuguuuuuuguuguuaugguuacuuauuuguuuuuguugugguuugguuugguuaauuauucuguccgguuuuuuuaacauauuuauuuuauuugagcauuauguuaccacguuuuguuuuuaggguggugaugggacugauccagguacagaaacagaagaaaguauggguggaggugaagguaaucacagagcugcugauucucaaaacaguggugagauuuuuauuagccuuuuuugaauugaauaucucugguauuuucuaaacuagaauugcacuuaauucuaauauauaaauuuauuuauugaauugguaaaaagagauuggccccuguucuagcuuugugacuguugugcucucauaaaaagucuacuauauuuaugauuguuaggugcugucauuauacucuuuucugccucauugggcugcuguaagaugcaaacauuuuguaacccuuacgguauuauaaaugcuauaugcugccauuaagaggaaaaauuaaauuagggacuacuuguaacagcaguucacaaccagaggaggucagucuaaucaagcugcaugcuucaagauuuggggcuauuggagcuuugcaguauggucugcuuuuccaaugaauaaaagauuuuuggaucaauauagcauauauuuuguuaaaucuuggauaaguccuggagguccacugaaaaguugugggcauuaaaagaguauggaagucguagaaaauaauuuuauuuugaaauguguauuaaauaauuagugauuaucugguaauagauaacuaacaacugauacuaagcugaaaucauuaguguugacauaguaaaaccuuagcuguuuagacuaaugggaaaauacuguaucuggguuucuguagaggccuggguauuuaaaagggcaagauauauucucauuuuaacuaaagaacagacaaaacuuuuaaauuuuuuaagagaaaaauacauuaaugaauauuaagccauauaauagguaauacuauucuuacuuuuaaagggagaugagaaauugauauacuuugaacaaaaauuuacauuuauaaacaauuuguagguuaagaaacauuuuuuguguaucacguaguugaaauauagagggaggaauuuuugcuccucuaggucucccucccucccucccuuccuuccuuccuucuuuuuccuauuuauuuuuauuuuuauuuuugcaaccaagcaaaaauaggccuagugcccugaacaaaauuaauggauggauuugaguacauuucaagcaacuacacuuguauugaauuguuuaauucuuguaguaaacuuaauaagguuuagguaucaaugaagaaucugaaucgcagaaguaaagugacuugaggugucgcauagcuuacuaaguagcuaaguagcuuaaguauuagagcaaggaucugaaucuagaccucagacuuuuaaacuaugaaauucugugacauccuguucaacuuuucauaguugaagauggcuucuuuuguugcuacaguguauguagaagaauacccagacauuugagagacauuuguuaaaauucaaaauucaggaaaaccaaaagauuaaaauguaguuguaaggcuucuccucugucuuuauccuuuuugauuguuacacugauucucuaauggucuaaccuuuagguaauuugucuacuuuauuaaaauuaauccagauuuauuaaauguuaauuuuaguuuuauuuuauuuuauuaaauguuuacuuuaauuuuaguguuuuuaauguuuaucauaggucgagcuaagagcuuuauguucauuaucugaaaucuuuagaaaaaccauuuuagaaacaccagacuuggagguuacauuugcucuauuaaccaaccaaaaaauagacucaaagagguuaagggacuugcccaaagccacacagcgaauaaguacacaucccauugucucuggguguaaaacccacauuugcuuccaucacaccucacuacuuuacuucugaaaauauucguacggugaacauuccuguuggcaagauuuauacuucuagggauuguccaaguuuuuuugugguaaauuuagcaguucaaaaguaaauuucucuuuuccuacaggugaaggaaauacaggugcugcagaaucuucuuuuucucaggagguuucuagagaacaacagccaucaucagcaucugaaagacaggccccucgagcaccucagucaccgagacgcccaccacauccacuucccccaagacugaccauucaugccccaccucaggaguugggaccaccaguucagguauuaaaaguacuggucauuaugaaaaaugaacuugaaaaaaaucuuggcuuuucucccuuuccauuauguauuucucucucucucuugguuuuuuuaaauuagcaaucccaugaacuuuuugguauuuuggcauauuuuuauaaaauucuuugaacuaaaacuaaucucugagggauguuuagaaaggcaaguguuacuaaaaguugugcauacauugaaaugguuauagucauagcaaauaaaauuguuauuucucaagugagaaaagaaaaagauuuucuuggguuuuaauuaaaguacauuuucgcagcucaccauuaucugauuugaagguuucuuucucuacagugcacguauuuauaaaagauaaaggaauuucuguuguacuuaacagaagaauauuuuuucucauuucuugguaaucacauauuuuaacuuuuaaguuuaaugaagguauguaugaccccuuauauuuagcauguaguagggucgggcaucucuuaaucagaagcacuuggaaaaagaguaggaaaaguacaaaaguucuauuaauuuagcuuaaguuuuucccuauaaaauaguauguguaaacacugucaaauauagauucuacugaaauaccacuagugaaaauaacuucaugaugggaaaauauaaagucuuaaaggauccuguauggaggcuacaaaaauauauccaaucuguccauuuagaauuaucuuaacuggaaaacaguuuaaaaaacaauacugcuguuugaacuccaaaagaauacuugcuaacacuuccaacuaaggaaauaggaauuaaauuuguuuacauacaagaugguaucauagaucuguuuuaaguauugguuaauaauuggucuguugguuaauagaaugauuuuuauugguuaauauuauagacuauaauuaaaaauuugucauugacaaaagugauuucuuggcagguuuuccugggaaaauguccuaauuaccugucugcuaacuauuuuguuggcagcguaauaagcuguaucuguugauauuugguguuuguuucauugccucauuucuuaaagcaaauguaauuccuuuaucuugacacgcagagaauucagaugacccgaaggcagucuguaggacguggccuucaguugacuccaggaauagguggcaugguaaguacuuacccauuauguaaaaguaauucauuucuugagcagauauuuauauaguccauaugugugguguuuuguuuguuaacucuguuuucuuuguuuuagcaacagcauuuuuuugaugaugaagacagaacaguuccaaguacuccaacucuuguggugccacaucguacugauggauuugcugaagcaauucaguaaguuaaugaaagagaaacauacuuuauaacuaaucaaacuuuuagucuuucucuguuaguuuguuuaucauuugguuaacucauuguuuguugagucccucucuacuauguacuaauaaguacuugggguaggucaguugaggauguauuguuggggaaaauuauacagaggugaaugacauacaguuacuucuaccaagaauuuugaaguuaaagacaauauaagaauguuuaagaacauggccucuagaguuagaaugccuguguuugaaaccuaacucuacuguuuacuagcgguagcaaguuccuuagguucucuguucaugagcaccuucauuuuaaaaaugggaauaacaauagaauaauuucuguugcauaaguuauaagaauuaagugaaucaguuaauuuguguuaacauguuuaagauguuaccugacacaugauaaauugcuuuauaguuguugauuaaguguugguaauuacaaugaucauaauuuauaguauucuugugaaagcuaagcaaaugagcaacuaacuguaauguaaacaauguagaaggauaauagaggaauaagcaguaggcuuuguuacuacaaaugaagaaguaauuuauuucaacaacuaaugagaaagaauaugagaugauuuaacgcggaugauauugaauucagucuugggaaagaauagcuagcauuuauugagcauuuucaugcauuaguuuauuuaaccucauaacuuaugagaguagacauuauuaauguugucaucuuauaguauacugaagcacagacauguuaacaaauuugccagaggucagacagcaaggaaguugcaguuuuuaguuucaaaccaguuagucuggcuguagaggcuaugcuaaguguugugcuauaccacuccucuuaaacgguugaaaggcucuccgugugaaaguauacacauuuauucguggcuaagguauuaguugcuuaacaggauguauuugaagaucagaauuuaaaaauuucuacaaacuuggggaaagguugauuguucuguagauguaacauguggcgguuagaaccaguuuuaaacuugcucaguuagccacaauuuaccuuggcuaacacauucuuacaaaccagccaaucaauuucagcuccuuccuucugaaagucagcacucaggaagagacucacuccaauaaacaugcagaauucugaguaccagcaaucaacagcauuuucacucaaauaaaugucacuaccccugugccucuagaagucaccacuuccugaacuccauguuuccuaaagacauuaauagcucacuagcuaaggaaagauaggcagaguuaaauaaugcuaaguuuuauguccugaauuauaggcagaaagauaaaugauaguguuauuaggauaacaaagaaagcaaguuuuuagcuaucuaauauuagaauuuuccuaaaccuugggagcuagcuagugaacucuuaauaagcuagacaggugacuugauuuuucuaugaccaaaugaaaacuaagauaaaacuuugucucaugacuucauucuaacaacucuuuuuguuauguuuuauguugaguuuguguugcuuucaguuuaucuaugugaggauaucugagacauucaagaaaugugaggcauaguucaggagagcugaaaauuaauuacauauaaaucacagguuauucuuauuacuaaauucauugacagcugauaguauaaaaggauuuuuauaaguaagaaacccuuuaaaauaaauagacuuuauuuucaaucuguuuccuucccaguuuguugauguucauucuuccuucuuccuauauuuuuuucaccauugugguuuaaauagguuaacuuuaaauuucaucuuaaauuaguuuuuguccauuuaguucgccgcagguugcuggugucccuagauuccgguuugggccaccugaagauaugccacaaacaaguucuagucacucugaucuuggccagcuugcuucucaaggagguaaauaguuaaaccuuuagauccccugaauuuguauguauuugguaauaaacuauuaagaugugauuuaaggggggaaaaagagcaaauaugaauauuuuuaaaauugauauuguuugcuaauuuauuuuuuuaaaugcuguaguauacuuauuaagcacugccuuacaucuuaucuuuccaacaaaguucuaauuucuuugagcauaaggauuagcuuuuacauuaguaucucuucuggcuccugguguaaugucauacacguaguuuaaguauucaggaauauguguugaaccaauaaauauagguacuacuagccauuuuaaaguuguuggaaggaaugcagcauguuuucuguuuacagcuugacacuuguaacauuucuaauuaaauguauaaggcuaguuauauuuuuuguauuaacauuacuuaaaaaaacaaaaaauaaaagaucaaaauauguggaauaaaauggccacuacauuaaguaguagaauuagcuaguuuuccacaugugaauuaugcuguuuguggaauugauuaccuuuuaauccucaguuggaauucauauuacccucuuuauuucugggaagcugucuggcacuugguaaaugaauagagaaugcauacuacuauuacaauaagcucaaucuuuagccaucauaaaagucauguaauguaacaucugcuuguuuaggauauuaguucuaacacugaaggccucuucuuauaugaaauuguaaguugacuuuguaaauuuaaaauguuaugugauuuugugacuuuguauguuaauacaguuuccuagacuugggcaucuaggcuuaaauuggaaugccaacauuuuaagcuuaguaaccuugguaauuacuuuguuaauuacuuuguaauuaacauccauaguuggauacucaauaaaauuagcuuguaugaaacucuuaagagcauuuuagcgaauguuuuaaggguacuguagcauuagaaaguuuaaaggaugucuuuaaguuguauuuaaaauuuugaggccaggugcaguggcucacacuuguaaucccagaacuuugggaggccaaggcaggaggaucacuugaggccaggaguucaggugcagccuugacaacauaacaagacugaccccugucucuacaaaaaugaaaaauaauuagcugggucuguguugguagcccuagcuccuugggaagcugaggugggaggaucacuugagcccaggaguuugaggcuacagugagcuaugguggugucacugcacucuuaacuugggugacagaacgagacccugucucuaaaauaaaauaaaaaauaaaaguuugagagauggauuuuugcuugauggaauaauuaaaucguggacuuuaguaaaguuguauaucuccaauaauuaauauuuuucuuucacaucccugacuuguugauaauuuuauguuuuuuucagucauucauuaauauucagaauugucuuuagguuuaggaauguaugaaacaccccuguuccuagcucaugaagaagagucagguggccgaaguguucccacuacuccacuacaaguagcagccccagguagggaucaaaggcagauaguagguucuguuuuauugguaaaaugaaaaccuaugaaguaucuucuggcuaaaaaugugauaaaccacaaaguuuuaaaguucuuuuucuuguguugucuuuuuaaagugacuguauuuacugagagcaccaccucugaugcuucggaacaugccucucaaucuguuccaauggugacuacauccacuggcacuuuaucuacaacaaaugaaacagcaacaggugaugauggagaugaaguauuuguggaggcagaaucugaaggguaaaaguuuauuuuguuguuuuugcuugcuuuagucucaacagacuuguacauuuguuuuccuuuagccaagaaacaaucugcaaaguuguguuuuguuuuuuuuuguuuuuuuuuuugagacagagucucgcucugucgcccaugcuggagugcaguggcgugaucucggcucagugcagccuccgccuccuggguucaagcaauuuucugccucagccucccaaguagcugggauuacaggcacccgccaccaugccuggcuaauuuuuguagucauuuuguacugaaauuuucacaugacuuaaacuggagcagauucauguuauucuuguacugucucccucauuugugucuugaauggaagagagaaagauggauguagccacugagccaggaauuuuacauacccauagccuaucucaucugggcuagagcccgugguuugguuacugguauacuauuuaguagugugacuguugugaacuuuuuauaguacugugcuuuccuaaaauguuguuuugagauuuaucaaaaucuggaccauauauuucuuaugagugucaagaaugugaacauccuugucaaaaggaaacauaagaagaggaaaaucauaaacuaaaauuggaacaugucauagugagaaaaggaaugaggaaaaaacaauuugagcucuuuuccccccugcuccuuugaaaaauauauaugguaaccaaaucagucuauaauuuuuuguuuaagggagcucuggauuacuuaagugauaaaauagauuuaaaagaguggauauaauuuaugauugacuguaggaucaguuuuguauuuucucauuuuucuuuuccuuaguauuaguucagaagcaggccuagaaauugauagccagcaggaagaagagccgguucaagcaucugaugagucagaucuccccuccaccagccaggauccuccuucuagcucaucuguaggugagucccugcccuugacugcaauacaguuuuuauacaucaaacuuguuugugaaaacacugcuuuauuaguaacaaauuaauaauccuuuuuuccuguauuuuaaaaugcuuuauuuaaaagagaaauuuuauuauuaaaaggaacuugguuuauauugaaauaauuauucuaagaauauucuggcaucaauaauaagaaauauggacaugguggauccaucccaaaagaauagcucacucauguuucaucuagacuauugguugucaacauauguuuuguagagcucuugggucuuuuagaggugcuacagggguuguaguggguggguauacugggagggaggcuaaggagugcuagggcacuccaggccucuugccucuguuugaaccacagcagcuccauuuuuauguguucuacauauugggguucuacaugagauuugauguggagaguuaagggguaagagcucaguugcuuaaaaaaauuguuugaaauuuacugauguaaacaguuucagaguuuggcuuuucaaauuuuugaaguuauuuugaaaaaaagauauguauuauuccuguaauagaaguuauuuuuuagaauaacaguuagcauuuacugaacacuuaacuguguaucauguaguauucugagcccuuuacuuauauuuccuuauuugauucucgcaacucagugcgguagauauucauccacauuuuauagauauggaagcugaggcacagaaagggugaauaaccucuucaaagucaaauagcuaauaaguaacggacaagcaacgauuacacugaagaagucuggcuccagagaccccacucuugaacaauacacuauacuagcucaucuaucucaaauuuuuagacagagaauuaccuuuacuauuaaggauauacaguacuuggucauucagucugauuauuuuaauuuuuaauuguuuacagugguaauucucaaacucugccauggaaccuucagauuuuauggcagaccugcucaguuauuuauuacuuuuuuaaaucacagaacuuugcuaucccaaaaucucuuccccugauucucagcugcuuugaugugacacaucagccuauugguuaauaucccuaauaucuaccguuucauaucugguaacuuuaaauuucuauacauuauguaauauggauacucauaacuaaucuugcaaucaggauuuaaaauaauguauguaaauuacagaaccauuucauacgcaguaaggcuuaaaaaauguauaacaaucauauuaaugauuacugaaguuuugugcccccaguuauauuuugacgucccauaaaaauuggcuuuccucaauagaauuagcacuuguuauaucuuaucagagcuuguaugagaaaauaugguuguuuccuuuaaaguauaauaugaaauuacgaugucuuuaaauuuauuugauaauguaaaacuguacuucccccaucugaguauucauuuggucaacaaauauuugacaguguagcaggcaguuucauaggaagcaucacuaagagaaggugacauuuaagagcugaaagaagaaagggaucaaagcugugcaguuacuuaaugaagagcauacuagaucaaagagaauauuaauagaugccaaguccauaaggcagcagugugucugcuuguguucagggucaacaaggaggccacuguggcuggagcacagugagugagaacagagaguagcaggagauauguuaagaggcgggagaggauagaucgaguagaucauuguaauugccuuggcugucauggauaccagaagcuauuggagggcuucacacagaauaaugacaugacaugaucugaucaguuuggcugcugcauacagaagagauuaaaaaugaauaauggacagaaacgagaaacuuuggaggcuacugcaguaagucaggaaaagauaguaauggcuuaggugagaugguagaguuaggauugugagaaguugucagauuugggauauauauuuaaauuugagcauucaugauuugcuaaugauugcauuuggggugucugaaaaagaaucagauauaauuuguguucuguuguaggcuguuugcugagggacuugauauuuuguuuucuguuguauuucucagcaccuggcaguauguuugauacauggguagucaacaaguaaauauuuauuaauauaagugaaugaaugaaaaaaagucaagcacuucugguuuuuuuuugguguuuuuuuuuuguuuguuuguuuguuuuuuuuuugagacagggccuuggucugccugguuuuuuggguguuuuuuaaggcaggaucucaccggucucccuggaguacuguuagcuugaucauggcucacugcagccucaaccucacccgggcucaagugauccucuagccucagccuccugaguaacugggacuguaggcauguuccaccaugcccagcuaauuguuuuauaauuuuguagaaacagggucucgcuguguugcccaggcuggucucgaacuccugagcucaagugauccucccaccuuagccucccaaagugcugcuuuuuuuguuguuuaaccauuuacccuuuuucgguuuguuaaauguuccucauuguuugaaaaaaagaauugaaaucaaaugaacaagucuacaucuuauucauucauucauuuaguaauuaguuuguaucauuauaaaugcuuucucauuuuuucacuugcuuuucuuuuaucuuaauguuuuucuuagauacuaguaguagucaaccaaagccuuucagacgaguaagacuucagacaacauugagacaagguguccguggucgucaguuuaacagacagagaggugaauuucugacauaacuggauuacaugauagaauguggaauaguaauaaauggaacaaguuuucuaauccuuaagccuccaauuuauuuuuuuaauguuccaaaguuuuauuaaauaauuacauguugagcaggugauauuuaccaaucuguaaacuucauguagacagauuuguauaccuuagauauauaauaaauaugugcuuauauuuuauauuuauugauuucuuccuuaaauccaaauuaagauuuggaaaauaugaaguguuauaguguuauauucauuuguuguaucucuaccuauugccauuauauuguuaauuuuuuuauacaacacgauaaagcuuugugauuauguuuuagcuaguaaaaguguaaaauuuuaauauuuccauguuuuccaauauaacuuuuagauuguacuugugucacaaaaagagggauuaaucugcuuguaauaauuuccauugaaguuguagaauacccaacaguuuuauauccacaaugccuagauauuuuuuauaaugaacuaggguaagugaauacacuaguuuugaauucuuaaaagauauauucaauuugauucuuuuuucuuuuacaggugugagccaugcaaugggagggagaggaggaauaaacagaggaaauauuaauuaaauggucuguaaacaauaacaacugugaauaagauuaucaaaucuguuuuaguguaaugauugucaaguuuaaaaacauuuuuauauauaaacugguauacucaugucaauauucuuuauuaauaaaauguuuuucagugucaa

SEQ ID NO: 21203 - RNA, 61893 nt, Homo sapiens
uugacacugaaaaacauuuuauuaauaaagaauauugacaugaguauaccaguuuauauauaaaaauguuuuuaaacuugacaaucauuacacuaaaacagauuugauaaucuuauucacaguuguuauuguuuacagaccauuuaauuaauauuuccucuguuuauuccuccucucccucccauugcauggcucacaccuguaaaagaaaaaagaaucaaauugaauauaucuuuuaagaauucaaaacuaguguauucacuuacccuaguucauuauaaaaaauaucuaggcauuguggauauaaaacuguuggguauucuacaacuucaauggaaauuauuacaagcagauuaaucccucuuuuugugacacaaguacaaucuaaaaguuauauuggaaaacauggaaauauuaaaauuuuacacuuuuacuagcuaaaacauaaucacaaagcuuuaucguguuguauaaaaaaauuaacaauauaauggcaauagguagagauacaacaaaugaauauaacacuauaacacuucauauuuuccaaaucuuaauuuggauuuaaggaagaaaucaauaaauauaaaauauaagcacauauuuauuauauaucuaagguauacaaaucugucuacaugaaguuuacagauugguaaauaucaccugcucaacauguaauuauuuaauaaaacuuuggaacauuaaaaaaauaaauuggaggcuuaaggauuagaaaacuuguuccauuuauuacuauuccacauucuaucauguaauccaguuaugucagaaauucaccucucugucuguuaaacugacgaccacggacaccuugucucaauguugucugaagucuuacucgucugaaaggcuuugguugacuacuacuaguaucuaagaaaaacauuaagauaaaagaaaagcaagugaaaaaaugagaaagcauuuauaaugauacaaacuaauuacuaaaugaaugaaugaauaagauguagacuuguucauuugauuucaauucuuuuuuucaaacaaugaggaacauuuaacaaaccgaaaaaggguaaaugguuaaacaacaaaaaaagcagcacuuugggaggcuaaggugggaggaucacuugagcucaggaguucgagaccagccugggcaacacagcgagacccuguuucuacaaaauuauaaaacaauuagcugggcaugguggaacaugccuacagucccaguuacucaggaggcugaggcuagaggaucacuugagcccgggugagguugaggcugcagugagccaugaucaagcuaacaguacuccagggagaccggugagauccugccuuaaaaaacacccaaaaaaccaggcagaccaaggcccugucucaaaaaaaaaacaaacaaacaaacaaaaaaaaaacaccaaaaaaaaaccagaagugcuugacuuuuuuucauucauucacuuauauuaauaaauauuuacuuguugacuacccauguaucaaacauacugccaggugcugagaaauacaacagaaaacaaaauaucaagucccucagcaaacagccuacaacagaacacaaauuauaucugauucuuuuucagacaccccaaaugcaaucauuagcaaaucaugaaugcucaaauuuaaauauauaucccaaaucugacaacuucucacaauccuaacucuaccaucucaccuaagccauuacuaucuuuuccugacuuacugcaguagccuccaaaguuucucguuucuguccauuauucauuuuuaaucucuucuguaugcagcagccaaacugaucagaucaugucaugucauuauucugugugaagcccuccaauagcuucugguauccaugacagccaaggcaauuacaaugaucuacucgaucuauccucucccgccucuuaacauaucuccugcuacucucuguucucacucacugugcuccagccacaguggccuccuuguugacccugaacacaagcagacacacugcugccuuauggacuuggcaucuauuaauauucucuuugaucuaguaugcucuucauuaaguaacugcacagcuuugaucccuuucuucuuucagcucuuaaaugucaccuucucuuagugaugcuuccuaugaaacugccugcuacacugucaaauauuuguugaccaaaugaauacucagaugggggaaguacaguuuuacauuaucaaauaaauuuaaagacaucguaauuucauauuauacuuuaaaggaaacaaccauauuuucucauacaagcucugauaagauauaacaagugcuaauucuauugaggaaagccaauuuuuaugggacgucaaaauauaacugggggcacaaaacuucaguaaucauuaauaugauuguuauacauuuuuuaagccuuacugcguaugaaaugguucuguaauuuacauacauuauuuuaaauccugauugcaagauuaguuaugaguauccauauuacauaauguauagaaauuuaaaguuaccagauaugaaacgguagauauuagggauauuaaccaauaggcugaugugucacaucaaagcagcugagaaucaggggaagagauuuugggauagcaaaguucugugauuuaaaaaaguaauaaauaacugagcaggucugccauaaaaucugaagguuccauggcagaguuugagaauuaccacuguaaacaauuaaaaauuaaaauaaucagacugaaugaccaaguacuguauauccuuaauaguaaagguaauucucugucuaaaaauuugagauagaugagcuaguauaguguauuguucaagaguggggucucuggagccagacuucuucaguguaaucguugcuuguccguuacuuauuagcuauuugacuuugaagagguuauucacccuuucugugccucagcuuccauaucuauaaaauguggaugaauaucuaccgcacugaguugcgagaaucaaauaaggaaauauaaguaaagggcucagaauacuacaugauacacaguuaaguguucaguaaaugcuaacuguuauucuaaaaaauaacuucuauuacaggaauaauacauaucuuuuuuucaaaauaacuucaaaaauuugaaaagccaaacucugaaacuguuuacaucaguaaauuucaaacaauuuuuuuaagcaacugagcucuuaccccuuaacucuccacaucaaaucucauguagaaccccaauauguagaacacauaaaaauggagcugcugugguucaaacagaggcaagaggccuggagugcccuagcacuccuuagccucccucccaguauacccacccacuacaaccccuguagcaccucuaaaagacccaagagcucuacaaaacauauguugacaaccaauagucuagaugaaacaugagugagcuauucuuuugggauggauccaccauguccauauuucuuauuauugaugccagaauauucuuagaauaauuauuucaauauaaaccaaguuccuuuuaauaauaaaauuucucuuuuaaauaaagcauuuuaaaauacaggaaaaaaggauuauuaauuuguuacuaauaaagcaguguuuucacaaacaaguuugauguauaaaaacuguauugcagucaagggcagggacucaccuacagaugagcuagaaggaggauccuggcugguggaggggagaucugacucaucagaugcuugaaccggcucuucuuccugcuggcuaucaauuucuaggccugcuucugaacuaauacuaaggaaaagaaaaaugagaaaauacaaaacugauccuacagucaaucauaaauuauauccacucuuuuaaaucuauuuuaucacuuaaguaauccagagcucccuuaaacaaaaaauuauagacugauuugguuaccauauauauuuuucaaaggagcaggggggaaaagagcucaaauuguuuuuuccucauuccuuuucucacuaugacauguuccaauuuuaguuuaugauuuuccucuucuuauguuuccuuuugacaaggauguucacauucuugacacucauaagaaauauaugguccagauuuugauaaaucucaaaacaacauuuuaggaaagcacaguacuauaaaaaguucacaacagucacacuacuaaauaguauaccaguaaccaaaccacgggcucuagcccagaugagauaggcuauggguauguaaaauuccuggcucaguggcuacauccaucuuucucucuuccauucaagacacaaaugagggagacaguacaagaauaacaugaaucugcuccaguuuaagucaugugaaaauuucaguacaaaaugacuacaaaaauuagccaggcaugguggcgggugccuguaaucccagcuacuugggaggcugaggcagaaaauugcuugaacccaggaggcggaggcugcacugagccgagaucacgccacugcacuccagcaugggcgacagagcgagacucugucucaaaaaaaaaaacaaaaaaaaacaaaacacaacuuugcagauuguuucuuggcuaaaggaaaacaaauguacaagucuguugagacuaaagcaagcaaaaacaacaaaauaaacuuuuacccuucagauucugccuccacaaauacuucaucuccaucaucaccuguugcuguuucauuuguuguagauaaagugccaguggauguagucaccauuggaacagauugagaggcauguuccgaagcaucagagguggugcucucaguaaauacagucacuuuaaaaagacaacacaagaaaaagaacuuuaaaacuuugugguuuaucacauuuuuagccagaagauacuucauagguuuucauuuuaccaauaaaacagaaccuacuaucugccuuugaucccuaccuggggcugcuacuuguaguggaguagugggaacacuucggccaccugacucuucuucaugagcuaggaacagggguguuucauacauuccuaaaccuaaagacaauucugaauauuaaugaaugacugaaaaaaacauaaaauuaucaacaagucagggaugugaaagaaaaauauuaauuauuggagauauacaacuuuacuaaaguccacgauuuaauuauuccaucaagcaaaaauccaucucucaaacuuuuauuuuuuauuuuauuuuagagacagggucucguucugucacccaaguuaagagugcagugacaccaccauagcucacuguagccucaaacuccugggcucaagugauccucccaccucagcuucccaaggagcuagggcuaccaacacagacccagcuaauuauuuuucauuuuuguagagacaggggucagucuuguuauguugucaaggcugcaccugaacuccuggccucaagugauccuccugccuuggccucccaaaguucugggauuacaagugugagccacugcaccuggccucaaaauuuuaaauacaacuuaaagacauccuuuaaacuuucuaaugcuacaguacccuuaaaacauucgcuaaaaugcucuuaagaguuucauacaagcuaauuuuauugaguauccaacuauggauguuaauuacaaaguaauuaacaaaguaauuaccaagguuacuaagcuuaaaauguuggcauuccaauuuaagccuagaugcccaagucuaggaaacuguauuaacauacaaagucacaaaaucacauaacauuuuaaauuuacaaagucaacuuacaauuucauauaagaagaggccuucaguguuagaacuaauauccuaaacaagcagauguuacauuacaugacuuuuaugauggcuaaagauugagcuuauuguaauaguaguaugcauucucuauucauuuaccaagugccagacagcuucccagaaauaaagaggguaauaugaauuccaacugaggauuaaaagguaaucaauuccacaaacagcauaauucacauguggaaaacuagcuaauucuacuacuuaauguaguggccauuuuauuccacauauuuugaucuuuuauuuuuuguuuuuuuaaguaauguuaauacaaaaaauauaacuagccuuauacauuuaauuagaaauguuacaagugucaagcuguaaacagaaaacaugcugcauuccuuccaacaacuuuaaaauggcuaguaguaccuauauuuauugguucaacacauauuccugaauacuuaaacuacguguaugacauuacaccaggagccagaagagauacuaauguaaaagcuaauccuuaugcucaaagaaauuagaacuuuguuggaaagauaagauguaaggcagugcuuaauaaguauacuacagcauuuaaaaaaauaaauuagcaaacaauaucaauuuuaaaaauauucauauuugcucuuuuuccccccuuaaaucacaucuuaauaguuuauuaccaaauacauacaaauucaggggaucuaaagguuuaacuauuuaccuccuugagaagcaagcuggccaagaucagagugacuagaacuuguuuguggcauaucuucagguggcccaaaccggaaucuagggacaccagcaaccugcggcgaacuaaauggacaaaaacuaauuuaagaugaaauuuaaaguuaaccuauuuaaaccacaauggugaaaaaaauauaggaagaaggaagaaugaacaucaacaaacugggaaggaaacagauugaaaauaaagucuauuuauuuuaaaggguuucuuacuuauaaaaauccuuuuauacuaucagcugucaaugaauuuaguaauaagaauaaccugugauuuauauguaauuaauuuucagcucuccugaacuaugccucacauuucuugaaugucucagauauccucacauagauaaacugaaagcaacacaaacucaacauaaaacauaacaaaaagaguuguuagaaugaagucaugagacaaaguuuuaucuuaguuuucauuuggucauagaaaaaucaagucaccugucuagcuuauuaagaguucacuagcuagcucccaagguuuaggaaaauucuaauauuagauagcuaaaaacuugcuuucuuuguuauccuaauaacacuaucauuuaucuuucugccuauaauucaggacauaaaacuuagcauuauuuaacucugccuaucuuuccuuagcuagugagcuauuaaugucuuuaggaaacauggaguucaggaaguggugacuucuagaggcacagggguagugacauuuauuugagugaaaaugcuguugauugcugguacucagaauucugcauguuuauuggagugagucucuuccugagugcugacuuucagaaggaaggagcugaaauugauuggcugguuuguaagaauguguuagccaagguaaauuguggcuaacugagcaaguuuaaaacugguucuaaccgccacauguuacaucuacagaacaaucaaccuuuccccaaguuuguagaaauuuuuaaauucugaucuucaaauacauccuguuaagcaacuaauaccuuagccacgaauaaauguguauacuuucacacggagagccuuucaaccguuuaagaggagugguauagcacaacacuuagcauagccucuacagccagacuaacugguuugaaacuaaaaacugcaacuuccuugcugucugaccucuggcaaauuuguuaacaugucugugcuucaguauacuauaagaugacaacauuaauaaugucuacucucauaaguuaugagguuaaauaaacuaaugcaugaaaaugcucaauaaaugcuagcuauucuuucccaagacugaauucaauaucauccgcguuaaaucaucucauauucuuucucauuaguuguugaaauaaauuacuucuucauuuguaguaacaaagccuacugcuuauuccucuauuauccuucuacauuguuuacauuacaguuaguugcucauuugcuuagcuuucacaagaauacuauaaauuaugaucauuguaauuaccaacacuuaaucaacaacuauaaagcaauuuaucaugugucagguaacaucuuaaacauguuaacacaaauuaacugauucacuuaauucuuauaacuuaugcaacagaaauuauucuauuguuauucccauuuuuaaaaugaaggugcucaugaacagagaaccuaaggaacuugcuaccgcuaguaaacaguagaguuagguuucaaacacaggcauucuaacucuagaggccauguucuuaaacauucuuauauugucuuuaacuucaaaauucuugguagaaguaacuguaugucauucaccucuguauaauuuuccccaacaauacauccucaacugaccuaccccaaguacuuauuaguacauaguagagagggacucaacaaacaaugaguuaaccaaaugauaaacaaacuaacagagaaagacuaaaaguuugauuaguuauaaaguauguuucucuuucauuaacuuacugaauugcuucagcaaauccaucaguacgauguggcaccacaagaguuggaguacuuggaacuguucugucuucaucaucaaaaaaaugcuguugcuaaaacaaagaaaacagaguuaacaaacaaaacaccacacauauggacuauauaaauaucugcucaagaaaugaauuacuuuuacauaauggguaaguacuuaccaugccaccuauuccuggagucaacugaaggccacguccuacagacugccuucgggucaucugaauucucugcgugucaagauaaaggaauuacauuugcuuuaagaaaugaggcaaugaaacaaacaccaaauaucaacagauacagcuuauuacgcugccaacaaaauaguuagcagacagguaauuaggacauuuucccaggaaaaccugccaagaaaucacuuuugucaaugacaaauuuuuaauuauagucuauaauauuaaccaauaaaaaucauucuauuaaccaacagaccaauuauuaaccaauacuuaaaacagaucuaugauaccaucuuguauguaaacaaauuuaauuccuauuuccuuaguuggaaguguuagcaaguauucuuuuggaguucaaacagcaguauuguuuuuuaaacuguuuuccaguuaagauaauucuaaauggacagauuggauauauuuuuguagccuccauacaggauccuuuaagacuuuauauuuucccaucaugaaguuauuuucacuagugguauuucaguagaaucuauauuugacaguguuuacacauacuauuuuauagggaaaaacuuaagcuaaauuaauagaacuuuuguacuuuuccuacucuuuuuccaagugcuucugauuaagagaugcccgacccuacuacaugcuaaauauaaggggucauacauaccuucauuaaacuuaaaaguuaaaauaugugauuaccaagaaaugagaaaaaauauucuucuguuaaguacaacagaaauuccuuuaucuuuuauaaauacgugcacuguagagaaagaaaccuucaaaucagauaauggugagcugcgaaaauguacuuuaauuaaaacccaagaaaaucuuuuucuuuucucacuugagaaauaacaauuuuauuugcuaugacuauaaccauuucaauguaugcacaacuuuuaguaacacuugccuuucuaaacaucccucagagauuaguuuuaguucaaagaauuuuauaaaaauaugccaaaauaccaaaaaguucaugggauugcuaauuuaaaaaaaccaagagagagagagaaauacauaauggaaagggagaaaagccaagauuuuuuucaaguucauuuuucauaaugaccaguacuuuuaauaccugaacugguggucccaacuccugagguggggcaugaauggucagucuugggggaaguggauguggugggcgucucggugacugaggugcucgaggggccugucuuucagaugcugaugauggcuguuguucucuagaaaccuccugagaaaaagaagauucugcagcaccuguauuuccuucaccuguaggaaaagagaaauuuacuuuugaacugcuaaauuuaccacaaaaaaacuuggacaaucccuagaaguauaaaucuugccaacaggaauguucaccguacgaauauuuucagaaguaaaguagugaggugugauggaagcaaauguggguuuuacacccagagacaaugggauguguacuuauucgcuguguggcuuugggcaagucccuuaaccucuuugagucuauuuuuugguugguuaauagagcaaauguaaccuccaagucugguguuucuaaaaugguuuuucuaaagauuucagauaaugaacauaaagcucuuagcucgaccuaugauaaacauuaaaaacacuaaaauuaaaguaaacauuuaauaaaauaaaauaaaacuaaaauuaacauuuaauaaaucuggauuaauuuuaauaaaguagacaaauuaccuaaagguuagaccauuagagaaucaguguaacaaucaaaaaggauaaagacagaggagaagccuuacaacuacauuuuaaucuuuugguuuuccugaauuuugaauuuuaacaaaugucucucaaaugucuggguauucuucuacauacacuguagcaacaaaagaagccaucuucaacuaugaaaaguugaacaggaugucacagaauuucauaguuuaaaagucugaggucuagauucagauccuugcucuaauacuuaagcuacuuagcuacuuaguaagcuaugcgacaccucaagucacuuuacuucugcgauucagauucuucauugauaccuaaaccuuauuaaguuuacuacaagaauuaaacaauucaauacaaguguaguugcuugaaauguacucaaauccauccauuaauuuuguucagggcacuaggccuauuuuugcuugguugcaaaaauaaaaauaaaaauaaauaggaaaaagaaggaaggaaggaagggagggagggagggagaccuagaggagcaaaaauuccucccucuauauuucaacuacgugauacacaaaaaauguuucuuaaccuacaaauuguuuauaaauguaaauuuuuguucaaaguauaucaauuucucaucucccuuuaaaaguaagaauaguauuaccuauuauauggcuuaauauucauuaauguauuuuucucuuaaaaaauuuaaaaguuuugucuguucuuuaguuaaaaugagaauauaucuugcccuuuuaaauacccaggccucuacagaaacccagauacaguauuuucccauuagucuaaacagcuaagguuuuacuaugucaacacuaaugauuucagcuuaguaucaguuguuaguuaucuauuaccagauaaucacuaauuauuuaauacacauuucaaaauaaaauuauuuucuacgacuuccauacucuuuuaaugcccacaacuuuucaguggaccuccaggacuuauccaagauuuaacaaaauauaugcuauauugauccaaaaaucuuuuauucauuggaaaagcagaccauacugcaaagcuccaauagccccaaaucuugaagcaugcagcuugauuagacugaccuccucugguugugaacugcuguuacaaguagucccuaauuuaauuuuuccucuuaauggcagcauauagcauuuauaauaccguaaggguuacaaaauguuugcaucuuacagcagcccaaugaggcagaaaagaguauaaugacagcaccuaacaaucauaaauauaguagacuuuuuaugagagcacaacagucacaaagcuagaacaggggccaaucucuuuuuaccaauucaauaaauaaauuuauauauuagaauuaagugcaauucuaguuuagaaaauaccagagauauucaauucaaaaaaggcuaauaaaaaucucaccacuguuuugagaaucagcagcucugugauuaccuucaccuccacccauacuuucuucuguuucuguaccuggaucagucccaucaccacccuaaaaacaaaacgugguaacauaaugcucaaauaaaauaaauauguuaaaaaaaccggacagaauaauuaaccaaaccaaaccacaacaaaaacaaauaaguaaccauaacaacaaaaaacaaaacaaaugaacaaaacaaccaaagguuuuagugaauuucauaagccuuucuauauccuuggaaaacagcaagugaaagaaagcucauagaaagaacuaugaaugguuaaaauucuagccaguuaccucagcaucaucagcuucauaaccaucauugccaucggcacuaccaguuccuucauuacuaucuucacccucaucucccaucccugugucaucuucaucaucaucaucaucuuccucauccucuucauaauccuaguagaaaguuccccaggcauaaauaaaaguuuagaauauggcccacaugcucugcaugucuagauaccacacuuagaaauuuaagugacucauuaaucagaagauaggaauuguccugagaguuguaugggauuaguacagcagcaccaaauaccacaacugugauacuuacuggaauuagugcaauaaugaucaauucugaauucuaacuguuugcaugagauugcucaaagauaauauagaccucaggugucagcaaaauaucaagugguccaguuuaauucuaaauuuaaacagguggaguugaagaaaaugauaaaauuacacuauaucaggagcuauuuaaaaaauguuuauuaaucuaaaauaagaagcugucaauauaggauuaaaccccaaaauaaaacaaacaauuugaccuuauauauauaaaauacacuuuauauauaaaaaaaugacaaaaaugaacuauggggcuccaagaggaaacaaaaacaauucuuguuucuucuuuuuaucuccggaaaccauagcacuuacauuuaaagccauacagucauuuaucaauaagacuuaaaauuaggucuaauugauaacaaauccuaaaagacucaucaauugucaaaaaaacaaaaugaaacaaaauuuuaaaaaugggcauuccaucacuggcucuacacuaauuuucauuauaaaauguugauuucugaacuaauuaagauagaagaaaaacaauauauauaaucuauuuaauauauaauauauuaaauauauaauauauauauuauauauauaaauauauauaaauauauaacauauauauuauauauaaauauauauaaauauauaacauauauauuauauauauaaauauauauaaauauauaacauauauauuauauauauaaauauauauaaauauauaacauauauauuauauauauaaauauauauuauauauuuauauauauaauauauauaaauauauaauauauauuuauauauauaauauauauaaauauauaauauauauauuuauauauaauauauauaaauauauaauauauaauauauuaaauauauaauauauaauauaaauaaauauaaucuauuuaagcugacugggaaccagaauuuacagccaaugcauuaguaucccaaggauuugagcacuuucauccaauaguuuaaaaacacuagaugauuucaaaucaaacuuaccucauguucuccaucauuuucaucaucauccucuucuucaucaucacugucaauuacaaugacaucaucuccuuugccuugaccauccugggaugaaguugucgucugcugaucugauugaaguggcccaagaucuauuuguagagacugagagguuucuucacugucuuccauagguguauaaucucccuggguaacucccuuuaaaaauaaaaaaguuaaaaaagaauuaagagcccuauaaacauaccuaaaacuauaugugagguauuauuauaggucaaaguaaagaauaaugaguacuuauggacuagcagcauuuaauuuaauuuuuuuuuuuugagacagucucgcucuugucacccuggcuggagugcaauggugcuaucucagcucacugaaaccuccgccccacuggguucaagcgacucuccugccucagccuccugaguagcugggacuauaggcaccaccccacgaagucuggcuaauuuuuuguauuuuuauuagagacaggguuucaccauguuggccaggcuggucucgaacuccugacuucaagugaucucccaccuuggccucucagaguacucagauuacaggugugagcuaccucagccagcuacauuuaauuuuaaaaauggcauuucaaguauuuuugaagaaagaagaugaaccuuugaguuuccuuaaugucuuccuauagaagaauuaucauaaaucuuauugguuaauacuccaauaagaaaaagagaaaaaaauauaaacaaauauuugugcauucaaaacuacuagcgugauaucgcguaucagugcugugagacaggaauaugucauguaauuuuaaauuuguuaguagccacuuaaaaacaggugauuaauaauauacuuaaccaauauauccaaaauauuauuucaacauguaaucaauguaaaaauuauuaaccagauauuucacauuuuaaaauuucuacuaagucuucaaaaaucugauguauauuuuauauuuguaucaauuuggacagccauauuucaguugcucaauggccagggcgguuagugcacaauacagcugcagaccaaagucagaaaagaaaaaaaaaauacucaugggucugcaauguuuaaacagaagguuuucccaaacuagaacuaauuuggaaaugcagugaauaaauaagcuauuaccacugucuuuuuacaaagaaaagcacugaauacauaaguuaguaucauuguccuuuuacaaagaacuucuucccuccucaaaauuccaauuauuccaagccuucaaaccaaaauaaauauaucagauacuaaauaauuccuugcucaaucuauuuccacaauucuauuuuguuaacuacugaaauaaacuauuauuuuaacuucauuuauaauauuuacuaucaaaaguuaaaugucuuuuuggcuuaagcacucacuaaaaucaauuuuuuauacaagcuagcaacaguaucuuuuaaacuaagacauucauaaaaaauuacauaugccguaauggaaaaaaugaguaagucaugguauaauuuaaaaagugccucaaagugacaugcuuauuucagaaaaagcaacacuugaaaagaacgucugcuucacugucagaaaaucagaaaaaugaacuguuacacauucaguagacaaugcuagagggguggaauaaaaauccaaaugguauuuuggagucacagacaauuuugcuaauuucaagaaaaagcuuuugcagaagauuucaguauaauuuaaccaagucugacaagaaggcagaaaaucuuauuauuuucaaauuguuauguucuucagaaacaaugcucucugaaggauagaugaaaaagauaucauuuauaguacgcucugaauaaguuauuuaaaaugcuuggguccagaaguguuucagauuuuggauuuuuuagaauucuggaauauuugcauauccauaaugagacagcuauaagaugcaagcauaaaugcaaaauucacuuauguuucauauacaaagguguauacacacagccugaaguuuauacacacagccugaaguuaaucugacacaauauuuuuaauaguuuuguguauaaaaugaaguucuaacuguuuugacuguggcccaucacaugaggucagguguggaacauuacacacguggcuugcaauguuggcaccuaaaaaguuuugaauuuucaaauuagggauguucaaccuguacuacauaaucaucugaagauuuaguuuaguguuuucagucaaagaaagcugguaaaauuaacuuacaaaauaaacgcagcuaagaaacuaaaauuuacuugcgauauggcuauuuaugguuagcuugagacaauuccuuaauuuuacaugauaaaauaauuauagcauaagaugauccagaaaguuuauacagacaaaaguacuguuucaagcuuaggacaguugaaaacuacacagccuggguuugaaucugagcuccaaugcuaugugaacuucgguacacuacuuuaucuggguaucaguuucuguaacuaugagguauaaugaagauuaaauuaguuaauaaauaaaaauuucuuagaucaacauuuggcauauaguaaugaguucuguguuaaauauugauauuuaauuacuaucauacauugugauuugagagaccaaaauagaugccauuuucucaacuaagacaaacccuaagguuaaggaaacaaaaguuacccguaggucaaggguucagggccugucuggcaugguaaauuucuaaauucauaugguuacaauaaaaaaauauaagccuuugcuaaacuccucuaacuggaacuaucgggcaaguuaucagacuccuaucucugauuuacaauccagaccacuacaacucugacuguagagagcacuggcaaggaacugcagacaccuuaagcuaguuucaaccugcuuaaagaggcugcgcacaaacugucuuuguguccuguaguucaccuuuuguucacucuucacguaaagagccaaauuccagcucauuuucaugcuaaaacgcugccccaaagugaacaugggauguauauuauauauauuuaccuacuguuuauaugcucaguuccccucauaaauauguauagcguuuccccaaaaccugcugaauaugcaugacucuauuguguaauaaggacccugugaggcauaaaaccacaccugucccugcccugugugaagacagaacaccuuugguccacgcuggagacuauuucuuccucaugagcaaaaugauaucacuaauaaagcucuccuuucuauuaaacacuauuuagccacccugggggucuucuugaugacaauaugaauucucauuuugugggacagaaggaagaaaggaaaguaauaauauucugagugccuaauauguggcagguacuacuuuagguauuuuacaauccuaaaaauuauauuuuuugacaagugagacaaugcagggaauuaaugauaugcuuacagucacaaagcuuccuagugguggagcuaggaaugacaccucaugcuuuguaacuucagggucuauauucucuccgcuaguaaaacugcuaggggaaccucaaugagagaucaaaaaaugaagagguauauaaaugcauuuccuuuuauggauuacuuuaauucuguaagggaaauaauacaggggaguaagagagaaccagcaaauggggcacuauaaauuaacucaagaugcaaccagcacucuuguauuucauguaauuaaaauagggaaaaaucuuggcucacaacucuaaaaaaucuggaaaucugugcuauauaugaacaaaaacauuucuuuaauauaaguuuagaaggcaguacacuauacucauaggaguaaaagaaagcagacucugcaaugauuaauucuaguaguauuucauuacauauaauaagaacaagcuaaaaaaaaaaagaccaaauaauguuucaauuugucaaagcuaauuucauucacgaaaagcaacggugugguacuuuagguauguuuuuacuuacuucuccaauggaaucuugagaauccugguuguauaccugagucucuaccucuccaucaguacuuucuucugccauaacuucuuccuguaucauaauacacuaauauauuaaccauaucaguguaguagaugaaggguuaccuguuuuuguuaguucucucauuugaaaaaacccuucaaaucuauauuuuaugaaacuauagaaaaauaaaaaaauuuuauuuaaaaauuauaaucacauuccuccucaguauacacaaaguaagguuuaugaacauuaauacaugcuaauacaauuaauuuaguagccuuaauguuugauuugaaaccugcuucauuacaauuuaaucuuaaccacaaaaaggaauauaauuuuggcuaaucuuagaaaaagauagcagguaacaguuuauguccaugagacuuagaaacuucgagaugaaauucaacuuauguuuuuaugacugagcuuuuuuauugaaauagaaacaaaugcaauuaaagauaugcaagaauauaaaacacuguugguaauaauaccuggguugucaguggaaucuuuguagaaaguucaauaaaaguguuuuccagauaauauauuuuggccccaaaagguuaauuuucuuuaggcuguagcugaaaagaguaccuuaacucuacugguaaaaguuaaaauacacagaaagaacuuuacgcaccucaguuccuacaggugugacacuuuucaacuucuuuggaagaggcauuuccacuguaucaucagagacuuggucugaugcuucuauggugcuauccucuuccucuucacguguacgcuuuggcaaagaagaacuggggguagccgaaacuuugaaauuauauaaaucuugaauuagagcaugauaauaacucaauuuagauaaagauaguuuacccaauauggucacuuaacuaaaggagaacacaguaaacauuuaauuguacagauuacuaaaauacaaucaaucaacuccuagaucaauguccaucaacauaauuuguuucugcuaagcuauggguaaacaaagagcaacuuaugcucugagucaauguuuuuauaccaacccaagcuuugcuuaauaaagccagccaauuuuuacaauauaucugguucacugagauuguauuacuauguuguuaucuacaaaguuuacaugggaccuucuauaaaacucaggacuccuugaauaagaaaaaauguacacuguauguaaaucaguauauagucuuaucuuaggugucuuuuaguccucaggacuuccguuaaauuauauacaauguuuugcauuaauauguaagaccaguaaaaaaaauaacuggagggggagaaucaucuuaaugacaaacaacugauuuaaaauagucauauucaguaguaaacaugaaauaaaauguuaguaauauauucauucauucuaauuccugguagaaagcauguaugcacaaagaauacuugugauacguauuauauccaagauauuauaauugcguaggucuauucuaacuucauuuguacaaagaauacucaagauauauauacucaagauacacucaagaucuuauaaaugcauaggucuacucugacuucauuuuaaaauuaauuuuaccugugccaaauacugcuguggaaguagaaggccgcucaacuggugaacucugaacaaccucuacuauguuugaagauaacucuugauuggcaggcucaaucugaggaugacucuguugaguggguugcacaaaagcuguagccuguguuuguugcugaacaguuaaaauagguugagagauagaaggcuggacauuaggacuaguagaacgaacggauccacuugugcuuccaaaaacuggaacauguuccacaggcccuucugacugcauagcugaaaaauaauuauaaugcugaauauaagccuucuacuuuuaucaaagcugaaauuauccuuccuauucugugguacaugucaccuuucacacagauuuggcacuugguagacaaauacauuguagguaaagguaauguauuaugcauuuuuauauucccuauguaauugauaugguagcaugcaauaaaauguugccugaauuaaauaaauaucuguaacugauuuugcaucuauucauuuaaauuacuguugaauaaaauuaaugaaauuaagcucaaaguaaaauuagaauuuuucauuaagcaucauuuaguuuuuaauugauauaacagauaguaaauuugauuaguaauauauuuaguuuauuggauguagcugaaauaaaacauucucuacuuucacagcacagaaauacuugaauaauuuacugaauucuaacauuugucaagauaagaaucuaaggaaauaugcagguagcaaaguuuuacugaacaccuacuguggaguuagguaaagggauuaaacaauaagaagcugagauuuuugcccuugaggagcucaauguaguggaguaaaaagcauguauaccacagaauaaaauacaaaguuguaauugcuguaaugaauaacaagagugucaugggaaaaaauugaagaaagcaaugaaauggucaguuucagugagaaagcaauguuggauugagccaguaauucaguaugauuuuccaaaguggauuucauauauucuuugucauuacaagugaaaauuuugguccuagaaguauguccuucaaauauuaaacacccauuuuuacaaugacgugacuucagcuguaguggaugcuucauuugucuuugaaauuacugucaucuucucauaauaaaucuaaauaagcagucucaucagaucuguauuauuuuacuaaccuuccugugauuccacuuguguagugggcaucacuguagcuguugggguaguagugggauuuguaacaguugcagguguaaccauugggcggauacuagcccuggguguugacuuauuuccagccauagcugcagcugucacuuuacuuggaguagacacaacaggaguuggcuugauauuggcuguuggugggucugaugugcuggcacuuauagaggagaaaauggaagaauaauuaauaacaaauuauuaugcaaauacuuuuaaaaacacagugaguauaggucuccauuuuuuuguucacuaaauauuucagagccuuauuaaagcuguuuugaauuuaagcauuaaaaacuacacagggaaugcuccagaguggugcauccugacaauguaaaauguaucuagcuguugaauugcugaacccaagucucagcccagcauuuucuaucugucaucauguaacaucacggggaaaaucaguagcagccuaacuuagaaaccaacuguaaacuaaaagaugagagacguuuucucugucacaaagcuucaucugauaggacugaaaguauggugaaaacaagcuggcaaauacaugauacaguucugcagagaaaacaacucuuuaguguauguuuuuacaauagaauacacagauuucuuuuuccuaaacagaaagaucacuagauauucccugagcuuuaaaagaaaaauaacagacuaugaaauaacuaaaacucacauuccucuuucaccagaagcuggaguuguuuucaaugugaucugucucugcuguucagggaccuauaaagagaaagcucuugauuguuguuccuagcccacaagaguccacuaaaaaugccacaaaaaaauugucauuauuguuaauucucuccgcauauauugaauuuuagccaaaauucacugacaaaggcuccuauaucaccaagcacuuucaaguaaaauguacaaagaaaaacaauuuguuacuuaagcagaauuagcuaaucaccuuauuagaagguucuugaggcucaucucucugcucaaggugucucucuugaugcucccugaguucucuuuccaagcgacuaauucgaccuucauauugggacuuuagcgcaguaaugcgaacauccaauucaucuuucugcugaucuaaggcuccauuccuuuguuuaagcuccucauuuucuuuaguuagcugaucuuuuacaccuaaagaaguaaccaggcgauuauauuaauauuauaaucaaacauuuaaaacagcauuuaugcacuuaauuggcacauggucacaucagauucuacuacuauaacaucuacauuaguuaugauacaucauacaucucaaugagcaaaguucuaaguacauucaugcuuuaacuuauuacuagaauauaaaauauacuuacuccaacauaaaaauuuacuuuuuccuaacuaaaaucucaaaaagcuaaagauccuaguuaacagaagcccguuuauauuucaauguaucaugcaauucauuacuaugaauugcaaaauuuuuauuucauauaaucuacagcacuguuuaaaaauaauucaagaacuuuuaaaaucaaguaaguuguuaggacacugucuuagagaucauuuuaaaaaaaugccuguaacaaaauccaacugauuugacauuuuauuuaacuacucagcagacugauaggcaaggcugaauaaagcccugagccuugaagaacuagguucuucauaaauuugacaugauacucucccugaaaagcuagagggguccuccaccaaacgaggcacaaaaaaaucccugggcugguaaagaucuuuaugcagucuacauaagguuucuagacagcacggucugggcucaaaggaucucugucacaagauagaauuguuauccaugaaagcagaaggauagcaguauuccauuaucuacugccagccaacaauugagaaaaauuucaucauaucaaggauauccucaucacuugaaaauuaggauugcucuuuguguccaacuaauuauuccuaauauuuaaagcacacauacacacacaaacacccuucauaaguagauaccuuuuauuucuauuccauuuaguuuuaggccugcaacacauaaucaacuuucacuaccaaguucaaacuuuaaacagauauuuaccagcuaagugugcaauuuuugacuuugcugcuacaauagccuuucugguuuuuucuuccuuuucaguuaucuguugucggagcugcuccuccugugugguucuaucuugaagauccugacgaagucgugaaaguucagacugaaguugcacagucuguuccuggagauuucuugcuucugucucuuuuucagauaaugucuuuaaaggaaaacaaaguauucaccauggaauucaaucauuucaauauaaacuguaugugguagcaacuuaaaguauaacuuauuaauuugcuuuuuaaaagauuaaauggaaguauaaguauaaaaaugguggucagaccaacuaaaugcacacuugaagaugauuggguacuacuuacauacaugagccauucaaaguaaaaagaauaaaauguauccauucccacaugguaagacaaagugucaguaguuaacacauauuucuuuagguguauaacaggaaagaauuaggaacagacuguucucacacucauaccuucugcagauucucuacuugacuuucaagugauuuugauuuuguuucagcuugguugagcguuucuuugaguuccugcauuuccuggacugaaacaugcugcuccugauggucuccagaggacugagccgaugucuccauaaccuaagacaacaaacaguaauaauacacucacauauuuauauucaguaauuccauuucugcaaguuugucuaagaaaauaaucacagcuuugcaaagaaauuuuaucccugaagguauucaaaacagaauuuucuaugaaacaacuguaaucuccaaaaauggggaacuaguuaugguuuuccacauaacugaauacuaaacagcuaaucaaaaugaugcauuauaguugaauuuucaacacuuaacuguauuuucaugauaaugaaucaagugaaaaaaguauacaaaagaauauaagcauauaauauuauuucuuuggaaaaacgucgcuuacauguaugaaaagggauacuaauguacuaauaguggcuaaaacaaagggguauuaauugugaauuuuuuuucuuuauauuuauuuucuaauccaacaugaaauaaauacauaauucucaacauacaaauuccuuaccuucaggaauuaaaaacaauauuuagauucaaaauauaaauauaacaaagauuucugaauuuuuuugauaggugguuaacauaaacaauuuauuuaaaacuauacaaaaccagauuagucaucauuuuuuaauauacacaauucuaauuagcaaugaguuauaagaacauagcuuugaaaauggagaguauuugaaaggugaagacugaacuaucuaguauuuaccaaaauuugugaguuuauaaugcauuuucagacauauuaaagaacuaaucuuaaauaaagauaucauauaugcuuacacgauuucgguaucuaaaagcuaguaauauucaaaauuacaaagaaauaagauuucauaacauucauccuaguuuuuuuuuguaagauaaguuucuucaaaauaccuuauccuguugugcuuuaaguucuucauauugagucuuguaccuacguccaauuuucuuaacuugaguaauaguuuugacuuuuucuuggauaucaauuauuuuggcaucuaaguccuucuggaugguuuccuuuucaguucuuacuuuauuuagaucuuccuucagacucugaauuaaguucugguuguuagucaaagaugcauuugaucuuuaaaaaauggaggaaagaagaaagauuaaauauaugagacauuuuucaaaguuugaaguccaauguaacuuuauguuauacugcuuuaauaacuuuuuuuuuugaaaauccuaaaaaauacccauauacuucaaagguaagaccuuacgaauuuacagcccuucggcaagaucuuauuacauagguuuacaugcacauuuuagagaugagaaaaacagagcuaccaauggucaaguaacaugcgcaauuuuacaaacuaaaaucaagugaugguacccagauuuuaauucagacuugcuuuaagagcaaaaccuacccucuuccuacugcacugaguauugucaaauuuuuucuguaaaagggccggauagaauguuaugcuuugcaagccacaaagucuuugcuguauuuuucuuaaacaaugcuuuaaaaauauaaaaaucauucuuagcuuauaggcuguacaaaaccaaaucaugggccacauuuggucuaugggcuacaguuugccaaccccuguccuauauccugaacugaacuugaaaucagauggccugaauuaagaguauggguuaauucugaacugaacuugaaaucagauggccugaauuagguagucaaucuuuuugaaucuuaggcuccucauuuuuaagauuaaaauauaacucuccuacuuaacaugcuagaugauugcuauaaagagaauguacguauauauaucacaaaaauuuguaaguuguaaagcaauauauaaaugggaccaugauauggacaaauuacacuaaagcuuacaaaagguaaaccagaaacauuaauuuuaauguuuaauuucuuaauuuuaaaggggcaauacuuugcuauuaguucaugugagaaaaaauuagacuuacaagcuucccuuggccaggcaugauggcucaugccuguaaucccagcacuuagggaggcagaagugggaggacagcuugagcccaggaguuugagaccagccugggcaacagagggaaacacuguucuccacaaaaaggaacacaaaagccaaaguaauaaaacccacuucccuuauagagucacaaauauaagcuaaccaaaagaaaaaaaaaaccuccuuguaaguuuuugauagcuguaaauuuagcuuuagacuucugaguagcucuuuaaaaaauaaaauauagagaaauaauuaugaggauagucucauauauauuuuauauacaaaggcauaauauuaaaucacugcuugacucuacaaaguagauggaagucagauauaggugcucuagcacuuuccauucuuucuaaaaccaggaggcaggcacuuggggagucauguaaauaaguaaaauaaacuucuuuuauauuauauaugauuuaaggcuucuuuccauauaccuugcaauuucagcuuuaagucuaccaauuucuucugucaauuguugaauacgcuuaguaugaacuuccuuuucagaaaggagcuuccgauauucuucuguaucuggaucuuucuguugacuuacuagaugcuagaauaacaaaaaugcauacuugauuuuuuuagguuuuaugaaacaaaugugcuauaauaaaauggcagaauaucugauuauguuuauauuagguguccugcauguaaaguaaucaagcauggaacuacaagauacuaagaucaaacuaagcuuuggcuuguuuggcuaagaagucuacccacaauacaagaggaaaaaaaaauaaaaugucauuaaauguucauuauuuuuucauauuugugaauaaacauuucauauuaguuacaaugaagccaaauaaagggaucugaagaaucaaaacuuucaauauuaaguaccuaauuucauugaagugacauuuacaagaaaaaaaauauagacaaugcauuacaaguuaaacacacaaaccuucuguagaugccagguaaugugcuucacauuuguuaaauuuuuaucacacgaaaggugauaagggaaaacuaaagcuccaagagguuaagaaacucucccaagucauauaaauaauacaugcaaggcagauuucuaaccuuuuguuugaauaaagggcuggaguuucgaaccacaguauguuacaugguuucaucucccuaaaaacguuccagugaacaagucuuuuuaaagugcuuuaauaaauucaauaaauuauacagauuccuauuuugcuuuuuuuuuuugagacagggucucccucucucacccaggcuagcaugcaguggcaugaucacaacucacugcagcuucgaccuccugggcucaaguaauccucugaccucagccucccaaguagaugggacuacaggcauguaccaccacgcccagcuaauuuuuaauuuuuuguagaguuggagucucacuacauugcccaggcuggucucaaacuucugggcucaagcaauccucccaucuuggcuuccgaaagugcugggauuacaggcaugagccaccgugucuggccucagauuucuauuuucauguauaaaaauauuuuagagauaaaaugaaaggcuaaaacuuuaaaauuauggaaaauaacugcuuuuuagaaauauauauaauauaaccaaaauuuuuuauaaauuggguuauaaguuuaacaucugucacguauuuacauguauuaauaacauaauagacuuucacuaauaaacacaguaauuuucacuaguuccucaaauauuuuuauuccccuaaguuuccccuauuauuaaaaacacguguuuccauguuuuggaagaguuuuaacugcauuuaccugguuacgugcuuuccaacguuugacauccucuucuaagagcuucuucucugccugcaacauaccgcuuuucucacucagcucagcauuugcuucuuguaaggguaaaauaucuaacuccaguuuccucaccugaaaaucaugccaauauuuaacaacaaauguaaaaauucauuuauuauuaaaaacaacaugcuuccacucuugauaacuaagcaacaaaccuuugcuugcauuugcuguagauccuguucuagucucuccuucucuucucuuagcauuuuauuggucuccauaacuacauucauuguuucaguuuucuucaucaguucuucaugcugagccauuguuuuugcaguuaccuaaacauuucaaauaaauauacauaccaacaucuaacaauaguugaaagucuaccuguuccuaugagcucaaauccucccuaugacaaaauaaagaggauuuaaguuucaacuuuuagaacuaaaauuuuugaaaguucacguuuacuuuucugugaggcaugcgaacugcagacuuuaaacaaauacaagaauuacaaagacaaaagugaaaagaugcuacaaaucccaccaacaaaguauuaacauuagguaaaaacauuaauccaaaucucuauuuaccuuucuguaucuuuuuuuccuugcugcacuaaauuuauuaguucuaaaauguuauucuaauccucaguuuauucccucuuguucagaaaucucucauuuugauccauuguuucaucacuuuggccaugagaaauuuuacugaauuaucugugaagaauuuuuuccuucucauagguuauaauuauccaucuucugcacuugguauuacuuucuucccccacuguuuuuaaagcuauagcauauuucaugguugccaugcuacacuguucaugcuuagacagacauuacauuacuauuauaauuuuuuuuuuuuuuugagacggagucucgcucugucgcccagacuggaguccaguggugugaucucggcucacugcaagcuccgccucccggauuuacgccguucuccugccucagccucccgaguagcugggacuacaggugccugccaccaccaugcccagcuaauuuuuuuguauuuuuaguagagacgggguuucaccguguuagccaggauggucucaaucuccuaaccucgugauccacccgccucggccucccaaagugcugggauuacaggcaugagccaccaugcccggcccauuauauuauuuuuuauauaaucuauguuacuuguugacucucuucuuccuguauuuaagguugguuucccccuaugaacucauucguaggcgggcauuuucuaguauuuacuuucuauagcccaaaggaauaaaaaaugaagcggaaaagacugaaacaauaugcagucuuuguuagagacucugauucugucccuuuuccuccaaguauuaacucuauugaacuggaggcucuauuauuuccauggugagauacauuugaauuaaacaggauauaauucuggaaccuuuagcuuuugcugaacacauaaaucccauaaaauucauuauuuacuuuucccuguccaaugguuucuucuuaacagucauuuugacuacucaucaguuaaaagaagauaaauguuuuaagaucuuaauuuccuuccuucuagagguggggguauauuacuguagcuccuaagaaugaaguaacucaacaauaagcuuugggugguagugugggguaaggagucaagcuugucuuauuaucauccauuucacuaccacagcuucuuuuccuuugguuguuaguuuuuacuacuuuuugcuccuugggugagaaagauauucuguagcaguuuaaaucacuuuauccuagaaugacuauccacacguauaauccauaacuauaauaaauuaagauagcuggaauuuauuaagcacccacuacauaccagacaugcuucuaaaugcuucaugugcacaaacucaauuaaaccucauuauuauccaaauauuacagaugaagaaacuaagagcagggaaguuaaacaauguacccaaggccacagcuaaugguaugaagcuagaaucugaaaccaggcaguuugguuacagagccuuuacuuuuaagcacuauacuauauuaguguuuaacaaaugcuuaaugaauuuacaaguuuagaagaaugcuuacuucaaguuaaauuuuacauuacguuaaaugguagagauauaaaugagugcuucucuuuugauuuaacaagugcuuucuuaaagcuuaguauaccuaccuggacuuucucccuuucagcauuuagacuaucuugcaguuccugcagcucucuuucuaaaaguucaacccuuugucgauaacgcagacucucaaccugagccaccucaaaccuaguuucagcaauuucuuuuucucgucguauaaaucuacaaaaauacagauauuaaaauuuuaugugaauuuuaaaaagccaacauuacaaaacguagguaauuugguaagaugacaaaaaucauugacuuuaauaacuauuacacguuuucauuaauaauaaauaauaaugggagauguauuucuauuuucuuuuauagacacuggcuuuagaauguuuaucucuaaaaugaucugaaaggcauuuaguuuuucaagagaaaacugcucuaguucuuacuaucagauucaacuuuaaagucacuuguuuaauauguguaaauguuaaaaguuaugaguucuuugacaaauaaaagaaugaacuuuauaucaaaaucguguauaaucuccuucucuaauuuauauauuuguaguuucauuucauaguuguuauaccacagaaaugaagcaguaagaacaugauuuaccugagaauuuccaaaauuuguucuugagauuuuccuucuucacugagagauacauucaguggaccuuguacaccuuccuucacagaggcaacgaccuugucacuuaauuuuucgaucugaucaugaaguaaucuguuuuguuucuccagaucuucacagcgacauacacauuuggaaacuucauccugcaagccaagagucuaucagaauaacagauuuuccaaugcauauuuaaaaaaaacaacuuggccaggcgcgguggcuaacgccuguaaucccgacuacuugggaggcugaggcaggagaauugcuugaacccagcagguggagauugcagugaccccaauaucacgccauugcacuccagcaugggugacagagcgaggcuccaucucaaaacauuauaaaauaaagaaaaaaacaacucuuucaauucaacagaacauucuauucagauuuacaauaauaccuuuaacauucucucucuuuccucccaagaugcuuuacacuccaacaacugugauucugcuuucuguguuguuucuuccaaaugcugacggacugaugccauuuuugaaaccugcuccuucgcagcuuguagagcuucaacaucagcagcaugcagcaucaauucucucucauacuuauucugagcuuccacagcuauuuuagccuauaagaaauuauuacccaauugauaccaaagauuaaaaauccauaaaacuaguuagcacuuguccaaagauacacauuggacuuuuuaaauaauaaaaguaaagacaaucuaaauguagcaaaauaagaaaauaauuaaaaguuaaugcuuuaguuacuuaauauuauaaaacugucagaaaugaagcuuagaagaccagcaauuuggacaaacuuuuugauauaagaagcuaaacauaacucagcuauauuaaguacuaaauuauagauccauugauuuuaaugaaauuuacuuugaagcauuucuucccuguauuacauuuuaaaauagcaauauacacgucacauauauauaggcaauaaagaauaguaagcaaaugaauagcuauuaacaugacacccaacuuaaaauaagaacauuaccaauaugcucaaauguacugcuaucccauccuaccauuuuaguaacucugaauccugaauuguuuuaucauuuccuguucauaaaaaaauuauaaaaagcuucaauacugugugcacauacauacauacacucaaaauaaugauacuuuuuuaacauuuuauaaauaguauauagauaucugcgcaaacuugguaaugcauuaacaauguuaucaagagguucuuguuuuguuagcaaagguugccucuaaucaacuguaucuguaauuuuauaaucagaucuagugaaggacaauaguaaaauaauuuuugcaaaugagagccaaguacaaauuuuagucuccuaguccuguuuuuauuuucccauugucaagauugcuuuguuaaugaauauugcccuauguauuuauuuuuagccuuccaucuauacuuuucaauuugucuugucuaaguuccacaaaaguggaaauuaucuugaauuuuuguaagguccaccaguucuuauaaugcauaaauauacuucaagaaucauucucuaggaucgaagcucauuucucaauaauuggcuauacuuacuuguuccugacagucacgucuggcuugcugcucauuacuuaaagcugugcuugcucucugaagagcuucuuguacuucauucugaacacuagaaaguguuuucuucaauucagauaacuaagcagaaagaacaagauuaaaaccaaaauuaauugcaaacuuacuuggaaaauacuguauuguaguguuacuaaauugaagucucauuuuuuaagauccaauuagcccaaaaaacugcugcuaaauuuaaaauguuuacacccugauauaaucaguuuugcaacuccauauccauucccuaacauuugcauaagucaagucucagguaggggcuuuuaaaaagaaccagugauaccuauuucuguaaaguagucuaaaaauuucaacgggaaauguauauagagguacagaaaagaguaaaacauaaaacuaaaauuuugccuauguguucaauaaauuucuguugagaugaacuaaauggcaacuaaugacuuaguugaaagaauucaaauccuuacaaguuaaaaaaaaaauuaauacgguuaaccuauuuaccuguuguuccaugcucucuauggcucuucuuuuaucauccugaaguucuuguuuuuccuucucuacuuccaucaacuucuuuuccaacugugucugaaauucagcugacucuuuuaaacgaacuucaauauucuuacgcacuucuucugucaccuuuaccauauuacaaacaguaggauauaaaaauuacacacauuuaaagucauacaauuauuuucuccaaaucaaaacuaauuugagaaguaauaaaauuaauguuuguuguauauuaaaaaaagaauccaucaaaggugauuagaagauucaacaacaagcaaaaacaccauauaaaucuacaagcauuuaccauucaucuuggcuacuggccauuuuucucuuuugaaaugaaauuuccaaucucucauuucucccucaauccucauauccacuugccaaauccaucuauucuacaaucgaaagguauuuuccucacacauuuugauuuauuuacaaugaugucaaccacaaaaggaucuuuuaaaauugaagcccuagacuauugcuacagccuucaaaaugaacacgguaucuuccaaucuaccacauuaauuuucuaaccagaaaaaagaaaaaaaaucugauuaugacauguuaaaaaaaucaauggcucuuaauaaaccuacagaauauaauuuaacaugauauucaaaaccuuucacauuugauuaucaacuacauuuauaacuguauccccucacuacucacuuuacaaauugucaucuucugaagacuuucuaccauggcugaggguucccaucacguaaaauaccuuucuacucuauuuccuauacagauaccuucauucaaggcuuugccugcacaaaugccaucucucuugugaaggcaugcauacccaguagacaaauaacaaucccuaccucucagucuccucaacauuuuaucuggaccauuccuacagcaaggauaaccuccuugcuucaugaauuuuguguguuuuuguuuuaucuggcuuaugagacucaaguacuuucacaagguuaaaggcaaugacccuggucuaauucauacgagugccuuaaaaaagcaguccucuaguuacuaaaaacaaaguuaacaaauguguugagauugaauucugaauucagaauuauacauaccuguuuuuccuuguucagggauucuucuaaacuaguaaccauugcuugauauuguuccacauugcucguacuuguuuugagucucuccuuuaagucauucaccugcucuucugucugucuuagcugacucacaagaucauccacaucuucuuuguugcuaggcugaccuaaaagacauaacagcucuguuaaaauuaacauuuucaauaguauuagagaugacuguuauaaagagcuuaugaaauuagcauuaagguucaaauacagauauauuuagaaaguauauuucaauccaugccgaauaccaaaauaaaagcagguacuuuguuauguuacuuccucaaaaacaaaaaaauucaaauauuaauauuuuaaaucuguuacaaaaauuaagaaaaggauauucaaaagagaacaaucaaauauuuccacuaaacugaguuagcuauaugaagaaaugacagaauucuuaauuuauuaaauguuacgggaagucagggaccccgaauggagggagcagcuggagccguggcagaggaacauaaauugugacgauuucaucuuaauauggacauuuaucaguucucaaauaauacuuuuauaauuucuuaugccugucuuuaaucuguuaauccuauuaucuuccuaaguugaggauguaugucaccucaagaccacugugauaacugcuaacuguacaaauugguuguaaaacauguguauuugaacaauaugaaaucagugcaccuugaaaaagaacagaauaauagcaauuuuuauggaacaagggaagacaaccauaaggucugacuguuugugggguugggcaaaaacagccauauuuuucuuguugcagagggccuauaaacggacgugcaaguaggagagauaucgcuaaauucuuuuccuagcaaggaauauuaauacccugggaaaagaaugcgucccuggggggaggucuaugaacagccgcucugggaaugucugucuugugcaguugagauaaggacugagauaagcccuggucuccugcagaacccucaggcuuacuaggguugggaaaacucagcccugguaaauuuguggucagaccgguucucugcucuggaacccuguuuucuguuguuuaagauguuuaucaagacaauacaugcagggcugaacacagacccuuaucagugguucugcuuuugcccuuugcccugugaucuuuguuagauccuuaucagugguucugcuuuugcucuuugaagcaugugaucuuugcaccuacucucuguucuuacacuaccuccccuuuuaaaacccuuaauaaaaacuugcuggucugagacucaggccagcaucacgguccuagauaugugaugucaccccuggcagcccagcuguaaaauuccucucuuuguacugucuauuucucagccagccgacacucauagaaaauagaaagaaccuacacugaaagauuggggguguguucucccaauaauuaaacauuauuuacucuaaaacacuaaaucuuaaaucuaaaauuuagcccaauuuuuauuguaaguacauaaaauaggcagaaaacuguaaauuggaaagaauguuuuaucacaugauaucaauaggaaaguauauaauuaucuacuagauaauuauacacccauuauuuauauggaucagauauuuaugggucuguauauauggacagauacagagagaugcuucucuacucccaguggggucacaucccgauaaacucaucauaauuugaaacuaucaugaguugaaaaugcauuuaauauaccuaacucacugaacaccauagcuuagcuuauagcuuagccuagacuaccuuaaaugugcucagaacacuuacauuagccuacaguugggaaaaaucaucuaacacaaagccuauuuuauaaugaaguguugaguauugcauguaauuuacugaacaaauacuauacugaaguaguuucuacugaauguguacugcuuuugcaccacagguugaaaaacuguguaaaucagaaagucugcauacaauuauuaguuauuuauuucccuuguguuaagaaauaaaacuggcugggcgcuguggcuuacgccuguaaucccagcacuuugggaggccgcggcgggcagagcacaaggucaggagaucgagaccauccuggcuaacauggagaaaccccaucucuacuaaaaaaaaaaaauacaaaaaaugagcugugcguuguggcggccgccuguagucccagcuacucgggaggcugaggcaggagaauggugugaaccuggaaggcggagcuugcagugagccgagaucgcgccacugcacuccaaccugggcaacagugcgagacucucucucaaaaaaaaaaaaaaaaauaaauaaauaaauaaaaccauauagaaagauuaucaagacacaaaggcuucgaacuugaaagauguauuuaaaaagggaagcaaaaucuaugaaacaaaucuuuuaccugaggcuaccaacgagcaaauauugggaauacugcuuuaaaggagaucacaaaucaacucauucuuuaagagaaacuuauucuugcagauuugguaagcaaccuuauuuccaaggggcccggguuaaaaaaucaaauaacccucuucagaaagaauaauuuuuaaaguaucaauaaauaguuucaagaauuagaaagcuggguacauaccuugaucaaaugccaagcugaacuauucugaaucuuuuaagacagcaaauuuacuaguuuaggcccaaaauugaguaccacuauauaaagaaaaaguuggguuuuuuuuuguguuuguuucauuuuacuagcauucacaaagaauuaggcuauuuacugacaggauauauuauaaucccaagaaguacuuguuuauuuacaauuauauuggucuacuuauuuuauuuaccuuuaccaguucucugugaagacugagaagcaacuuggacuuccauauuacugaggugcuguuucaauguggcaauuucuuuuugagcauuuuuuaauaguucuuuuguguuaagaugaagauuugucucuguauccaguugucucuuuguaucuaaaaguugaaccuauaaaauacauuaaucuuauaacauucuuuagguuccuaaguaacuaaagguucaaacuaucuuuuuauagaccuuuggagcucggccaagagaguaacagaaaacagauuuaccgucacaccugaaacagccaaaaaaaaccagacaaaacacaugaaacaaccgagauccugagacagaaaaccaaagaggugaaccuuagauugccuuaguuuacugauuuaaaaguuuccaggcuaugacacaggaaagaggaaaugaggcagagcccaggagacucucugaauugagaacacagaucugagaguccagggagaccaaaguagcucaaauuuguaagacagaauauaagacaggagaguugcacacacagaguacccuggagcucuacagaggguccuccuuaaauauucaucagaguagcgaucgcugcaaauauauaaggagcuuaccccagacaggggaagaauuguccaaaggaauuaagagugaagaauaccuguuacucaaagaaagucaagaauaaugccuguucugcagccagacuaaaaaaaccccacaauugcaauggacacuggcacuaauacucaugaaaguauuggccucaguuccagaaugcacacugcucugggcccaccuaauacaucauaaaaggcaaaagucaaaagaaucaaaucauuuuaaauuaacuuuacugcaucucagaauaaagcucaagaagauuuaaaggaauacaaaaauacucagcacccaacaugguaaaacucacaauauauggcacccaauaaaaaaauuacuggguauagagugaggcaagaaaaacuuaguaacaaaguuuuucaaaaucaugcuucaucuuggauggcagacuguccacacaccagauuaauuacugaacauaaacacccuacagaaauucagaacucugauggacucacaucuagauuucuaguaaguguaugccuuuguuccaccucauuuuccaacuucuucuuuagaugagagaucucauguuccaguuuuucuaucuggcuacuaagccuuuguuugguuucuguuucagaucgcuccaguauucccuaaagcaaagaaaagauuuuugguuaugcuuaagaaaaaggcaauacaaaaaaauaaaaauugaaggcaagaaagaauuacaauauuacaacccauuucuacaugaagcagcuaaaaucuacaguauuuaucaagaaaguauucugguauuuuuuauauuaaaacaucuauuauacaggaaagagauggaauguauuauaaucgucauucagauuucccaaaguuuuaaagaaaauaaaaaccaaagaauuaaucuuauaaauaguaaaacugcacaggacacuguaaauauaccugaggacuuaccaauguaugguuucaaucaauucucuuucaauauuuuauuuaaaauauuuaaaugucuuaauaaacugcaaaauucaaugaucauaauggaugacaaaagugauggauaaauuuucuaauuaaggaaauugagaggauaaaaaaaaucuaaauuuaacuuuuauacauuuuuucuacauaggcuuuuuauuugguuaccugaauuguuugcagauuaguuagcaguaaguuuugcccccuuuguucagcuaacaaagacucucuuugcugagaaagacgaacuucagacaauuuaagcauuuccuuuuccuucuucaaauuuucugcucuuaccuaaacauaaguagaaaugaaauaaaaaaugcugaaaaacauggugucaaguguauuaagauuauaaaauuaaaaugauucauacaucacuacuuuuuuuuaaugcucuuagggacuauaucuccucauuguauaaggaaauacaaaacaguuucaugugcuaaaauacgaagcaaaaauuauuggggaucaucaaugaaaaaaucuuucaauuacaaauacuuaugguuccuugcucuaacaauccacaguuuaaaaaauaacagcaagaaaaauuuaauaugugagaagaagaaagcagaauugcaugacugcuguaaucauucauaccugacuacuauuaaauuauguaacuuuuagaauccaagccgguuucaaaguaccuguuuaaaagugaugauugaucuauuuaaaguuucucccuccccucaaccccaagagucugagucucaaggggaccagggagaguguuuugaaagcucaaaguacucauauuuacacacaaguacucauauuuacacacagauucauauaaaugaucaaugauaaaauucacucuaccaguuugaaaaagugcugcugcccacuccucacaauggaguuggagcaagauaaaaauaaagaauacagccuuauaagagcauuauaagacauggguucaaguccuaaccaacccaucucucaugacugucccaaaauaggcaaauuauacauuagcucuugagucuguuuuacacagguaaaaugggggacaacuauaccuagcuuacaaguaaugaucaaagacagaagagauaacugaauaacaaagaaaacuauauaaaaaauuuaucaucacaaaacuaaguauuuaguuaaaaguaauaauuucaaauggacauuuauauucaaguuaaaauucagaaauauaaauucaaugcaauguaauuuuuauauugcuuuuuauuacagaugagcaagaaugaauaacauauucgucuggccaggcacuguggcucaugccuguaaucccagcacuuugggaggcuaaggcgggcaaaucacgaggucaguagaucgagaccauccuggcuaacacagugaaaccccaucucuacuaaaaauacaaaacauuagccaggugugguggcgggcaccuguagucccagcuacucaggagguugaggcaggagaauggcguaaacccgggaggcggagcuugcagugagccaagaucgugccacugcacuccagccugggcgacagagugagacucugucucaagaaaaaaaaaaccaaaaaaaaaaacgucuuuguuagaaccaaacacugaccuacaaauuuauuuugaaaugcaagacuugcgaguauaucuuagcccagcagaaaaacaaauuccuuucccucuucuaucuuaauagaaacaaucaccccacuaacgcacacuggcuauuugcaaacuauguauuaauuacuugguguaaccuccaaacuucuuaaauaccuaaguccuaucagugaguaaaauucaaaguaaaaacuaaagaaaugucaaaugcaacuuauaaugcaaguuggacaagggauauuggacucacuucugcgacagcuagcuucucauuugcuccucucaaaucuugagucaucguauugauaaucuguucuugcuuuugaguuguggcagugaguuucugauuucucucaugaagugauguuauuucucgacgauauccuucaacauuaucuugcagcauuucauaacugguaugaaaaaaguaauucuacaaguaacugaaaugauauccuagcuuaaucccuugaagaaauuucacaauagcuuaacccauuuccccaaaugcccugagaauauugucucuaauccuaauguaacaucauacauauuucuguuaaguugaauucugcuuagaaauaacuccaggaacaguuuuuauauuuuauuuucacacugaaaaucugucagauuugccucaaccucaaacagcaugcuuauguaaaauuaaaugagcgcuggcagcaagcugcacuuuuuuuuuucuaaaugggaaagggguuaauuuuaugauuuaugaagaaguggcuuguguaauaagguaaaaccuucauucuuuuuucccaauuccaaauguagugguucaaguucuaaguaagcaaaguauuucaugcuaaguaacuuuuuaaucuuauuuuuaaaaaaucaauuauauuuaaaguaaugacaaugcaauauugauaacaccagacacccacuacaaugcaguauacaaauuaaguuauuauacaggguuagugauggauuuuugcuaauccuuuuuucuucuauaauccucaguuuuauuuucuuaugugcuugaaagcugacauaauggcuggcuagagguaucaacagagaaaaaagaagugcuuuaauugggguugcugaacuauuagauguauagggguaacugccugcaauauauccugccugcuauaaaacagaaacaguuuuaucauguacuauauaaaaauaaauauuguccuaacaaacuaaacuaacaagcauucaaugaauuuaauaacaaauaaucaugaaauauuuauuauuucuuuggaugugaccaagaaaauuaauucuccuaaaacuacauagcacuugcuucucuucuaccuagaauagaaaagguggaauaaaauuugcucucauuucucucaucaucuggugcauuuuuaaaagaauuaaguccuaccgaaacaaguccuuuaaucuuaggaagguaaacuaccaacauuccucacaugaacuucaacuuauuuuuauuuuauuuuauuuuuuugagacagaaucucacucucuugcccagacuggagugcaguggccccaaucuuggcucaccgcaaccacugccuccugggcucaagugauucuccugccuuagccuccugaguagcugggauuacaagcaugcaacacugccgcucagcuaauuuuuguauuuuuaguagagaugggguuucaccaugguggccaggcuggucuugaauuccugcccucaaaugacccaccugccucggcuucccaaagugcugggauuacaggcgugagcugcugcgccuggcuucaacuuaucaaacaagcuaaacccuuagcacugccuagagaaucauuaaucaauaugaaaaaaaugaacuaccagagguucucauucuggaacacaguucacaaaaaaagcaacacuauugcaaauuagcucuugaauuuaaaugauuugaauuguaaaguauaacauuuagacuuaauuaauuugaaacaaaagaaaacuuaccguuuagaagcaaaaucuagcuggguagaaauuuugguauuuugugaucgcaaaucuguaacuuguucuugaaguuucucaagcugcucauuuuguauuuuuucauuuucugcuuuuucuuuuuuguaguucucaaaaauuuccugcaacuaaauauuggagauuaugagaagguaacacuguguucucuaaaaaccuaacccaggacaaaggugugaucuuuaccuguuuaagggcagccuuagccucuauagccucuguugauucaauaacagguacuggagcaggaguggaaacagucugugauguacuuggacguuuuggaguugaugcaagagaaacaucaucuaagcuugaagcuucaggaaaguaaagacuaauaaaaugcuuuguuggcuuucauaaaucagcuuuaaucuaaugcuucuuugcaaauacacuauuaucaaauaaacaagcuaaacuuauugaaaugaaacaauaagauuauaggaguuuuuaaauaaggaaucuacuaaacaauguauuaagauuuuuugaugguuauuagagauaauucaguauuuauggguuaaaacauaauccauauuuauguuuuauuaaaacauaucuguuuuggucauuaaaacauaaccaaaauaaauacuguaauucauugauucugaaaugcaccuuuuucaacaauagaaagcauuucuuuuuagcaauacauaaaauaaugguauguuuuacaguugaugggauguuauaagcaauuauauaugguagucaaauuugaagcuaccaucauuagaguggcuauugcuuauguugcaaaauuaaucccuuaauauacauuucuaaauuauuccuuaaaauaacuuuauaaaaaccuaccauguaauggaauggcaacuccuguuguuugugacaauaaaauacgguacauaucacgcugacgaacuauggaaucaacaagcugcauuugaugcugucgugauuugcggaguuguucuaguucaguaagggcacucucaaguuugagcugaagcucagugauucuguagaaaaagucggccuaauucacaggacugaacugagaguuaacugauuguaauuucuacuguaauuaaccaagcaucuuugccuaccauucaucauaccauuuuugucucucucauuauuuuuuuucaugcugaguauuuuaugaacuacuuuuuaaauccccaccacacaggacucagguacuuauacuuaccaaugcaaucugaaaaauuuguuuguaaaaauuaaaucaguuccacucacuccaaacucuagucuucuugcuuucuuagccauucuuccucuucuagaagacauuauacauguauuuugaaaaaaccucugacuaauucuuacauagguucuccagguucuccaugaagccggucugcucccugaaaucuaggacaaguccucuaccgcuaugaucccacagauaggcacuaaucacagugaaugcaaauugucuacuugccuauuuuauuaucuauuuauuacaucugucuuacccauaaccugaggucuuggaguagaaauuuuuuguuugguauuguugcucaauucuuuccucccuauaucacuauaucccaaguaucuagcacuguuaggaacacauagauuuuuuuugcgggcaacagggucuuacccugucgucccacuuagaguguggugcaugaucaugcuucacugcagccucaaacuccuggacucaagugauccucccaccucagccugucuccugaguagcugggacuauagacaugugccaccacacccagcuaauuuuuuacuuuuuuuugagacauggucucacuaugucguccaggcuggucucgaccuccugggcucaaaugauaccccauuuaggccucccaaaacguugggauuacaggcaugagacacugagccuagcugagguuuucauaaauguuugcucaacaagcugagguaugugacuacuuacuuggaugaaguuguuucuuguucuucucuuucucugguuuccccaagcucucuaagggccacuaagagacguugauuuuguuguugaagcucuucaauauuucuguaagauacuagaugcugugauauuaccucagaugaacuacuuauaucagcagagcuuacuuccucaucacgaauuacgugguuaccccuugcuucuucaaguuccaucaaaagcacucuaaucuaaaaacaaaguuuuaauauguuauaaaauaguauuaguuacaauucuggacaaguuuagaaugaaaguuuucaaauuaaaacauuacuuauaaaaccuucaacuuguacugccucaaauuaucuuuaaaaauaaagcauccuuggauauuaaaaucuaaacaaucaaauuuuaauagaauaaaauuacuuuuaaguauguauugaaggcuauuacuuauuacaaaguagccaaauuacaauucccaaaacauggcuccaguuuuguaaaacagugaucaaauaaaacccacaaauaucuauuuuuuugugugugcuuuuguauauaugauagggcagagcaugaaaaauagacauuuaaacaaaaagcauauauauaaugccauucaugugaaauuuuuacauuugugcauugcguggauguacacacacacaaauuaggguaaaauauaugaaugagacauuaauuuauugauuugcuuguuaagugucagaguaaugcauacaguccagucuuacuucaguaaaaucaaauaauucuuacauauguuuauauaugcucauguauauacacauacagagaaggaugugaaaaaaauacacaacugucuguuaacuuagcuacacuuugggacuucagaggguagagggguagaaauuggagaaagcuuuuauuuaucuuugaauuauuucuucauuuauuacaaccaacacguauaauuuaaaaauuuaucaaacauuugaaaaaagggaggggcuaugaaaagaaacaaugggggugcaacucugcucgaguacuauuccuaauuaauuagaauuucauacaugguaguucuaucuuagguaccuucaaacagauucaaagauuacugggcagucagguuuuuaaaaguaggaaaacaaacaaaaaaauucuaaccuguugugaaagaucuuuuacuuguauuuccauucuucgauuaucucucucaaguacagaugauugcuuguuggcuuuaucaguguccuccugcaaucgcugaaucuccuuuaaaauguaaauucaagugaaaauuuuguacuuccuucuaggauuuauacaaguaauaaagacauacaauacucaaacaccaccaguaaucaacuuauacacuaaauaaaauccuacauaauauuguagccacuaaaaaagaaguuuuguauaaauuugaauauguuauuucucauucagacaauaacaagcuucagguaaaacccucacuuucaacagagagaaaaauucaaggaagaucuaauuggauccaagggcucucuugcaaacuacacugcugguaaaaaagucaauauucucaggcaggcgggacugcuagacuucacuugaugaagaagaaaaaaaccagcugauauaauaaaguacuuggauuuaaacugacuucuaaauuauaacagcaacagagauuuaauuuugaaauagggauauauuuauauucuuuuccaacaaaagggaaacaauuuaucaguuuagaagaguagauauaaauucauuuaacugaauuuccuccauaaaacuuguucaagaaaucuugacaauuucccucaguaauguuaauaguuguaccauaaggcaaaacauucagaguauaaccucuuuuuccaucaguaucucuuaaaaggaaaaaaucuuuaugaauuucauuaacacuucuaauaagcaaaugagcaauaacaaaauaaugcauauagagacacgccaaauugugaaaugguauaaaaaaggaguucuaccuauggucaaacaauauuauuauuucuaggcaggcuauuacaacugucugauaaagaaugauuauggcaaauaggagaguuuuauuacacagagauuauuuuaauuugaagagcaguuuuaggagauuuggcuauuauucucuaguugagaauccuaaggaaaacauaguaaaugcauuaaaaaaagguuaaaaugcuuucacaauuuuauauaaaaauugaaauacauaaaaauugcuaaauaaagguaugacguuuugagaucagcaguguuuaauaaguuucaaaauguguuuauugaaaaucguauuuagauuuuucugacucaaucaccuuaagaaaaaaaaauaccuaguaaaucauuucucauuuguauuguuaccacggcuaaauuuuaggaauggaaccaaccuucauagcuuguucaagcuuaacagauaaacuugcuacagcuuucugugcacguucauauuccucacgcuggcguuucaaaauuggugcuuuggcuuccacuucuuucacuauuucaucuagguacuuauuaauucuuuuguucucuaguuucuccaaaagcaacugauccugaguuuccacauaagcauuauagagcugaaaguagacaaaggguuguuucaaaucuaaccauaacaacgcaaauauuuaguugaucuaguuucauaauaaacauucuuuaacacuaacacaaaauggcaauguuuacuauguuaguuacacagcacuaggaaccaaagaaagccuuuccuagaaugauccacuaauuauaagaugauuuuaaaaauaaguuuugggagaauuaaauuuugaagagauuuguauacauuugcugaagaaaaagaauuuaacaacauuuaauaccauucuuaccucaguuaguuucaucccagguuucacuaucuuagcuacagcugcugcaguaggagacauggcggcaagcucuucuucagacaauauggcuccugugccaacaaauacacaucuaguauaauuuguaaaauuccaaacuaaaagccauuaauaauuuuucaagguaagugacauguacuguacauuauauaguaauuccuauaaaaauuuuaaauacaugacaucaaaaagucauguaacacaucuaauucuaaaaaaucaugcaauaaccugggaauuuacaagacugugugugaucaaaugguauuuauaugcccgauucuguaaagauacagguaagaguauuaauuuuaaaacaaauucuauuaauauaacucgauggaguuuccuacaucacagcaugacagauaaauacuauuagugaaauuaaaugacuuuuauguaggaaagcuguaguauuucaacucacuaacaagcaucuauuagccauaccuuuacguuuuguggcagaaagaaggucauuugcauucucuaauuccuucuccaaucucccuauuuucucaagcauuucuuuuuccauuugaucuuuggauugcuccaccucuagaagaugaucuuguauugcuuuguuggcuaaaaaacaauuuuaaagaccaaauauucaaacauacaguuaaaauuuuaguuuacaaaaugcaacagaucagucacuucuccccucagcagauaauauuaaauuucuagagaggcuucagcugacaguaucuauugaaaguucuugcucuacuuauaauuuuggaauugucuucgccugguguuucuccuuuugaugucucuuacccacaaagaaaauaaggaaacccaaaggguaaaaagugguucuagguauaucuuugauuucgauuuugaucuuuaauccuaaguaaaggaaauuauuggaaaagaccauaaauauaauacauugaaaaaagcaaaaauuugaggaaauaaaagacuuuacaaaaugcaaauaaagaggaugucuuauuuauaaaguaagaguauucaaacauuaucagaguaaauguuucaaaaaagaaaacuuucucauuagaaaucagcaaauuauacaagauuauuagauaaaaaacaaacaaaacccccugcugucuguauuuucaaaaauauauaaacuuacauuugcuuaagauauaauucugaauuuccuaauccaaaguucuuucuucuguaccuaauucugucccaaauaaagucuaacaccuaaauccaaucaucuauacaaaacaaggguaaaaaaaaaaaaagaguacaauaacaaaaauaauguucccauaacugaaaacacuuaccuucaccagcuucuuucaaaaguuuguguaguuccucuacugcccggguuaguucauugcucuuugcuucugagucaucagcggcacucuaaaaguuaaucuuaaaaaguuaccuaacagucaacaaugcaacauuuagauacuaacauguguggugggauauuuaccuuguacaaauuagaaaguuuuaugugggcauuuaauucauuguggaauuucucuuccauacuggccuguuguuccuuggccugaaaaaaauagcccaauuauagcagucuacuuugaacuaaauuuagaaugcuuaucaaaugacaagaugaaaaauuccauuuuuguaaaguaagagcuaaaucuaaaacacucaaauucaaaucagucuucaugacaaagauaaauuaaggauaaaauauuacuaauauuuuaaauucaaaguaaaauaauuaaacaauaaaauuaacccauacucauuuuuuagauaguauuuucaauauaacauauaauugcuauuucugauucuauuuuagccuagcuacagcauauggaaggaggacucucacuguuuuauggggccaaggacagauuaaaaaaugacaucauuuugugaaauaacagcuucguaagugcuuuaguauuuuguaaaaaagacauuuuaauggucauauauaccucuuuuaauuuggucaacagauccuccacaugcuuuugaagauguucauuugauguuuuuaagccauucauuuguucuuccagucuagaaaccuaaaaacaaaaaauagagcagggggaaaggaugucauauuaacugaaauuacucugacaugagguuuaugcugcuaaggaaaagcuaaguaacucccccuccccaccugaaaaagcaauuaaaauaugcauauuuaagaaaacuaagaguaacugcucacagaacaauguuuagauuuagcucacaaaaacuuaccaccacuucuuaaacaaacacauauuuuaggaaagauauaucguaagacaguagauacuaaccagauuugacaaagaaucuuaaauucuuuauguaaacgcaauugguugauuuuuuacgccaaauguaaugcauuauucacauuuaaccacucaucuuacaacuaaucagguacacacuacugaauacauauuuaauaaacugacauacaaauguaaguuauacucaacaugaagaaaaacacaauuuuacuaacuuaccucuucuuuuuuauuuucaagauuacauuuaagcucuagaaucucauucccuuuuucucuuccaagagccagaaguucaucaguuuugguuuucaacucuguauucagccauguauucugacuauguagcaauuccuuuucuugcuccaagcguuuuucucgauacuaaagaaauccaagaaaauaacacguacaguuaaagaugauauaugauuauucaaaagauuuugucuguagcuaagggacacaagcagaauuuuauuucaaaacagaaauuaaguauuugcauagauucuuaacuagaaaacauuaagaacuguaacaaacuuaaauuucaaacaagcaaaacagaugaacuagaauuguccuaaugcuuaauuuucugacauuaaaaacaaaacaaaaugcagcuuuuaauuacuuuauugccuauauuugaaauuuaauuuaggugaguuuuaauaaaaagcuauaguuuaugcauuaggaaucaucugguacuugccuuaacagaaacaucagaagcuugaaguucauccaauuuuaacugaaguucacccuuuguuguauugcuuucuuuaaguuuuucauucagacguuuaacauccucuagaauggugaagagaauuaaaaaauaauaacuaauuaacacucaggggaaccaaauaucaaaaauauauuucuaggaauauaaaccuuuaauacaaaguaugcacagcuggcccuugaauaacacagauuggaaccaugcagauucacuuccacucauauuuucuucaauaaauauauuggaauuuuuucccaaaaacuuacaauuugaaaaacucagagaccacagaccaauccaggcagcccagaaaugggaacaaacuaagaaaaagcuacuguaagugcauaauauguacuaauauguagauauuaguguauuuuaucauuuacuaccauuaaaauaugcacaaauccaugauacaaacuuaaaaaauuuaucaaaacuuaugcacacaaacacuacacaacccuaucugcaaucaagagaaauauaagcaaauauaaauaugcuuuauuaaaccauaacugcauaaaauuaacuguaauacauacuguauuacuggaauacuuucauagccaccuccugauacuacugcaguaagcucaaguguuuugagugucuguauagaaugcugugugacucuauugugagcaguuucucucuucaguaaauugcauaaugcagaaaauaguaaucuuuugaaguuuuugcauauuugucauuguguuuagugcaauaccauaaaacuugaaaucuuuugaaguuuuugcauauuugucauuguguuuaguacaauaccauaaaccuugaauaacaacaugggauccauaagaacugccacuagugauguuggaaguacuucuucuaagaagcagggaaauaucacgacaauauuuuaaagaguugaauugcuugauauguaccacagauugaggacugcagcgaugguuacccaccauuucaagacaaaugaauccaguauauggaccguuguuuaaaaaaaaaaaaagaaauaaaaagaaaauucguaaagccaucacugcagcuacgccagcaagcauaaaaaagugcauuucugcaaaauaccuuccuaucucgcauugaaaaugcagcuuuuauggggugcaggauugcuaucacauaccuauagacucuaauaugauacgagguaaagcaaaguuauuauaugacaacuaaaagcaaaaggaaggugacagaucuaaagcuggagaauuuaaugccaguaaaggaugguuugauaauuuuagaaagguuugacuuauaaaaaugucaacaaaacugaagaagcagguucugucaaccaagaaacagcagaugcugcuaagaaaaucauugagaaagguuauaugccugcaccagguuuuuaaugcagauagaaguguacuauucuggaaaaaacaaugccacaaaagauauuuauuaguaagaaagagaagggagcaccaggauuagggcaggaagggauaggcuaacucuaccguacugagcaaaugcagucagguuuaugauaaggacugcccuuauuuauaaagcuuuuaaccccagggcccaaaggaaaaagauaaacaccagcugccugucuucugguuacacaagaagaagaccuggacaaugacagacccccuucucugaauugguuccacucaugcuuugucccuaaagucagaaaguaccuugcuaguaaaggggcugcccuuuuuuuuuuuuggagacagucucgcucuaucccccuagcuggaguguaguggcauuaucuuggcucacugcaaccucugccucccugguucaugugauucucaugacucagccuccugaguagcugggauuacaggcgccuaccaccacgcccagcuaauuuuuguauuuuuaguagagaugggguucugccauguugaccaggcuagucucgaacuccugaccucaggugaucuaccugccucggccucccaaagugcugggauuauaggcaugagccaccguaccuggccaaggggcugccuuuaaaguucuuuugacuuuagacacugucccuggccacccagaacccaggaguucaacauggaaggugucaaagcagucuacuugcucccaaacauguuucuaauucagccuuuagaucaggagucauaaggaccuuuacggcucaauagagaugauacuuugugaaaagaaaaugucaacacuguggaagagaaccccaacagagaaaauaucaugaaaguuuuaaaggauaacacacugaagaggccaucccuucuuuuucauuacagaaaaaguuaugaaagccaucaaggcugaaauaauaaauuccuguuggaggaaacucuccagauguugugcaugaugucacaaaauuuguaacagagccaaucaaagaaaucaugaaagagauuguggauauggcaaaaaaagugggaugaaggguuucaagauacggaccuuggagaaauccaagagcuaauagccaccauaucagauaaauuaacagaagaugacuggauggagaugagugcuuccaaaccagugccagacgauguggaaaaagaauguagaacuagcagugucagaaaacauauugguaacagacuaucugguggaaggguucugauuacccaagacugcuuuugauuucuuuuaugacauggauccuucucuuacaugggcacugaaacuauagcaaacgguggaaggaagauugguaauguauagaaacauuuuuagagaaaugaaaaagcaagucagacagaaauuaggcuguauuucguaaaguuacauugagugugccucccucuucugccuccccuucuaccucugcaaccugacccagcaagaccaaccccuuuucuucagccuagguaauguaaagacaaggaggaugaagaugguugugaugauccacuuccauuuaauguacaguaaacguauuuucucuuccuuaugauuuucuuaacauuuuuuucucuagcuuacuuuauugaaggagcacaguauauaauacagaucacagacaaaacguaugacaaucuacuguguauguuauugguagggcuucuaguuaacagcaguaguuaaguuuuuggggagucaaaaguuacacauaaauuuucaacuguggggggaaucagcaacccuaaccacuguguuguuuaagggucaacuguaguucucaacucucuuauuuuaacuuguuucugccauaguuaauuacaaauucaauuucuacaaauauaugacaaaaaauugaaauuuguguauccaaacuugugaauuauccaaauuuauuuuaaauacaguguguuaagcuaaauauucaacguuaaccuuaauuuuccugauauauauccaaagaccuauuaaaauuuuauaaauaaucauuaagcuaaaaagcacuaauauaaaaaccuacucaauauggaauacacauuuuuaaaaaacuaucuauuaaauaucuagauuuuaugaauucguuuaguuguaacuaccacuuguugaucaacacacucaaguauuuugaaggaacucuugugagacugggaaaguauacuuaacuaauggaauauuauuguauaaugauauaaauaucugaaaauccuuucuuuuauagaaauaaaaaaauuucaaaaaccauuaaaaaaaaaagaacccaaaacaccuuuuuuuuuuuuuuuuuuuuuuuugauacggagucuagcucugucgcccaggcuggagugcagugacgcaaucuuggcucacuacaaccuccggcuccuggguuuaagcaauucucugccucagccuacaaaguagcugggauuacaggugcgugccaccaugacuggcuaauuucuguuauuuuuaguagagacgggguuucaccaucuuggccaggcugcucuuggacuccugaccucaugauccacccaccucagccucccaaagugcugggauuacaggcgucagccaccgugccugggcaccaaaggaaacuucuuaccauuaacugcuucagagucaaguucaccugacuacaucagcuguauuauauacuacagucuauguuuauguauuuuaugucucugccuccuucagucuguuuauaaauauaggcugaguauauguucuuauauugaaugcuuauuauauagcaaggauguccauaugaaauaaagaacaguaguucagccuuugcaaauauuuaaagugcuuccaauuugacauuauguacagcauuguagugaaaaucuuugcauguaaaaucugguccaaauuacuacuucuuugagauguucuucacuugugcacuuucuagacacuucuuuaaacacuugacaaugauuuaaagauaaaugaguaggagaaauaauaggauaugacaacucuauacucaaccauaacaaaaaaauaucagcaacagaaaugggcugagcacuaacuccuagcacuaacagaagaaaaauaaaggaauggagcuaaaagcuacaagcacuucuucauaccuguuaaguauucaaguucuugagauagucucucauugguucuaauuaagucucuuuucucagcuucuaauucuuccuuuguucuuguaaauuggcucugucauauaaagaaguaauaaguaagaaaaucaaguagagcaauacaggaaagcgaacauagaauugucacuuuaguuaacaucagcuguaguguaaaugacuggcuuucucuuauaacuuacacaucaaaguuaaaaaauacccguaauuccaauguuucuauuuaaauuuuggauuuuuaaaacauuuuuacuaggcuuaugaaaauuuuucucauaucucuuuuaaucacauggaaauguccuaauaacuuagaauaucacuguauuuacaccuuaguucaaauuauuuuucaagaaagauuccuaaaaauugaauuacuuaaaacuuuuaauauauuuugucagccaggugcaguggcucaugccuguaaucacagcacuuugggaaaucaagcugggccgaucauuugagucuaggaguucaagaccagcuugggcaacacagcgaaacccagucucuacaaguagaaaaaaacagccagacaugguggcacaugccugcggucccaccuacucaggaagcugaggugggaugaucauuugagcccgggaggcagagguugcagugagccaagacugcaucacugcacucuagccugagugacagagugagacccugucucaaaaacaaaaaacuugucaaacugcuucccagcaaaacaauggcaaucuacauguuuuugaguuagaaauaucuaucucaagcuaccuaugucagaacuguagguugccuuuuaauauucuuguuuccuguguagaagcuuuuuaguuugauguaguuccguuuauuucuuuuugcagcuugaacuacugaugugauccaaacaaucauuaccaaggccaaugucaagaaccuuuccccuauguucacuucucugaguuuuauggcuucaggucuuacauuuagaucuuucauccaucuuggcuugauuucgguauaugauguaagcaacacaaacauccaacauucauuucuucaaauguggaaauccagucuucucaacaccauuaaugaggagacgaucacaacuccauugggucuucuuggcacccuuguugaaauuaguugaccauauguuuggauuuauuucuaggcucucuauucuauuccauuggucacuuuucuguuuuuaugucaguacuguacuauuuggauuacuauaguuuuauaacaguuuucuaaaucaugaaguaugaugccuccaacuuuguuuuucuugcucaguacugcuuugguuauuauucaggauuuuuaaaacugauuccaucagaauuucagaauuuuuuuuuucuauuucugcgaagaaugccuuuggaauucugacaggauuggccugaaucuuuuuaccacuuuauaguguggacauuuuagcaauauaauucuucuuaucuaugaguaugguauaucuuucccauuauuugcaucuucaauuucuuucgucaauguuauauuauuuucaguauaugaaucuuucaccucccagguuaaauuuauuccuaaguuguuuuuugaugguacucuaaugaaaucuuuucuuaauuucuuuuucagcuaggucauuguuuguguauagaaaugcuacuagauuuuuuaauauugauuuuguauccuucaauuguauaaauucacuuauuagcucugacagguuuuuguggaaucuuucagguuuucuacauauaggaucauauaaucuauaaguaaagauaauuuuauuucuuccuuuccaauuugggugcauuuuauuuccuuuucuugucugauugcucuugcugguacguccaguacuauacugaauacaaguggugagugggcaucccagccuugcauuggaucuuagugaaaaagcuuucaguuucuuucuuucagccaccaagcaguuaaauaaauucuauuacuuuuuaagucacuucauaguuuuuuuuuucugaaaaauuuuaugugacugugugcacacuauuuuccucgguuacagauccauaguuuuuacaagauuuauaaagauuuugugacagcucugcuucuuuccaaaagauuaagaaccuccguauuggguuuuauuucuggacugccuuuuauucucuguacugauuuuuauaucagcauuguaauauuuuaauaaccauagcuuuauaaaacuugaauauguggcuaugcaaguacuuaauuuaaauugauacuuccuuuuuuuagaagcauccuagcuauuacuauguuuuuuuccccaaucaucuuuagaacuacauuaacaaguuucuggcuaucugacuuggacuuaagagucaaaauguauuaccaacacauuaauuuggaaaacauuuccauccagaaauuugcaauaucuucauuuauaaagguauauucucacaguuuucagagaaguauuugaguuuucuuggguauugagucauucuucauauaaauacauuucuuacaaagccuuucuagguauacuacgaggcuuuuuugcgccuauucagauucuggaaguaaauuuuuuuuucccuucagaaaugugaagaaauuaucuuuuaacaccaaauaaaaugcaaauuuuaaaaaagcaauggcaaaaguauaaaguuguaucugguuaaaaaauaauugcaugcaaccacuuuaauuaacaaauuugucagcaaucccugugaucauauucaaacugucauucuuauaaaacuacccuaaggaaaugacuaccaauguggauucacccaaauucccaacuguaucacauuugauauaauaccuggacuacagucagcauucaauagauaauuucuguugaauaaaagagauguccaaucuaucaauaaaacauagauccaauuaaggaauuuauauuuacauauuuuuguugguagcuuccccuaauaggacaucaguuacaucuucccauugacuaauaacugauaaacaaucagaauagaaugucccuucaaguaaaaugucuacaaugagcuuauucuaagaaauaucucuuaccugaauggcaauauugcgauccugagcaauuucaaguucuuuguuuuucucaguuagugccuucaguugauugucuggauaaaaggaauuuuaugaauacauacacauuugcuuaaaacuugcaaugaguguuuuuaugcaacugccaaccuuacauauuuuaauaaaugaaaaaacagaagcccagaaagacugcauuguacaucacauuccaaauucaugaaugcauucaaaauuuacuguguucuagaccaaaauuuuaaauaugcuauccugucuccaaaucaaauguauaauaauccuagccaacauuuauggggaaagucacaugcaauuaguaauuccuuuauuuuucagugccaucuucuaagucaacauauaucauaagaaacagugaacuguacuuagcaguaagaaaauggaguuaaaaagacaggaucaagagagaaaaagcauuuaaacuauauaacauguauauacagcaaaucacaauaaugaauauuugcaauuccuaucauuuaucacucuaaauagagccuuuaaagaaaaaacauuaugcuugauaacgcacuuaucaaucucucaauugccacucaaaaugggcucuuuucccuuacaugcaguuucucuucuaaacauaggcuaacuagaaaaaauauaauuuuuaaaauuuuuccaaaaauauacauuuugaaacuguauuucacuaaaauacauauguuggcaauuuaauaagcaaauacauuuuaauuaauucuaaucuuaacuucuauuuaaagaggaccauuaaagcaaaaaaauccccauuaaaugugucuaaauuuucuauuuuguuuuaauauuauuuacugcuuuccagacuuacugauccagaguauauaaauacacacacacgcgcgcacacauuaacuguauaccacaggaagguaucugauguaucuguagguucaucccuuuuucucuucucccagaucucguaaaagcuguauucagucauuuuucucaaauuccucggcacuacuacuaaacagaucuuuuuauuauggcuaggcaaaacuacauagauaaugaaccagaucuagcuauauaugcuccaucacacauguaugcauauacauuacguuuuuaaaaugagguguaccaaaaguagcugaaaaaaguuauaaccuaaauaguugauggucauggacccauuaagaaggaaagcugcaauuuuaaucauuugauuaugaacuuccuguguuccuucuccaucaaucaaauuaaaauugaacuauauuaaguaucaauuaauuauaccagccagacacaguggcaaucccagcacuuugggacgccgaggcgggagaaucgcucgaggccaggaguucaagaccagccuggccaacauggcgaaccacuguaucuacuaaaaauacaaaaauuagcugggccuggugguacaugccuguaauuccagcuacucaggaggcugaggcgcaagaaucgcuugaacccaagaggcagagguugcagagagccaagauugcaccacugcauuccagccugggcaacacagugagacucugucuccaaaaaaaaaggaaaaaaaaaauuaauuacaccuuuauagagaucuuuccuaauguucugauguuugcuuucuuaaagcagaagcagucuacagccagaccacccugaaggcaccccaucucgucugaucucggaagcuaagcaggguggggccuggucagaacuuggaugggaaaagcaaagcacaagacauaucauccuccuaagaaaugucaggaucuuuaacaucuugugaacuuucuaaaacuuaaugauguaagaaaaguaagaaagagauuagcuaucaaucuuuuauaggaauuaggccuuaaaggggaaauauccugagauucauagauauuuauaaaaauuauuaaaaaauggaguuaaaacauaaauauaaugaaaucaauaggcuucgauucuucaacauaaaaacaagccacucucuacuucuuuaguugcauaaugcuuucaccuuuuuaaaaagauuucaagaacucuuaucucauuugauuuacaaagcugucuagguagacagacaugugggucuaaccauuuuauaaacaauaaucagauacuguuaagauuuacauguggcaaaagcaauuuuaauagcaaaaucagaauaagaauccagaccuccugaccauuaaauucuguguucucacaaaaucuuuaccacuaagugaaaaaucaaaauaucaccauaauaaaaaccaaugaugcuuaaucaauauuuucauguuuaguaagcaaauguuuccaaaguauauaaaggagucucugaagauuucgauacuccgagaauacuuacaaagaugaauuaaauacuuacugaguuucucuagcucaagccgcaagcuuugacacucucggguuucauucacaagucucuccugacugugggacaaccucuuuucuauuucaaaauacuguuguucuacagcagacaagcaaaaaacaaaaaacaaaaucaaacacauguacauacauugugaauacuguuauuuauuucuaauaaccuugauuuuaaaacuuaagauacaguauuagaauugugcuccacauaagagaaucugaguaaagauaaauagacugagcacugaaaaggacuuaaagcauuuccaaacgacuuacaugacaaaaaauaaaaaauaaaaauaaggccuaaaaggggcuuuacaaaucaaugucuucaaggcagguaaccucauuuaucuuaguauuuucuccagacaucaguaaacugcuuaauaaauaaaguauuuauuacacgagaaaaaauuguuuagacaaaaaaaaacuccuuuguuuuaaaagacuucuuuuauaguagucaagauauuaccugaaagcauaaaacuacuaaauauauguaaaaguaaauguguaaacuuuccaagggaagggauugaauaucauguucagcauaguaucaggaacauguaagacauucaauauuuauggugcaaauuaauaaauagaaugcaauguacuauacucagcucugggaucagagaacuaauuuucaaggucaauucugcuugacaguuacacuuuuuuugaaguaaaaacuuguucagaauuuccagucaacuuagcaagaacaguaugaaccuccccaaacaaaugguaaaccaaaacacauuaacgggaaguuuguauuuuacuaaugguaaugacuauauucuucauauuuuuuucaaggauguucaagccauuauugucaguaacuuucuuacuuaaaggccuacuuuagguaauuacaagaaaauuuuaauguuuucuaucaaacuccaacuuuuuaagagaaaucaagauauauuaaauuuauguacugcacauucacuguguuuccagcgcucuuaugcaccuaauauucauuuuuguaaacaucugauucguucuggagccacgggacgacgcacacacuaagaacaagugcacagaguggucaauuuggcaaaggccuagaaugcaggugccuagaaaauagggcggagccacuaucaguugaagugcaacaaaacauauaagguacucuaggcuuagagagauggguucgcagacucuaucaagucuguuucccgucugccggacgaaggaaaauaagcgucccuguaugagccuacccuaacuacaaagaaaaugcuacugaacuuagauucagauuuuuuuuucaaaggcuucuuaucaaacuguaaggagcaggaaagcgaaggcucaggauauccacagagcccaggaagugagguuaacagagcgguacccagugccaacuugaugggggaagaccagacccaaagggcgggagucgagcccaaaaccaaggacggaaagagcaucucacuuaccgcucuccaccuuaaauuucucaugccgccccuucaggccaucgaucucggauugcugaucagcaaggaacuuuucaaguuuguucuggacagacuugggcagcuuguucagcuccgugcgcuccaggacuugcugcaacaccgccgccaugucgguggggccagggaccccaguggcagcggccgacgggguagaagcggagaagaaaggcgaagaccagcaggacccagacgccugggccgccgccucuaucaccucgcucgguggcucgcgcgcgcccgcccgccggagacucccgcggcgggacccugggaaaucgaguccacccucagcggcagcguuucagcaacagcaccucaccgcccgcgaccgaagugcgcgcgcagccguuggaagcuacgaacccugggaacccgagcucagaggcuaucccugauccucuugcgcacccaauuuuccggcuuccagcuccacccacuucaggccuuguagggcucugggaaauguaguguuuuucucauucuuuuccgggagcccaaugcugcaccgcccucucagcuuccguuuuucuccccgcuccccuggcucuccuaucucggccccguaaccgcuguccgcacgguggcgccacauacguacucgucaccccuuggcccucccugaagagcuggugaccuuaccgucaaagccccgggaugccauggaucguccucguuggcggcuucuggacacugagccacuagagggcaucggucccgguagggccggacggcaggcuccgggauaccgccacgcucucuauggcgcccagaagggggcgggguggcgaccgcagucgcuuu

SEQ ID NO: 21204 - RNA, 109572 nt, Homo sapiens
cgcuggcgcugaggggaggaaguuugcugucgagcggccuggguuccgugggcaaggccgugggaggcagcguuggcugcuucgacacacugagggcggcgcgaugggagacgagauggaugccaugauucccgagcgggagaugaaggucagagacuaaccggggccucccucccuucuuuaguccuggcguugccuuggagcccagcugaaaggcgaagcgcggugcuggcugucccgccuccugcuugaacaguuuaccgcguucacagcucucaccagcgcgucugccgcgccgcuggcgugauagccccaccgaaugcaguuucccagucccauccuggucucgugcacggcuguugaguuacccuagcuacuuccuggggcggucacaauaguggcaauaacugcuguuuauugaguguugacugugugccaggcacugugguagucaucgcggcagcccuacgaaguagucguuaacguagaggaguaaguugaggcucggaaaguaauuucccuaaagucacauuugacgcggggcugaaagccagcaucauuuaagaccuuugcucucccaguacuucuguaaggugauacgggcuugccuaacguagagucagggaaggucauccauccugcagaaccuuuaguugauuggacuaggaagacuauuuugaccucgguauaucagccuaaagucaggaaccuaaagggagggccaaguggucccagugauagcaacgugggagucccccagggauaacuucaggaugguguguuuaauaguucuuauauggguucugacagaaugaggguacaacagacgggcuacaucuguuuuaaauagugaaaagaaguaaguugcaggaagauuuuaggcaucugugugaacaauaaaucacuaaaaugcauuuagggcauaguaauaccauguuuagaauagugauuuuuuuuuuuuuuugagacagagucuugcucugucacccaagcuggagugcaguggcaugaucucggcucccugcaaccuccaccuccccggcucaagcgauucuccugcuucaaccucccuaguagcugguauuacaggcgccugccaccacgccccacuaauuuuuuauaucauuugguagagacuggguuucacgauguuggccaggcuggucucgaacuccugaccuaacgugauccgcccuccucuggcucccaaagugcugggauuauaggcgugagcuaccgugcuguccuagaauagugauuauuuuuugagaaucaccaccuguggugagccaccuaaugggguugugucauauuccucagauaugcugggguagaagaaaaaaagguuuuauuaauagaaccacagacuuagaagaugguaaucucgcacucccuuuggcagcacauauaaaauugggaucaugcagagaagacuauuauggccccuuuacauggaugacagacaaauucaugaaguguuccauaucagaaaaaaaugagggccgagugugguggcucaugccugugagcuugcacuuugggaggcugagguggauggaucacuugagguccggaguucgagacuagccuggccaacauaaugaaacccugugucuacuaaaaauacaaaaauuagauggccaugguggcgggugccuguaaucccagcuacuugggagucugaagcaggagaaucgcuugaaccugggaggcagagguugcagugagccaagaucgcugcacugcacuccagccuggacgacagagcgagacuccaucucaaaaaagaaaaaaagacaauugagacagaccuuggucucaguaauacauauuuuuguuguacugaaauugggucuacugaauauaacauguuuuaauuucuuucuuuauugaauugaucucguuuugauucuucacaacaggauuuucaguuuagagcgcuaaagaaggugagaaucuuugacuccccugaggaauugcccaaggaacgcucgagucugcuugcuguguccaacaaauauggucuggucuucgcugguggagccaguggcuugcagauuuuuccuacuaaaaaucuucuuauucaaaauaaacccggagaugaucccaacaaaauagguaaguucccugguuuauguugcaaaguagagagaggaguaugguggcaugcucuuguguuuccuucccaagaagucauucuaauacuaaaaugaacacugcugucaguuugaagguugacucccaagaagauuaauggaagccuuucuagguuuucuccuugguccuuuguauuucuccuuacaugaguuguuccucucagcucaacagggaagaacuuaaccauuaugccaugcuuuuauuuuugcucaguugaacuugggcucuggcucucugggugaaggguuuuauuggcauggguuuucaguuggcacaacaguaugauccaaacuauuggcaagguguacuauuuagagcauuguugcaaaaauauuuucaacaagggcagcagccacaguuaguuuccccagauuguaugaggaagaauuccagggauacuuaauccaucauuauauaucuuuaagaaaguuaagauuuaucuguauaacuagguauugggguguauguguguuuauguagaugcaaaaauuuuuucacaucgaacuggauagagguuguggcuuuaugcuuagaacauaccguuuucugcuuuguauuuuuuuguuuucauaguugauaaaguccaaggcuugcuaguuccuaugaaauucccaauccaucaccuggccuugagcugugauaaccucacacucucugcgugcaugauguccagugaauaugguuccauuauugcuuuuuuugauguucgcacauucucaaaugagguaagcuacuguuauacugugaugucaacaugagaacccuaagcagauuuccuuguauugaauuacaacuuggaagcuucauagguuaacccuugaaguuucucucuagauuaaaauauggguuaaaaaaaaauccuuaauuauagaaucauagaucuuugagacagaagggacuucaagaaauucuuucauaacgccaucugcccuaaguuguuaucaggaggcuuaggugacuugcccaaagucauagaugaauacauaaugucaaaaguuccuacauuuuggauguucuuccauuccaagcaguuuaagaaugauaauaauagugaguguuuauacugacuguguguguuagacucuguacuaagugcuuuauaugccuugucccucguucaugccuaccacagccuuauguaguagguacuauuaucuucauuuuauagguagagaaacaggcucagaguuuaaguaacuguccaaggucccaacauuauuaagaagcagagccaagauuuuaaucuauugucugcuauuuauugguuauuuugcaauugugcauuccccuucugagagucccccuaagcauguuagaauaauugauugccauuuucaaaguuguguugaaauugucuauagcaaauagauugaugcauaaaacaaucuuuuuuuaugguuauggagaaaaauaaacugauuugagauaccuuguguauucaguaauuuccauugaauauuaaauguuucugcauuuacuauuuguuaacuuauuucacuuuugcauauuuguuuuaaaaggcuaaacagcaaaaacgcccauuugccuaucauaagcuuuugaaagaugcaggaggcauggugauugauaugaaguggaaccccacuguccccuccaugguggcaguuugucuggcugaugguaguauugcuguccugcaagucacggaaacagugaaaguaugugcaacucuuccuuccacgguagcaguaaccucuggugaguaauaaaggcuuucacacuguagcauacaaucauggucaucuacuuaagaauugauuucuagaagugaaaguggauagcuuuuuguguuuugguuuuuuuuuucaugacgagggagguuaaggauggaagguauucuuuuuugagacagucucacugugucgcccaggcuggaguacaguggcaucaucucagccacugcaaccuccaccuccuggguucaagcaauucucgugccucggccacccaaauagcugggauuauagacaugcgccaccaugcccagcuaauuuuuguauuuuuuguagagacaagguuucaccauguuggccaggcuggucuugaacuccugaccucaagugaucugcccuccuccaccccgcauaugcuaggauuacaggugugaggcacugugcccggcugagaguauucuuuauacccauaguuaauguccuugaagccaaacagcauacauaauuuaaccugaauguacuugggauuucuggagaaauauuuugguacagcugguuuagaaguguuuuuugggaauaauuguuucuggaucuguaacggugguacucugaaagucauuuguaccuuugggcggaaaagcauuuuaaauauuaaaugggagcaggagaaugauuucugguuuuguuuuuuuuuuuuuguuuuuuuuuugagacagagucuugcucugucgcccaggcuggagugcaguggcgcgaucucagcucacugcaaccuccaccugcuggguucaagcaauucucuugccucagacuccagaguaguugggauuacaggugccugccaccaugcccagcuaauuuuuguauauuuuaguagagacgggguuucaccauguuggccaggcuggucuugaacuucugaccucaagugauccguccgucucauccucccaaagugcugggauuacaggcaugagccacugugcccggccagugauuucuugguauuuggaaaccuucucuguucuccuugucuuauguaaagacuacagaguuuucuguauuuugcagcuuucugggcaguaaucuauugaaaaagcauuuuuagcuuucaauucaauagcccagugauaaaucaauuggcuuauaucguuaaaaugauuuuacuuuuuuccacuuugccugauagagaugauccuacaaucuuccauggacugacagaggaaugagaauugauaauuagcugugugugauagaucuuauugguuugcuccauuuucuuguuuucauuugguaauacugucuuugcucagugugcuggagccccaaaggaaagcagcuggcagugggaaaacagaauggaacugugguccaguaucuuccuguaaguucuuaucuugaacuucagaauuuuucuuaaguugcccacuuuuuugggggugguuugggaguaucuuucuuguuuuuccuauuaaaaaguaauuuauacucauuguaacaaauccaucagugaaugaagaguggaacucuucccuuucccauaguccuucuuccagaggcacccacuauguuguguugaguagauagccuuccauacuuuucuggauguuauacaaauagucuauggguagcugcuuuuuuuuuguuguuguuuuuauguaaaaugugaucauacgcuaugcgcuguuccccaccuuuuucaguccauuccauaaaaacagcucaagggaaaagaguuagugaaaaaacuaugaugauaaugcagaaucacucuggguuaaagcacaguauuugucuuuuaacugagucugucuuuaaaggucuguuugucuaacuaugggcaccaaagaaaauggauacucuuguugcaugugcacucugucauccucccugugaauuucuugaaauaauguucacaaauauccuucaauaucaauugaguugcaaggaacccccauaugucuauugagccuggacacgaaggagggauucacagguggugcuaaggccuuucuugugccuuccuccucaagacuguucucuggcgaggaggggagcagaguggugaauguaggugguauagguuuaagguuaagguuauguuucuuauuuguuauuaccaaaaguuaccugaaauuugguacauaaucuuuuaggacacuaaccuguaaaaagauaaugcaauuuuuuaaauuuucuugcuuugcuguuugccuuaauuuuuuauuuauuuauuauuauuuuuuuuugagagauggucuugcucuguugcccaggcuggggugcaauggugugauaacguaaugguucacugcagccucagccuccugggcucaggugauccuuccacuucagccucccggguagcugagacuacaggcacuugccaccaugcacagcuaauuuuuguauuuuuuguagagauaggguuuugccauguugcccaggcuggucucaaacuccugggcucaagcagugugcccaccuuggccuuccaaagugcugggauuacagacaugagccaccucgcccagccuuauuccacuauugaugauugucugcaucagugcuaguggcguugcugcugcaaaugguguugcauugacuacucucauuaccuauaucugaacauguucaugcguucaugcguuucuuuucuuuucuuucuuuuuuuuuuuuuuuuggagaccaaguuuugcuuuugucacccaggcuggagugcaaugacgugauuucagcucaccgcaaccuaugccuccuggguucaagcaguucuccugccucagccucccgaguagcugggauuacggcacccgccaccacacccagcuauguauuuuuaguagagacgggguuucgccauguuggccaggcuagucucgaacuccugaccucaggugauccaccugccucggccucccaaaguguugagauuacaggcaugagucaccacacccagccacguucauggguuucuguaggaugaaguccuggaaguagauagcacuauucuguuucuucagucucucccggccaaggagauggaacagguagcaucuaaggaauagauuagauuugacaguuugauugguuuaggauuuguuucauuugauacuuuauuuuccccuccaaaucucuuucagacuuugcaggaaaaaaaagucauuccuuguccuccguuuuaugagucagaucauccugucagagguaacaacugcuuuucuuauugggcugaccucuaaugacauguuauguauauuacagaaauucaaaaucauguaauguaccugcucagugagguauugguguuugcuuuaugaauaaugucacuauuucaaacagcuaauuaagucaguguaaauuauggcccucugggugacaucuguguuucacgauaaaugacaugaaauggaucccgacuuuuuauuacaauucuucauaauuugcccugauuauaauccagcagaaaaauuaccauuuggggaugaguuugggcuucuugggucauuguaccugugcauuauauuuagucaaugaaaucagggccuuugauuuuuuuuuuauccauaguggcuauuccaaacauaagcugcuuuuucuuguaucugguugcugucauuuuuaugagcuacugauuaagaugugucuuucaguucuggaugugcuguggauugguaccuacgucuucgccauaguguaugcugcugcagaugggacccuggaaacgucuccagauguggugauggcucuacuaccgguaugccuguggaagaaauuucauuguuugagaauuagagaagucuucuaauaaagcuggaggcuuugauuucaagggguuuuuuuguguuuguguuuuuuuuuuuuuuuuuugagacaagaucucacucugucgcccaggcuagagugcagugaugcgaucucaccucacugaagccuggaccuccuggacucaagugauccucccaccuuagccuucugaguagcugguacuacaggugcacaccacuaugccuggcuaauuuuuuuuuuuugguagagauggaguuucaccauguugcccaggcuggucuugaacuccugagcucaagugaucugcccaccuaggcuucucaaagugcugggauuacaggugugcgucaccgcaccuggccugauuucagguucuuuuacuuacuggcagugauuaugcaacuucagguauaagguuuccaugcugcaccaugggccaggggucuaaaauuggaguguccacagcauguucuacuguuaugagguuaaaaaaaaaaugauuuugcuuaagcuauaaacuaugagucuugguuaacucgauaaauuuuagaaaagcaagacaguaucuugauuuuuaaaauuauuucauuugcucucgaauauuuaaugccaacagugugcuaggcacugcuuuaaagcugaguauauagcagugaucaaggugaugggcuugcuuuuaugguuuuaaguuuguuguuguuguuaauuuuuauuuauuuuuuagagacagaaucucacucuguugcccaggcuggcauguaguggugcgaucacagcucacuacagccucaaauucuugggcuuaagccauccuccugccucagccucccgaguaguugggaccacaggcaugcaccaacacagccagcuguuuuuaaauuuuucgcagagguagggucuugcuuuguugcccacgcuggucucggacuccuggcuuuaagcaguucucccgccucaucucucagagcacuaggauuacagguuugagccaccacaccuggcuggucuuacauuuuaaugggauagucaauacuaaaugugagaucaaggacugauaagagugauggagaaaauaaagccguguuagggauagaugaugacugguauguguuugagauugugugucaagggaggccaauuugauacuugaaaaagaugucuuguuuuuaacucuuuuggauuucuaauaagguugaguuuuugaaauauguuuaucuagaugccuuauuuuaagauuagagguuuuuucuauucuaggggauaauauuaacacuaguauuuauuaacugcuacuuauguuucauguacugggcuggaaguuuuguauguaucauuucauuuuacacuuuacaguagccucugaaguaggcuuaguaggucuaguauacacaugagaacacuaaguaucaggaagguugaaaaaucugcaugucucgugggcagaaaguggcagaacagaguuuaaaugcaguucgguugauggccaauguuuguacuccuuguacuaagugcugccuuuauaccauguccguauaucuggacuuugaguaaauauucucauauaacuuuaaaugauuuauuauuugagauucuuuugcugugggaucugagaaaaauugcacaugagaauuuuuuuucuugcuuuguucauuguagaaaaaagaagaaaagcacccagagauauuugugaacuuuauggagcccuguuauggcagcugcacggagagacagcaucauuacuaccucaguuacauugaggaauggugagcagagagucuggacagggcauuccugcucucacuggaagaucacaccugagucaccuugucccauguugaaaucuuuucugauugauugauugauggauuggcagggucucacuccauuacccaggcuggagugcaguggcacgauuguagcucacagaagccuggaacucccaggcucaagugauccuuccaccucagccucccagaugggacuacaagcacaugccaccacaccuggcuuauuuuuaaauaaguuuuuugguuuuuguuuuuuguuuuuagagaugggaucuugcuauguugcucagacuggcuucccaaaguacugagauuacaggugugagcuaccgcacccagccugaaaucuuuuccauuacagaggaaaauggaggcugagaugccuugaacauauuuucagcugauucuugauaaugucuuucuauuauuucuguuuccccaaucuugaauuauuuaucuuaaauacauacuaauuucaaaaaucuaauuuucucaauaaccccuagugaugacuuacgaaaauauugauauucaaggaauauauuaaaaguuuccugagagcagaguugcccuuuggaauggagauuacucaaagcaaagcuuccaucccucuagcuacauuauucugccuuuggauggcauauugauugugaacugugacuugauucuguugugucuuuccuuugucuucauguagguaggcacugagcugauucuacagggcuuucucacagaaacuaaaaaguucagcuuuacaucuagaaucuucccaccuuuguucaaccagauaaaaaaccuuacucucucuuugacauguggaggcagcccucacagguguuaccugcagacccagguuagcuuagaacuauugcuguauuugaacguaauggucucugguuuuauucuuuaagggauuuagugcuggcagcaucugcggcuucaacagaaguuaguauccuugcucgacaaagugaucagguaaaucucuuuuuugucacuucuguggugcuuucuuuuuuaaauuauuauuuugagacagucucgcucuguuguccaggcuggagugcaguggugcaauuucagcuuacugcaaccucugccuuccaaguucaagcaauuuugugccucagccucccaaguagcugggacuguaggcgcgggccaccacaccuggcugauuuuuauauuuuuaguagugacuggguuucgccauguuggccaggcuggucacaaacuccugaugguacuuuucugaaaaagauuuuggagggaauuaacuauaugugguuaagguauacaugaucucacaucuguuuuaucaaguuucugcgugacagcaaagcuucagugacagagugccuuggccaaauggcuuggcuauugcauggagaaacacgggugucagacuuagcacuuccuucgcuucuguucuuuuaggauccaaccccugucuguggaaacauaccaugcaguuaaccuccaacuggaguaugccugauguguaggcggcuuuuucugccuuguccuguuuugucaucuuuguuuuauuccuguugcuugaaacaacuucuauacaauuuaaugauaauccauccucaguuaugaaagaaaaacaugcagaugacacuaaauugugauucaccagaaguacuuucuguuugacuuugaaaaacugucagaaggagcaaagcaccuuugcauacaagaaccuucuuucacguugucuuucuugcagggacacagugggcccagguagugguggugcgcuauccacuuguagauuuugcagaaugacuguagagagggcacaacgaaagaagggaaacuucuuuuuaaaacuggcuugaacuuaaaaaucuuuagugcacccuuauaaauaagaagcaagugcuucuccuccccacauggauacuuugugcuccacccauacauagguacuuugugccucuucaaccauuggcauuuaucugucacucucuggguggccagguggcccauuaggagggccauggcucucauugucuagggguggcugcuuuuggaugaggcuagaguucagccaucugauuugcugcucuagaacuaucuuagauugaccucaguaauaauuucuuauuaguacaaguauuucauauguucacacauuaaaaaugcaauuuuauuuuuacuuucuaucagaauaauuuauguucauguuuuugaaaaguaaauaguagagaagggcuuauaagugaaaagaaucaccccugcccuaccuguuugcuuucuagaggggacuguuuuuaauuuguaaacauuuucuuauaaugcugccaccuuaucccuaaagaaaaaucugcuuuauaacuaguaauugguuauuaguuuuagaccuuacugacuguacggcaaaugaugaucuagcucacacauggcccccaguccccuccuuccucucaagaguuacagcguuguuuuaauuucuuaucuuggugaaccuuuguaauuuuaauugguguuuuuuacccucauuucuggugguaucuuuuuuuuuuuuuuuuuuuuuuugaggccaagucucacuuugucacccagugcauuggcgccaucuuggcucacugcaaccuccgccucccugguucaagcgauucucaugccucagccuccuaguagcugggacuguaggcaugcgccaacacgccuggcuaauuuuuguauuuuuuaguagagacagguuuuugccuuguuggccaggcuggucucaaacuccugaccucaggugauccgcccgccucagccucccaaagugcugggauuacaggcaugagccacagcucccggucuggugauaacucuugaucuuccacuuugugagaggaaugucuuagcacucccacccuuucccuugguagccuuccaguuguuaucugcgucuucucuuuuguaaaauugcauucuguccuacaaugauaagucaucuuuaucuugucuguagacuguuuuuaaaaguugagauuguuuuuguuuaauaugaacgugucuguuaccugcuccauagcuaagucacauagugugauuucauucccucuccugaacugccugccugcuugcuuucuugcuugcuuucucucucucucucuuuuuucuucuuccuuccuuccuucucuuuccuucuccuuccuuuuccuuccuuucccuccacuccccucuccuccccuccgcucuccuccccuccccuccccuccccauaaccuaggccagagugcagugguaugaucucggcucacugcaaccucugcuuuccggguucaagugauuauccugccucagccucccaaguagcugggaccacaguugcacaccaacacgcccagcuaauuuuguauuucugguagagacgggauuucaccauguugaccaggcugguuucaaacuccugaccccaggugauccaccugccucagccucccaaagugcugggauuacaggcaugaaccacuacauccagccuguuuuucuuuguuggucuuuaagcacuauuccccugugauucaugcuucccagucuggucaacacugaaaguuaggcaaaauguuagugauuuuaaaaaccaagagucauuuguuggaaggaacagagccuauccaagcacacuuaagcaaaaagggaguuuacuagaaagacuuaguaguuucucaaggaaucuggggacaggaaagcugaccagccugaggaacugguaccaagaacugggaagaagaacuaagguuaucucugucucuauagacgagugagcgcagggcaucugagcacagaccagccuuacaugcuucucugugaaagacugcaguagagaucagcuggaguuccuggccccaauccaaaaugucuaggagcagguauugacuggcuuagugcugcuguuggauuugucccucauggucagcaaucucccuaguugucauggaagguaccucagaaaauguucaugauagugguuauuuauuuacaaggcagaggcuugauacaccaggaacagauagagaggggguugauuuggaaaauuaacuucccauuugcugggguacuucuggcuuuuaggccaucuucucagauuucagagccuccuagucaacaccugagucuaaaccaagugagucaucucuguucuccuauuugaacaauguuaggaggaaccaaugcaaagcucuaaccaacauggcuuuuucuuuuuucuucuucuucuucuuuuuuuuuuuuuuuuuuuuuuuagauuaauugggaaucuuggcuacuggaggauucuagucgagcugaauugccugugacagacaagagugaugacuccuugcccaugggaguugucguagacuauacaaaccaaguggaaaucaccaucaguaaguguagccugguaguuagugcagaaauagucuucuuucuaguuaggguuaauauugaaacaccaguuacauguuacugacagagucuacucugcugggcacuuguagcuucuggcagcacauuucucccugaagagugauaacaggcugcguugugacaacacuaaacugauuugaauggauguucguugaugagaccaaggccaaacacuguauguaugugugggugcauguuugcacacuugcacaugucuggguguacuuuagaaucugguugaaauauagaacaucaggauuuuauggcuugguuucuuuguccaauccaauucccuggugaccucccaaagaagcaauacccgaaucugguacugcacacaaguacuugguuugaaggcaaggauuagaaaauagagaccucaggcccaugguuuccaaauagggccuagauauguguuuugaauagaucuucccugcaguagcuuggcuauacuguagucauugaaauguaaaagugccacaaaagaaacagucuuugccaucugguacuuaaguuuagagagguguccccgucaggcaccauuaaguugcuugcuccuucccugguuaggcaggaguauuuguucugauaagcucauuugcucugauucucuugaagccuuaacugauaaaauacauacuugucauucagcugugaaugaggauaaagugguuugacucaucuuucuguguccuacuguccauuccaaagagucuagucucauuuuccuacuaaccuaaguacuucuuagauauucuucucuuggucaggggaaugccaagccuaccuccacugagguacacaagccacugagacacucauaaaaacugagggaccuuugggagagucagagcuacugcgggacugauggagcuucuaggcagggcccagcagggugguggcgaucugauagcggcaggaacucucuuuaaauagcuggugcacgaaaggcuguucagauauaaaaucagaacaaacuaacuugagcugcuauucagaugagucccuuaaacccucuucauguugagggcagucuuugccuucugggcucaggcccuuaaauucacuugguuuuuuuauuuuuguuuucuuuuuuaacaggugaugaaaagacucuuccuccugcuccaguucucauguuacuuucaacagauggugugcuuuguccauuuuauaugauuaaucaaaauccugggguuaagucucucaucaaaacaccagagcgacuuucauuagaaggagagcgacagcccaagucaccagguaugugccucugccugcuuuaucaguaagggaauaccaugggcuugcacaagaguauuuccaagaaugaacauggugugaagacacauagugauuaucuuuaccagccuggucugucuuaggaaggcacacacuaaucuuuuuuuuaaacaugcauguacauauuugccuuccccuacccucaagcuuuauucugcagccauuacuuuacuucggagaugaaggaaggucaaccagaugauuugcauccagucguuuaccaacaguuuucuaagacccuauauuaugugaugugcauccaaaagacauugugcuuaaucauggggguugguuaaagaaaugauuguauagucuuacagugaaaugccauguaccaauuauaaauguuauauuuauugacagggaaggagugaguggaauacaucaccaaaaaaaaaaaaaccacuauucuuugugaucuuuucuguaugagaaaaaacauauacauagaaaaacaacuuggagauggauuuaaagucuaaauggugguuauuucugggugaugggaacauggagauuuuuguuuauauuuucuugacuuuuuuucuccuuuuugaaacauuucuuaaguaauagauguuuauugaaggaaaaugagagcaugcaaaacaauggccacagucaacauuuugguaccuauccuccaugaaaaugaaugcacacauauaaauacuagucuguauuuaaacaauuuuuacagugacauuuguaucacuugugaaaagaaacuuuuuuuuuuuuuuuuuuuuguggagacagggucuuacucuguugccuagguuggagugcaguggcaugaccacagcucacuguagcccuaaucucccaggcucaggcagucaccuaagccucccaaguagcuggaacuacaagcaugcgccaccauaugcagcuauuuuuuaaauguuuuguagagauagggucuuacuguguugcucaggcuggucucaaacaccugggcucaugugauucuucugcuucagccucccaaagugcugggauuauacgcaugauacacugugcaugaccagaaaauauaaaacuuuuaaaaagagcauuguuucauauguuggaauuugacuaauauuucucuuuuugaauucugugaguauauaacugauacaauuuuuuucuucuauuaugaccaguuucuuaccuaagcaaaaauguaugaccaguugguuuguauaagguuagcaauaacuuagggguauauucucuuccugcaucccagugcacagugaguuguauaucacaaauagagccacucagauacuugggcccuaacaacuggcagcacuaccccaagugauauaccagauggcuugcagaguguuguaucaggguaguccauuauucauaguguguguacucuuuguguuguuuuuuuuuccuccuuauucagccaugaauaaggguaccaugaacuaccuauacccagcugccuggugugucuguaauaagcagagcagccugugagauuaggagccucugggaugggacgagguuuguuucugagccuuugcuacuagcccauucaaugcuggagcacaaucagaggccaguuuuacuguuagccuuuccuagagaaacuccccucuuccuucacaguugguccagagguuauaguuguguucagauguguagaagagagccccugcggggagaaaguccgucccaucagcuaagucuagcuaaagccuacuucauggguucagaagacauuaaugguuccaccuguuucuacacugcaguucuaaggaugcuguauugaucagaaguaguaguagcaugaugguuuuccaauaaucaguucuguuuucaguggaaaaaaugcuuuugauuuauuuagggucugguauauauuuuucaugucaguuuaccuaauaugcaugaaaguguuuuaacaucuauguaugucuuuacagaaguuaguuguagcugguuccauaucuauuguauaaagaaguauuaacagaauagguuugcuugcauuauuauacuuucaucaaugugacaguuuacuuggauuuuuguuuucagaaagugguauuuucauacuuguaucuaaguauuacguugcauuagacaaagugucuuccaugaagauaaacugccaucuuagcuaauuuggaacaaccaaguccuauuaauauaaauagaaaauauugacacaaagaauucuuuucuuauuuaguugguuauuuaauuuaaagauuaauauuuuuaccuuauggaaaguuuggaaaauagaaaaaaaaauuauucauuuuugagacaggggucucacucuguugugcaggcuggaguguaguggcaggaucuuggcucacugcagccucugucucccaaguccaagcgauccucccaccucagccucccaaguagcugggacuacaggcacaagccaucacaccuggcugauuuuuguauuuuuuuuguagcaacagggucucacuuuguuccccaggcuggucucaaacuccuggacucaaaggguccuccugcuuugcccucccaaagcucugggauuacaggcaugagccacugcgcccagccuuccauugacuuuuuuuuuucuuuuuaaccauuuggauugcauuaaauaucuuuuucauuuuuugcauuauguuuguaagcuuuauucuuagaagagaaauuacugggucuguuuuuuacaguuuuuuauacaaugccaaaauguuuucuuaaaaaaaauacuaguuaccuaccagugauaaaaaguuucagguuuguuuuacccauccaaacauaagggguuagacauauuuaaauucuuauaauuuagaggacaaauuaaaaauguaccuuguuuauauuucuuugauuagagagauugaauguguuuucuuuaugugaguuaguuucccuguuuauuaguccugaaauuuuaaaaucucaauuuguaugagcuuuuuaaaaaauagaaaacaucuuauuugucauuugcuauggaucuuuuuuuuuaguucauuaccauuuaguuauuguaccugaguagcuauuuuuuacacaaaucuuaaccuucucccuuugcgauuguuuuuuuuuuggucacuucuaaauuuaucaagguguuagauucugagaccuaacauaucuaucaauuugccuccuuuguuuugagauaccuguauuuaugugacuuucuauguguauuuaucuggaauuacuuuuagugaaauaagguggaggucugaauuaaaacuuuuuccugguuguuaaugaaauguugcagugacugaacuguuuugugugccauaguagcacugagaaguccaugaaguccaauuauucuaaugucuuuccuuaguuuuccuucaguuucauuuaucucaugagaccugaaaacuccaacaugaacuguguacccauguguucuuuuugcuucuuaaacuaguaacauuucuggcuuuauucuaccacaaauucuuuuucacuugcuuucuauuaugugaaccuccacuguuacaguguuaacauuuuccuuccuuuuuuugucacugcaggaaguacucccacuaccccaaccuccucucaagccccacagaaacuggaugcuucugcagcugcagccccugccucucugccaccuucaucaccugcugcucccauugccacuuuuucuuugcuuccugcugguggagcccccacuguguucuccuuugguucuucaucuuugaagucaucugcuacggucacuggggagcccccuucauauuccaguggcuccgacagcuccaaagcagccccaggcccuggcccaucaaccuucucuuuuguucccccuucuaaagccucccuagcccccaccccugcagcgucuccuguggcuccaucagcugcuucauucuccuuuggaucaucugguuuuaagccuacccuggaaagcacaccagugccaagugugucugcuccaaauauagcaaugaagcccuccuucccacccucaaccucugcugucaaagucaaccuuagugaaaaguaagucacuucuaaaguuugauucuucugugaguuggguagaaauauuggauguuauuuacuaaaaguagagucacucugagaggaguuaacugaguagaauuuuuuuacccagagugauacuugcaaauggcaaaaauucaaccaacauaaaauacuggcauuucaucagugaauagaguccagaagggucucuuagcuagcauuuuauuuuuuugacuaugggauuuauauucagguauuuguuuugcuuuuuuacguuacaaauguaggaaauauuccuuauuuuaaaaaaagaagcaauccagaguaugcauccuggaagggaaaugaaucccuuguagucuuuuuuccucccugugucuacccuuaacucucucugaacugcugucuacacagccacaaagucaucuugugacacuguaaauuguuaggugauucuucugcuugacagucccuaugaagccccguggcugcucacugcuaauucuuagguugguauccaguuuccuccagaucugggucgggcagcucacucauuucuuauuuauuuacuucuuuaucuuguucuuuucuucccacuagaauguaagcuuuuggagggaagcaaucccuuauaucuuguaaccccucccaagauaaccaugaguucccaagauaaccaucgaguauaaguacuaccagcuuuuucccuacuugccuguacuaucuguuguugcuaugguggugcugcugccaccacaguuacuguuaauacugaauuggcacacauccacuucaugcuaaggguugcauaguguuccauuuuguugacugcaccacaguuuaucugaccagucaucuaaugcuggaguuuagauugucuacagacuuuugcucuuuagguggaaccgacuuuacauuuccuuuaggccauaaguaucccaaagacaguucccugcauuccucuuccuuuuucacuccccagagaaggugcucacucucaaaacgaguucucaguaauuuccuugguaagagaaaguacuaacucuccuaagcauaauugugucccaccuccuguuuaaaacucagcuggaaacaauaguauuucauaucaugauaaacuugguauuucauauugugauaaacuuaguuuugauauuuccccugaauaauuaauuccuaaauaagcagacgaaaagauaaauguuuccuugcagcuuucaccuuuuauaagaaauagcuaaacauuuuuguuuccugaaggcaaaaaguauguuaucuuuguaaguuaacauaaaagauaauaaguuaucuuuugaugacauugcucaugcuaguguaaaagaaucuucuagcaggcucuucugaggccuucaggcugccauuuuucagguuuacugcugcagcuaccucuacuccuguuaguagcucccagagcgcacccccgaugucgccauucucuucugccuccaagccagcugcuucuggaccacucagccaccccacaccucucucagcaccaccuaguuccgugccauugaaguccucagucuugcccucaccaucagguaugauuuuaagcagacaacuuuagaccucagcccugccuucucagauuaacgguuuuaaguguuaagagucguagcuaacauaguuggacaagguuauuuuuucuugcuuccuguaucauacauuaaugauuaaugugcugugauuuucauacucugaauugggagauuugcucuugcuuaaaugcugccacucuucucucugacacuucuuauggagcuaaguguauuuaaugagucaaaaaugccuugcucuugggcauuuauuuucauauggagccugcccuccaugaagagcaguuacauaacaguucuuuaagaagcacaggcacaagaguuguuuggcggggugcgguggcucacgccuauaaacccagcacuuugggaggccaaggcagguggaucaccggagguuaggaguucgagaccagccuggccaacauggcaaaaccccaucucuacuaaaaauacaaaaauuagccaggugugguggugggugccuguaaucccagcuacucaggaggcugaggcgggagaaucacuugaaccuaggaggcagagauugcagggagucgagaucacgccacugcucuccagccuggcgacagagcgagacucugucucaaaaaaaaaaaaaaguacagaggagagaguaccugcagugauuauauucauauuuucacagucagucauacuguaaacaggaaguuuuguuuuguuuuuugagacccucucacucucucacccaagcacaucacugcagccucuaccuccugggcucaagcgaucuucccaccuuagccuccugaguagcugggacuacaggcauguaccaccaccgucggcuaauuuuuaaauuuuuuuguagagacaaagucuugccauguugcucaggcuggucucaaacuccugggcucaagcaauccuccugccucagccucccaaaaggcuaggauuacagguuugagccaccauaccuggcuccuaaaauuuuaauauauuuuuuucauuaucuuagaacagaggcuagcacaacugguggucaucacucuuuaaaauaaaucaugaaagugggccaggggcaauguguaacuuaauuucuuagauuuggagaaaggacauuugugauaggagaaauaaagguaauaaaugccaucuauuuuaacugacuucuuuuucaagcaggacgaucugcucagggcaguucaagcccagugcccucaaugguacagaaaucacccaggauaaccccuccagcggcaaagccaggcucuccccagguauguuuaaauucagcuugcaauguuuguguuuauuaauuuacugccccaagcauaccuaugaauaaaaugaguuuucauguuuuauaauucagaccuuggacauaguaauugggacuaugugauaguaaauaccaaagugcgagguuugaauacuuguauacucguaaaagccauuuagcuauuuuaauuuuuuauucauguauaauacaaauagaaaaaaguacacaugauacauguacagcucagugaauugucaacaacugaacauaccuugguaacuagcauccagaucaagaaacagaauuuuacgagaaccuggcugggcacagugggucaugccuguaaucccagcacuuugggaggccaaggcgggcggaucaccugaggccaguaguucgagacuagccuggucgacauggugaaaccccgucucuacuaaaaacgcaaaaauuagccgggcgugguggcacguacuuguagucccagcuccugaggaggcugaggcaugagaaucacuugaacccgggaggcggaggccagaaccccagaguucuuuuucaccuguccccuucuagucacuacucuugccaaagaguagcugauuugauuuccaacagcauagaugagguuagccugccuguaccuccuaucaaguggauuuguacaguauguauucuuguaucuggcugcuuuguucaacauuauguuugugagauuuauccaugucguuguauggaauuuauugugugauuauauuacaacuauuuguuccacucugaugggcgcuugaguaguuuccagguuuaagccauuguauguagcacugcuaugaccguuccaguugacaucuucaaugaacacauaugcaaguuucucuuggguguaucccuaugagugagauugcugggucauagaaucugcauguauuccucauuaguagauucccaccaagaguguaugagacuucuggcugcuccacauacuugccacucuugguauuuuucaucuuuuguuguaugguuuugugguuuuaauuuguauuucucuaaugauuagcaaaauuaagcuuuuuaaaagaugauuauuggccauuugaauauuuucuuuuauguugugucuguucaugucuuuauucuguuuuucuguuggauugucuggcuuuuuccuucugauuuuuaagagugaguuccuugaauacacacacacacgcacacacauacagugcaaauauguucucacugugaauugucuauucauugucuuuuuuguuucuuugaugaauacacauucuucauuuuaauauaauuaaguauaucaguuuuuucuuuuaugauuaaugcuuuucauguuuuagaaauaauuuucuauuucaaggucaaaaagauguuuuucuaaaagcuuuauuauuuuaucuuucauauuuagauuuguaguccaucaucucaguuuauuuuuaugguauaauguaaagagaauuguaugucaguuucccacgugauuacuugagugcccugagaauaagcguuaugucuuuuccuuucugugucccucuaaccaacccuuguacccuaacacacaccuguacuagguacauaguaagugcccaggucacaguucacgguguggcaugaugcaugacauacaguguuugucaaauaaauguuugcuguuaaugaaugcugaugcagucuaagaccucucuaguguuaaucguuguaaguaucaaauagucuaaagggcauuucaaauuauaguaucuuuaaagcagaacucuugauuucugucuccccuagaggcuaguccuuuuccaauggguaaguagcacuaacaaaccagauguuugcacaagccccaagccccgaagcauccuagaucccucucuuuaacaguaccuguccccaguccaggcuggcgggaggucuugucagcuccacccucugcugugucacaugucauaagcccacagcucugucccccugcuagcauccugugucaagcuguugcaccucucaccuuguuaaccucucgacuacucucucugcuaucccugcucuacauagcagcaagagggaucuuuuaaaucauaaaggagauuuaaacucuuguaaaacaccaguaguagcuuuccaacacguuuagaauagaacccaaacuccuuggugugaccuuauaugaccuaccccggccugccuuccugacucuaccccugcccucuacaacgccuccccugacuucacagagcccacauuuacuuuuuuucuuugcuaagguuucuccugccuugagaccucugcacuugccuuucuuggugccuggcaggugcuuccugaagaucucauagcuugcuuucugcuugcagccuccguucagauggcagcccgcagugagggcuuucuuggccaucucaucugaaguagugcccuuuuuuauucucuuuauguuucccuguuuguucuccaacugaaauuaucagauguguuuauauuuuauuauucaacaugucccaguaggagguaaguuccauaagaguugggcccucaucuacuuguucaccucuaccugcacugucuagaacaugccuuacacaaaguagagacccuauaaauaaggauucguuacaaugagugaagaaauaaugacuguguuacaggagcgccacucccuguaauaggcucugauauaauugcuuguagaagcuaugacuugcaguuuuuaaaccuuuuccuuccauuucaggcaaagucacuucagccugcuguugcagaaaagcagggacaucaguggaaagauucagauccuguaauggcuggaauuggggaggagguaaauuuguuuccugaggguguuuuucugaaaguagcugacagacuuggaugggucagagugccaaccccuguaugacuaguuaguucauucuagcgcugaagcauggcccaucccagcagucugagcaguuaguaagcacgauagcagugacauuacuguuuguccuucagacugaguaguuccucacuuguggcuucuacagauugcacacuuucagaaggaguuggaagaguuaaaagcccgaacuuccaaagccuguuuccaagugggcacuucugaggagaugaagaugcugcgaacagaaucagaugacuugcauaccuuucuuuuggagauuaaagagaccacagagguuuguguuuauggauacuuuuccugaguugaauugcauuuaacaauuuuuuucuccuaguacuccaugggguuauguacuuuauuucuucaaggaccaccaguguuguuguuuuuuuaacguggcugaguagcuugccuagaaucccugaguucaaauccuaccuucagcacuuaauaaauuaugugacuuugggcaaguuaaccucguuacucuauuuuucaguuuucucaucauaagauggacuaaguuucuaucccuuugaugcauacugugcacuccauaaaauuuauuauaauuguuaauuuaauuuagguuuauuugaaauuuuacuaucucaaauaguguucgauuuuuaaaaaaggauauuuuaggacauaugcaguaugaaaauauuaaaugcuggguguuaauaguguuaauuauuguaaccauuauuacuacuuacugugugccaggcacugugccaaacgcaucacuuguauuaucucacugaauccucacaacuuugcugugucauacauacuguuacccuauuuugcaagucaggaaacugaggcuuaggcaaauuugucaaaagucacccacuuagcaagugguagugccagaauucugcuucagacucucugauuccagaguucgggucuuaaauaguguguuuggaaagaggcaaguucuuuagaguguuagcaguaauuaucuucacauaguaguguuagagcuacugucuuuguauuuucugcauuuucaaucauuagaauguauuuuuucaauggggaugaaaaauaaauauaaaaaaagaacauuagugucguucuaaacaguuaaauucuuuuuuuaccugaguuaaauauguucagauguucauucuguucagugagcguuugagaaacaccaccuuccuugauccaaacagaaagauuuggacguaacaacuuuuuguaccaacacauuauuguacuuuuucuagucgcuucauggagauauaaguagccugaaaacaacuuuacuugagggcuuugcugguguugaggaagccagagaacaaaaugaaagaaaucgugacucugguuaucugcauuugcuuuauaaaagaccacuggaucccaagagugaagcucagcuucagguaggagaucuauguaaaucuguuuaaaagauuuaaaaacaagcucauguaacaauugcuaccucuuuuugcauauagauuuggaugauggcucuuuuugaaguuguugauuuucugcuuauaauuuaccacauuucccguaaacuuccuuaacuguggcaaacaguacacuucauguaauuauguaauuuuuuucacuuaaaacauagauuuuuuuuaaaauacuuuuuuucuugagacagggucuucucacucuguugcccaggcuagugugcaauggugugaucccagcucacugcagccuuacuuccugggcuuacgugauccuccugccucagccuccugaguagccaggaccacaggcaugugccaccacacuuggcuaauuuuuaauauuuuauuuggagagauaagguguuacuaugcugcccagcccagcuggucuugaacuccuggggucaagcaguccuccugccuuggccucccaaagugcuggaauuacacgcgugacuggccaaaauuuuuuauuaaaccuuaagcuuaauagagaauacucuguugaaacauguaaguugaauuauaaauaaauaauaauuauaaauaaauaauaaaaauaaauaauaauuauuaaaguggcaacuauuucuugagugccauuuaaucugcuagguguuucuuaugcauuauuucuagccuucaaagccagcugcucugcaagguaagaguuacuggucccuguagcccauuauacagguaacuggaaauuaaauuucauaggcuaaguagcuuguccaaagucauguuggcuaggaaacggggaaccagaauugaaaccuccauuugccugagcucuuuucuguaugcuacacuuaacuuuucucuugaaaaaaaauuuuuuuuuuuuugagacugagucucgcacugucgccugggcugaaguggcaccaucacagcucacugcagccucaaccucugggcucaagugauccucccaccucagccucccacauaguugggaguacaggugugugccaccacacccagcugauuuuuaaauuuuuuguagagauggggucucacuacauuauccaggcuggucucgaacuccugagcucaagucacccuccugucuuuguaaucccaaaauucugggguuacaggugugagccacuauucuuaauuauucuuaaucucugcuuuugcuaaucggauuuugcuuuccaucuuucaguguacaccgaaucauugugucacuggccuuaguguggggguccucuucugcuaucucacauuugucuggaauuccagcgggaagcguucacuggcaucucuggucuuccucaugacaucugugggguuugcaggugugaugaaucauucuugccucagagaauuugaggccucaaacuuuauuguuccccaguguuucugucccacaccuggucaacuuacugaaaauuaaaaaaaaaaaagaaaaaugguuccuucuucaagauagauugcagagcccuugcugugaucugcagcccucugguauuccugaugcguccucuuuccacuguggauauuaccucucagcaagagagugcugccugccuacugcucaucaaauuacaggcauccgcucugcauccgagcuacauguuguuccuaugugccuuuccaccucuuucucuauugacaaacuaagaggaaagcauacagcuuuagggagacacuuauucaggagggaauaauuuucuuuuuucauggugcuaaguagauaauacuaguuagcauguauugaguguuuacuauggacaaugcacagaugaugaaaccaagauaacugaaacugcccagguuuuaccacuaauaaaccuugaaaccuugaaccugggcagucugacucaagagccugugcucguacucaagagucugguuuacaguucaugcagguuuacaauucacucggguuugcaauuccugcaguuggguaagugacagagagaaagacgaacauguaaauguagugugggauauguugcuaugggaccacaggugagggagcagccgagccagagaaaagaaguauuugugauaggcuuuaaaagaagaauuguuuuuggcuggugggcacaauugggagggcauuccaaagaaacagcagcagcuaacgcagaggugugguuguaucugaagugaucaaaggaaagagccucggugaguugaaaguuacauuugcuacuaagguuacuucuacuucucuugaaucaucuuggcucuuuuaaaauuacauuuucucuuuuucagauaggacauagacccuuauccacaaaauaauuuuuuuuuaauuuuuaaaaauuucaauaguuuuugggggacaagugguguuugguuacaugguuaaguucuuuaguggugauuucugagauuuuggugcacccaucauccaagcaguguacacuguaccccaauguguaguauuuuagcccuuaccgcccucucuccuuuccccccaagucuccagaguccauuguaucauucugucuaucuaucugucugucugucugucuaucuaucuauuuauuuauucauucagagacagucucacucugucacccaggcuggagugcaguggcgugaucuuggcucacugcauccucuuucaccguguuggccaggcuggucuugaacuccugacuucaagugaucugcccgucuuggucucccaaagugcuaggauuacaggcgugagccaccgcgccuguuccguuguaucauucuuaucccuuugcauccucauaguuuagcuccugcucauaaaugagaacaaaugguguuugguuuucaauuccugaguuacuucacuuagaauaauggucuccagcuccaucuagguugcugcaaaugccauuauuucauuccuuuuuauggcugaguaguaguaguugugugugugugugugugcgcacgcgcacgcucgcgugugugucacauuuucuuuauccacucguugauugaugggcauuugggcucguuccauauuuuugcaauugugaauugugcugcuguaaacaugcgugugcaagugucuuuuucauguaaugacuucuuuuccucuggguagauacacaguaguaggauugcuggaucaaaugguagguacuuuuaguucuuuaagaaaucuccauauuguuuucuguagugguuguacuaguuuacauucccaacagcaguguaaaaguguucccuuuucaccacauccacaccaacaucuauuauuuuuugauuuuuaaauuacggccauucuugcagaaguaagacgguauugcauugugguuuugauuugcauuugccugauaauuagugauguuaagcauuuuuuuggauguuugucaaccauuuguauaucuuuuaagaauugucuguucauguccuuagcccacuuuuugaugggauuguuuguuuuguucuugcugauauguuugaguuccuuauagauucuggauauuaguccauugucgaaugcauaguuugugaaaauuuucucccacucugugaguugucuguuuacucugcugauuauuucuuuugcugugcagaagcuuaauuaagucccaucuauuuaccuuuuuguugcauucgcuuuuggauucuuggucaugaacuccuugccuaagucaaugucuguaagaguuuuucugauguuaucuucuagaauuuuuaugguuucaagucuuagauuuaagucuucgauccaucuugaguugauuuuuguauaaggugagagaugaggauccaguuucauucuuuuacauguggcuugccaauuaucccagcacuauuuguugaauaggguguccuucccccacuuuauguuuuuuguuugcuuuguugaagaucaguuggcucuaauaauuuggcuuuauuucuggguucucuauucuuuuccauuggucugucugccuauuuuuguaccuguaccaugguguuuuggugacuauaggcuuguaguauaguuugaagucagauaacgugauaccuccagauuuguucuuuuugcuuauucuugcuuugacuaugugggcucuuuuuaguuuuauaugaauuuuaggauuguuuuuucuaguucugugaagaaugaugaugguauuuugaugagaauugcauugaauuuguaaauuguuuuugacagcauggucauuuucacaauauugauucuacccauccaugagcaugggauguauuucugucuuuuuuuuuuuuuuuuuuuugagacggagucuugcucugucacccaggcuggaguacaguggcacgaucucggcucacugcaagcuccaccucccggguucacgccauccuccugccucagccuccugaguagcuggaacuacaggcgccugccaccacgcccggcuaauuuuuuguauuuucaguagagacgggguuucacuguguuagccaggauggucucgaucuccugaccucaugauccacccgccuaggccucccaaagugcugggauuacaagcaugagccacugcgcccggcugagcaugggauguauuucuauuuguuugugucguuuccauuugugucgucuaugauuucuuucagcaguguuuuguaguuuuccuuguagaggucuuuugccuccuugguuagguauauuccuaaguuuuuuuuuuuuuguucuuuuuuuuuuugcagcuauuauaaaagggguuguuguuuauuugauucucagcuuggucgcuguugguguauagcagugcuacugauuuguguacauugauuuuguauccugaaaguuuacugaauucguuuaucagaucuaggaccuuuuuggaugagucuuuaggguuuuuuagguacaugaucauaacaucggcaaacagcgacaguuugacuuucucuuuaucaguuuggacgcgcuuuauuuuuucucuugucugugccagcuacacaaauaauuuugaaaauacauuuaaacauaauaagaucucucuacagauguaaacugcuuuuccuaguguauagcacauuaucuccauuuguagacauacuuaauugaaugccucaguuuuauuuuauuuuuuuuuaggagacagaguuuugcuauguagcccaggagugcaaaggcuauucacaggcaugauuauggugcacaaaagccucgaauuccugggcccaggugauccuccuaacucauccuccugaguagcugggucuacaaguguacgcuaccacguuuagcucuguuuuuuuuuuuguuuuguuuuguuuuuuaauuuuggacacggucuuucucuguugcuugggccagaguguguggugcgguggcacgauccuagcucacugcagccucgaacucgggcucaagugauccuucugcuucagccuccuaaguagcuaggacuacaggcacacgccaccaugucuggcuaauuuuuaaaauuuuuguagagauggggccuugcuguguugcccaagcaggucucgaacaccugggcccuagcacuccuacugacuuggccucccaaagugugagauuacaggugugagccacugugucuggcguuuuuuuuuuuuuuuuuuuuuuugagagagagucucacucuguugcccaggcuggagugcaguggugcgaucucagcucacugcaaccucagccuccuggguucauguaguucuccugccucagccaccugaguagcuggaauuacaggcgugcaccaccacucccagcuaauuuuuguuuuuuguuuuuuguguuuuguuuuggagacagggucucacucuuucacccagguuggagugcaguggcaugaucucagcucacugcgacuuccaccucccagguucaagagauucuccugccucagccucuggaguagcugggauuacaggcgcgcgccaccacacccggguaauucuuguauuuuuaguagagaugggguuucaccguguugaccaggcugguuucaaacuccuggccucaagugauccaccugcuuuggccucccaaaguacugggauuacaggcaugagccacugcacccagcucuaauuuuuguauuuuuaguagagaugggguuucaccauguuggccaggcuggucucgagcuccugaccucgaguaauacacccguccuggccucccaaagugcugggauuacaugcaugagccaccaugcccggccugauuuuuuguuuagagacagugucuugcucuguugcccaggccggagugcaguggcgugaucucagcucacugcagccuccgccuccuguguucaagugauucuugugccucagccucccaaguaccugggauuauaggcaugcaucacccugcccagcuaauuuuuguauuuuuagucaaggcgggauuucaccauguuagccaggcuggucuggaaguccuggccucaggugaucugcccaccuuggcuucccaaagugcugagauuacaggugugagccacagcgcccagccaccuggccuguuuuuaauuuuugagaaucaaguugcauagccaugaagguuaacagucgcccaaaauuuaaauaaaauuauugcaggccuauaauaaguuaaauagcuaaaauuuuaaauaaugacagauucaguuuuuagugcugauaguguucuuugauuuugcaaacaaaugaguauuucucaaaugggaagaugacuuauauguucuaugcugugaauagauagguuuagaauuacuuucagcaccguuuugucuccauuacaguuaauuuuaugggugggagagcaaaaucuaaauggaugcacugucugaguaccagaauggaauggaaaauucccagaccauggaacugagaaaugagaauuaagcaagaacauuuguucccugggggccuaggcagccauacccauucuguuucccuuuucauuguaccaccucucugccaccucugccuccuggguucaagugauuccccugccucagccuccugaguagcugggauuacaggcaccugccacccugccuggcuaauuuuuguguuuuuaguagagacgggguuuuaccauguuggccaggcugaucuugagcuccugaccucaagugaucugcuugccucagccucccaaagugaggagccaccacuccuggccaauuuuguuuuucauuuuaauuauaaaguuuuuuuauguaacuuuuuuauuuguauacauuauuagagacagagucuugcuguguugcccaggcugaucuuuaacuccuggcuucaagcaguccuccugccuuggccucccaggguguugggauuauaggccugagccacuacacccggccucauuuuaauuauauaguuuuaaaaaucguauuaaaaccuauucuguuuuccuuguucauuaugguucuuaauauagaaguauuuuagaauucuuuugacuguuuugauacaucuucccccaaacuaucagaaaaacaaguuauuugccuuuuaauuuuuuucuuauaggaaauucggcgccuucaucaguaugugaaauuugcuguccaagaugugaaugauguucuagacuuggagugggaucagcaucuggaacaaaagaaaaaacaaaggugaaugagaucucucaucugcaauguguuggaauagauauugcuauugccauuuuaaaaagguuauuuaggaacauaugaaaaucccaggccgggugcgguggcucacgccuguaaucccagcacuuuggcaggccgaggcgaguggaucaccugagaucgggaguucgagaccagccugaccaacauggagaaacccugucucuaccaaaaacacaaaauuagccgggcaugguggcacaugccuauaaucccagcuacuauggaggcugaggcaggagaaucgcuugaacccaggaggcggagguugcagugagcugagaucgugccacugcccuccagccugggcaacaagagcgaaauucccaucucaaaaaaaaaaaaacaagaaagagaaaaucucuacaaaacguucauucuuuuuaacagucauucuacuugaaauauuuuucuauagaaacaacaaaugauacucaguaauuuacauaaaauaauuuauauugcaguauaauuuaugauagugaaaaauuggauucagccuaauuaucuaaagguacaggaguggcuaaauaaauauggucgcuuuuuuucuuaacuacagaauacccuguaaccauugacuagcauguucuccaauaaauuauuuaauauauugaauacauauucuauguucuacaaaauguaugaauauauaacuauuucgcuauaauuauuagauguaauauaaaaauuuaauaaguaaaaagacaaaagcauauuggcuaauaagaauguggagguacaaaaguaaauagauguaacaaaauauucguaguuauaucugcaaaacgggauuaaggagaauuuuccguaauacucuucuguauauuucaaauuuucuuuuuuagaaaacauuuguaauuaguguggauaauuaaaaagaugagagaaaugauggcaaaguaaugggaaaaccuuuuagcauaguuuuuuaucccuagauauuugguuuuaagccacauauuuuccacaaggaguagaaugucaugcaccaugagagcaugaagugcccauuagaaauuugaaaaaugaaucagccaugaaauguuagauuucugaaacaccuacacuugauuaaugauuagcuagcccuguaugaaaacaaaccaagaaauggucuauuugauguacuuuucagugggacaaccugggugugauaucagggacaggacuauaauaugcuuauaauuuaguaagcacaauucaauaaauuacauuguguuauguggagaaaggcuaaaaaucccaacuggaggacccucagcuugcagcauagauagguauagggagauagaagugagaagcucuccuccgccacuaucuaaggggagaauucuguggccuguggacuggagcacuugucuccaugggcaguggggccccauuagagaacuagcucacacaccugguucugauucauguuuaaccauaugguuugcuuucccacaagggaaacaauggucuaaccuuacaguggguacauucugcucugcucaaugguuguauuucuuuuugguaauuaacaaguuagccuuguaagaaagugcaugaugcuuaaagagaagccaagcuuuuuuuuccuuuguaacaauucuguggauuuacuacuuaugcuuuucugaguucucuuucugcagaguucaaauucuuaaaucuguacaauuuucuauuuugauagcacuucucuguuucagggccaucccugaauauuaccuugaacccuauugaaaugccuuuuuuuuuuuuuuuugagacuaagucucgcugugucacccauauuggagugcaguggcgcgaucucggcucacugcaaccuccgccuccgggguucaggcgauucuccugccucagccuccuugaguagcugggauuacaggugcgugccaccacaccuggcuaauuuuuguauuuuuaguagagaugggguuucaccauguugguuaggcuggucuccaacuccugaccucgugauccacccaccucgcccucccagagugcugggauuacaggcgugagccaccgcgccuggccugaaaugccuuuuaaaaauuauauguugaacuaccuuguuaccagaggcagucauucaagucagcccugaacucaaagagguaaugggaaaaagggaaauaaauccagagguuucuguuuagcaagcauuuuucauuccaugauuuguguugaggcaaaauauacauagagucacuuguugcuuaacgugcguucugagaauuucauuguuaggcgauuuugucauuauaugaucaucacagaaugugcuuacacuauguguacuuauuaccuagaugacaucaccuauuacacaccuaggcgcuuaugguguauagccuguugcuccuagaccacaguaccauacagcaagcuuguccaacccacggccugcaggcuucauguggcccaggacagcuuugaaugcaauccaacacaaauucguaaacuuucuuaaaacauucugagauuuuuuugauuuuuuuuuuaagcuuaucagccagcauuaguauauuuuauguguggcccaagacaauucuuccuccaguguggcccagggaagcaaaagauuagacaccccugcuguacagcaugguuuuguacugacuacuauagacaauuguaacacaaaucacuaggcaauaggaauucagcucuacuguaaucuuauaggaucaucguuguauaugcaguccaucauugaccaaaaugucguuauguggcacaugacuguauugacauaccauagcaaagaaaauuugguuuauaacugaugugggauuauuccuuauguuuuuauauguaugauuuuuccuauccccucugcaaauuaaugcagucagaaaaaaauuucaaagcuacuuaaagauuucuacugaaaagcggaagcaaauagaccugucgcccucuacagucagaccuacuucccagaggcagcuacuguugucucugucuuguuuuaguucuuuugggcagguuaccuuccugaugcuaaaucuuaugcugucccccuauuucuugacaauagucugaagaauuaacugacucccauagacuuccagugaaccuuuuuuuuuuaauugaauauaauuuacauucagaaaaacagauaaauucuaaguagaaagcugacuggcuuuuuccugguuccugacucacaccucacuccugcccuuuucuucccagggccucucucagguuucaccuaauguaugcuguccuuugcuacaggacuggccugccuguuuccagcuguuuucuccacauuccauuuuaucuucauuaggcuuucaucuccuuuuuauuuucuaguaauuucuuaaugguucuuguccagugcugguucuccauuuuaucauuuucacuguuaccauuguagucuuguuuguuuuuuuacugggagauuccuuuacuugaaccauucauguuuaauucuuuucucauuguugucaacaggcaccugcuugugccagagcgagagacacuguuuaacacccuagccaacaaucgggaaaucaucaaccaacagaggaagaggcugaaucaccugguggauagucuucagcagcuccgccuuuacaaacagacuucccuguggagccuguccucggcuguuccuucccagagcagcauucacagguguggagaggacuugcacucaauaaauaugggugaaugaaugcaugaacauuuagggagucuuagagugguucagauauggguuugcaagugacucugugucucucaccuguguaauccuggucagggucccacccucucugauccuuuguuucuuugccuaaaaaaugaggaugacaauaccugcuucgugggauuguuggagaguuaaauuaagucuguaaaauauuacacugaugaaaugggugcugaauauaucauagcaagugauacaccauaguaacagugucaugguuugauugaaaaucagcugauaggauuaaguugacugacuuguuucugaagcccagauuugccauucugcuugaauggggggacuuucagacccuggcagauugacaguuugccuugaguuuaccaaaaugguuuuguguuuaugcuuuuaggccaaauguauaaauuuuaauuacuuuuucuacugaggcaccaucauguuguguuugagguggagaugguauauaauaugauugugaucucacuucuuuuagauuaauuccaucaguuggucagauggcauguuuauauauuggggauauucucaugucuugcauuuauauuuaagaggauaguguacccccgacagccuccgaucuuucagcuccuaguuggucuguaucuaacacuguucuguuucaguuuugacagugaccuggaaagccugugcaaugcuuuguugaaaaccaccauagaaucucacaccaaauccuugcccaaaguaccagguaauugcauccuucccagucuuuuaacucccuuuauucucuuccaaguacugauaucuuaaaaacugagucuuaaucauuuauggguuuauggauuucuugcagccaaacugucccccaugaaacaggcacaacugagaaacuucuuggccaagaggaagaccccaccagugagauccacugcuccagguaaagagaaccaguaacugggccuguacauagugauagggugugguggggugugugugugugcgcgcgcacaugcacgugugcaugugugagcuagggugcuguguauguguguguaaguguguguguguugguucuuaauaggggauagagaaaaugucuccagaaucuguuguuaaucugaauaguggaauaagaaccagcuuauauauacuugaugaagcagcaaaguagucguuuuggcuuuuacacuguuuucugcaguccucaaguuuuauggcacugauucacaaggguuugagauaggcugagcuggauccuagccucugcuuuagccagagaagguuuacuuuucugauuuguguuggguuuugaguaaguuugcaucugggaaaaaggcauuuuaaaaaauaaauaaauaauagaaaaaaauaaaagacgaggucuccccauguugcccaggcuguucucaaacuccuggguucaaguuauccuccugccucagccucccagagugcugggauuacagguaugagccacugugccuugccgaaaaaggcuucuuuuaugaaaaaagaagaaaaaaauaagauuaagcaauguugauuaaaaauacuuacuuaaaaauacuugcuuaaagaagccauaaauuuuuuucccauuacauuaccuagauaauaacuucaauuuaaagaaaaauuugugacaauuuuaggcauaacugcuuuguuuuaguauccauauccaaauuuuucuuugagauucuguuuucaguuaaaauuuuuuuaugccaauaacaaaugcuuuugguaaucagaauaacugaaagaaauuuaaucuuacugauuuauuuuucuguacucacauagagcuaaauuagauaaauaauagucacagacaaguuaauuuucaaauaauuuuucuuuaccuaaagaauacauucucuugguagguaauugggaaaaauauggaaaguauaaaggagaauaaaaaauauuagcugagugcgguggcaugcaccuguaaucuuagcucuucagguggcugaggcaggaggguugcuugagccugcagcugcagugagcuauggucaugccacugcacuccagccugagcaacagaaucucuaaaaaaaauuaaaaaguuaaaaaauuacucucucucaacccagauauggccucacuuaguuauuuugguuuaguuccaaacuuuuuucuuugcauauguaaaucugauuuauuuuaaaaugaaauugagauuauaacaguuuugugucuugauuuuuuucuaauuuaaaauucaugagcccuuacuauuaaacaaaauaaaugcugguggugaagauauggaaaaaauggaagcuuugugcacuauuggugggaaugugaaaugguaaagccacuguagaaaacaguuuggugguuccucaaaaaauuaaaaaugugauuacuggaugauccagcaauuucacuucuggguauauaccccaaauaauugaaaauaagguuucaaagagauacuuuuguauccaugcucaugacagcauuauugguaauagccaagagguggaaacagugugucuguuaaugaaugaauggauaaacaaaaugucugucuauacaauggaauauuauucagucuuuaaaaaggaauuuuugacacauguuacaauauaagugaaccuugaggacauugugcuaaguguccucaaauagacaaauacuguaugauuccacuuauaugaaguaucuagagacaucaaauucauagagauggaaacaagaauagggguugccugaaggacugagguggggggucauggggaguuauuauuuaauggguauagaguuucaguuuugcacagggaaaauaguucuggagauggaugguggugaugauuacacaacaaugugaauguacuuaauaccaaugaacuguguacuuuaaaacacuuaagaugguaaauuuuauguuacauuuuaccaaauuuuaaaaauuggaaaaaagauuuaaacuuaaaaucuuaaccuuuuccucugccuucuguguuuaaauauucuuugaacacaugccuuauaaagacagcacaauauuuccuuguauuagaaggccauaaugccuguugcuaaucuuguugccaaaauuuucucagaacgucuuuguucacaaaucuuuagcccacaucagauuauauauuuagauagaguccuuacaagugagauuuauguaauuuacuuauucauucauucaauaaauaugauugccuaguuuguuccaaucagugguaaauaagagaaacauggucucugcccacaugaagcuuuucauuuaagaggaggaauucagacauuaagcagauaacugcacaugauacucauuuaauguuagugggcaugcugggaagaauaacucagcauguaaacacuuugaauuuuuaaaauugugaaaaacaacacacauuaagugcacaaaacaaaaacguauaucccuguagccucuacccaggucaagaaacagaauauugccguuuuuuagaagcccucuugcauaccccaguuuuccuucuuccccuaaggcacgauuauaugggcuuaugugagaguuuugccuuugccuuuuuuuuuuaauuugacauuuuuuguuauuuuuaauuuauuauuuugaaaaaauugaaacuuccaauugcgaguacaguaagcacccacuuaccccucacccauauguuuacuacuguuugccacaauuguugcugaacuaucugagaauaagcugaagacaacgccccuuauuccuaaauauuucagcauguguccucccaagaacaaaggugcucucuuacacaccauaauacaguuugcagguucaggaaauuuaacguauacaguuaucucauauacaguugauacucaaauuuugccggcugucccacuuaccccuacacguugauuggaucuaggauccaauccaggauucugcauuguguaaguugucauucucuuuagucgccuuuucuuuguuuuccuucagagcuuuacuauguaagcauaccucccaaaacacuaugauuugguuuugccuguuuuugcauaccacauaaauccauucacuuagucucuggacaggcuucucuuguuccacaucaggcuuguaagauccauccguguuguugccucuagcuguuauuuuaguugcucuguauaggauucuauuguaugaauaugcuguauuuguuuauucauuuuccuguuggacaugugcugcuuucaguuuauagcuauuacagaaaagguucugaauauucccgugugugucucucggagcacauguguacuuuucauuugguuacauagcuaggaguggcauuguuggcucauagucuguccauaugcucagcuuucauagacucugccaggcgguuuuacuaagugguuguacuuuaucaucaguaaaugaguguuacaguuguuccacaucuuugccaaacuugauauugucggucuuuuuucuuuuaacuauucugguaggacucuuuuguaaaauguuuuaaccauuuggauauguucuuuuguggaguaccgaauuaaaucuuuugcucauucauuuauuauugaauacucugucuuauugauuuguacauguuuuuaucaauucuggagaccagccuuuguugguuuugugaguugcagauacucacuuugccuuuuuguccucuuaauuaugucuuggugaacagaaguucguuuuuguuuuuguuuuuagaaacagacucuugcucuguugcccaggcuggaguguaguggugcagucauagcucacugcagccccaaccuccguggcugaagcgauccuccugccucagccuccugaguagcugggacuauaggcacaggccaggccaccaugcccagauaauuuuuuuaguuuuuguaggaacauggucuugcuguauugcucaggcugaucuugaacuccuggccuuacgugaucuuccugccucagcuucccaaagcgcugggauuacagaugugagcaacugugcccagccuggugagcagaaguucuuaauuguaaaauagugagauuuaucagccuuuucuuuuauaguuaguacuuuuuguguucuguuuaagaaauccucuaucucuagguaaugaaaguagguaugcaccuuuauuaucuuccagaaacauuuaaguuugucuuucacaauuggaucaacuuuauugagguauaauuuacauauaaaacucaccugcugguagcugggugcuuuuuacuaaguuuacagaauuguauacccaucaccacauuucaguucuagaacauuuccaucacuuaaaaaguuuccccaagcuuguuugcagucaauucuuguucuacccaagcaaccacugaucugcuuucuuucuucuuggaucugccuuuuuaaagaaauugcauauauuauggagucugauaguguuuggguuuagguucuuucacuuagcauguuuuuguuguucacccaugauauguaccauguaucauuaguucauuccauuuugucauugaacaguauuccacuguauagauauauuuaguucacccuaucaauaauugauuuuugugugugauauaagguauggcucaugugucauuuuuuuguguuuggauaucugcuuguccuaacacuauuuauugaaaagacucuccucccugcuuagcagggccacuuuuauuauaaaucguuuaucccuauacauguauguuuguuggucucauacacugauuagaaagcacuacugccacacugccuuaauuagugcucaaauaagucucaauacuguucucuugcuagauucuagagguguucuguccaauaugguauucugcuuacuuuguuuuuuuuuguuuuuuuuuuuuuuuuggagacagaaucucgcucuguugccaggcuggagugcaguggcaugaucucagcucacugcaaccucugccuccuggguucaagcaauucuccugccucagcuucuuaaguagcugggacuacagcugcgugccaccaagcccagcuaauuuuuuuguauuuuuaguagagauggggguuucaccguguuggccaggauggucucgaucuccugaccuugugauccgccugccucagacucccaaagugcucggauuacaggugugagccaccacgcccagccucugcuuacauuuaaauuaaauaaaauugcaaggcaagguggugcaugccuguaaucccagcuguuuugaggaggcugaggcaggaggaucacuugagcccaagaguucgaggccagccugggaaaggaguggugagacccugucucagauaaauauauaaauuuuaaaaagaaaaauaaguaacauuuaaaauuuaguuuugcaaucccaguagccacauuucaagugcucaguaggcacaugugacuaauggcuacuguaauggcaaacacguauaaagaacauuucaucauugcagaaaguucuacaauucagaguagggguuggcagauuuuucuguaaggggccagcuggagaauaguugagguuugcaggugcugugguuuccauugcaccuaccuaacucugcuguuguaaugggaaagcagccacagaccaugugaugagaggggcaugucuguguuucagcaaaacuuuauauuucugcaaagagacagcuggucuaugguuguaguuuucugacuccugcucuagaauguuuugccuuucuugguguuuuacauuuucauauuaaccuuaaaauugucuuguuaaauucuaccucccuguaccuagaguagucaaaacuauagagacagaacuagaaugguggcugccggaagcuggaggagggaaaauggggaguuaguguuucauggggaugaaguuucaguucgggaagaugaaaacguucuggagauagaugguagucacgguuauacaacauuaggaauguauuuaugccauggaacuguacacuuuaaaaugugacuauggugcauuuuaugucauguauauuuuaccacaauaaaaaaauaaauaaauaaaaaagaagggaggcaggagaaucgcuugaacccgggaggcagaggucgcagugagccgagaucaugccguugcacuccagcuugggcaacaagagcgaaacuccgucuuuaaaaaaagaaaguuuugggggaggaauuuugccuuccucagccuucaaaggaaaguugagauuuugauuggaauuguauugagucucuagaucaacuugagaauugacauuugugcaguagugaacucucaguuccugaacuggguacauauuuguauauuuggguguucuuuaauuucucuuaauguuuucugcgugggagacaugcacaucuuuuguuagauuaauugcuaaaaauuuaauugcaaaaauuuguugcucuuauaaugguagauuuuuuuuccuuaaauuuuaugguuuauguuggauguaguaucgagaaauaccauugauuuauguguauuuacuuacagccaacaaccuggcagaauucauuuauucuaacacgucuguagcuguuucuuggccuuguaacuauggaaacaaugaaauccuccauggauacuaauggugacguuucugccuuuccaguccuuuuguuauuauuauuaucauuauuauuauuauuauuauuuuaccuuacuucacuggcuagaaccuccagugcagcguaaaagugucguguagcucuccuugaucucaaaaggagcacuuucuauaguucauccuaagaugugagguuugcugcaucuacugagaugaucauaugacuuucuauccuuuugucuccccacccucccugcccucagucauguagcuuucuaccuuuccuuaucugacguagaguguaaacagaauaagauucuuuaaauuucagugggacgcucuuucuaaugccaggcaguuagcugcauccuugaucacagcagagagcagcacccauuaaugguggaggcagcaccauuggcauagugagcaguccaugccccaugcuucugugagugagcaugcccauugcaucuuucaguugaugggguuccuccaccgaaggcagguaaauugccucagaaaggugaaggaaggaacuaagaguaccuucauguuacauaggaccuuggagguuacauaguuauuccagugucucuuucugucuaguucuugaaggugaugugauuauuugagucaucuuuuauuguuacuaucaggaacuacaauaggauuuuggagaaauuauggagagaaauuuggccccaagaaaacauggguuuguauuaguuuccuauggaugccguaacaaauuaucacaaaccuagcggcuuaaaacaguaccuaguuguuaucucacaggaagauuuucuuuuuuuuuuuuuuuuuuguuauacuuuaaguuuuaggguacaugugcacaaugugcagguuaguuacauauguauacaugugccaugcuggugugcugcacccauuaacuuuucauuuagccuuagguauaucuccuaaugcuaucccucccuccuccccgcaccccacaacaguccccagagugugauauuccccuuccuguguccauguguucucauuguucaauucccaccugugagugagaacaugcgguguuugguuuuuuguccuugcaauauuuuacugagaaugaugauuuccaauuucauccaugucccuacaaaggacaugaacucaucauuuuuuauggcugcauaguauuccaugauguauaugugccacauuuucuuaaaccagucuaucauuguuggacauuuggguugguuccaagucuuugcuauugugaauagugccgcaauaaacauacguaugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggcgugagaugguaucucauugugguuuugauuugcauuucucugauggccagugauggugagcauuuugucauguguuuuuuggcugcauaaaugucuucuuuugagaagugucuguucauguccuucacccacuuuuggaugggguuguuuguuuuuuccuuguaaauuuguuugaguucauuguagauucuggauauuagcccuuugucagaugaguagguugugaaaauuuucucccauuuuguagguugccuguucacucugaugguaguuucuuuugcugucucacaggaagauuuucugugaugauggaaauguucuguaucuuuguuguccaacaggguagcuacuagccacauguggcuguagaggacaugaaauguggauagugcaaucgaggaauugauuuuucauuaauuugcuuuugauuacuuuaaauuuaaauaaccacauauggcuacuggcuaccaaauuggcuaagacagccguagcacauagcauugguuuuuaguggcauuuguuuauguuauacuuacauuaugacaauaaaaucuugcagagccaugugcacaugggacacaaaagucaauaaauauuugcagagccauuuuaaauaacuuggggagggaagaaaaagggcuagauuauuuuguuugguuuuuguuuuuuccaauauacaggaaguauucacuugcauucugaaauuuaugauagaaaguuaacaugacauaaagccuuacucuucguagucuaaacagaaggccgggauucaguucaauucaauucuauuuucucuuuuggguuuuucuuguuguuauuugagaaggagucucacucuguugcccaggcugcagugcaauggugcaaucugggcucacugcaaccuccaccugccggguucaagcgauucuccugccucagccuccugaguagcugggaguacaggugugcaccaccacgacuggcuaauuuuuguauuuuuuaguagagaugggguuucaccauauuugccaggcuggucuugaacuccuguccuggugaucugcccgccucagccucccaaagugcugggauuacaggcuugagccacugcacccagccuuuuuuuuuuuuuuuuuuuuuuuugagacagaguuucacucuguuacccuauuuuuuguagagacagggucucacuauguugccuaagcuggucuugaacuccuggcuucaagcaguccuccugccucaaucucccaaagugcugggauuauaggccugacccacugcacccagucucuuguauuuuuuuuuuuuaaaccuaauugucugaaucagaagaaucauuagauuuaucuggaaauguucgagacacucaggaccgaggacauucuuucuaauccauuuugcguuggaccuguucuuagaagcuuaucauuggaaggugacaguaauggugugauuguucaccccaccauggaaacuugccuguuacauuucuaguauauuauuauuauacuagugagggcuccaggcuucuacuuugacaccagcauuaauucugucucuuacuuuuucacauucuuuuaacagccccaagauguucucguucacacaccucaguuucucaaauccccaucugagcaaagacccaaaaccauuuuuguucacauuugacaauaccugcucccacuuaaaauaaguaauaauuaaaucauuuuacaaguugaguauuuuuuuuuuuuaucaacagugaaaauuacuuagcuuuugggcuugcuuugaguugucuaaauuguguuuuguuuggggcuuuuguagccagccugucucgaucagccuuucugucucagagauauuaugaagacuuggaugaagucagcucaacgucaucugucucccagucucuggagagugaagaugcacggacguccuguaaagaugacgaggcagugguucaggccccucggcacgcccccgugguucgcacuccuuccauccagcccagucucuugccccaugcagcaccuuuugcuaaaucucaccugguucaugguucuucaccuggugugaugggaacuucagguaaguaaacagugggaaaggaaacuguuuuucccuaugauguuucuaacuaaugacggaauuguaacugggucuuauacugucacaccaauauggugguuggcuccagcccacuuuuuuuuuuuuuucuuuuuuucuuuuuuuuuuugagguggagucucacucuguugcccaggcuggaguguaauggcgcgaucuaggcucacugcaacauccaccuccuggguucaaaugauucuccugccucacccucccaaguagcugggauuacaggcgugcaccaccacgccuggcuaauuuuuguauuuuuaguggagacgggguuucaccauguuguguuggccaggcuggucucaaacuccugaccucaggugauccaccugccuuggccucccagagugguaggauuacaggcaugagccacugcaccuggcugcucaacucacuucugcuuauauucuagaaauuagaagacugauugaaaagauguguguuccccuugaaagcaguugcuaggccauugugaggaaggagauggcucuccaaguuuaugcgcuauaacaguuuuucugcugagccagcuuguuuuuuaaaacagaucuuuuucagaaguaaaagggggcuguuugcuucaguuauaaagcaacauccacacucauaucuuuuaaauccuggcucauuucagccugacuuguggcauauucugccucagaacucaccagcucugaugcuuguggucaguauuggcucacuguacugacagguguugugcccccacacuuucaguacagugucagggcuuugcaucaaagugacuuccagcagagaaaaauaccaguguuagguacuagaaugaagagaauuugugagaggggaucagggaauuggucuauguugguauaaaaguuguaucucaaucaguaucaggaaaugaugauguaucuuaguagagguggguaggcaaauuucaugcgauaacugaaagauauagaugccagccuguuaguuuacugguacuuuucuauguuaacgcuaauuuuagcauuuucccugcagucgaacauaaagaauuuaccaauuuaaccuuuuguauuuuccuguucucucacccacucacacuuaauuuuucuuuuccucuuaguggcuacaucugcuagcaaaauuauuccucaaggggccgauagcacaaugcuugccacgaaaaccgugaaacauggugcaccuaguccuucccaccccaucucagccccgcaggcagcugccgcagcagcacucaggcggcagauggccagucaggcaccagguaaaagcuguagccccauaccuguacagaggcugauuaugagcugucugagucacaggccaggacagcagguggcaagaaacagugggcgcucuuuggugcccuucagaagagaagauugaugugacagcccucuccccuuuguggagagaguucuaagaaagcagagacuaggucugaaaaucuuugcuuuuaaggggagggauuagaacugccacauuuaguuaagguggaaaucagugggguuuguuuuuuuuuuuaaacaaaauugcuaauccuacuuuugaauaaugucugcuuagagcccuaaaauuauaaccuuugaaauucgaucaucgaauaacacuagcgucaucucuuaguaucuuacagauugcagcuaccccaagagguagguauuugaauggcuauuuuggcugggcauagugacucaugccuguaaucccagcacuuugggaggcugaggugggaggaucacuugaggccaggaguuugagaccacccuaggcaacauagugagaccucaucucuaaaacaaaacaaacacaaacaaacaaaaagaaugaccauuuuguguuugaguaaucugaaguucagagaggugaagguuaucccaccaauaaguagcagaacccagacucuaacccucugcucuuuuucaguugagcauuuuuucuucuccaacuauaucuugcaugaagcuuuuuuuuuuuuucuuuugagacagggucucacuguguugccuaggcugaaggacacuggugcgaucacggcucgcugcagccuccgugaucucccgaacccaggugaccuucccaccucagccuccuggauagcuaggacuacaggcaugcaccacuacaccaggcaaauauuuaaaaaauuuuuguagagacaggauuucaccauguuauccaagcuggucucaaacuccugggcucaagugauccacccgccucuaccucccaaagugcugggauuauaggcaugagccacugcuccugaccaaagcuuuuuuuuuaacauuguaaaauuuaacuuuuacagaaggaagcgcuaauaagucaguuagcacuuaacauuucgucaguggcuugucauuaucccaaacuuucuacuacuuucuacguuaauguacauuguacauuaggauuuuacagucugcguaguuggucucaaggacuucaguuaucacuaguuaucaguuuuauaagcuaguaguucucaacuagaggcugcccccacuucccuguccuccaccccugaaacaguuggcaguguugcuggcauuuaguggguagaggccaggaaugcugcaaaaaaaaaaucuuuaaaaugcauaagacacccccacaacaaaggguuaucuagccccaaaaugucaguagugccagggucaagaaacagauauaagccaaauauuuucauuuuagcugaguaaaauuauuuuuuagauguaucacugcuuacaacacuuaucaauuuagaguuuuuuuuaaagacuaaaaagacauaauaguuugauuuaggaaaaaagaacuaacauuaaacagugauaagucaaaagauuguaaagaaaaauucaaauauuaaaaccuuuauuaagacaucuaacauauauauugaagaacaaaacaaagauaacuuuugagguaccuuugggcuuucuaaaaauagaauucuuugaucucuuuaaauauuacuuggaccagguagaaucuugccauugugcugaacaggccugaaaucaaguugaucaagucaaugaucuguaaaacguuaaaaucuauuaggauugaggauuguuccacucagcagaagguggugugaucuguauuaucauguuggaugcaaaaauuucuaagguauaggcaccuuugaauaugaaauaugaaagaugugcagucgugggcaagauguucuggucacuucuuugaaagagggaauaaaagagaauuaacuacaggucugucauucugcuugugauaaccacuuucaccuuggccagugaugcaguuaguaaugagccacaagcuuugcucaggcuuccuuaauugcuaauuauagaaugucauuaagucuuuugggauacaauuuacaauuauaagacgaaagcugaugaggaggugucagauauaugccucuuagucucuucucccauuauuguccaagcuccauuuuccacauuuuauucauuaugccuuucugucucacuaggccaugaguuucuuuagagaagaaacuauagauacauuuuguauucgcagccccuaacacagagccuggcacauaauaagcccauguuaaagaaagacagugaaugaguggcagaaauccugagucuagaugcuguuaauccucuagcucaagcugcccuuuuccaggacagaccagcaguguggcaggugucucagcucuguguagaaaagcuggccagagaauucuuuuccccuacucuaguacauucgauucaguuacaggaagccuuguuccaucaccuguguuaauggaguaggccagguguuccuuugaacacaaugcugcaagaacuaccuagaguagauuuccuucacaugauaaggcucuaaucugcuugggcucaugucuugguuuuucauuuauauguggcuagaacuuuuuauccuuugcuggaauuaauaugguguucucucuucucuguuuaaauuagcuguaaacacuuugacugaaucaacguugaagaaugucccucaagugguaaaugugcaggaauugaagaauaacccugcaaccccuucuacagccaugggguauguucugacugcaguguguuucagccccuggcugcuucuguaguagcgguggacugccugcagggagcagcagugccacugucacagucugguuuuccugcaccgccuuagguuauaagggggguggcggcuaagccugccuacacaaugcauuuucaggagacuguccuuuuuaacuggccggugacaguugccucacaaacuuuuaaaguuugucuugaugcuguaugcucaguuucuguuugccauguguaagucucugugugguacacauuaggugugcagguugauuuuuuuuuuuuuuuuaaugcccuagggguuccagaguugaugcuuugggucucaugcagacuugauucuggaaacuguaaucucaagggugacacucuccucccucacuucccuucuccaggcauuucuguucuucccauuucuuuugcuuuuguauaaaagacagcaccucuguuuggagacuuuagcuucucugccaugccauguuugagggcuggauuguugcugguggagcucacuuguuuuuuugguggugguggugguuuuguuguuguuguuguuguuguuuuuuguuuuuuguuuuuucuuagacaaggucucacucuugcccagacuggagugcagagugcaguacgaucauggcacacuguagccuuaaccuucugggcccaagccaugcucccauaucugccucccaaguagcugcugggacuacaggcacaugacaccacacccagcuaauuuuuuaauuuuuuguagagauggaguuuuugccaugucaccccaggcuggucucaaauuucugggcucaagugauccucucaccucauccucacaaagugcugugauuauaggcaggagccacugugcccagccuagcucauuugucuuuaguccucaucuguguucggaauucagggugcugacucccucccgcugcccugggcagguucgcagaacaugccugugcccugcuuugcccugcauauuuugugacugugaucccuuuagaccaaccaccauccccuguggcaaagggaagaguugagggacauuuccucacuuggaacauggggaucuugaggacuaguaucagauuucagggaguuagugucugguacccaugauuagucuagcagcaagaagggcagccauagaccuugugguucuccacagcgugcccacccucugccauugcacagagcagaucugcccacgguucuguuuucccucucucaaguggcccugccucacugguccgcuggccucuuuuuuuccauguuguucuguuuaucaacacugcuuguuugaggaauuuuuaguuaucucagggccauacuaacagccaaaaaacaagccuucucuauuacuauuuuguagugaccucggagccuugguaugcuguuuagaccaagaugguauuugugguuguugcaagcuuuucaagggaaagaacuaugcauuagaguuugggaauuguagccagauucccagcauagggaaggcaaggcagaauguuacauaagaugggaaaacucagcauaugguacaggaaguauugucuaguguuucugagauauauuaggugcuaaccauguaugagaagcaccuuuuggagauuccacuucuccuuuucucaagcuucauuucccuaaaugguucaucugagcugaucuuugaugaaggguuuguucaaggaguaauuuugagucuacucuuucugacaaaaaaucucagacaacuuaagaaaucuugaagaaacuuucuguuccauucuccacagaauuagacucugguauaauuauuucauguguaugcccagcauggugccugaaauguagaagcauuccuuucaauaaucauuuauugaauaauagguaaacucuacuccaaacauaaauugaaaagugaaaauugguguuuacugccaccccuccccaggaaagaucgagagaauauguucauuguaaaaugacuugcuuucagauucuuuuauguuuuauuuuuaaaauuauuuucagccagcucucguggaacagauucuuuuaaacaguaguuuccuaaguguauuuuaaguauuuaauuuugcaguuagcuuuuucucagugguaucuacagaagauucaucauaggaugagcuuacauauuucugccauugguguacuuuauguucauuggccucauccauucaguucguuggaagaguguuuaucuggcgccaacccacagcuauucaaauuccuuugcagugcuccaucgcuugauucagcagauucuuacacagcgucugcugugagcaugauacugcccuggguacuagagauaggguaguugaauaagacaaaccaaacaagaagacagccgggaaacugccaauuacacaaacacuuauuuuggugugcauucauucauuuauucauucuuucaacaaauacuuaaugagcauuuguuguaugccacacaguauucuuaggagcuggagauaaacuaccuguuuuguuguuaacaaaauagaccaaaaaaacuaacagacugauuguuuggagagacaaacaauaaucaaaauaaauaaguaaaauauguaauauauuagauggugauauggugugauggagaaaauuaaagcgggggaaagguuagagaguauugucugaacauggguuauaauuuuaaauaggguggccagggaaggccuucucaggaaggugaccuuugaaugaagagagaaaggccacacagcaggucucauuaauaucucggaagaaagcuccaagcacagggccuguagcaggagcgugucuacaaguugaagagcgagucaggggggaccucuggugacgagaguagagggaacaagaggaagaaugcugggggaguaggucaggaaagacuguugguggacagugucuguuugagucccugcuuucaguucuuuuggguauguauguaggaguggaaucgcuggauuacauagcucaaacugguuuacagaggugcugcaccauuuuucauucccaacagcaauguauggggguuccagcuucuccacauccucaccaacacucauuauugacuaucuuuuugguuauagucauccuagugguauaaaaugguaucucacacuaucagugguuuugauuugcauuucccuaauggcuggugauauugagcaucuuuucacgugcuuauuggccaguuguaucuuuggagaaauaucuauuuaguuccuuugcuccauuuuaaaauuagguugucuuuuuauuuuugagcucuaaguuucuuuauauaaucuguauucaagucucucaucaagcauaugauuugcaaauauuuucucccauucuuugaguuguuuuucacuuucuuguuguguccuuugacacgaaaauuuaguccaguuuaucuauuuuuucuuuuguugcuugugcuuuaggugucacauguaagaaaccauugccuaauccaaggucauaaagauuuacaccgauguuuucuuugaagaguuaugugguuuuagcucuuauaucuaggucucugauccauuuggaguuaauuuuuguaaauggugugaaguagagauccaacuucauuguuuugaauguggauauccaguugucccagcaccacaacauaucuuuuccauccuuuuauuucaacuuauuuugucuuuauauuuaaaauggguuucuuguagcacagcaaugugaauguacuuaguaucacugaacuacaugugcacuuaaaaaugguuacuuuuaagauggcagauuuuguuaaguguauuuuaccacaauaaacaaaaauaauuuaaaaaaauaaaauggauuucuuauagauuagggguccccagcccugggcugcagaccaguaccggucuguggccucuuaggaacugggccacacagcaggugagcggcaggcaagugagcauuaccaccugagcuccaccuccugucagaucagcggcagcuuuggauucucauaggagcaugaacccuauugugaauugcacaugcaaaggaucuagguugcaugcuccuuaugauaaucuaacugaauaaaauauaaaauuauagccugaugaucugaggugaaacaguuucauccugaaaccaucccccuccgcuguccgucuguggaaaaaauugucuuucacaaaaccagucccuggugccaaaaagguuggggaccacaguuguagacaguauauagugggccuuagcuugcuuuuuuuuaaucuugaccaucugugacuuuuaauuggggugauuagaucguuuaccuuaaguguaauuauugacauguuuugguuuaaaucuguuauauagcuauuuguuucuauuuaucccaucuguuuguuguucaguuuuuguuuuucugccuuuuuuuggguuaaaugucucuaugacucuauuuuaacuuuuuuguugacuuauuggcuauaacuugguguuauuuaagugcuuacauuaggguuuauaguauacaucuucaacuuaucacagacugucuucaagugauacuauauuacuaaagaauaguguaagaaucuaacagcaguauucuauuuucucccuucaccaccuuuaugcuauugugcauuuuacuuccacuguauuguaaaccucaugauacauuguuauaaacaguugacuaucuuuccuccccacuaccccccagauggauucuucuucugucgccaaggcuggagugcaguggugcgauuucagcucacugcaaccucugccucccagguucaagugauuuuccugccucagccucccuaguagcugggauuacaggugcccaccaucacaccuggcuaauuuuuauauuuuugguagagacgggguuucgccauguuggccaggcuggucucgaacuccugaccucaggugauccgccugccucggccucccaaagugcugggauuacaggcuugagccaccgcgcccggcugacuaucuuuuaaauacauuuaaauaagaagaaaaaaguuuacauguuuauacauauaguuaccauuuccaggguucuucauuccugugucuggucccagcuugccaucugguauaauuuuucuucugcucaaaggacuuccuuuaauguuucuugagguucauaucugaauucuuuuagcuuuuguaugucugcagaagucuuuauuucaccuuugauuuugaaagauauuuucacaggguaaagaauucuagauuggcaguuuuuuucuuucacugauuuaaagauguuccucuacuuuaaaaauaauaacucuaguaaugaccagaaacuuaaaaggaacuuuaauccuuuuguuuuucuaauuacaaauguuuguuguagauauaaaaaagauaguuaaaaagaacaaacuuaaaaucaccuuuauucccaccacaaauguaugauuguuauuuacacauuuuuucauccuuauuuuaugaaaauguuucuuguuagagaaaaauuuggaugcaugcugcuuuguaaauuuguaaccuuuucagcuuaaucaugaaauguaaucguuuacauuuuccaugucauuaaaaauucuuacacuauucguauuuuuucuuuucuuuuucuuuuuucuuuuucuuuuuuuuuuuuuuuuuuuuuugagauggagucucgcuuugucacccaggcaggagugcaguggcgcaaucucagcucauuccaaccuccgccucucagguucaagcgauucuccugccucagccuccugaguagcugggauuacaggugugcaccagcacagccggcuaauuuuuguauuuuuaguagagacgggguuuaaccauguuggcccggcugauuucaaauuccugaccucagaugauccacccaccuuggccucccaaaugcugggacuacacgcgugagacacugcagccggccucucucuuuuuuuuuuuuuuuugagauggagucucgcucugucacucaggcuggagugcaguggcacaaucuuggcucacugcaaccucugucucccggguucaagcgauucucaugcuucagccucccaaguagcugggacuacaggcaccugccaccacaccuggcuaauuuuuuuguauuuuuaguagagacggaguuucaccauguuggccaggcuggucucgaacuccugaccucaagugauacacccaccucggccucccaaagugcugggauuacaggcgugagacaccgugccuggccuauuuuuucauauuuaauguggauuuuuucaaagcucuaaugcaauuccgucuuaauuauuuaaguuacuuagcaucuaaacauucaugcaggaaauacaauuugcuuuaacagacuuuuggauacuauuuuaaagaaugugucuuugaagacauuaaauuuaccaauggagaaaauaguuggcaguuauauuuccaucgacagaugucaaaaacgcccaagaauugaauauagaguguuuguuuucaguaucuucuaucauuuucauucuuuuucccuguugauuucuuuguuucuucaguuacucuugauaaguuccacucucucauauaugaguauguaugaaaagauacaugugauagugauuaagauuuaccaaaauaaaacauaaccaggucucuuguuuuuuaugcuuuuuaaaauccugaaauaaguuacaagaaguugaggcuuuuuacaacaaugggaugaguauuuaccuuguugaaguucauuaaaguuggagggaucaauagcaaagggccuaggugacauuuuaaugcuucacaacccaauuuuauaauuguguguagaguacacauccauggaacaugugugcauuugucugccucuguuggcauguagugcugguaauguguggccaaaaacagaaaaaaaugacucuucuguguuuuauuuuucuccaagaacccgaguuuccagacucuuagugaucugugccucugucgcucauuucugaagcaggaacuuuaguguugcuggcaaugucagugucauuuguagacucacucaguaaagagaugucucuuuggggcucuguuauagcaccauuuucuucuuagaacaaauaucaagaugaauuucugauauuuuucaacuccauauugcuaaaaaguggaauaaagucaccuaagauauggauacuucugaauuuggcuuuucuaucucuugaucauuucuagcuauugauuuccauuguuuugguucaugcucaugcaaaaacguuugaacauauuuguuugagaguauacuguuuuuuucugugugcugucuuggaucuugauaagagauuuauuggaucugguuuguuaauugguuuacuggcugauugcacugaacagcauuucuuugcaggggugucacgugguguguagguacugugaauccuaauuuuguguauuuggggauuuaggauacucaggagauacauagaauuaucacaaauaaauagaauaauaauuacacucagucuuauucaugcauaauuuacuaucaugucacaauugaauucuggcuguaaaaaauuuucuaaaauuuggauaaauugcugcuuuuauuuuuauuucugauuucuguuugucuuugagaaagcaugaaagaguuuccuuuccuuuguaauccuugugagcuccaaccucuucucuaagcaagucugcugugucuguccagguacugcucagggcccagcagucucacucacacauucuuuuccucugguacagauucagcggaggugacgggggaacacuguaucuguauugccugcuugguaaacuaucucaggggaacagagauguguuucuccagagagaugcauauuuauagcugcuucuggcuucaguagaagcaugaaacggguuuuguuucauugaacauaaguucacuuuuucuucucucucaaucuaauaaagucuguuuaggaagguccccuuguuauuccagcagagaaucucaauaugcuuguaagguuuguuaagcuguuugauaauuuucuuccgugaggcacaggccuaucuuuuaucuucuaaguucauuuuugauggaaaauaugaauccucccuaaaucuaggggaguucugaaaaauaaccagguccuacaacuacuacugcuauauauaccagucagaguagcgcugggcugacaacagauaaauugaaaaaauugccgcuaggagccaagaacuuuugugugugauuacacuaacagguaguuuucccauaugugaacacuaguuauugaaauaacaguuccucacauacaguauucaccuacuucagaguuaacaaaagaugaugagagcucuuucugcgaauagggguauacuuuucaugcuguagcaaagaugcagguugggaauggaacagugguacauuugaaucccuuggaugcugaccuggugagcccuggagauagcugcugugagaagcuaagaucucuuuggauagcaccuuugcgguagcagcgaauuggaugcauagguggcagugagaaugcuucccauagagccugcuuggguaagagaaucaggaauuucucguggucuacaacagggggaagggccagggaggaggagggcuuauacucuggauagcaaaaagaucuaguucugaaugguuacuaauuuuuuucuuuggauugcagaaaggaaauaaguuauaaggccacugcuuugacuuucaugcuaaaaacccaaaguucauuuuuaaaauuuauccuucaaaaaaaaugucaaaucaguuguauuggggucccaugcaucuguauccuacccaaaacugguauuguauauuggacagaagguuggcuugagaaugaaugugauuuuuaccuagucaugccuuucucugaguguaugcuuuguguguuuuucaguucuucagugcccuacuccacagccaaaacaccucacccaguguugaccccaguggcugcuaaccaagccaagcagguaacuuacugauuuuuacuuuuuuuuuuuuuuuuuuuuugagacagagucuuacucugucgcccaggcucaagugcaguggugcgaucuuggcucaccgcaaccucugccuccuggguucaagugauucucguggcucagccuccugaguaguugggauuacaggcacccaccaccaugcccagucaauuuuuguaguuuuaguagagacgcgguuucaccgcguuggccaggcuagucucgagcuccugaccucagaugauccaucugccucggccucccaaagugcugggauuacaggugugagccaccguacccggccugaguuuuacuuuuaacauucaugccgugucugucuuuguaagugaagaccauacuguuuuuaagucuugacuuuguuuaaaugaaccauaagucugauaaaggcccauaaucccuuccccacaauuuaugccagucuugacauggcuguuaaucaggguaggucagucaggaccugauacugucuucauaggccauuuaaacauucugcaccuaguaauuuggggucauaauucuaauaccauacauuuuuauaugaaguauuuugcuuugcaguuuacuuucacauuaucucaguuaacccauacaacagccguguacagugggaggauagguguuuagauaugucucacuggugaggcagccuaggcuugagugaccaacgcaaacucucacgauuaguaaaugguggaaccagagcugggacccaaggcuucugacuuccuccuguccauugcucguuucacuacacaguugaguaucaaugucugggguauagguuaucugguuuucuccugcaaucccuguuugucagaguuugcauauuuuuagugauguuaugucuagcuugucuagcuucaggcuuuugccugauaaacauugucccuuagaaaaauaggugauauugcaaacaguuaaacaauccagaaaaaagugauaggggaugguuggaaggucagucaggcuagugcugaaacucuuccuaagaaguucugguuucucucacuacucuuacaucugucucugagaugaguaguuuguguuagagaucagaauuugagacuggauaucaggacuugccuauuuaaguucucaaacuugccucuguuccuuaguuuaccauaacuuaaaauggcauuuaagcauuuagcauucgaucuuucuucuggagguauuuguguucaccauggaaaacacaugauaaggcauaagucauggcgagugaaggaacauugacuggagauggauaagucaguuuugcuuuuaaccuuauuguacaugcuuugagagcuagaaccauuuuauuaauuuacuccuucauuaauucaucuaccuaauagucaagugcuuuugaugugcuaagcacugugcuaggcacugggaagauagccaugaacuaggccagugugacugccuucuuggagcuugcagaguauuucuauuuucauccuuuaauaugaucuuacauaugguuaacuuaaauugagaccuuuuuuuuguuuccuuuuucuuuuugguaauuuaucuaaaaguauuuguccuugcuuauuuuaaauuauauuuuuguguuuacauuuuacauauuucuuuguuacaaagaaugguuagugguuuaacauaaacauuuugcuugcauucuguuauaggggucucuaauaaauucccuuaagccaucugggccuacaccagcauccggucaguuaucaucuggugacaaagcuucaggucaguuugcauuuuuguuuucuugaaaagugaaagaagcacuccacaauagggguuauuguucuggaucacugagacaguugccauaggaaacaggagucacauuugaugagaucgggagcauucaggguaguaugaccauagacaagagaucauauuugaaagccgucagcuaaugaagaauuucuagaaaauuaguaugcccuucaauggcuauguagacuucugaaauuuuuagguuaguuugaaaaugauagagcaauaggagaaaaaccucccuuuaaauucuuuuccuaaaauggagcaauaguauuaucuuuuucuuccuugcuggaugaucacaguugagaggaauggaucagaaugcuaaacgcuauuucuuccacuaaaaggaauuaaaaauucuguugguccacagugacaguucaaaagccuauaagguagagaaagugaaacagauuuguaagaucucagaguauauaaugagucgauauuaugagauuuuauggcuucacguaacuucuccuacacucacucaagcauaauuauucuuaauuuaguuuucacaguaaccaugaguguuuugaccagacacuuuguccaagugucauugcccaaaccaacuuuaugcagaaugugggucuuccucaguguccccuuuuguuggcuccuuuauuauagccuaccuaauuuggcguguauuacuuccugcugcaagggucuugugcugucugcaauacugaauuuuuacaacacuguugauucuggcauuuguuucaaucaugcucuuaagugggccuucaagcaaauucuguuagaaauugaacuucauacauuagcagccugcgucucauaaucuuaaucauacagucauucugacuuucucuguaaucccaaacuuucugauuggauacuggauuuaucuuuaguagcuauuccuugcagaaggaagccauuauugcauaagccagaguuguauucuagaauucggagugauauggaaccacaguugguaucauguacgccucacaugagaaggagguaucuagcacuucucgaccggggccuaaagcuuuauguuaaaaggaaaauuauauaguagaacugucaaagacuugaguauuuuacaaaaagguuuugaaagaucauauacucuuuuuucaaggacuucauuggagagguuuuugucacucuuggaguuagaaucaaagaaaccuaaggaacuuugcuuuaugcaugucugggcaaguagugugacuugcaagaaauuuccgagauucaccauucauugcugaucaugaaauccucucuuuuguuacgagguguucacuucuguuuucacuugccagguaaucaagguuuagaaaagaacuuuuuucuuuugguaggaaaacuucccugaaaggugcugcuuaagaguuugcaaaaaguuucuuuuugaaaaagagcauuucuaaaaccucuagagaauaguucucuuauuaguaauggaaauaccuucauuguuuuucugauuguaaaacuauuacaugcccagaaaaagccuaugguguagagauauauaauguagaaugugaaagcugcccuauagauucuguauuccagagaucaugauuucauguauaucucuugagguuacuucauuguuuuuuaaagaaaaauauccuauauacuguauauccuauauauauugauuuuguaacuuauuuccccuucucugcccccucuuacaauaaaugucuuggucucugcaggucugauacagauccaccuuacucauuuuaagagcugucuacaaccucauuguguaguuauacccuguuaaauuuaacuaguacucugcugaugauuuagauugugacuuuucauccuguacauuuuacauuguauaucaguaguuuuaaaaauauuuguacugccaucuacccuguguuuguuuauuuuagaagguugguguuuuuuuuuucuuguuguuguuugguuuaguuucguuugauuugggcuuuuaaauaguuuuccucuuuccuuucccccuuuugaaguggagcaaggccaggccugguggcucaugucuguaauccuagcacuuugggaggccaaggcaggcggaucaccugaagucaggaauucgagaccagccuggccaacgugaugaaacccugucucuacuaaaaaaaaauacaaaaauuagccgggcaugguggugcaugccuauaguuccagcugcuugggaggcugaggcaggagaauugcuugaaccugggaggcagagauugcagugagucaagauugcgccacugcacuccagccugggcgacagagcgagacucugucucuaaauaaauaaauaaauaaaguagagcaguagggaaaagauugaagauuguacccaaacuauaaguaaguaguuagagugaaaucgaacauggggagaaugauggauugcacuuuuaaccuuuuugcaugucuccauauuauagcaaucauguuuuacaucuguaauuuuaaaaaaagaacacgauuauuuguuaaaugccaacaaaaucuguggaaaaugcagaaauguauauagaaguaaacagccuuaaagucacuacucagaaauauuuagcuuaugaaccuauuucucuuuuggauuuuuguccuucagcauagauuaauuucaaauaauuauaaagcuacauuauauauaguuuuauuuacuuuuguggggagggggcuuagccucacauuauaagcauuuucccauaccauugaaauauauaagaguguacuuuuaaaacuguacauuuaaacuauacuagaauuauuuugauauauuuucuguaaaggagaagauggcacaccuuagacuggaauuaacauugacagagccacggagcaauuucagagaccucaaacacaagugaggcaacgugcucacuccccauggccacugacgugucacagaaggcacauguggugcuaagcagcaccucacaggcugagcuacagggaauuauacacuggaacaguguuucugucuuuuuguaauauucuuuuuuuuuuuuuuuuuuuuuuuuuuccauaauuucagggacagccaagauagaaacagcugugacuucaaccccaucugcuucugggcaguucagcaagccuuucucauuuucuccaucagggucaguaaugaacuuaaguuuuauggcaaauuacuagcaauuagcuuccccaaaucuuacaauuauagauauauuuauuuacuuauuaaauguguaugaacccagaguucuuaccguggcaguaauacaugugaugauaguggcaauaguuuaauguucucauguaaaucgauuuucccuuugcaauucaaguuaauacuuguuuguuacauauuuguguaucuguuuuguuuuuuagccuaagccucauuuucuuugaguaaugagucugcuaaauucuguaguucaucuaguuugucacacugagauguuuccauucugacaccauuuugggggcuagaugugacauucaaauugacuuugcuggacaaacaugguggcucaugccuauaauccuagugcuuugggaggccaaggugggagggauugcuugaggccaggaguuggagacugaccugggcaacauagugagaccucaucucuacaaaaaauugaaaaauuaaccagguacguugguucacuucuauagucccagccacuugggaggcugaggugggaggaucccuugagcccgggaguucgagguuacagugagcuaugaucacaccauuguacuccagccugggcaacagagugaaaccccgucuccaaaaaaaaaaaaaaaaaaaaaaaaaaaggcuuacugcaucgagaguacaguauacuaaacuuagagaauguaaugaaagauaauaggcauuugaaauuugagguuuuauauagauguggaggaaucuguuuccguuucuuuaaaaaauaauaauaauaaugauggcuguacuuguaaaguugaguuguuuuuaaaaaugaaagaaucuucuauaccuuaucucaagaugagccuuuguuaaggugccuguucucugugcccugagcgcucauguugaaaccugugugagcugcugaagcauuggguuagacucuguggaacugagaucaaaaugugucaaaaggauuuuuugccauugaagcauugugcauucaguuccuuagaaaagccucuuaaguucuucaguuuaugcuuuuguaacuaggagcauauuaaccagucucuuuuuccugauuuuaauauauuuuuugaguguccuucagccuaaggagaaaagaggguauuagaauauuauuugagggggaaaguaauacauauauuuuuucuuuauuauaaaucauuauguuuuaugcuucccaaagguaauuugcagcaaauuuuaaagaguaggucaaugccaagaauuauugcauccuuuacagauggcuaauaaucagucuucugugaaaugauauucuucuuccuuuucuuuuuuuuuuuuuuuuuuuuuuuuuuuuuuuuuggauuuucaggcagaguaucacuccgucacccugguuggagcgcaguggugagaucucagcucacugcaaucuucaccucccggguucaagugauucucuugcccuagccucccaaguagcugggaucacaggugugcaccaccacacccagcuaauuuuuguauuuuaguagagaugggguuuuuucauguugcccaggcuggucuugaacuccuggccucaagugauccacccgccuuagccucccaaagugcugggauuguaggcacgagccacugcaccuggcccucuucccauuuuuaaaauaacccagaaaagguggggucauugaaucaauggcuugacacuauuagauaaaauuuuuucacuaagaaagguuguguuuuuuuuuuuauuuuuaauaugaugggcaaaggugucuaaguuauuacauuauuuaguauauuugaugugcuugguucguuauauuuuaaagcuaguuugaaaucugcaauuugaacuuugcgugugugugugugugagauagagcaagauucugucucaaaaaaaaaaaaaggugcagugguacagucauggcucacuacaaccuccacccccaggacugaagugauccuccugccuuagccccccgaauaacugggacuacaggugcgcgccaccacaccuggcugauuuuuguuuuuuaauuuuucgguuuugguuuuuggggguuuuuguuuuuguuuguuugguuuuuggguuuuuguuuuuguuuuguagaaacaggguuccaccauguugccuaggcuggucucaaacuccugggcucaaaggauuaaccugccucagccucucaaaaugcugggaugugagccaccaugccuggccugaguuuuuaucacagugaauaaucuguucugauucacacucgcgugggauuuucuuccuuagcuauggugucuucacuuacaguguaaagaaaacguacaaaaggagagaggagauggugaaaggagucacaaaguuuuugaacuagauuuuccuagccguaaaacucaguucugucaaaaugacugaguuagggcuucuauuucauuguauccauuguuuucccuagcaguguggggcucucugacaugcuuguuggucuuggagggguucugagaggcucucccuagucuuaagugcuucugucuuaccagaccuuccuucuguccccucacuuaacagaccaucugcuccggccaccauucccacaugcacauuugucaugugucucuacugcugcagcuuugcucaucuugcaagaaguccccacucaaacuucugcuacagaaagcccagccaucccccaaugggcucucaacugcuaucccugucguaucucacacacaaacugcuucucugcuuagagaucauagaguggccuuacugcuucugagauaggugcuuugacucuguugucauuuaucuucuagauuguaaauuccugagggcgguuuguaugaaugaaugauaaaauggaauauuaagagggcaauauugugccuugguuuguuccuuuuuaauuucucuuuuuccacuuguuaggacuggcuuuaauuuugggauaaucacaccaacaccgucuucuaauuucacugcugcacaagguacagacucuguguugaguagcauuacucauguguuuucucuaaauaaguacagguuauuuuugcccacauguuaguauuugacuuguuccugaaucuuacuuacaguaucugcaauaagcucaguguugauaaugugcauuagaaauaugcuuaauuuaagaaacugaugugaaggauuucuauuuuuauaauuaaggacaaggaaaggauuugcuucuagaaaaucagggcugugcuuuaacauuuaaauguuaacaugugaauuaaaauuucuccauuuuuugucuguaauuuaaaauuucuucaauuuauagggugauucuguagggcaagauagacaugguaauagauagacuguagaaaugaaagaccaaacucguuuuuuuccuugauaacauaccagcaaacacacucaucccaugcauguuguuaaaaauccaucaauagacugggcgcgguggcucacgccuauaaucccagcacuuugggaggccgaggcaggcggaucaccugaggucaggaguucaagaccagccugaccaacauggagaaaccccgugucuacuaaaaauacaaaauuagccagccgugguggcgcauaccuauaaucccagcuacucaggaggcugaggcaggagaauugcuugaaccugggaggcaagguugcagugagccaagauugugccauugcacuccagccugggcaacaagagugaaacucuguguguccccccccccccccgcgccaaaaaauccaucaauagcauguuuuuaacauuuaaaagaauuugaagcccuauaaagaaaccagaucuauuuguuaagugccuuucaguuauccguuuaugauuaagucuuuuauuuuauuuauuuauuuugagauggagucucacuguugucauccaggcuggaguguaauggcgcaauugcaguucacugcaacccccaccugcuggguuccagcgauucuccugccucagccucccuaguagcugggauuacaggcgcccaccaccacauccagcuaauuuuuguauuuuuaguagagacaggguuucaccauguugauugaucaggcuggucucgaacuccugaccucgugauccacgugccuuggccucccaaagugcugggauuacaggugugagccaccacgcccggccucguuacucuuguauuuauuaaccacuguuguuugaccaggccuuaugggugcuuuacccauauuuccugcgaucuuuguaacagcacaaugaagguagguauuguaaugaucuagauuuuccaaaugggggaauugaggcucagagagguaaagcaaccuuuccagauucacacaaccagcgaguggcagagugcauagcuccagagcccauguccuugaccaccagaccguacugccucugucaaauagcugacuuaguagagcacuaauaaguagccauuaauuguacauaaaaaugauuuucuguggacugacacuuuauuugcucauaaaaaugaaggaagaacuuccauuuugaaucaaguccuggucuaucaggagguccacaggccauugcugugcugaggauguuauuaaggaaagcacacagcuaggguaaauuaagggaagaggcuuuuuuauuucucuuugggauaauauguuaauuucacauauucuagauauuuuguauuuguugugauuuaauggucauaaaaaaaguauuuuuuccuuuucaccucagacgacucagagcugauguuuguguggagaagcacucauuccaccuccuuagagaaagcugcugugagaacaaggcacccugacucuguagagggaggagagaaacuuuggcuuagaaacacaaucaguggaaauguaaugggucaucuuuugcuaaauccaacccauuuucugauuucuuuuucuugcuaggggcaacacccuccacuaaagagucaagccagccggacgcauucucaucuggugggggaagcaaaccuucuuaugaggccauuccugaaagcucaccucccucaggaaucacauccgcaucaaacaccaccccaggagaaccugccgcaucuagcagcagaccuguggcaccuucuggaacugcucuuuccaccaccucuaguaagcuggaaaccccaccguccaagcugggagagcuucuguuuccaaguucuuuggcuggagagacucugggaaguuuuucaggacugcggguuggccaagcagaugauucuacaaaaccaaccaauaaggcuucauccacaagccuaacuaguacccagccaaccaagacgucaggcgugcccucaggguuuaauuuuacugcccccccgguguuagggaagcacacggagcccccugugacauccucugcaaccaccaccucaguagcaccaccagcagccaccagcacuuccucaacugccguuuuuggcagucugccagucaccagugcaggauccucuggggucaucaguuuuggugggacaucucuaagugcuggcaagacuaguuuuucauuuggaagccaacagaccaauagcacagugcccccaucugccccaccaccaacuacagcugccacuccccuuccaacaucauuccccacauugucauuugguagccuccugaguucagcaacuacccccucccugccuauguccgcuggcagaagcacagaagaggccacuucaucagcuuugccugagaagccaggugacagugaggucucagcaucagcagccucacuucuagaggagcaacagucagcccagcuuccccaggcuccuccgcaaacuucugacucuguuaaaaaagaaccuguucuugcccagccugcagucagcaacucuggcacugcagcaucuaguacuagucuuguagcacuuucugcagaggcuaccccagccaccacgggggucccugaugccaggacggaggcaguaccaccugcuuccuccuuuucugugccugggcagacugcugucacagcagcugcuaucucaagugcaggcccuguggccgucgaaacaucaaguacccccauagccuccagcaccacguccauuguugcucccggcccaucugcagaggcagcagcauuugguaccgucacuucuggcucauccgucuuugcucagccuccugcugccaguucuagcucagcuuucaaccagcucaccaacaacacagccacugcccccucugccacgcccguguuugggcaaguggcagccagcaccgcaccaagucuguuugggcagcagacugguagcacagccagcacagcagcugccacaccacaggucagcagcucaggguuuagcagcccagcuuuugguaccacagccccaggggucuuuggacagacaaccuucgggcaggccucagucuuugggcagucggcgagcagugcugcaagugucuuuuccuucagucagccuggguucaguuccgugccugccuucggucagccugcuuccuccacucccacauccaccaguggaagugucuuuggugccgccucaaguaccaguagcuccaguuccuucucauuuggacagucuucucccaacacaggaggggggcuguuuggccaaagcaacgcuccugcuuuugggcagaguccuggcuuuggacagggaggcucugucuuuggugguaccucagcugccaccacaacagcagcaaccucuggguucagcuuuugccaagcuucagguaagaauuuguggaagcuuuuuacuuguuucccucucugcuauuugaaacauuagcaacagaccccuauuacuuuuguaauuaaaggggagacucaaaacccaaaaauaaucuguagguuaaagaagacagcuuggagcacauguggucucaggaacuuguuuggccuaauuggcuggaucuguuacagcuuaaugcagcuccaguuuugcuucuuagcaaauuguccacucugcaagccaccagaguguguuucauggggaaaaaucaagcaucuuuaguugagguccugccaaguaauuuaaugaacaauaaauaggaaauuucaaauuuggaaggcacuguagagaucauuauacccaaagcugucaagccucaaggagacugcucuaaugucaggauagugccaguggaaccagcaggagaguccaagugucaucauaguccaccgcccugccaguguuuucugucuccucugacaccaucuuucuuacuguaauggcagucacugacauuugauuuggguucuuuucuauuuucaguguuaugacuuuuuguaaaaacuacaguuuacuguuuuugacagugaaaccuaauucuucucuauugcauuuuccauuuuagcagcuacuuuuacuucuaaaaguuaucaauaagcaaggcaauuugaaaaucuguccugagauuugcuuucugaaaguuaucuuaugaaagguaauucuucagcaauagacucuaggagaaaagcaaggaucaaugauuucauggugggcaagauuacuaguaacugcuaauucauuauucgaugauaacuugaaaaugguucauaauuuauuagaaaggaaacauuuuccuuucuucaacaaauguuuguuacacuccuccuaaauucagcuauaaggacacgguguugaaaagacagauaugguuuugagaccuacccaaugcccugugaagaggccagagggcugcugaaugaugggaaaugugcugacuugguccagaaaaugggcaaggagaaggcccuaugagucuuagaggagaacguguaacacaguccguaucacuaccacaccauuugcucugcagucagaaccugagaagaccucaugcacaggcauggucauacuauuucaacaaauucagaacccaggaaggaaucuucuuucauuuaguaucugugcggaaagguaucugagcugucuacuucagcccuaguugaggaauugagucuugucuaagcucaccuacccaaucagugacagaaaugagaauagaggcugggcauggcgacugacgccuguaaucccagcaauucgggaggccgaggcaggggaaucacuugaggucaggaguuugagaccagccuggccaacaugguaaaaccccaucucuacuaaaaacacaaacauugccgggcgcgguggcucacgccuguaauccuaacacuuugggaggcugaggcagguggaucaccugaggucaggaguuugagaccagccugaccaacauggagaaaccccaucucuacuaaaaacacaaaauuagcugggcgucguggcaggcgcauguagucccagcuacuugggaggcugaggcaggagaaucgcuugaaccugggaggcggagguugcagugagccaagaucgugccacugcacuccagccugggcaauagagcgagacuccaucuccauuaaaaaaagaaaagaaacgagaguagaacuccugccuucucacuccuugucuggagcucuuuuguuguauaguucugccucauguucccaggcccuguucagcucagcacuucaaccauguuaugccaucuggaagaaagauaaacuacccugaaaagaaugugguaucugagauucagaagaaaccgaggaguagaaauauucauaauauuaagucauuagaaagaauuucuggucacugaaagugaggauaaacuauucuuagcccccauccacgugggguuugguaggagaggauucauuccccagggcuuuagaacuuacacuauuuuaaaauguuagcaaugaaaaauggucuuuaaaguauuugcucagacuuuucuccauacuagaugaggaaacauuuuauucauaaguugauuuauuaugggcuaucuuagcacaccugaaugucauuuaaaaagaaauaaacuuaggcugggugcgguggcccacaccuguaaucccagcacuuugggaggccaagguggguggaucaugaggucaagagaucaagaccauccuggccaacauggagaaaccccgucuguacugaaaauacaaaaauuagcugggcguugggaggcggagcuugcaguaagccgagaucgcgccacugcacuccagccugggcgacagagcaagacuccaucucaaaaaaaaaaauuagcugggcaugguggcacacacuugagucccagcuacucaggaggcugaggcaggagaaucgcuugaaccugggaggcagagguugcagugagccaagaucccaccauugcacuccagccuggugacagagcgagacucugccucaaaaaaaaaaaacaacaaaacuuuaauguuguaaaagacucauccaauccaaauugaauuuuuguuuucuuuguauuuuacagguuuugggucuaguaauacugguucuguguuuggucaagcagccaguacugguggaauagucuuuggccagguaaauaugcauuugucuucauucacgucaacauguaucaaacccauucaguuuucuucacuguaauguagucaguucguguuguauaucuaaauccagcaaauauagcccugugugguucuuaagcuguacucccuucagcugccuuggaggugcagaagucucagccucugauuaaagaggaucacuagaauuuugauccuccuuccacagucuucugagaaaguauuuugaaagcacauugccugauuccuuuuuucuuuagacacaggaucuugcuguguugcccaggcuguaguacaguggcacaaucacagcugacucuagccauaaacuccugggcucaagcaauccuccugccucagccuccccaguaguuuggauuguaggcaugcaccauaacacucaacuaauuuuuuauuuuuguagagacacagucucgcuauguuguccaggcuggucucaaacugcuggccucaaacgauccuccacgccugaccacauugcaugauuucuaucaguccccugccuguuaggccaaggguugacaaacuucagucugugggcuaaauacacuguuuggcuuuugggggguuuguuguuguuuaacuucuuaaucuaagaaugguguuugugugugugugucuauauguauacauauauguguguacacacacacacacacauauauauauuuuuguuuguuuguuuguuuuuguuuuuggaggcagagucuaacucuguugcccaggcuggaggacaauggcacaaucuuggcucacugcaaccuccgccucccaggcucaagucauccucccaccucaguuucccaaguagcugggacuauagguuugugccaccacacccagcuauuuuuuuuuuucuuuuuguguuuuugguugagacgggguuuugccacguugcccaggcuggucuggucucuuaacuccugagcucagggugaucugcccgccuuggccucucaaagugcugggauuacaggcgugagccacugugccuggccaguuuuuauauuuuuaagugguuguuuaaaaagaaaaaagaggaagaagauuuggcaacauauauauccccucugcuacgcuauauguagcccagagacuccuuuuggugaacugagcuguuugauuuuauguagcuagcaguuaucuaugugccaggcauaauuuuaagucuuuuauuuauuuauuuauuuauauuuauuuauuuacuuauuuuuuuuuuugagaccgagugucgcucuuuugcccaggccggacugcaguggugcuaucucggcucacugcaagcucugccucccagguucacgccauucuccugccucagccucccgaguagcugggacuacaggugcccaccaccgcacccagcuaauuuuuuguauuuuuaguagagacgggguuucgcuguguuagccaggauggucucgaucuccugaucucgugauccgcccaccucagccucccaaagugcugggauuacaggcgugagccacuguacccagccaauuuuaagucuuuuauacaaauuaacucauguaagcaucacagcaccuccauaagauaggugcgauuauuaucgccauuuaagagaugaggacaccgaaggcccagagagguuaaauugacuguuacaucagacaccggcugcauuuagaucauuuagaucauaguaaccuccuaaggagcccuuaugaagaaagauacccuaauuuaucagaaaggauugugacuuucugaagguagaauuuguauuaguccggcaguuaauaaagugguaggcauaauauauguuucuuauacaucuucaggaagaaauuuucuuuaucaucucuguuuuccuuugaagauaggcucuguccuagucagugaucuuucuuaagagagaagugaaacuucugauuuccaguuucugguaguagaggacuaagucauucaagggaaccaaguucccuacugaaaacuacuaaaaaaugcuagauaaaacauaaaaaccuugucuuuaaaagcaccaauaaacuaacaagguauuuuaccaagccaaaaggaaaauggggaccuagagaaguggagcccagaagccaguugugcccugacagcauuuacuaaucugagaaaaugugaauuuucuauuuaauaaccccaaagguaaagggacaaaaaucaccaacuaagauaugcacaaaguggggagucuaaaagagacccuucagcugggacuccauguugacaggucucagccccugacuagacugauaugguuccagagugaugcugccuccaggugucuggcagaggcagcgcaggcccacccugaaggaaaggaacuuuacuuagccuucgaauuacucuuacaaguaauuucugucccucaaugagacacacaaggaaaccaggaacuaugagcaagagccagaauaagcgucagaaaucaccuuugcacagacuaccuaaacuguaaaucagcuggggcuuacagaguuuagaagaaaucaaagacaaacuugaaaauaccaguaaggaauauaaaaucuuaagaagugucauagcaaauuugaagaagaaccaaauagaauuucuaggaaaauguaaugauuaaacucagguguaaacucaguggcuguauuuggagcagauuagacccacugaaaggagcaguggugcucuagaacagaaugugguagucagcguuuccagcuuugagggcuaucgauagccucugucagaagcacuuaacgcugccauuguagugcagaagcagccguagacaauauguaaacgaaugcgcaugauuguguucaguaaagcuuuguuuacaaaaacaggcagugagcuggauuuggccccugcgcuguaguuugcugaccuaacuagaagguagguuaaggugaguuaccuggaaugcaucacagagagcgaaaugaaagauacaaaagagaaaaaauccuguaggagaaaauccaacacacauuuaaucagagucccagaaggagaagagagaaagacagaaccuuccaaaacuaaucgauaauaguaauccacagauucagaagcccaacaagugccaaacgagaaugcauaaaaggaaacugauucuaagaccuguccuagugauacugaagaacaccaaagaugaaauauuaaaagcaacuagagaaaaaagacagauuaucuucuagggugccauaggcagacugacagcagacuuuucagcaaugaccaugaaagccagaacuggccaccuagcauuucuaaauccagcaaaaaaauaucuauaaagaaugaagagaaaucaagacuuuuuuucagauaagcaaauacugaaauaauuuaugucuagcagaccugacuccagucugggcgacagagcaagacuccaucucaaaaaacaaaagaaauucuaagagauacuguuuggaaagaaggaaaauuugaccucacuaaaauuauggcccucuuaauuuuaggguaaaacaagccauuaaauaggaaaauuguagccuauguaaccaacaguguaauuguauucagaauauguaaagcuuuccuauaguucaaaaagaaagacagcuauacccaaauuaaauuaaaaggcugacaguaccaaguauuggugaggaagaagagcaacugggaacucauauugcuagugagaguguaaauucauauuaaccacuuuggaaaaccauuuggcaguaucaaaacuaauauacaaaaucccucuuggcccagcaaaucuacccugaauauguaaccaacagaaaugagugccuuuguucaccaaaagauauugauaagaauguucacagcagaauauucuuaauagcuaaacacaggaaacagcccaaaugcuuaugagcuaaagaaugcauaaauaaauugugguauauucauacagcccaauacuacagagaaauaaaauguacugcuccuauagcuggccuagguuuguuuuuuuguuguuguuuuguuuuugagacggagccuuacucuguugcccaggcuggagugugguggcauggucuuggcucacugcaaccucugccugcuggauucaaccucagccucccgagcagcugggauuauaggugcccaccaccacgcccagcuaauuuuuguauuuuuaguagagacaggguuucgccauguuggccaggcuggccuugaacuccugaacucaggugaucugcccaccucgacuucccaaagugcugggauuacagucaugagccaccaugcccagccuaaauuuguuuuuuaaagaaauucgugcacguauguaucaggauacaaguguauucauagcaacauuguuauaauagcuuacaacuagaagcagcccaaauguuugucagcauucauauggguagguaaauuuacauuauuccacauagaauuuuuuucuuuuuucuuuuuuuuuuuuuugagacaggguuuuacuccugucgucaaggcuggagugcagugaugcgaucuccacucacugcaaccuuugccucccaggcucaagugauucuccugccuuagcuacccaaguagcugagacuacaggugcacacacugugccuggcuaauuuuuuguauuuuuuuguagagacgggguuucacauguugcccaggcuggucuugaacuccugggcuuaagcaaucugccugccucggccucccaaagugcugagauuagagacaugagccacugugcccaacccucuuuucuuuuuuuuugagacaggaucucacucugucacccaggguggagugcaguggcacagucacagguaacugcagccuugaucuccugggcucaagcaguccuccuaucaguucuccagaauagcuagguccacaggugcaccaccacgcccaacuaauuuuuucaguuuuuuguagagauggggucucaccguauugucuaggcuggucuguaacuccuggcccaagugauccucccaccuggaccucccaaagugcugaugagauuacaggcaugagacaccauaccuggucucauaguagaauauuauccagcuaugaaaaggagcagauuucagcuccauguauaacuaacaagcacaauguugagccaaagaaauagaaaacaucacugugauaaacuccauauuguuacuuccccuuccacuccguauucuuccaccacggaaauuauguaugcaauuggaagggccaaagauugaaaucaagguuuuuucuaugauggcaggggccuuauuguuuuuauugauugcuguaucuccaaugcuuaggacuaugucuggcacaugauaggcauuguggaaaugaaugaacuuucagguagcagaaguauccucagaaaacucuaaagaugcuaggcagauucuggcuaggauguaaaagaauauagaaaaccuucacugccauaauaacaccaagaaaaauccagaugauguagaagucacacuuacucuggcaguauuggaauuauuuacugcuguauaacaaauugccucaaaaccuaguagccugcaacagcuacuuauuuauuauagucuuggauucuguaggucauaacuucagauggacuuaguagggauggcuugucuucacaguaucugugaucucagcuggaagaagggaagacuggaggcaggagucaucugaaggcucacucugaugucagugguuggcuuggcuguuggcucagaccuuagcuggagcuguuagcugaacaccuacauuuggccuauguagccugggcuuccucacaacgugguggcuagguuccaaggaggaacauuccaagaaagaggaagagccaugcugaagcuguauaaccuuuuaugaccuauccucagaagucacagaacaucacuuaggcugcauccucuucaucaaggcacucacaaagucccauccagguucaagaggagauacagaggccgccucuugcucuagaagagcauaugugacuagaaguauugcugugaucaucuuuggaaaauaucugucauaaugggaccauugaagaguggcagaaagccuuguugaacugguuuccagagaguggagcccaucauaggugugagcacuguggcacagcagcugcugggggcagaugccaggucuggguuugagcagguaguagagaggacuugccaaagacugagaaaauguacuggcuggagaaggagcuguuggcagugaugggggcaagcaaaauaaaugaccaguaauuacaugaaaaggugaucaaguagcauuaaacuaaugagggaaaugaaaaucaaaaccacaauuagauaagauaccacuucacacccccuaggauggcuaucauuuaaaaaguaaaaaauaaaaauaaccaguguuagcaaugauacaaagaaauuagaacccucauacauugcugaugggaaugcaaaauugugcagcuacuauaguuuggugguuucucaaaaagcuaaauauaguacuucuaccauaugacccagcaauucugcucugggguagaauacccaaaggaauugaaaaaaagggauucgaacaaauacuuguacaucaauguucauugcagcauuauucacaguagccaaaagguggaaacaacccaagugucaaacagcagaugaauggauaaacaaaaugugguauauacauuccaugggauauuuuucagccauaaaaaggagugaaguucuuggccgggugcaguggcucacgccuguaaucccagcacuuugggaggcugaggcgggcggaucacgaggucaggagaucgagaccauccuggcuaacacagugaaacccugucucuauuaaaaauacaaaaaauuauccaggcgugguggcgggugccuguagucccagcuacucgggaggcugaggcaggagaauggcaugaacccaggaggcagagcuugcagugagccgagaucgcgccacugcacuccagccugggcgacagagcgagacuccgucucagaacaaaacaaaacaaaaacaaaaggaaugaaguucucggcugggcaugguggcucacaccuuuaaucccagcacuuugggaggcugaggcaggcauaucaugagucaagagauggagaccauccuggccaacauggugacacaccgucucuacuaaaaacaaaaauuagcugggcauggugaagcucgccgguagucccagcuacuugggaggcugaggcaggagaaucgcuugaacccaggaggcggagguugcagugagccgagaucacgccacugcacuccagccugggcgacagagugagacuccaucucaaaaaaauaaauaauaaaaaggaaugaaguucucauucaugcuacauauagauaaacuuugaaaaccauaugcuaaggcugggcgcaguggcacacacaccugugaucccagcacuuugggaggcugggaugggcagauugcuugagcucaggaguuugagacuagccugggcaacauggcaaaauuccaucucuacaaaaaaaaagacccacaaguuggcugggcguggcagugcaugccuguagucccaacuacuaaggaggcugaggugggaggaucacuugagcucgggaggucaaggcugcugcagugagcuauguuccuaucacugcacucuggccugggugacaaagugagaacccugucucagucagucaaauuuauuuauuuauuuagagacggagucuugcucugucgcccaugcuggagugcaguggcacagucucagcucacugcaaccuccgacucccagguucaaucaauucucccaccucagccucucaaguaguagcugggacuacagguguucacugucacaccuggcuacuuuuuguauuuuuaguagaguuggaguuucaccauguuggccaggcuggucucgaacuccucaccuuaggugaucugccugccucggccucccaaagugcugggauuacaggcgugagccacuacaccuggccucagucagauauaaaaauuaaaaacucagauugggaucugaaagacuuguaagugcaacaauaauuuauucagcauacauauccuccagcucucccccgcuaauccuccccaacuuugcaaagaaaaaggaacuaaagcagcacuaaaaaguagaaagaacucacagggucuuacauucuccuguuuucuggaacucuuguuugaaaggugauacuuccucuugccucccaccucagauacuuacagaccaauaaccuaaaaccuaaguggagacuguugggcuaaccagaggugagcucagucuucuuaaaucugugacucuguuccagaucaacccuuagugaaaucugaauaauuauuuccucacuuuaaucagacgaaaugggagcucucacucucuaggaaaagcauuaauguucuucagucaccacuguucuuccauaauacaaacauacagagcaaccaaaaaagagagugacacccacaauuaaauuuuuaaaaucagcaaaaaccaaccuauagaugauucagauauuggaacuggagacagacuuuaacugucauguucauagggcuuaugggaaaauaguugaaacagugguugaauaaggaaucucagcagagaaauggaagcuuaaaaaaaccaauggaaaggccgggcacaguggcucacgccuguaaugccagcacuuugggaggccaaggcgggcggaucacgaggucaggaguucaagaccagccuggccaacauagugaaaccccaucucuacuaaaaauacuaaaauuagccggcaugguggcgcgccccuguagucccagcuacucgggagguugaggcaggagaaccacuugaacccaggaggcagagguuguggugagccgagaucacaccacugcacuccagccugggaaacagagcgagacuccaucucaaaaaaaaaaacaaaaacgcaagucguuaucuguauuugaaguuuaaaucuaguacgugaaauaaaaaacaaaauaggcuuaacagcagagugaauacuacaaaagaacagugaacucgaagacguaucaauagaaauuaucuaaaaugaaggucagagagauggaaaaaaaauggauagagcauuucuacgaucuaugcaacaauaucaggcaguccaauauauguguaaucagaguccuagaaggguaggagacagaauggguaggauaaauucacaaaagaagugcaaaacuuauacaaugaauacuauaaaacauuguugaaauuaaugacaaccuaaauaaaugaaaauacaucccauauucauggaucagaagacucaacauuuuguuaaaauggaauacucuuagcuaguaaauuguagaaccaguacugaaaccaaggucuguucaaauuaauuuaaucauucauauaggaauucauggugaguaggacaggcaaagguggcuguguucauggagccuccauuagauggagggagucauucuuuaauaaaacgguauaauuucagauaguguuaaguacugugaaauaaagcaugaugugauaauaauuggggaagaugguuuagguuagauggucaggaaaugccucucugaaaaagucucauaaaugucucuuuuucuuuuuacauuuuguuuucuugaauuaggaccaaauaaaggccacacauugagauugcuugcuaugucucuuaagucucuuuauguauagguuccucuuucauaucucgcuuuugaauuuuuccugguaauucaguuguugaacaaagcuggucauuuguccuguggcguuucccaugaucugguuucugacugcacagcuuccaagugaaugccaucuguugcgggaagucagggaccccaaauggagggaccugcugaagccgugacagaagaacauaaauugugaagauuucauggacauuuauuaguuccccaaauuaauacuuuuguaauuucuuacgccugucuuuacuacaaucucugaacauaaaucgugaaaaugucauggacguuuaucacuucccugaucaguacucuugugauuuccuaugccugucuuuacuuuaaucucuuaaucccgucaucuucauaagcugaggauguauguugccucaggacccugugaugauugcauuaucugcacaaauuguggagcauguguguuugaacaauaugaaaucugggcauccaaaaggaacaggauggcugcgauuuucauggaacaagggagauaaccauugggccugacugccugaggggcuggacagaacagagucauauuucucuucuuacaaaaccgaauaggagaaauaacacugaguucuuuuucucagcaaggaacagcccugagaaagagaaugcauuccuagggagaggucucuaaaauggccacucuaggagugucugucuuacacgguuguagaugagggaugaaacaagccccagucuccuguggcaccccaggccucuuaggauugggaaauuccugccuaguaaauuuuagucagaccgauugucugcucucaaacccugucuccugauaagauguuaucacugauaaugcaugcccagugggacaugaaacuucaucagcaauucuaauuucacccugguccugugaucucgcucugccccauuugccuugugauauuuuauugcccuugaagcaugugaucucugugacccacacccuauucauacaacccuccccuuuugaaauccauaauaacuuacugguuuuguggcucagggggcaucacggaaccugccaacaugugaugucuccccuggacacccagcuuuaaaauuucucucuuuuguguucuuucccuuuauuucucagacuggccgacacuuagggaaaauagaacguauguugaaauaucgggggcugguuccccgauagccauccucagcccucuguuacuuccucugcaguggugguugggucuagaggcuugaggagagucaaguuaauuguuuuuggcaauauuguaagucuggaucuuaaacacuuacuccuuacuccuuacacuauauuaaggcauuauuguuaaaauuuucggauauaauggucauguagugaugguuuuuuuuauagauuuauacaggaaaauuaguggaugaaaugauaugucugagauuugcuccacuguaauaaaggaugagaaguacuuggggguaaagacaaaaucugacaggccaugaguugagcauuguugaaucuggcugaugggugucuggaggguucauuauacucuucugucugcuuuuuguaguuuuuagauuuuccauaauuuuguaguuuuuagauuuuccauaauuuuauguuuuaaagccuguuguuauuuaucucaauuaaaaugaauggaauucucucucacccauuuaugaggaugcaauaacuaucaauucauguugacuucaguaaaauauguuagugaucuacuucauuuucaugggaagccauuauuuaucaaaucacuuuuuuuuuuuuuuuugacgguguuucgcucuuguugcccagacugaaguucaauggcacuauacuggcucacugcaaccucugccucccggguucaagcgauucuccugccucagccucccagguagcugggauuauaggaaugcaccaccacgcccagcuaauuuuguauuuuuaguagagacaggguuucuccauguuggucaggcuggucuugagcucccgaccucaggugauccaccugccucggccucccaaagugcuggcauuaugggcaugagccgcugcacccagccugucaaaucacauuuuaaaaauuaagcugaaccauuugagguuucugagcuuuuucaggcaaaaugcucauauacuggcaauuuucuguguuucagccugaugcauggacgucagcuaagcagucaaauaccuuccacaugcaugcauucauuguuagguuuucuaacuuuccauggcaguuuacuaguuaucagggccaaugcuguuaggacugaauuggauuccuaguuuuuaaaagcugugacucaccauuaaaugguuguagugaauugguacuguuguuguuguuguuguuguuguuguuguuguuguuaagaaauuuaaagggggaaaaaaaagagacuaggaaguacauuaaguauguuacccuaagacagaaauuagcuuguuguauuugaggcacagaagauaugugugacugcccugagugagggggaggaugauaaaagaugaugucagagcaguggaaaagggacagaucauguugggccuucuagaauugguagacaggagugaaaugaugugacugccauugcaaguagugcuccagcugcuguguggacguagacuguagugggagcaaaagaccagcuaaguuguugcauagucugggcaaaagguugggguuagguggcucagaccagaguagaaaggaggggauacccuaggggguggggggcauuucagaaguggcccacuggagguuugaugaguagagauuaagugauuacuuagaaaauacuuaggaaugugccuagcacauacagagugcuugauuuuugguucauugugguuaaaacacugaacagcaaccauuuuuugagcauauaagucuguuucaggcucuguucuaaaguguguuacauuucuuggcucacguaauucacucuccgcuguguugagauggguaguuuauuaccaccauuuuacaggagaggauccauagcaccgcucugcucuugcaaguuucuaugcacaguggccccuuuccaaaguccaucuuauucugcauucucagccacggagagaugacacuuaacuaaggugaauggccccucaaauguagcccaguuguucuuuaagaaccagcuuccagagaaguuaagugucugggaccugacacagccucgagucagcauuugccccugugcuagcagcauccucugagcaugagauuugcaaacuuggacagaauucagcuuuggucaucauuucaacaaugaagcuaauuuaagcuuacuucugcagcacugggaaagucauuaugaaauaaaagugcacaaauggagagaaagacagugaaaaucacuuaucauccauugcuaaugaguucagccaaacgcuggaggaaucagaauaagugguguccguaauagcuuguaaauguuuucgaacuuuuuauuugguggaucucuugugggguugguuuuccugacccuggcauugugucaaacagacacugcgggcaguguagcagauaaacauuaaaaguucccaccuaccauaaaucauguuuucagagaacugugaacauggaauagcuugagaacuucucauagauaggaagucccuguccagagucuagcuucuuuuguggugguuagagcauuuguaccagaacuaaucuugcuuuuuccauuugugccagcugugagcaccuccugcccacggaugcagccugccauuucacgaugaccucucauccuaucuugcuuccugacccuuuuguuuuuuagcaaucauccucuuccagugguagcguguuugggucuggaaacacuggaagagggggagguuucuucaguggccuuggaggaaaacccagucaggaugcagccaacaaaaacccauucagcucggccagugggggcuuuggauccacagcuaccucaaguaaguugagaagacuuuucccagucccuugguccccuaaugccauugucauucuuaggguguuaucaaagcuucagugacaaauauaaaaagaaaaaaaaaucuagaaggcucauuuaaaauaucuuccccaaagcagugugaucuguuuugcuuuuuuauuuuugguuuuuuaaugagauguccuauauaaucaugaaaagauaucagagcugcagggagaggaucuguguauugagcugcuccccucuucucucccaaggcccaaaucgcucuguuucuuaguauuggagugacuugaagugaaugcaagcagacaagcauaaaugagcagcagcagagcaagccgaggaugcugggaggagagcaugcagacuuucauuuggauaguacucuccaaauuuuccuuaaaauucagcuccuguagggagaugucacccaaaaguugaagccuuuaauauuucucaccucuuacauuuuuguuuuauuuucaucugaagcuguaucugccaguacuuucuuuagcuaauuuuuuuuuuuuuuuuuuuuuugagacagaguuucacucuuguugcccaggcuggugugcaauggcgugaucucagcucacuacaaccuccgccucccagguucaaaugauucuccugccuuagccucccagguagcugggauuacaggcacgugcuaucacgccuggcugauuuuuauauuuuuaguagagacaggguuucaccauguugaccaggcuggucucaaacuucuccgcccgccucggccucccaaagugcugggauuacagguaugagccaccaugcccagccuucuuuagcuaauuuuaaaaauucuuuuuuuuuuuuuuuucuuuuuucuuuuugagacagagucuugcucugucaccaaggcuggagugcaguggcgugaucuuggcucacugcaagcuccacuucccggguucaugccauuguccugccucagcguccugaauagcugggauuacaggugcccgccaccaagcccggcuaauuuuuuauauuuuuuuuaguagagacgggguuucaccauguuagccaggaggucucgaucuccugaccucaugauccgccugccuuggccucccaaagugcugggauuacaggcgugaaccaccacgcccaggcuuuuuuuuuuuuuuuccuuuuuuuugaaacggaguguugcucugucacccaggcuggagugcaguggugcaaucucggcucacugcaaccucccagguucaagcaauucucccagcucagcuucccgaguagcugggauuacaggcaccugccaccaagccuggcuaguuuuuguauuuuuaguagagacgggguuuuaccauguuggccaggcuggucucgaaccccugaccucaggugauccgcccaccucagccucccaaagugcugggauuacaggcgugagccaccgugcucggccuuaaaaguuauuuguugaccuguguauucaugguuggaaaugaaagaaaucuguuuguguagaucuuuauccugcugcucaggcggaagcugagauuagaaguugggagccuguccuguuugucucagcuucucucauuuaaugugcccuacaugaaguuucucucaucuguugugcugugugagaucuccaugaaucaugagcuaguguucugcagucaugacagauguuuccuuaauauuaaggccugugcaguuagcaaaacuuucuauccugauuugcccuucuaaacuccuaaaucaaaaacuagucaguuuuuuaguucagccugggcaacacagcaaguccccaucucaaaaaccaaacaaacaaaaaccuaguuauuuugaugucacuguccacuccacuaauacauaaggaaagauuauugucaagagacacauaccuuuuaccuugugaaauuauguaaucagaaguuuuuguucuuuagguuucagucugccaggagggauuuagaauccuggaucuuagaaaucaagucuaguaguuuucaaaaacuguuuuugccaaugaacucuuaaguagcauccugauaaggaaaacaaaaguagguucaugcugaagcaggggucaggaacuccaaaacacacagcuggcuggcaccacaggaccgugaggcuccauagcacauacuuugaaaacaucguccuuuuauggcucuucauuuuccauugaggaaacaagcccagaauucugaggucacagagccagaaagucacagauauagaacucagcuagacuauaugucacaugccagacacagaaucuggcacagaauagacacuuaauaacaugcuccacugcaguuagaaauuuggguuuaucccagagcuaagguaucaucugcgagguuguguuacuggccaauuuuguuaaaaguuaaaugugucauaucccuauaaacauucguuuacucaucucuaaugccauggcucuugacugucaaggaguugccuucugucaguggcuggcugcagcugguuugcacggacacaugagagccagccaagcacaucuucccaguuguucauuuggugacaucguuugggguaaccugaaaugagccauuguggaguauuuauaucauggaaaucagaaaacccuacaaaccaggacuccccagccugucaaacauuacuggcugauucuucuaauucugguuuaaaguaaacacauaacuauucuugauaccagauaaccuguuagucuucaucuucuaaauguuggcuguuaacuauaaaccaacaauuuacaugugugccuaagggaaguuuaagugauuuugaaggaguagaggaaacacuuaacauuguauuauuuuaaaaacuauaugauuuuauuucaauaguuuuugggguacuagguguaugauucaauagugaaagggacaggaauuguuuuaacucugagggccaccaaguacagaauaaaaggaaggaacaguggagaaggaagagcugggagucgucuggggaaaggcauuguccucaccacaguacucaggaucguuucugcagaaucaucagugacagcuucuuucuccuuaauugacucugcaucauuugaugcuuugagcaccacuucuuuccuggacuguaugaacugauucuccugguuccuucugccuuucaaacaauuccuccucugcuucucuucuuaucucuaccuucucucccuccccucaccaacccccgcacuccccgccccauuuugcuauggggcauuccccguggucaucuguucaucacaaucuucuucucccuucccccuggcucuuccauuguggucugaaaauccaugccaaacccgagucuuaagacugcauuuauuuugccccuuuuccuacucaaacccuugggcaacuucccacugacuauaggauaaagaugaaauaaacuugaaacuggaauucagggcccuccuugagcuggccccaaaguaccuuucugacuguacucaguuccccagcacauuccuucugguuuggucaguuugucugcuugcaucccucccucacuuccuccagguucacuuggcacccugcacccaccuucugagccuguccuucuuuaaaagaugaaugcaaggcuguuucugugugcacugcaccuuugccugagggucauucaggcccaccaugaucgcucccucucuggaaauccugcagcccuuggauuucaucacuacacaaaccaucaagcagaaggaaaccagccuuuauuaaucaccugcugugugccagaagcucaaugcacgugagcuaaccacuucuuacaacagugcuuuuagauguggcuguccccauuucacugauaggaaaaucagguccaagaggagauguauacugcagaaguugcacagcuacuaaguggcguagccaggauuuaguccagcugcguuucccgagcucugauuggccuuguuuacagaacgucucccagguacgccuuuuugggcaacauuuaugcauggaaaagaccccauuauagagaguuauuugagcaguccccuuugugacauuuaugccccgggcugcuuugcccugaaacugcccacuuuaccccugagaagucgugagaacuauaacaaugaccgcaaaagacaagcugagaacaccaguacuuggaguuggcauguucuguauccagaagcucaaagcuugcaagaagggcuucuucucucugucauccccauagaaucuacuaaagaaaaccugggaacccauggagacaucuaaaauucaccaccacuguggauuguuacccauaaggaccuguugccuccuuuaguauuguccugaggacacuguguagggccauucccagcacauucuuucuguuuaggguccugaaagacauauuugucucaucagaagaugaagaagccguuugaugaugaucuuguggguuuacagggucccucuacaacuguucuuuaagaaaauaucuuggaaaguauccugggcaagagcuuccugagagacccuuucggaguaugcauugaauucuuguucaaugacuuuagaccugcaggaugauauggggccuggucugauacucuguaucggauuuaauugcuauccaguuuauauuaaguauaauuuaauucagauugggucaggcccugauguuggaugaugcuaguguuuuugccaaauaaaagaccaaagaagauccauguuuugccagcaggguggaagcccagagcagaugccaguuuuaccuguacuuggcaccccuaaagugucagucacagauggcuaugcaaagacaaacuuguuuuuuuuacuggauaguuuauuuacaagucaagaagaaucuucuacagugaaauauuguucgguccgccaagauauucucuuaugguaauaugagaauaugguaacauauuuucaaaaacuagagacuauguuauuuuggaaccauuaggagaaaaccaagaaacacauuguugacauuagaaacagagacucagucauuguuuuaugcuacuuuguuucagagcaguuuaaaucaaugguaaaaugucucaacaugcagagcuccuugagagacuguaaaugagagugauuacagcuuuaauggugucauucuugggaucuuuuaaaaaugaaaaggauuugauuaucuccugcugaccugcucagugucuuacuagcugaagugugauugagauguggaaggaagagguugaaggaacagagaagggcagcagccuuuuccgagagucuacaacauaccacacuagugcccugugugcaucauguuaucuucccagcaucccugcagagucacaauugcuguccuguucuguguguggggaaacugggacuuaggauaguuaaguccuugcccagggugacacagcuauuagguaaucucacccgggucugacugcaaacuucacugcuuguuccacuaugauaugccauaaagauuuuaaagucaaagaguucuuaaagagagaaaaagauuaaaaagcccaaagacuucuaaaugaucucugacuucccaccacugucccaauaacaucauuucaccucacauuucauaugguugcaccaaguuucuccaagaggagauucaaccccagucuugcccuugaauuuguuugcuauuugaauuuugcauugcuagcacuaacaaagugcaaaaaucuguucuugaaauaccaaguaaacggaauggcugagaagccuguuuucaucuccauugucaaauguacugccauugaaggaaucagacguaacuuugggcuagcucgauaaggggaaggucaaacugcucagaaggccauuuugugggacuccgucaagggauacauuauccugugguaccgaguuaugagggugauacaaagggauuucuuaaccacccagcugccaguaccugacauaccugacauguggguccuuagccaggcucucaaauugucagcagugguuuuauagggcagugaccaugaugugaugggccaagucauauuguauuacuggugccuggaaauuugaggugacugggucccaaagugaggccacucacuuccuggauuguggauuaagagcauugcaucuggacguauuaaccaugguggcucuccuauuagaguugguugguagcagcaugaguugagagaccuggggaggugacagguuaaugggggggccaccucuuccaacagcucgacuuugaaaaugauguuaagugcucccccuccuccaguccucuccuuucacuuugcuugugaacaccugacuggcuuagggagagacugguccuucauuacccacccagugauuacccagagcauaugcugugccucccauuuaugccuugugucuuugggcauccacuccacuucaggauagcuucucccugccuugugggcauauauucaauaaaacacccaucuagacgugguaggaaacgugaguuauuccuucccuucccaccaacgcccaccccccccaaaaaaaguuugaaaacucugacauauccugugcuauauuaucugagugacagcugcuguguauguggacuuugucuguuuaucuauuauuaucugucagguuugcauuucuuguaacaggugaaaaaaaauucucagccaucuugguuuuuaguaguuuccuuuuuuccuuuaauucuuggagugaauucagugcauaguugagagggggaugacccccuagauaaguaucuaaaaggucaagggcuucauuaaaccucuuagaggaaaucugacuggaagucuugcuagccucuuuaacauucuucagaccaucccuauauccccuuggaucaaagacaggagcaccaugauuuuucucauuucacugccauucucugagcagcucaggcagccauaagcaugcugaacuugacuauaaaagcaggagguaagugcuagaagccauuuugccuggguuggauuuguucuaacuuuaauuucccuaguuugacaaaauuugaaguuggucuugugugaagagaccaaucaaaguaagcccuguuuuccagaagaaagcagccuguggggcagagcccauggccuccauugcugggcagucuugacacuugcaggagcacccagugagcuucuacaaaggagccuuuucagugggaccucucacugcuccuuuauuuugugccuauaaaaucaugccaggaaauccugagccugggugccagaaugauuaaaaacuucccagcaaggugcgugaaaaucagagaaaguaccuguugcugucacugucgcuccgcucccuuggcuucuaggcggcuugucacucccaucuuuccaaacacccaacugagacuuuuucuguguucugagaagcagguaaggacauuugucucccucugaccucccucacaucuucaucucuucagauaccucuaaccuauuuggaaacaguggggccaagacauuugguggauuugccagcucgucguuuggagagcagaaacccacuggcacuuucagcucuggaggaggaaguguggcaucccaaggcuuuggguuuuccucuccaaacaaaacagguacuccuaugucuauuuguuaugguuaucuuuauauauguauuuguuuaugcauagauaucuggaaggagacaucucuagggugguuaucuuaagagaguaggauuggaguaaagaaguuaacuguuuccuccgcauuauuuuuauauuuacugagcaucugcuacauuccuaacaugauuccaggucuuccaaaacauguuuaaaagcauagaaugcaaguaaugcaacauuuuuuuuucuuuuuuuuuuugugagagggagucucaaucugucgccaggcuggagugcaauggugcgaucucagcucacagcaaccuccaacucccugguucaagcgauucuccugccucagccucccaaguagcugggauuacaggcaugugccaccaugcccagcuaauuuuuguauuuuuaggagagaugagguuucaccauguugggcagucuggucuccaucucuugaccuugugauccgcccaccucggccucccaaagugcugggacuacaggcaugagccaccgcgcccagcuguaaugcaacucuuaagagaacacagauucuucuuggggagaaaacauuguaaauauuugacaguugcagaacaaacaaaauaaaggaacacauaaggaaaugauaacugaaguaucugcaggaaagcauccugagucauggauuuguugggguucccauuauuugugagggucaaagcagauuaucuguuuaauuucuaauguguauguuacuuuccccucuuucgcaaaucacuuuuuuuuuauuuuuauuuauuuauuuauuuuuuuuuuuuuuuuuuuuuuuuugagacggagucucgcucugucgcccaggcuggagugcaguggcgcaaucucggcucacugcaagcucugccuccuggguucacgccauucuccugcgucagccucccaaguagcugggacuacaggcgcccgccaccacgcccggcuaauuuuuuguauuuuuaguagagacgggguuucaccguguuagccaggauggucucaaucuccugaccucgugauccgcccgccucggccucccaacgugcugggauuacaggcgugagccaccaugcccagcccccaaaucacuuuauuuuuaauugaaguauauguuuauccacaauccacauaaguacacagcugaauuaauuaucacaguuggaauacacccauguaaccaaggaaaaggaacauuacuaggacuacuuuuuaucccagcauuacuauuaaaguauauauuuauauaaacuauaugccuuuuuauaaucauguaugauguauuuauaacuacaaauuuuuaaugaacaguguauguuuagaucugaaaacauguacuucauuucugucaucugccucuccacccuguuucugucucugagaucugcggagagucugcacuccuguccuuguugauggaaaguugugugaaaagaguuuuuuuuaagacaggugguccagggugggcuguuugagcaagcagcuuuuuaaagcaaacucccccuggguaagugggcaggacacuuggcccucguaugcaggggaugcucugaaauaugcuaauuccagaggaaggaucuaaccucaggacuagaugcaucaguggcucugaccugggaguaaggcugccccaaauuaauacauggagucucauauuuagagccuaaagugcugugguuuccaaauccacugugcaccuuaccucagauugugacucagguagcuuagucuuucuuugguugcuaguuguuaauacuguuuuccuagaaauuaaaacagaauauucugaaaugggcuucacagcuuucuuuuugcuacacacacagugcauuguuuaaaaaugaaagggccacaaggcuuuuaucccaguuagaaaggugcaucgugaacauuucaacuggggaauuuuaguucaucgaucaucaagacuuuuuauguuuuuaggaggcugauaauguuuucuuugacucuuaacgguuuuccuauauaugguucuuuauccugagauuauauccccauugauuuggaaaucugaccuuugaaaauuccaccuguaaucccagcaguuugggaggcugaggugggaggaucacuugagcccaaaaguucaagaccaaccugggcaacauagugagaccccaucucuaaaagaaaaaaggaaaaucacaccuaauucagacacuggguacaguggcucacgccuguaaucccagcacuuugggaggccaaggaagacagaucacuugaguccaggaguuugaaaccagccuggauaacauggcaaaaacccgucucuacaaaaaaaaauaaugcaaaaauaagccaggcacguuggugcacaccuguagucccagcuccucgggagacugaggugggaggaucaauugagccugggaggcagagauugcagugagccaagauuaugccacugcacuucauccugggcaacaaagcaagacucugucucaaaaaaaagaaagaaaaucugacccuuuuauuugucuagucuuagagaaaauguaugccccaacuuuucauaguaaguacuuauuugccccaugaaacuaauacuuagauugaggccucgaauagagaacaacuaucuuucagauacauaagaugagugaacuaguaaccauaaacaucaaagugagggcaggggaaaggccacucccccucauguuucaggacuucaucucucugcugcagaacucguauugguucugggagagcuuuuucuauugaaagaggggacuggaagucccgagcagaaggaagggcugcugugaauagaggaacugccuuccuguccaggcaucagggcacuuuuugcuuuaagagagauuuuaaguugaugauuuggaugggucuuugaaaaauuccaaaaguaucuauccucccuucaguaaaauugcauuauaaaauuauccugcuggaggucauccggggagaggacaggaggaaggugggauggacugaagauggccuugcugcccaccauggucaguggucuacacccugcugucucgcuaaaguguuagauuuggagggaggcaggcaggggaugaaugauggggaagaugagaggugggcguuugagucgcacagaccuuguuccagucccagcucuagcacccaucagcuggcugaaguugggacaaguggcauauucucuaagucucaguuuccuccccugugauguaaggaucccaggcuuauugggaagauuuaagaaaacugcugugaagcaccuggcauauagugggcccucaauaaaucagaaaguuuaucaucauugauuauuagaaaauuuguuucuucuggagaagaaauuuaugaaaauacggcaacugauaaaaucaaaccccuccugccaucaggagagaguugccucuuuaagccagagugacuguuuucuuccuguuuaauuuggcugugacccagguguguuguuugggggcuuuuucucucuguguauauuuaaccgccaccccuccccuguccaguuuauuuucuguaucaucaugacuucccauuuuucacucaccuuccaccaagaagucuaagcaauauugauacaagguacuagauagcgcccugcaugucuaggaagaaaguguaacuagaucugugaucagucuuaaauaauucaacuguaaggguuuuuuagcacuuuuuuuuuuccagucuguuauauuuauaacccaacagucuccauuaucauggcuuggaauuucacucaguguuuuaacaugcggaauguuaacccaaacacgagccuuagcaaaaaaguaucuucucaguugugcagccuaccacuguuaauggcaaauaggcacaugagugaaucacaaaauaacaguuaacugagggauucagcugacaacuuuucauacccaggauuugaucuuuccugauucagauggcagaagcuuguguugugauuacauaaacaauaagaagucuggauuucaucccucuaacaacagauugacuuucugaaaggggagaaaaggcuugucgcuaggccaccauuacucccgcuagcacgcaguucauaggccaacacucaccuuaagaaguacucccuuuagagggugcucccaguuagagcacauuucuuaugccauucuauuccauucauucaagaagacacucacugagugucuauucuaauacuuuagaaugauuucagcaguaucuuggaaguuugggaacccgcaucaggaauagcucaggagaggauguuuugucuuccugccugacaggcaucaccagcaaucagaguagggugcccugugcgugaccugacccuugucuguguggccaccuguguggugcugcccucuggcagccugagcccacugggcagcaguguuggcaacguugcagaaggcaucugaacucuagggcuguccucacuguugacuuauuauuuuauuagauuuaugcagcagccugccuccaaagaagaaauuugguguguuuuuucauugggaaguaauuccagacugcaggaaaaaagcauuuaaaaaaaaaaaaacaaaccuccacugagcgagagaaagggagacucugaugagagacguaggagccaucaggcuguaaauaaauaaaaagcaccuggcugggcgccagcauacacgucucugucucugcuaugacccaauucagggauucucccugagaggagguuuugagccucugauuuuauaauuuggguuucuaugaagcuggaugucuugccuguguacugauaaguaauauagucugucaucuuuugucagcuagguagggauuggaguuuuugagaaugguuuuucacuccaaacagcucagaggaccugggagggguggaaggugcaccgagugggcucuuggaggucugcucacacggcuucacagugacuucacagggucugcaggagcucuccugaguggaccccagagcccucugcuaggaauggaggggagugguuugguuugagggcuuuuguuuuguuguuuucauuacuauuuucuugauagaagggcgggggggaggggggguguugcccuuuacucuaguucuugcauuugaauugcuaacauccucuuuucccuuuuuucuuccuauuuugauuugguuucucauugcucaaugucuucucuuccugucuccuccuuucuuucucccuauuucuguuuguuugccucuguuuugcucagguggcuucggugcugcuccaguguuuggcagcccuccuacuuuugggggauccccuggguuuggaggggugccagcauucgguucagccccagccuuuacaagcccucugggcucgacgggaggcaaaguguucggagagggcacugcagcugccagcgcaggaggauucggguaagcccccuggggagggcccuugggaacccacacgccagccaaaaagcacuaggggccuguacucuugcucugaaaagaaauuugaccaugaggugaaggccccucccuugaaauuugugaacaacucccucaaggauuccuguaccucuccaggguaagacucauuucguucaagccaggcuuuguugaauucaugguggaccucagcuguguugcuguucccugguaugagaaaugcuggucaucagagccccuguucuccugcuggggcuaaaggaaggcaccagcccugccuuaacuacugcuuuguagccaagaggugccccgguguggagcuucuguuaggaaguccucaaugaaugguuuucaccagauucuuuccucuugggauuauucuguguuagacccguuguccuugaacaaacaacucccuguguccccugcuccccugcagccccccagagugaguauucaguugcacagguccucccgugggaagauccuggaugaucagggauuucgaagcugcucucauugccucgugugcgucugcacuggaaaaggccauuuuuagggagucgcuuuuaagggcagaauuucagugugguugccaaaaccccaagggaaaaaaaccuucaccacaccacaacaucccaauuuaaaaaauguacacgggaugacuaccaagucucuuguucaaaggaggugucgaugccugaaaggaguucuaaaacgccucuugccgcaguacugggcucagcaugagcugaagguuugggggaggggagaugauuuugucuaggggaauuguugagauacuuggaucugagucuuggcaagaugacagcaucuuuaucuugaaaauaaacuauaguauguucuuacucacacccuuccccuccgugcaagaugcuggagcgcagcagcaggagugagaggguuggcgugcugcuucuccuguuucacgggagacugaugccuuagguuugcccucaggaaaccccaagaauuaaaguuaaggaaagcuuugaaaggacaguuagagacccacuuaggcugguauucucagaggucuuaauggaugcuguucucugcagugaugaaccagcacacaguaccacagaguugguagaagguuuggguuggcuggguaucuugugaauugauuuauuuauuugaaaccagcuguuuucuuuacuaguagaaaaguauauucugccuuggggcggcucucacacaaaucccgauuggcugguuagucaguccuaaaaaagguuaaugccaggucaguuauuaaaucuccauaagagcccauuaccuucuuccaggucccuggccaugagccugucuccgacccugaagggcaggcuguugcugaugaggcccaaggcaggaggaggaagggagcaggccgcuccugggagaaaguccaaugagagcagaucccuuggccaccuuuguauggaaagagccuugaccucaccauuaaaagugaauagaauggugggaaggcagaguuuuagauacuuuuucuugcuuugggguugauucuugcccccaggugcugccccuucucccagaaaccacugauccguuucccucaccuagucaccuccagaccccagaagcucuccccaacccagccgaguuccucugcaaacaauucaaggggcucugauaggucacacagugccaccuugugugcuggaccauaucuggagggagaacugagugagggggcacaggggauugucuccagguggggcgagcaggggaaggaaaauaguggccacuuuuacauugguuuggguaguaauuauugauucaggaagcaaauacaaaauccugaaugaaaugacuuggaaaaaguaaauagaaucaagaucccaagaggagcugaagauaaauaaaugggagcaggaugugggggaauggucgguaagugagaaaugcuaaaaugauagaauaaagcuuaaggauuguuggagguagagcaggaacuguguacugcauaguucccaaaugcccugguguuccaaugggggauggaaacuaaaacacuggccagguuggauuucauacuguaguccugccauuuuucuuccuagagcagagauaaaaguuggcccugggcgauagcucauucucucugaaaggcugcuaguuaggcccagccugucacccuggaucaugagugucguguguauugggacuuacagcagggggcugaggcuugcagaugggcaaguggugagaggccccacugaccucagucuguuucucacuggagcgcagguuugggagcagcagcaacaccacauccuucggcacgcucgcgagucagaaugcccccacuuucggaucacugucccaacagacuucugguuuugggacccagaguagcggauucucugguuuuggaucaggcacaggagguaagcugccacaaguucuccccucacaagcaaaaugggucccucuugccuucucccccaaagaaaugaguauguuuuaccugaccagucuguuuaguauuuuaaaagcugacugggcacgugguucacgccuguaaucccagcacuuugggagaccaaggcaggaggaucacuugagcccaggaguuugagacuagccugggcaacauggcaagacuccauucucuacaaaaaauguuaaaauucgccagacaugguggcacacaccuguggucccagcuacucgggaggcugaagcaggaggaucacuugagcgcugcagugagcugugauugcaccacugcacuccagccugggugacagaaugagacccugucucaaaauaaauaaauauguaacauacugaaagugguugaaacauauauauauauauauauuuuugagacggagucucgcucuguugcccaggauggagugcaguggcacaaucucggcucacuauaaacuccgccucccggguucacgccauucuccugccucagccuuugaguagcugggucuacaggcgcccgccaccaggcccggcuaauuuuuuguguuuuuaguagagaugggguuucacuguguuagccaggauggucuccaucuccugaccucaugauccacccaccucggccucccagagugcugggauuacagcaccuggcauauauauuuuuuuuuagguuuuaguuagacuuagaacacugugucauuucuuaccaaagaaauuacugucuugauuuccucucaggauuugagaagcccaaaauaauaauggucuuacuaggccuugguuuaaaaaaucuaagccagcagacucaaaaaaaaaaaaaaaggcauagaaacuucacaaaacaucuugcauuuguuuaacacucugcuucuucagauggcagaauaugugucuuccauuuuguucuugcaguaaacugacaaggcacagaauuuagguaucauuacaauuguacccgugaagaaacagaaacuccaaggaacuaaguguuagcaguuagcaguagaaccaggccuagaauccagccaucuugcuucucuggcccccaaaaagaagaggaagcaaauggauggaaaaacaacaacagcaaaaaaaaaaaaaaaaaaaaaagguuuuccuaaugaauggaucuaugugguccaguacagcugagaggccaagccagagacccucugccuacagcuggggccgaggagggaggaagaacccuaaaauaccaagaagauaacucauaaaaaguaaaggauuuuuucugccuucugggggaucugaguagcuccagaggacaaacucagaauaaaggggcuucuguguguaccuuuccugccuuccuguaggugguggaggcacggagggcuucccacaagaagcacagaggagggcagacacuuagcauggggaccaccuuugucuuucgaguggaugcgugcuuuaacuucacucuuauucugcuuuucaggguucagcuuugggucaaauaacucguaaguaucccccuuuuugagucucaccuuaauuaaaagcauuaaauaagguuggaaguguguggaucuugcuggauuugugcauuuucuuuucguuuuuuccuguuuuuagaguuuguccuggaaguguggggguucagcagcaggguuuggguuuuguggacuugcucuucucuguagcaauauggcaggaggugccaggccucgccuucuuaagaggcgugguucaaagagaaaagagcacgccugccagugagcugggccugagggcagcgcugaggagaugcugcuccugacuucccuggagguuucucagaagcugcaugcuaaccccugggcucugggccaucaccaggucucauguguugauccacccucugugcuucuguguaaaauuucauggcguuaaaauucagucuuagccaggugggugguucacgccuauaaucccagcacuuugggaggcugaggugggaggauugcuugagcccaggagucaagaccagccugggcaacagagugagaccccaucucuacuaaaaauuaaaaaaauuagccgugcaugcuggcuuaugccuguggucccagcuacuccagaagcugaggcgggaggaucacuugagccugggagguugaggcugcagugagccaagaugguaccacuaccgucuagccugggugacagccagacccuauaucaaaagaaaaaaauauauauacuggccaagcacgguggcucacaccuguaaucccagcacuuuggcaggccaaggugggcagauauuugaggucaggaguucgagaccagccuggccaacauggugaaaccccaucucuacuaaaaauauauauauauacauauauagauaaacacacaagaauuagccaggcgugguggugcaugccuguaaucccagccacugaggcugaggcaaaagaagcacuugagcccgagagacagagguugcagugagcugagaucacgccacugcacuccagccugggcaauagagugagacucuguaucaaaaaaauaauaauaaaaaaucugaguccugaccuuugcacacaggcagagcagcagagccugugacugcucugugacagagcagcugacuccaccacuguccugugcuuccuugcaggucuguccaggguuuugguggcuggcgaagcugagggcgugucagcaggccuuucgaucccugggaccaaccgcauccucagcuucuuccccgagaaaugcuggagcaggcuguucagaccgacguugccaucaaaacacauacacccagaaagaaacaacagaaaccaaaacucacaaggcgcaugauuacuuguuuuauauuucauguuggguuuucccucccacuauuaaacagucuguuuccguacagaacguauguggguuuuuucagaucacagccaagaagauugccccguuucuguggcucugagaagccagcagagccuccaucagccagaacacugugucuucaaggauggcaucagaagucaccagcgucggguguugauaaacagcaucgaaugugccguggucucacuuggaccuagcgcccuccacauagggaagagguugaaugcuggugggucaucuuuuugaggcugaaacuugguuaucuccucuccuuguucuuuuagccauuguguaucaggaccauccaaggacgcacucugcgauugaguggaggcagaggaagccacucaugccagcagcaguugaguuucagaagcagccauagcgcuuuucaguacaguacaauaguagccagcgugaggcaggacagugcugcgccuuagccggccuuggcucucaucuccauguggcucuugggugccauguguccuacuccagagaggagggggccggucacuugagaagacagccuuuauauucuguauguggcagugacauugguagccacaccuacccagugucuacuaaccacagugcagauagcccuuggguagacccaggaagugugaagacagacacugcuguugccagacaacacuagcagaacgaugcuggauuugacaacaguguuugcuaggacggcccagagcucaucacugcaguuuuauuagagugcuucuuuaucuuuaaugcaguaucuuugaggccuguaacauccuagauaguugccaucaaacaaggaccgucucgcauugaaaacagauguaagaauuucucuuucaggcccagaaucugacagugcuuuggcuugggucaugagcagcggggaguugggaagagauuuuuuuuuuuagaguuuuacauauuggcagguuguauuuuuuuaauguuuuaauaaaaguuugacaugacauuaauucaucauguugcagacagugugaccuccuugguucugauggcuuauguggggacaguagaccauggugaggucuccacugugucaccaccuggucugaagguccccaucucgccugugccccagggucaccugcagaguucuuugucaagugcacauucccagccuccauccuggggacucuggcuccagaggacuccgauagaggcuggacgcccaccuggcuuuguguuuggugauuucuuaagcucacgagaagaggaaucucauuguauagcacuguuggguuucagaaaucccucccucaaccagaugccagcagagccaagagcuggaauuagauccguggugucucuggaugacugucacccugcgcucugugcaguuaggagagggaggggcugucuguacgguccguuaucuaggggcucugccucucgcaaagagcuggggucuccauaaauuuaaugugugcucuuuuugguccuugagaauugaagagccugucacc

SEQ ID NO: 21205 - RNA, 135902 nt, Homo sapiens
auguugccaauuaucuccauguuuauuuaaauauuuugcucuaaaggaagcaaucauuccuuuauacuucuuuaaauuuaguauugacauuuuuauuuugggaaaggaggucuuuuuuuuuuuuaacauggauacaggaaaagaaaacucuccaauaaaaauauugucuaaaaaguuuguuuugucugcaugauuuacuaaauauguacaauuucaauucacagcgaagguaacaaagauuuaaacagccaacaucacaaaugucucaaguucuaaaaaaaaaucacugugcacaguuuaacaauuuaauugaaaaaaccaaagcuaagccuucagucugaaucuuuuuuuaugaugggcacaagccauguauuuucuucaucuuuguuacacgaugcauauuucagugacuaaaagccccuucccauuuuaguauauuagguuaugucaguacauacuuaagagaggcauaaauugccucuugguacaccaauaugauuugugauguguucacauauaugucauaauauuuauuaauauauagaaugaucagaugagucaccugugauuuuucuuaaugucuucaaauguaggaauguuuuguugcauguauaaaauuuuucagaauuuauaggagugcuuauauaagcgauaauaauuggaccagugucccuugauguaaggugucuagaaagaacucuucugcucuugaaauauagagauuucacaucucuacacaauacagguuuauaaaguuugcuauuauaugaucaagugagugaaccaauuaaucauuagaaacaaaugucauugaauacagaauaguugaguuacaguuaagaagggagccauaaccucagcugcccuauaaaaucuauaauaaggugguuuucauauauauauuuuuuccccaugugaauucuuugguguuuuuucccccucuuuuuuuagugcuaugauugaugaacaugcaaugugagauucaaauaauugcauugagcauguuuauuugaauaauugccccauugcacaauaaauaaauccgcugaguguguuuguuugaauguuuuuacauguacaugggaucacauagucaaauaaaugcagcuguguuuauuacaauguguggggcuccagauauacacacacuuguuuguguguauauccagggcccuacagccccugaauggccucacacaucuuggagcaaaagcaugguuaacaauuuuucaguucaaauacauguaaacuuauuauugggcagucuccucaaauuugugacuaagauuugcuuuuauuaaggcuuacauuauuagaaagauaaaaaaugaccuuuuuaaaaguuaucugauugugaaaaguaucuaauacauuuauucauauuuauucaaauauagucccuucuuuccccuuuccuccaagcccucccacuccgcccccaguccaauucaugcuaaggaagauguauguuuuguuuagcucuugcggagaaauucugauacgcaucucucuucccaguuauuucaggccuaagcuuacagugucaugugaagaaaaaagaaaagauugcacagauaugcuagaauacaaaaggcucuuggagaaaaugggcagggguguucaguuguuccaguguuuccucauccuccccugcccccuauucgaggggggaaagguuagauuuagaacuaagcgugugggaagaguaaguaguugauaaaacagaagaacacaucugauguuacuaaaaugcacaucucuugguuguggaggggaauuucuuguuugcgaccuuggagaagaaucuuaagacaaaucaaaaguuuuuauuuuucccuagaguuagaggauuaugcagcccuaaugugcaaucguguccagcggauaaauagcauuaaaaaaaacuccucagauaugggacauuguagugauugucacaauucacaaguguuauccugauauuuucagacucagguauucugagccugccuaugaaauggaguuaggaacaaaugacagagaaggggguaacaggaggggcaaggcagggucugcccacccuccucuacuucgugcacacuuucuucuuuccaaggagaaagaguuagguugcacauucauuguuuguugguccuaucucuuguggauugggacacagauaugccccaugggcaacagagaccuacauugcuuuaaaagaggccacagggauuuauucuacccggacaaaauuuaauggcuugauauuuucagguugaauuaauaaaguuaucgccuagagccuuucaaaccagaaaaauuuauguaguguauuuauuugugccauucaaagaaggagaaacgaggauagaauuuucuaaacuuuccaaauauaaaaacucuaggcuguggauaacaggaggcauagcauuuugaugccacuccucccccugccccccccacccccucugccagaaaguuugaagauagagcuaaaaacauguuuuucuaaaaaggucugcucaacuauuacuguaucuucauuacauccuuucuguguauguguguguguguauauauauauauauauacacacacacacauacacacuuucuauugaguuucaaguugcaaagaaugacuuuugugaaauuuaggaaagugguauuauggcuaaggaauaaauauaaauauguuguucuugccaacuggaaauaucauacucaaaauuuuagcaaauuuaauagcaaaaugaugcuuuucuucuuugauucuaaaguagaaaaaauacauggacagcuacuauauuauaguucuguauauucaagagcuguaaauuugauaagguaaucuguuuuuucuguuauucuucacuuggcaauuagauuuaagaagcagaaucuaguuucuugauaaaagucauuauguaaaaccuacgaauacauucauauucugaauauuagggucaucuuguaaaaacugaaaaacugucuuagaaaaucacgguuauuuuuguuagcauuugcuuuuagcuuuuccucucccacccacgccuucuaguuucagauaaacgguaaacuacugucugcauuucaaaaagugagauaaacuaucccaauccuuuaaaaaagguuacauauuauaaauaacacugaauaauagcugucuuuuugaaauuagacuuuuuuuugaauaaaucacaaagaccccuuggacagagaagugaauuuuuaacacauaaucucuaaauacucguaaugcaaaaguagaaaugucuguaaaguaaauagacuaaauuugaauaauauaaccucacauaaaaauacacaaucuggaaucaggaucaguugagaaaagcuguaaaauugcuguacauagguauggaauuuuaaaaaacaguuauugguaccagucaaaauuauugcuaaacuaaaauuauaugaaaaaaacauaauuagcauuauuauaagcauaaagcauguuacauguuaauggucauugaaggaaaacucucuaaaaguacagaacucauuaacuacauucuuaguuuggcuacauuuuuauucgagcauggucauuuucaaaagaaauuacaaauugaaaauucaauaauacuuuuacaaagacaauucaggaaagauuuuugucaugguaucauacauuguauuuaacagucccucuuuuuagcuaaaaaacaagaugaagaaaguggaauuuucagucgaaaauacaguguuuucacaagaucguaucaaaaguucccaaauuuggaauuuccaguaauuggaaaaaaacaaaaauaaaauaauaaaauugaaaaaucccaucucacaauuaauguuccaaaacacaauaaaugcucuucucuuuacguaaaauuugcccaaaugaucaacgucauguuccuuuuuuacuaaaauauaucuauauauugaagaacuauaauacuguacacuacaguaugaaauaaauaaaauuaggaaauauaaaaugagccacauaaauaaaauguuauuugaccuaaaauuaaaugaaugcaaaaaaaauuuuuuuguugcaaaaacaguuugguguaauacugacaaaauuaaugaacaaaaaaguacagaaaauaauugcacaaacauauguaaacuaaggaacugcugccuauucuucuaauacugacaugggugcuucaaagaacagggugagcuuaacacugaagcuggugcaaagguaacccauguuacccucuuaacacuguacaaggauggcacuugcagaaacacagauuaaaagguuugcauauaaggcuuuuaaaaccaccuuacaaaggcuuucuuuauuucucaucuuacuuuuuccuucacguccaggucacuuuaagacuucgguaucuuaaauucacacaugcaucacuucaaguuccuucacagaaaaaaaaaaaaauugaggccuaaaauugugugguuacuuaagcugaaaaaaaaaaugggaaauugaugaauagcgaaaggaaaguacagaggaaucauaauacugaugcauuguagugcgagcacauuaaauuaaaaaggaauaacaauaauaauaauaaaaauacugauguaugguagugcgggcaccuuuuuaaaauguauuaauauaaauuagacauaguuuuuuaaaguuuguagugauacauaaguagagugcaauucuuacaauuuucuaguugugcuuaaaguauaaaugcuauuaaacacaggaauuagucucugaaccacacaguuuuuaggccuuaacacuguacaaaauuuuugcauaaugcaguuuuuaacaauacccagcuccaacuccgucuacaucugucuuggcugaaccgccccuucugucccucucuacagcuuccuggaagcgucaggcacgugcaugaacagcuuaacacagcaguguuuucaagcagguaacaauacuacuggaaaaaaaaauaggaagcuuaaaaugcaguaguuuauuacaugccaucuuccauauugucuuccucguggucugauuugguuuccauuuucccauccuccgaacuaucguccauggagugaucuccagucucuucuucaucucguaucguuucgggauccguauccauacuuuuauuuucacuuucuuccucuuccuccucgaacuccucgucgccauccugucugcccagcuucccguagccauccucgccuucuuucucgugcuccuucucgcucucgccaucccucggcauacucucccucuccuccgagucagaguaccccugagggguaaugcucugcaaguaagcccgguucaucagcagcucgguggguuccaagugcccuuucucgcgcgccucgcgcuccgccgcuucccgcuccuccgccucccgcuugcaguaggaauaccugugauucaugugcugcgaguacgagcccgagugugagaagcgcuugccacauuuaucacacugauagggcuucucgcccgagugaagccuugagugcucgauaagguggugcuuguguuuaaacgcuuucuuacaaaucugacacugauguggucuuuuuccugggagaaagaacaagaugacagggugauuagugucuuugcaugaagucucuuuccacuaauucuguacgcgaguccagacucaggcauaagcguguguacuuaugccugaaagaucaacacaccccggucuaaucgauggagaguuaggaagaugcauuuccaucccacaauuugguuuucuaaugcuugcugaugcaauguaguuaauaaacaagaagaacuuagaaagcugcuggaggaaaauucucagacaggaagcuuuccauugcuaauugucucauuuuaaaacuuggaaaaauguucuauucaacaagacauuucuagugaucuagcacauguuuucaucagguaauucucuuccuuacauuuuuaaaacaaagacuuguacaaaagugauaaagauggcaucaucgcuggcauuggcauguauauccucugcuuguuauaucaugagauaguugcuuugaaaggggaucuuaggucuuaaaugggagcaaacugccaaguuaggagggaguggaagaaacagaggaaagaggaugucaagacugucuuaucagucauaggagucuaagaauaaaaaucagagaagaaaccauuagaaaauacaaauuaggaggguguauaucauggaggcugaacugauuccaaauaguguuuucccucuaaaguuuuccauaagaugucagccacuuguugaguguuaaaauacucuucagcuagggaaugcuguauuuccuuuggcauuccaggcaguuucuaaccaguguuuggaacuuaaagccagugccaagccuaaacacaucugguugauuccaggccacaaauagcacuggaaugccuucaacaccuuccauagcugccauacuugaaaguuuauuuccaaaauagaacugauaaaaaaaaauuaucagccugaugcuccagaguuaaagucagaaaugugucauguagagugccauggaucacuguaacauauaugaaguuguaugcuuuauuuccuaauacaaacuugcauuucagcaaauuaaauuaaaacccaacaaaguagauccaaucccauuuucguuugcuaagugucauguuauaaguuuagggacccauucuauacacuuuagguauucaguuauauggugauauaaaaucucaaucaguaauuaaauaucuuuaauaauguuauugaaugccuccagggcaugccacuauucggaaagugcuguagacugcuauaugucauuucauuaauggucuuuauuuaacuggaauguccacuagaaauuuagugaugauaaauguaguaagguauaauauuagaguagaaagaaguuauuuaacuggaagaguggaaaucagaaagauauuuguuggugacuacuaguuauaugggaaauaaagacaguucuaauaaccuacuucaagguagcucauacucugaagaaagcaaguauaauucaaaccacacaagaaccauuccuuaacuuuuggaaaagauguuuugaaugagguaaacuggauaacagagaaucccaauggagugccaagagucugcaaagauagcaugcuuuuccauuuggaaagacaccgugguaggaagguaauuuaagaggaagcagacguguauuugggaaaaagacaagagguuuugucucccgggaaacuucaugucauuauguuaugaauuuggucucacuuguguggacuuggaccuuaaaggaaaggaugcugucaggagaaaggauaagacguuucuagucgcagcaauucauccauaggggcaguguuaaaugaauaugauuaucuggguucacauccaucauuuaugacaggcugugcauucucaggcauguuaacuucucucaggaucaguagguaaaaggaagaucauuuggggaccuaacucauggacugggcauaaagaauaaggaagacaacuuauauaaagcauuuaguacaaggauugcacauaguaggcagucaguuaauguuagaucauguuauucuuauucauuaauacauguucaauaauuucucaaguucuaaguaggacgcaugcagcaggagcagaguacauggaaguaauaaaucugaauagagagaagagaaauuauagaugaaaauuuucuugaugcucuaguugcuacggcguguaugggcaaacuguccuacaaccucuuuuggauacuaaugucucauuagcucaggagcacaaaaaggucaacuacuuagguaacuucuggaagagacuguaugaauaauuuugaaugaacauuaugauauggcuuucuuuuccaaagcaacaaaacacagagcaguguccagagagagcaagcauccucuguuauagguuucaaggcccguuagcaaugcuucgggcaugcccacuaaacugcagucugucuuagagauaugccuugguuauagacauucaauuuucagagaacucauucgauaauaaacaguaugcuuauaauacgcauauauuaauccugcauuaugaauugacaaccugaaaaaauaaaauguucaguuaugauaccaugcaaaggauagaaucugggagcaggugagaguuuugacauauaccuuacacuaaauagucuacugaucuccagaaguuucagugguaagcauuuaauaaauucaauuuaaauaguaacugacuuggacauucaucucuuuuuaacuuguuuugcugguuuaccugauucaaaucaagauguccuagaauuaaauuuccacaugaccaagauucagaacauccaaauugauacugagugaaucaagcuuucuuaggguaaauauuuucucuaauaucuagauuugugauucaccugacagcuagaaugguaacugaacuuaauaauaaaugaaagguuugugguaugaaaaaaauuaccauauaacugagaaacaagauugacugguaaauuuauuuaaaacuuagacuuaucuacucaaaaguagaaacauuuguauuacuuuucuaaauaagguggguuucaaaagcaccuaccaugaugucucaacagagaaagcacucaauaaaggucagauuuaaauuuuagaauacaaaugaguucuugacagugccuaacaggaguuucagaguuuuuaauuucacaguccuuguuugugacaauuaauucuguugaagucaacauuuacauaguguuucccuccucugucccagucccaggucccaggaaaagcaagcaagcaauaagccauugguaagaaaaaugaagcaugaugacuuugguaucugccuaggaaauaaauugaggcaaaaaaagcacugggucucaagaauaaguagcucauaauuuccuucuuaaguuaaacgauucuauauguaaaauuguagacagacaucacaaacacacuuuaccaaggacacauucauaaucaaugcauaaugaaaugaugauucaauuuuauuucccgaccuuagaaucagucagucccaagacaguucucacuuauaauuuucaucuuagugcauucucaaaauauuacuagugcuuaauguaaacaaaugaaaggcuagugggauaggaacuaucccacagguucaauugggauaggaacauggacuaaauuuccacauacaucacaucaauagaaaauccaugaagaacuugauuugaauagaaccuaauacacugacaguaguaaugucaugagauguuuggucaagugaccaaaaaguuaacaugcuggaaacuugacaaguuggaaagccaacaggaagauaauuaaucacaaguuuagagcaaccauugaaugauuagcaucuuguugcuaggcaauguuucgaggcagcagcucucacaucuugaaggagcagaauaguuuauuuuuacuuuaaaaaacaaaguuuguuuguuuauuuauuuauuuauuuauuugagauggagucucacacugucggccaggcuggagugcaguggccuuaucuuggcucacugcaaccuccgccucccggguucaagugauucuccugccuuagccucccaaguagcugggauuacaggcaugcaccaccacacccagcuaauuuuguauuuuuaguagagacgggguuucuccauguuggucaggcuggucuugaacucccgcucucaggugauccaccugccucugccuccaaaagugcugggauuauaggcaugagccaccgcaucaggccugaaguuuauuuuucaaauaaauuaugcauauuuguguuugucaacuuuugggccucucaacuaucuacagaccuaugaagguuacaauucucuaauuuauaagaaguaaauauauugacuggaugucaauguguaugacagcccucacuaaaauaaaaguuguacacucaccguguaguaaaugauagaguuugcauauggucauauaauaaaaccaaucagagagggaaagaugccuucagugaugugccuauuguagcugaauaauggaauacaaaauauauuuaagguugauuaaaauauuaaaauuaaaguaaaauuuagguaugaaaauaucuuuacuuuguaaaugcuuaaguagcacuuaguacuaaagaaaauaucuacacuaaaagaaaauuuugauguuucaaacauugaauuauauaacacaaguauaaaagcuguuuggauuuagauuggguugucuuuaagguaucauuaaacuuuuaaaauaauaacaaugaauaucagacagcuaaagaaaaagaaaacuguauugguuggaguaagaacccuguuauuuaucaaccuuguugcuucacaaaaacccuccccacacuaucaggcugaugcuggucacuugagcugccuccagcaugugcccagugaggaauaauagccgaugaugaguacgaguacuucccaaggacaguuuucagugacagaaaagagugccuuguaucuagguagucaaaauaugacaggaaguauucaccuucccuucgcuuuuuuuuuuuuuuuuuuuuuuuugagauagggucucacucuguugcucaggcugaggugcaguggcacaaucauggcucacugcagcaucgaccucuugggcucaagccauccuccuaccucagccucccaaguagcugggacuacaggcuugagcuaccacauccagcuaauuuuuaaaaaauauuuuguagagucaaggucucacuauguugugcaggcuggucucaaacucuugggcucaagcagucuuccugccuuggucuuucaaagugcugggauuacaggcgugagcugcugcgccuggcucauauucccuuuucugucuuccuucuuuuucuuuugugccucaucaucgcuuuucccccaaaaagcuuuccccccaaagugcuaguuuuuuuuccuccauauugaaauguuugauacuagacuuccugguuuagaaugaguuguuuuccuauacuccccuauuuuuuuuguucccucgugccaaaauuuugacugagauccuacacuuuuucccccccgauccagggcuaauagagcaugccaaauuuccaguggagaagaauuggagaugggcuagggguagggaugagguucagcuaccuuauuguucagggagguggggauggagccagggaggaaacacaaguggagcucaaccauagagcugcagaucuuggauugugggaaguaauauuaaauuacauaugguacuucaucuuucuuuucaaaaauuaacccacuaucucucuacucauagugaagaauuaggcuguuuucuugucaacucuuuguaauuguuccuaauuaguaaugcaugaauuggaaauauacuaauuaaaauuuagaaaguuuuauuucaaucuuccaaauauaggugguuucaaguagcucaucugaucuauuacuuuucuuuuaugacacuaaugccuuuaguucuuucaaaauguggcgaauuuaaaaaaaaaaggcaaacaaaauuaccccuaaauuauggcuuucuugguguuuuggaugaugaaacuaauguauuacugucugaauuucuuauuagauuuuuacauauauagguucaucuuaagcuuugaaacuuaagaauuugaagguauuuucaauaacuggcugugucaugccauuucauugcccuggccaucugacugucccuuugacauaauuucuaaauuugguuuacagaauaacuggaaagauauuaagacaagcacacucauaaagacaugaaugauccaauaaacaggcaacaaaaaaguccuacugagcucggcaaaagcauuauuucuuccuuguugaagguaucagcauauguuacaucuuauguugcacaagugugcucauuaaauauuaugaaauguacagcaggacgggaagcucuaaccaguuaggcaaagucacucauaccuguguguucguauuuaugucgcagaagggaacugcuuuucuggaaugucuugucacauaagucacaugcauacaugccacucucugucuucuugaucuuuuugcgagacagacaggagucggagucugucauaucaucuaggccugacauguagucuugugcuccaucaagcaauucucccugcgauagaaucacacaguucaauacaguggcuucucuuugugcucacaccaaacaacuucacauagggggacauuuggagaaccucaaaauugcuugcuacuaauugauugaguuaaacauuuuuuuuuccaugaacaauauaugaggucucaauaugcaguauaugcaacaauauacgcaacaaaaauauaaacuucucugcccuggaagguagaucucacuguuuuuuaaggacaggaaauggucaacucugaaggugagagaaacaaauuuuucuaaaauccuucauuuccuuuauaccaagaaauacccauaagugaaaauuuaacauugaaauuuguguauuuuccaguaugcuuaacuuuagaaaugaucuguagcuguagaaacccgauuuuaauugaauuuuauauuuagguacaaaauguuauuauuaugcaaucuauuuaaauguaugucuaccaacuaaaggccucaagcuauauuuuuauauuuaauuuucuaauuugaaauagggaauauuaauaacacuuuuuaucaauguucuauguuaaaacagccuucagcauugaacauuaaugaauguggaucaguaaauuauuaaauuucuugauauuuauuuugucuugauccaaaggagugcaaacuugcaugauaacauacauuuccauuugcuagcccacaguucaguuuucuuagacuauguuuguacuaauuaauauuagagaagauuaaauaggcuuaaauacauuuacaaagagggcagauguacuguaaauuggaauacuggaacagcuguuacagaggugcacugcuacuuaugcuccuauuuugcaaacaaagauuauaugcugcauaauguuaaaauauaacugcuuuccuauuugauaaagcauaauuauuaacuacuuugaagauuugguaagaagucaugugaaauauggaagauauuuuuaagaauacucuucaaaauaaaccauucucuguaaaacaaauguaccuauuaaaauguguauauacauuauugcaaguugugcacaucuuuauauuuauuuauuuauuuaagacagagucuugcucugucucucaggcuggagugcuguggcacgaucucugcucagugcaaccucagccuccuggguucaagugauucuucugccucagccuuucaaguagcugggauuacaggcacccagcacuacacccagcuaauuuuuguauuuuuaggacagaugguguuuuaccauguuggccaggcuggucucaaacuccugaccucaagugauccacccucguuggccucccaaagugcugggauuacaggcaugagccaucacaccuguccuguguacaucuuuaaaagcacgugacgguuauaaacuuuaacuucuagcaccuagguaaguccuaccaaauauuuucaccaaaguuuaauuuuaaaagcagaugaguccaucuaaauacaucucaaaauaaauauuaauuucuucuuuauccuuuuuguuuuuaaagcaaaugugcuuagaguacagugauccacuguuucauccauuguucuagcccacugaugguuuuagguucauguuaaagcaaacucuucuguuucugcugaguuuuuucacuaagauuuuuuuuuccuacaugcacauaaucaaaauaauugccaccucuuuucuucauagcagaaaaacauuugucucuuuaccugaaauccuuguuuccgcugguacuuucuccuuugcugcauaucagcaaaaguagcugcuccaguuggguagguguaggccauaugugguaggaagcucaucugauccaguccuggguauggucguagcccaggaauacuggucuggacugguggcaugaaaguagcagggggaaaugcgcuuugagguggaagagcuguguauaaagguuuggcacuaaauggguucaugcugaacacuggguuagugcuuuuguuguccagauuauuugaauuugaaaauuccuucuugauaaaagucaaguucagaggcucaucugaguuuucagaugaggaagaaacacuguuaugaucuaaacugaugcuacuagcuuuuguuuuguucuuuguggcuauaauacuuuuggguucuuucauuuguuuugguaaugacaagucuaaaggcucagccuggagcuccucagaagagaagcuguuuggaguguaugaacuacugugggaguuuuuagaagauguggaggaaagauuuaagggagaaggaguauuacuccuggagugguccaauuuuucaacugguuuaauauugguaaaaugggaagguuuuguuagccugagaggaggaucacaauucguaacacuguuguggaguucugcuauagauggugauguuauggaguccauagguuuuacaggagaccuggguaauaaagagucuuuugugggaggguuacuguugggagcuaacggcuuggagcuucuuuccagggauggggaccuggaauuugaguacugguagacuuuucguuguucaaaccauuccuucacaaauuccugaggaaggcccacagcaauggaaauuuucagcaguucaucggaguugggcuccauguucauagcauaguaugcuuugaguacagacaugugguccuuguauggguugauggggcuugucauuccuuucucagaaaguacagaugacaagaggagggcuuuauuaucaacaaaaacuccggcuuuguuggggacuauguuuucaugaggcugcaggaccgccuugaucucuucauucaucuuacaaagguaacguucaugcugaugcaaagggauggggccaggaaaacuuucuuuacagaacuggcaugaaaauggaguggauauguugugguucucaaucauuuugucaucagugaccaaaucuauuaaaguacguagcuucucuuucuuuauauuacugaucugucuccuugagucaguagucaagcucuggaggcaagcuuuggcuucauugacuuuuuccaacguauagucaauaauacuuuuaguggcaccauuaugacucacuaccggaagaccgacaggcggaauauuaggagaaguaacuccuuguuccucagguugagagcauggauccuucaugugauaaccuuucaacuuugaaauuucuucagccuugcaguccauuuuuugccuggaaacaguauuguccacaaucuguagaaccuuuuguaccucacuuaaauuacuauucauggugggaaacccaaguaaaggggcuuccaucccuacaccuaagugcugcauuggacucugagcagauggaugaacuccuaaagggcugguggcuccaagcccaccauucauaaagggacuagugccacuaaacccguguguagccauaagaacuuuauagucauugaagucuagugguucuguuuuaauuuuaaguaagccugucuguucagacauacuaagugguuuuccauucuccaacuuguuucuuaacuggguaauggcugaauuaguaggagaagaagaaacagaauuaggggaagaacccgucuugauauuguuucucauucggccauuuacagagauuaaaccaauacauuucuugcugcugaugugcgaacuguaggaaccagaaugggagaaacguuucuugcaguuugggcacucguaagguuuuucaccuaaaaugauaauuaaaauuaccguuacauuuccuugauuagauaacaauugcaauugucuaccaagagaagaaucugugaaaccaaacaaaaggaacacaaugggguaccucuacauucuagguacuuagauuagaauuaugugaccauaaccauuucugaacuuuaucugcccugggaggacauaauucaagauguucacaguggaagguaagggcuaucuaugccuuuuucagcugagaucccaaaucuugucugccaucggcagccuccuauuuaaacagagugucagacuaauguguggucaauagcacaauaaagaugucacaguauuuaaaggcaaguguagccauggcuuuaauaaacuuuguggagauuccauugauucuaccaauccaacuaguccuuugaauagcauccaacuugguaauaaaaugcuuggcagagcuaucaaacuaguuauaaagaggaaaucucagugguaggauucuguucugugauccacggcccucaggaaucagggaguauuuaucauacauagcucuuauccaaaauucuucacccuuuuuuucauggguaggucucaaaaauuaauaucuuucagaauuugccaguugaguuuccucaggucagaaauauuuauucuggagaagcgguuuuaaaaggacaaaaaggagccucuagauuuuguaauaaaucaaagcauuuguaauuuuuaagacauguaagcauucugcuucuuuuuauaagacagugcuacugguuguaccauaagucucaugaacacaaaucaggcacacagaguugaugaaauaaauagauaguuccaaaaagcuacaaauaggacuguguaaauuuuaaacaaucuuuuaaaacuccccuaauuaaguaaaaugcaaaugcgagcuccagcaccucugcuacucaccacugugaauucgcagguguucuuucagaugguguuuauauuugaaggccuugccacacucugugcauuugaacuugcgauuaccugcuccuuggguuagcauuuggugcuauaaaaggagaaagacugacaucaguuuugugcaggaggaacaaagaaaauuuguuacaaauauuuuuaaaaggccucuguuuuucagacaggccaaaagguuugagugcaugcuuauuuaucugcucagucuuucagaguugcaauaaaagugauaauguugguaauaaaauuggaacaaauaaaaaaaagugcuuucacaugcgcauccaacacuugcuuuagaauuauuucuguagugucuuuuccaaaauguuucuuugaaccuuuggggacgaggaaguauaacuguaaagauauuuguuguuuuucguguuuaccacaaauucuaaaauaugaacauucucugcuagaaugugacaauucugucaagaaaaaaauauuuuccugaaaauucugaauagucucaagaaaaaccacccccacacaacaaaaguuaucaauuuuuuuguaucagcauaaaaguauaucuuauacugaagcaaucuaaaauuuaaaaaagaaaaaaaacccaaucccaaaccaaaaacacacaaacaaaaaaaccuugacuauaaauauuucauuacaugaugagcauguuuaaauauccuauucauugugcuaguagcaaauauaagcccaguuuuuccugaggugucgccuaucagauuugauucauuaucaaacguaagagacaacaucuuggguuauagcugcuugagcaguuuuaucacaggccaguaggaaagacuucaacgacuuuucauuuuccuuuuuaguagugugcuagggaguagggacaaaaaaggaaaaaaaguuuccugaaaagacaaguuaaaagcagcaaagauauaaucaaacacagcugaccuuuuugaacaaggggaaaaaagcagugugacuuagaauucuggaaaaaaaaugcagucauccacucuggaugcucaagguaggaggucagccuuuuucuagcagcaaugacacaaaagccuuuugcaaaaagacagcacagaaacgguaugacaacugcuagggugugcugaaucuucccacauuccuagugagacagaugguguuacaugggacacagggagguuuguucaaacagcagcaaccuucaaagaucaagcagagcccagcccgccgagcgccauugagggaccagcgcucauauguugcugaguugcauaaacaaacagcaacagcugcuuugucuccccccacagcccucagaggacuacuauaaacuuuaguugugccacuguuaauaugauacaaucauuuuaauuuacuaauuguaaaugccaugagcaaaugaggggacuuuucaacaccaaagcuaccauucauaaugcgccaacacaaucacacuucugcaugugaaauuuaaagcgguuaugcuagauaaauaucuaggcacuuuuuuuuuccuugaguuuuugugcauauaagcaaggggagauaaacuguuacauaagugcaacuaugcaagcauauuuuuuauaacucaucuuugaaaagcauucaggugacaagcccaaucagauauaaauggaauaauuuacaugagcuguucuccuaaaauaguaaaauuccauaaucuagucuuaucaccauuauugacuguguuugcuuauccucauuuuccuuauucgaagaaaaugaagguuauaaggaaaaccuaagaauuuugaauacaauaucauguucaauaauuuuaaaaacagacauggugucaagacuuaaauuaagugauuccggaucuguagggccaguuauugugacuuaaggcacaccacuucuguccaugcaaacauaucauaauaucaauuugcagagucaauccucccagugggaaagaggaguuuugauguaacauuuaaggaacacugugaaucaauccuauucaguuguuuuaaagauuuaagaagcuauacuuaacuguugaagacagaguuuuuauuuuugagacaaguaagcaaaaagagggggaguaauuuuaacauuuagcuacaaauauguauauuaagggaucauuuuuaauguacauccaacguuuuaguacuaauccaauuuauuuuauauauuauauauacacagauaauauaugccuuuuugauuuuccuuaaaacacuuaaucagauuucauaaacuaguagcagcuuauaaaaauacucuaaguaauugaagguguuauaugaaaaaugaaagaaauacacacuucuuuuucuaugacuuagauccuauaugaaaagaaaauuucuaaguaaagcgaggugaaaaauggaauuaaaauugcugagauguuuaauaauguauaauuaaaaugcuacaauuucauucacuuuuuguggaacauaaaaaugaaacuaaagucaaguuaaagugcaaauaaaauuucuaaauuagaaauuaacacacucauucgaucgugaacauaagacuauuaaaucauauuagaagagaccaucaaaaaaucauuuagaccucaauuaaagcuauuaccauuaaaagaucugcaucuucaaaaugccaugaaaaauuaauaaugauugccaaucaaagcaauaucguuucucuaagggguuauuauagaaagaaaucacuuaaaaccauccccccaccugaucugucccuggcuugugugucaccauaugccgcucgagcugggugcgguaggcaaacguguagcuacagagagggcaggaaaaguucucuucauucuucucguggcgguacuugaugugcuccuucagugaugucaagcgcuuguagccccggucgcaguaggggcaggucagcaguugggcaaaagcaucuggaguuccagguggcaggucuguagccgagagacagagagagagagaagcgggccaaaaggucaguaaaucaauggcagcuaaugggcugacugcccgggaugguaugacaggaaucacugcaaucugcuccacagagugccaucauugcacccggcccccucgcacaccaguccccucgcaugcccaggacagacuugucggaaucagcucacacugugcucaaaaauuaauuaauuacuucagguuuuuuuuuuuugggggggugggggggacuuaaacagcugauaaaugaggaaauucucuuuaggugacugacaguuccuaugaaaccuguagccacagauuacucaggaacucacagugugaaggggcguuucaggugucgguggagaagaacaaaaggugagggagugucggucucaacuuuuuuuuccucaaaaguaaaauauuucagaaagauaggaauacauuuagauauuuuuaucucuuagaaaugggcucuaauuguucuuguucuuuauuggauguacaaaugacacaaauuugcugacaaaaaaauuucacaauacccuaaaauuacaguucuaaucuuugcucaugaaauuccaugccucugcagcuguucuucaaauuuuaagguaaacacccaggcauguagugcauuuguaauuguaacagcugcagaggucagugcaguggcuaaaaaugauuuacagccucaccauuuucuucuugcccauuggccucuggcgugccaaggcgagacagcuccucaggggcuucuggguaaauaauggcugugucacugcgcugaagguacuccucgaugcugacugcaugaccaucgcguuccuccaguuuucuuuuggcaaaguauuccucaaaaucugaugugcaauuugcauucuucacugaaaucauaaaaggagaagaaauguuguuuccgggccuucuuccuaggaucccaaguccaucuccaucauagccagugagaaaugcugacuugcaauagacuacaaaaccuaguuuauuuguaagaaguguugaagaugaccgauuauugacugaaugcuuauucuugcaauauaugcaagaaggcgggcacuuuccuucaaguuaaauaagcacauuuuauuuuauuuuuucuuccuggaauauuagucuguauauacaaagaaugaaagaaauuuaaaauguuuuucauaaauuuuuuuuaaaaagccaacaacugcauucuaagauccauaaacauuaaagauaauauaagauuaagccuauuuuaauagucuaucugaaauuucauuuucuucuaagaaagguauauuuaauuuuucauuguccacuagacugagcgucccuaaccacagauacauccuguugcuaaauauaaguuuuuaacccuccacccucugaaugucacagacagccaggacuacauagucugagacagaugcaaaaggaaagauauuccuagacagauaauaaugcaacuuuguuaaaaaaaaaaaagcaccagaauguggcauuuuaucuuucccuauaauuuuaaucuuuaguuccguauuuuaaagcugcugaaaauaaaauuaagcucacagcugauagaaauaaaauaaaaaguaacagagggaguuaagaaacuggugugugauuuugaugugacuuuaacuuuuguaauuaugacucuauuccugugaaaugaauaacaguuguaacucaauuuuagcaacuugugucauaagauuuuguauauuugaaaccucuagauguguuucugaaauaagauguggcuuagcuaucauaaauaauauuuuuaugcuaacaaaguugggagaguagcuguuauauuauucuuuauccuaaguaggugaaaaaagugcuuugcugguacaauuaaugguggaauccuauuaucauaguuuuugaaagcaguuaaccuuggugccacgagauucuucaccuugucuucucuaccauaaacaauauuauaguauuugacauacuaauucucuuuggcaacuguggcagggugaugcgcaagcaagcuaggcaauuuuuuuuuuuugcuuucaugauuaugaacuuggauuuuuuaugaggggaauagaaaguggaacuauccauuaauucaacaaguauuuucugaaugccuagugugugauaggcaucauguccugcucuggugagcagaaaacaguucuaggcucauccuucgggaagccaugagagagauuaauacaacugauauuaucuccaaaguaaacacaucauuacaaacucagauaaguauuaugaaagaaaguuauauggugguauaaaaaaaguaacacaggaaccugauggcagcuagaagaucaggaaggucuuaacugaagaagcaugaaguuaacuaaauguagaagcuggagaagagcagcaugugcaauguggugacugaaacaagcaugggacaucucaggauguuaaaaaaaaaggacagugcuggagugcagaggaugaaaggggaaccacgugauguaaggguggagaguaaggcgggagccaggccaugcagcagguaagagcuuguuuaaggauuuggguuuuuacucuaaaagaagcaggaagcuauugaagaguauuaagcaaggaggauggcuggaugaaacuaugauuauuugcauuuuuagaugacauccuuggcuauaguaugauagggauuggagaaagagaaaaguagguccugggaauccgguuaggagguuccuguccuaggccaggcaaaagauacuguuaaggaauugaugauggagaugaaggaagugucuggauuugagaaauaccuaagauccaaaauuccucagauucaucugggaaagaauucaguuugucaaguugggagaugcuaagguaccucccucagguuuauacuuuccaaauuugauggaugguaggugacauucaucaaagcaaagaacacuagaauucuaaaaagacuugaaacuauaaacaaauauaugggaccaaauaaaaggaagugggagaauuacacuauguggaccacuaaacuaagcgccaguaauccugaaugcugugaucucaaaccuuucuuuuuugccucuguaacuucuaauaagguuaacaagaacaacggucuauuccaagaccguauuucccucaaaaauagauuuggaauguacaguaguggauuaagauuuuauaccuugaaauuuugcuuaaaucuguuauuagcuggacuuaauaaagaauaugggcuuuagauaagaucacuuuccccuugcuguaugcacaaugucauggaugcuuuccaauggauacuuauugguggugacugugaugaugucauuucacuugcaucacugagccccuauggaguauguagaaacugucaacuugcauaaaguauuugcucauuguuuuggaucaucaaaauaacaucagaucuaucaaaaaaucaccuuuuacuuuugaugggaagaaaggauaaaaggggcaaaauggcagagccaugaugaaugucuuuugaguaacuucacugauuuuaucagugacugacuucuuuuucaguacuaugacagcacaaaguaacguaauagcuccuuucugaauucguaucuacuugaggguugucaaugguuuauguuaaggguuaagacaugguuuaaguuuuuugagaauauuguccuacuugaugaccuuaguguaaccuaguaaacauagauggauguacauuuaauauccuaauuuuaucuugauauuucagcaacuauuugaaugaucuggcuaucuuugcaugaauuuucauuugcauaugaauguuuccaucagaaauguaaucauaugcaaauucaauuggauuugcauuaauagccuuuuggcuuaaaagggaggaaaauucugauuuuucuggauaggcaaacaaaacugcaucuagauacacuacuguuguuuggagagguaauucaauugcuagaucaaauuuggcuaugcuagauuucuaugucaagugugauggggacaaaauacaucaaaucaugcgcucucuuuaaggauucaucuuugaucaucuuuguauccugggcauugaauauauugccuagaaauuaguaggcucucaagaaucauuuaugggaugaauguggaauaaauuauguccuuaacacuaaucuugguguagaggucuuuugguaaaaggaagcauaaaauaagauaccugcagcugagcuaggaacuuagaccuaauacucaggcaacuguagaauaauuauuugauaaacuguguaguaguggucauaaauacuugaaagaguuugauagggcucagauaaguauucaaaaaggguuucaugaagaugucacucaaucauuuaaauccauuugcuccaucuggauauuucuucaugcuguauagauauucuguuguuuauauaucucacauaccuagggucacuuaagugggcuagaguuaaaccucccagaaacuagguaucaccagcaugaaucuaauguaguuuuuccaugaggugcaauaggugcuaguaauauacaguuuuucugcccaguacuucaacauucaccuuguccuaggaaugcuucuccauuuccugauugccaaggcuuaugguacccaaggagcugcuguguuaccaugugauccugcuccccuagccacaauugaucucuguugcucaggugagccaaucucaguccucucuucuccaggccaacuuguugauugguccaggguagccaauagauccaauuaaauucaauaaaucccuucccuaugauuuuaggacuuuguuccagaaaaagcaucaaggcaguuuuuuuuuucugccaagugacuguagcuauaaaauguggaaugaaggaauuguuauuuuccaucuagaaaaagaagauuuaugaagagagaauaaagcagacauacagagaaaagcagacaagauugcauguucugacaguucauuucuagcucuucucguuccugaggccgaggugcaccuugcagugguucgguugaccaccuuccuuaaauuccgugagccaagaaacuuccuuuucugcuugaagguauguuguguuucagucucuuaaaacuaaaaucacccuaacaguuacaauacuaggacaaaugaugggauucaauuuugguuacucucagaauuguugggaagaaugaaguuuugauuguaucugaaaguuuguauguuuguuuuuagaaagauuaugcaauaauguguacuggacacaggaaugagguacaaaaguagcugaaagguuguagaauucuucacugcauuuuucuaguguaaaaucaaccucauuuuccuucuuucuguaauccucuucacucccuggucucuuuggaagaacugccaaaacacacugacaaaggauauuugcaugguauuuaugaucaaaccauaacaaaaauucacaagaaggcucaaguaauuucuucccauaccuucuccagagauuuugcauuuaguccuaaaauuuacccuaaugucuugcaaauaucucucaaucuucucuaagguuagauaaccuuuucucuauccaaaaaaagaauaucuagcuugggcaacaaaucucgucucuauagaaaguaaaagaauuagccuggcaugguggugcgugccuguggucccugcuacuggggaggcagagguagcagaaacgcuugagcuugggagguugaggcugcagagagcugugaucgcaccacugcauuccagccugagugacaaagugagaccccugucucaaaaaaaccaaaaaaaaguuguuguuuuuuuuuuuuuuuugagacagagucuugcucugucgcccaggcuaaagugcaguagugcaaucucggcucacugccagcuccgucucccagguucacacuauucuccugccucggccuccuguguagcugggacuacaggugccugccaccacgcccggcuaauuuuucguauuuuuaguagagacaggguuucaccguuagccaggauggucucgaucuccugaccucgugauccacccaccucggccucccaaagugcugggauuacaggcgugagccaccgcgcccagccauaaaaaagaauguuaauuaaaaauguuuccucaugaccauguguauuuuaauacuguuagauuguuagggugaauuuucaggucccuuuuugucaggaaagccucaguucucuuggcaauauguuggccacucuuacuaauguugcuuauuaaugacacuuuuauagauaucuuuauggcugcguuagauagauaauugauuuuucagacagauaauaauaaauaucaacauagacuggccuuaaaaauuauugccuaaaauucaagcgauguuaacagaacucuaaauaaaagagaaauauugguccccaaauuagucagcccccauaaucaaguugcuuuagaauacuuucucaaagauacuuaaaagugggcuuugcuuaguguuuacagguaaugaaauauagaccagauacuuauucuuuaucauuuucuguuucccuuuggcauucauuuucuuuauuuguagcaagccuguguucacaguggaagacagguacucuauuaucacugguuuaguguccugcaugcuuuuaauuuucauaaaaaauggaagaaaauugaauauuauguuaagccauuuaaguaaacaucaaaaugaauaaauaauucuuuuuaaaaagaaaauaucuuggaagguacagaggaguugcagcaaguauauguaaaaaacugaguagaaucauccauccauccccuuguuuaauaacuguuuauugagugccuacuagugccaguguucuuggaaaugaggacaugagugguaaauuuuuuuccuacuucugugauucacccguuuggagauauauacacauaaugguugugauucugcaauauacagacaugucuauauauauauauauauauauauauauauauauauauauauauguauaauagggcaucucauauauacacacacacacacacacacacacacgcuuccccaguguaauguaauguauauaacauaaauuauguauuuaucauauaaucuggcuuuugcuuacuucacuaugaaaggcaaagggaccugaagaagcaauuacaaaucuagguaacuguauuuaucaucuuuuugaaaaacagccuuuuuguuaacaucucagaugauaagaaaacacgaaaauuauuuugaauguagucauuuguauugaguuuuuuaguuuaaggaagcacauauucagcauuuguugaggucuauagauucucauggcuacuuuguuuaaaguugacuaauuaauaaauguaagcuuuucaucauuaaaagugcauguaugcguuuuugcagaagguuuccaaaagacauauuggcacuaguuaccuaaaaacaaccgugagggaagaggaugaucuuuuucucauuacacagcuacaugggcggccucgcagagccuccagcugguacagaggcauggauaaagccaggucgucaagagcaacagaaaaguuuucugcucuuccugggaauuaguacagcaucuuggccgcucucuccaccccugcucugaacauggcuuucuccagggaacacauguucagaugccaaugagaguuucucauguaagagagcuucaggagagcgaggugaagaguggacaaggaaugggaaucuguaguagucugcaguaucaaauaucucccuaaacagcaggagaucuuacauuaggggauuuugaauaucaagauguagagacugcuaacacucaacgauuuugauugcuguguauuggcacagaaugauagaguccauuacuuuuuuaaaaauucccaagauaggccgggcacgguggcuuacgccuguaaucccagcacuuugggaggccgaggugggcggaucaccugaggucaggaguucaagaccagccugaccaacauggagaaacaccaucucuacuaaaaauacaaaauuagccgggugugguggcacaugccuauaaucccagcuacuagggaggcugaggcaggagaaucacuugaaccugggaggcggagguugcggugagccgagaucgugccacugcacuccagccugggcaacaagagugaaacuccaucucacacacacaaagaaaaauucccaauauagacaauaugcacuugucuuucacauuacuguguaaccuaaaaauuuggaauuggcauauuaccaaaaagauagacuaguuuauuauaauuuagaggaguugaugaaguaaggugauuuugcccagcaauucaaugcucuuuucuuaugcuuuauguagagacacgugaaaccuaagaaugcucaggacagucagugauuuucaaaagucaguggcauccguaucaucugggagcuugcuugaaaugcaaauuauuggggcccauccaaaccuauggaaccagcaaucuguguuuuaacaagucuuucacgaaauucugacccuuguccaauuuaagaacucuacaaauucaauccucugccucgcauggcuaaaugagacauucauaacaugauuuuggagagaagcacaauuggucccauauuauuauuauuagguagcuuuccugacuaucucagccugaguucacauagacuuccuucuucacuuacugaaugucaucugugugucucaaucauugaauugaucacaucccaucguaaucuuucucuuacgugucugugagcugauaaaagaaugaaccauauguuauucagcuuugugucaccagcaccuagcauagugccugggucacaguuauuaugcaauaauugaaugauuaggcaagguucaggguccuuggacuccucauuuuggcucaguuauuucauguuuuugaauuucaauuuccucaucuguaaaaugagccagggugugcuuucugggguguccucaaaguuccagaauuccauaauuucaauuaauuaauuacuuuaaucaguuugcuuuuucuuuacuggcuaggccuagagaauuuuaucuguauucuuuucaauuaaaaacucaaaacaacacagcuuucugauggggaaaacaaacaugcagauuaagagaaaauauuuuggaagugccuggaaaccccagacaacaucacaagcaaaacagcgcuuauuaaauauuuguugaaugaaugaaggaggcacucaagaagcuugaaauaucaguuauuucuugugggaacacuugcugugaagugaagauagcugcuccuaaucgcaaacaaagcuaauaaaacaacagcauucauuagccaggaagugaacaggcucuucuuggcguucacugauuauagucugaaaaucaucccccgucucaccugccaagcacuacuucuauuuuucucuccuccaaaccuaucucuuucuccaccuuauuuuuaaaaacucaauguaugaaguuaacuaagaaauuaaaaaauaaugacuucccugacagaugucugacuggcagacaaaacucuuccaaccuauaaaaaugugauagauacaaccaagaagaauaugacauacuuuguaauaguaugauucccuccuuguuaaguauuuagguacuaacugaauuaucugauaaacugauuuuguacaauugauuaacauuauauauccacucaacucuugcagagaaauacguuauaaucaaacuuguaucgcuucuguuacugauauaagaaagcuaacuaauuuaaaaguuuuaauuuaagcuccauguuaagaggaacaggagaaauugagaguuauuaaaccaagaggauagugaaaguaaaaaaaguucuucuuucccccacuuuccccuaugcuaacgaugcgaugcacagaauugaugguuaaagagacuuaauugcuggcuaggcugccaaccuuauacuaauauuaucaguuuaggggaguuacaccuggcaccacuguauuucuugcugaggcaagauuuucagucuagaucuggaucuuuacuugggguucaauugcucuggagacacccaaagaaggauccuguaaacuuagaccuaacuggcauuucuguucaauacuugaagcagugccucucugauuccaccacuucccauccuagcuuguacucugcuauucuucucauguauuuugugagacaugaacaggacuggcuauaugguugguggggcccaguguaaaaugaaaauguugggccccucauucaaaaauugucaagagcuucaagacagcaacugcagagccaaccaagcagcccuucucagugcugggcccugugcgacugugcaggucccagacccaggaagcuggcccuguguauguuaucgugaggcagggcccccgagagccucccaucccaugacggcuagugcgguccaguaauuuuuuuguucaugcuuccaguaaaauuucauuagaagaaagggcagggugggguggaguucaaaauuucuagccugauuuccucauuuaacagauguuacaacuaagguacagugagguuagugauucauacaaaguugcacaaguaauuucuggaagagcuguauguaggauuuauguauccugacucuucacccacugcucuuucuacugcaccauaaugacucaacaugagagaaagaggcaagaaaagagagaaccucaucuuuuuaguuuuucaucaugccugacuugguaccauuugaacaggcccuacauacugaaacgaucacaaugacauuauaagcaauucuaaauagcaacauuauuacaccauacaaugaauauggggggaagucaguuaaaaugcccacuucagaguguauguguguguguguguguguuuguauauguguguguagaaaauuuuuacuuuuuuucuuuuuuuuuuuuaaauguccccauuccucugaauccuagacacuuguuuuauucuuacauuuuuuuuuuuaacuggguaauccagagcugggucuaguggggcaaagagaacacauaaaaguuuuucaaauucucuguucaagaugcuuauuuaaaauuuccauuuaauauuuaaggauuguauuuccuaauuugacuguuucuaauuuguaaucaaguuucuaaaggcgcucaauaaagaauaacuuuccauagcaccuugcaaaggugaauuuuuauuagguauuauuuuaacaucuguuaaaauagcagguauuaguuauuaguuagcagauauuagauauuuugugguuauaguaaacaagaaaugccucaagcuuaacuuuggacuagaaaccaaaaaagaacuuuauucccgguucauuuugcuuucccauuucacauauuacucguuauuuuccucccaugcuuaauuauauccuccuacauguguuccacuucuucagacuaaaugaaacugugucauccccugauaauaacccaucccuuacagaccuuuuccacagggccauuccugcuuucauuuguuaugacucacagaacaaagaggaagggucaacaaacuccuuaauucacgcuacugcuuccaaucaauguuccuguuucgucaacucacucaucauuuauuucuuuguuuauuuauucauuaauucaacaaauacccugguuaugaaccauuaacacuguauaaaccacugcauccucugagagggauuauggagaagagcagaccuaaccucuacccucaaauuguuuccacucuguagcuguaaugguuugaagucgaagucgaaagucauccauuuucaccgucauguuuuaggacauugccuguauacugcaagcaaaaugacgccugucccaugauuacauuucccacaggaugccauugcauucugggaaacuucaucacuuaauagauaguccaugcagaaccuggcuucacagugcuuaggcuuucucuaauccagcaacauggauggccacacuugcuccugggcuaacccugggacaagaaccagaaccgcgaacuuucgcucucugauuucuacuuucuccccuugccuaucauccaguuucucauucccuugaaacguguacuucaaugugacaaucaggcccugaaaaguuuccuagucccuuuuacccauucugauuuuauuuaccucaguucaccuuggaacuugaaaucaucacuuccaucucugucccuuacacuuguaucauucuuacccugcugaacuacgauccaguccaauuucuggaguaucaaacguaucuuaaaaaaaucuuaaauaauaguauagucuuguugcagacuauguuuucaaaaugggauauuccuuccuaauaauugaaucuccacgcauuguccacagcaauuauucuacauguccaugucucaagauuccaacuguauuccuauucccuuacugcugacugauagucucuuuuuccuauugacuucaaagagugcaacccauacaguguguauuccuuggaucaucuuaaauugacuacauucucuccuaucaucauucugucuucuucuucugaucuuacugcuaaaaaauaaacauuauuguggcuaucaucuaaaauuauucucuuacaacucguuugauaacccacuccaucuuucacccagucuccuuuuacauuucagccuuucucucuuucucucuugugcacagaggcauacccagcaagucuuugucuugaagaaagucuucccugaaauuugcaauuucuuuaaggcaccucucuuguccuaucuccaauauuugacccuauacugucagaaacccucuacaauacugaacacuuugcauuugaacuuacauagcuugcuguauuucaaauaaaacgucuuaauccagaugauauuauaaucaauaauaauggcuagaaaugauagcgcauuuauuaugcgcuaacguugcacuaaauauuuuacaugcauuucguauucgucuaccacuguuuuauucacccggaugaauguagguccuuaaugacagugacucuucuuuucucacuguaucuuuugugaugacuaacaaaaugccuugcacuuaguagggucccaauaagugaccauugaguugaauaacuaaugaggcuauaauuauuuauuuguaaauuuucucuucuugucauuaugauuuuuuuuuaucaacaccccuaaaauuuuauguugcuuaguggaaggaacucacccuucuauuuccuuaaaguuuccucaagccucaguucaaauucuacauacaacaaacacucugaauguauguauuuuagugguuguuaacaaugggcaaaugcuucguuuuuguuuauugguuguuauccaggguaagaagaaaaaaauauauaugauuuuucuccacuuccaugagaacagcuuuuuagauuccacauaugagugaggucaagugauauuuauguuucugugcuuggcuuauuucacucagcauaauguccuccagguuuauccauguugcugcaaaugacaugauuucauuauuuuuuauggcuaaauaguauuccauuggguauauauaccauucauuauccauucaucuguugauggacauuuaggcugauuccagaagaugaggagaguagggggaagggugaacaaugagagauuucucaauggguacaaaacuacaguuagauaggagaaauaguuauguuggucuauuaugugacuggagcucacaaaaauguagugcauauuucagaauagcuagaacggggguucucgaauguccuuaucacaaagaaaugauaaauguuuaaggagauggauaugcuaaucaccuugauuugaucauuaauuuauacauguaucaaaacaucauguugcaccucacgaauauuaauauguaaaauuguuaugugucaauaauaaauuuuuaaaaagaauacgauuccugaugugagucaguugucaaagaaaggaaaagucugacagcuuucaucauuauuauacguaaucauuauaaauacuacuaaauccuccuccuacacaguuaaagaagggaugcuacauaaaaaugaaaucagauauaaaacgaaacuaguucuuaaccuucauauuuuagccucaaaugccagaguacugaaaauaauguguccuacaacuugucuguguaguuuuccagaaugucaaaagaacuuaaaugucaaagccucucaaaauugguuaguucuuucauuacaaauuuguuaaaauuguauuuuuguuuccuagagaaaaaguuaaggaggaaccaguaugaauggagaaaaccguuuacgauguauucauuucuuaaugaacaaaaauaguuugaaguuggccaggccugguggcucaugccuguaaucccagcacuuugggaggcugaggcggggggacaccugaggucaggaguucaagaucagccuggccaacaugacaaaaccccaucucuacuaaaaguacaaaaauuagccgggcgugguggcgcaugccuguaaucccagcuacucaggaggcugaggcaggagaauugcuugaacccaggaggcggagguugcagugagccgaaauugcaccauugcacuccagcccgggcaaaaagagcgagacuccaucucaaaaaaaaacaaacaaacaaaaaaaaaaaaaaacuggcaaaacaaaacagggugagcaucuagucuauguuaguuguuguacugggugcuuuaaaaauggcaugccaugagaaugacacaauggacuuuggggaaauggugggagggugaugagggaaaaaaaacuacacauugggcacgguguacacugcuugggugaugggugcgccaaaaccucagaaaucacuacuaaagagcuuauucauguaaccaaacaucaccuguuccccaaaaccuauugaaauaaaaaaagaaagaaaauaaaaauaaaguuaaaaaauaaauaaauaaaaaugucaugccauuuaaucccuacagcgaggccuuguacauaaggaaucaugauuuccacuuuaccgauguagaaaugaaggcuuaucaauuacacacucaaguuaauguaacuaguaauugguagagauaaaauucaaguguagguaauuggucucuagaaucuggagccucccaaaacaauugccucucauaugugaaauaauuuauguauuauucuuagaauacuggaaacaaguuugacuauaguuagagucuauaaaguuaguucuuagacaagaaauuuauuguguuguguaagauuaagaacugaugccuaaauuggccuugcccaguuucuggauguaagguaccucuucccccucuuagcaaaggaagcgcagaugcaggugguuauuaauagcccuuuauaacuagagguacuagauugucugaguaaauauaacuuucacacauucaaagaguaaaacaucagggcccuauuuggauauugauaugcacguggaacugcauuaaugcuaaugaucaccaugcaccuaagauagcuccuuguuacuacuagcacguaggcaaacucauguguauaaugcuuccaaguuuuuccauuucucuacucuucuuagaaaaugguucauucacacacuuaaaaauuuuaccuaauaauuucauuuugaauuuaaauccuauuaauaucugaaaguuguaaggcucuuuguuagaagauauucuuuaucuuacgugugaaagcauuacaauuuuguuccuuuuuuaaaaaaaaauaaaaacuggugaacuuaugcaauguggaaaguuauuaauauaaauccagguuugcacuguuuuauguguuauagaucaauuuugccauucaguuaaucuaacuuuguuguuaaaaaaaaaauguagugauacucuaggcuauucuucuuugccuuuaacaaggcaaaauccuucagggacuuagauccuaguuucacucucugaagauacuuagucuccuccacagagaauguuuuccccuacuguggcuuccuuuaucagaauccauuucuucuccaccaaauauucauucauugauucauucauucauuucaccaguuguaauaucugccaugugugcucccugcuauaacugggcuuguugaggcaaauggaauaguccuuuccuuagggcaaacauuuuuuuagucacuuacuaauaucgacauauacauucugauuauuacuauuuuugagauagggucuugcucugucacccaggcuggagugcaguggauuauggcucacuguagccuccaacuccuggacugaagccauccuccagccucgaccuccugaguagcugagauuaugggccagaccaccacaacuggcuucauuauuuauuuaauuaccucaguaauuauuuauuuaauuacuggcuagagaacaaggucagccaaugagguagauaccaggaugauccacccucauuuuucagcugaagaaaccucuugucuucaugaaauugacuacaugaaauaagggcaaacaauauaaggaggaacgaugaaacaugcugaaguuagccacauacaccuuaggguugugggauuucagaaccccacaaggguucugaagagauugcugucguuugggguguucagagaugaccacauuaaggaaaugggaugugaccuggacuugaagaacagaaggauggggagaauuuggaugacuggaagaaaggagcugggggauuagggucugaagggauagcaugggcagagauucagagguugguauaaaugugguucuuuuuuguugucaccaagggauuuggucugacaagaauggagcgccauugguauacaauggauggcacuuauuaucggacugaagaacguccuguaggugcuaaggggcaauucaggauucuaagaagggaauuuggacauugaggaaacuguuauaggaaagaugugggcugacuaaauagaggaggacaugagggacagagaacagucaaauauaacuaaggcuuucaaguuuggaugacuggaauaauggagagaugaaaaugucugguugguuacuucaggccagggcucaaaaauauguuaaccugaaaauacaaaagggaaguccaagugcuguuugucucccauucacucgcucauuucuucagacacacuuugugauggagaccauuccaggauccauggcgauaaagcagcccaaaccccacaggcucauuggagggagacauucuaguguggaauggcuagagaagaaauucagccaauagcaggagcuugaugagcaagacuugggagcagaggaagauagucuuuuagaugcaauuucaaccagaaaagauguauuauuucuaaaaccacauguauuuagcauccaaagagaugucagggagaagaagugguaaacuuguagcuaggaagaaagaauauguacuuauucucucaaagggcagaguuguaagcugaagaucacuaguaaauuucuaauuaacuaaguccaguguauuugcucagcuuucuuucaaggguaguuauuugaagcuuuuaacugaguucucaccuuuacgaaauucucuuucuuugcuucugaauguuuaauuuuuuucucuugugucauaaucuuuuuuuuuuuuuuucaaaagaaaaucuuuguugauuuuccuccccacccaccaggagcccuggccucagcuuucuacuugcuucaacaaauacacucaguuguaaaucucauaguccugugugaucuugaacaugaucugaguauauuugcauaacucucaaaucucuaucuccagcccugacuucuuggguuucaauuccucauuuccaaaggacauuccuauauucccauaucuauauaucuuuuauaugaaaauacuugugucuaaaggcugguucaagaucuucucaaaauuagauccuucuucuguaaaucuagaaauagcaaguacugcuauaugcuaaacaugcagaucuguaauuuugaagccauuuugccuccaucauucagagaaucaauuguuuguuaagaagucauguugcuaauuucaucacugucuccaccuuaggacaagauuuuuaucacuucacaccuggauaacuacagugacuuccaguuggucucucagagucugguuuucacccacagaaaucaugguagcauaacaugacccagacucuucugucuggugcuuuauauucuccaccaucuggcuuuaacuuaaauguccagcuuuauuucccagaaauugccuccuaggacucucugauucagccaaaacccuuuacucacuauccucugaauagaugucacacuuucccuucuuggcucacagacuccucuucaauuagaaagcccuuccucacuccuccaugacuauugaaaauguauuuaguucgaauucuaccuccuucacaaaaccugaugugaaugcccauuccauagacucucucucacuucuguaauucaaauaauuauaggccaggcgcaguggcacaugccuguaaucccggcacuucgggaggccgaggugggaggaucaccugaggucaugaguucgagaccagccuggccaacauggugaaaccccgucucuacuagaaauacaaaaauuagccgggcaugguggugcaugccugaaaucccagcuacuagggaggcugaggcaggagaaucgcuugaaccugggagggagagguugcagugagccgagauugcaccacugcacuccagccugggugacaaagugacacucuugucucaaacaaaacaaaacaaaucaaaacaaaacaacaaaaaacuaaauaauuauggcuccuaccauuuguugcagguuuaucacauauuuucacuuauucuucaucauuauuuuuucagguguauuagucucaucuuccaaaugaaaugauaaccauguuuuagucuuccugacccaucuucuaccacauaugcacacagcagugacuauauagaacacacucaaugaacacuuauugauuuauuuauugacugaauacauaugaacuacaagguacagcagguauuaugagaaaaaagggguguuuaaagccuggugaaaagacauucaagauugauuuuuaaaccuucugaauagaagcaauuuuuauuaaccucacuuuaaacucuagguguauacaacagcuaguaaauuguuacuuugugggguaaauuuucuuuugugacacuuuaagugcuuauaaggguaaucaaaaucagcuuuuauuuaugcuggaggcugaaauuuaacauuuaucuuuaaaaggaacuugaagccauuuuugaucccaugaguugggacauuauagaaaguaucuaauucaugauaucgcuuuauuuuuguuuuaauaugaaguuauuuuaucuuguuucuauuuuuacauggugauaauacccaugcaacauaaaauauuaaaacuagaaguauuauuaucaagaaacuaguugaaucuauucguuuugcaguugugggaacugaguuccaaagaggaaaacugacuugcccaaggguuacaaucuagucauugucagggcuguguguaaaaauuaggauucuuggugcuugauucuauacuuuuucuagaaucaucuauuguacagcuuuauuuuuauaccuuaaauugacauuauucgaaugaauagaaugacaauagguuuuuauuauuucucuuauuuuauacccaggaaagugaauucaugcuuuuaaguuauuaauaagcacauuuuaaacagaaacacaacaugagcagucuaucaugauguguaucaacauaagggugauguaaaaucaucuuaguuuuuuacauuucauaaaacuucaaguuauuuuucauggaugaguugaguagaaguaguuacauuuuuuuuuuguuuuauuuuggaagauaauuuuaugguggacacuaugcuaauauuugugaugguaguguagaggacuguuugcaacaccccuccccuccacaaaauaaauagucucaucuaggaaaagagagauggaacauguaaauuuguguuggugauguaagaaugugagagaagaugccauucaguguuugggaaaaaacauggaauaucacaguuguccugaaacuccauucuauugcaguagcagaguaaaacaaaacaccacucaguaucuucccacuguaauuuuuuagcuucauuaaaaauaaguaaacuugucaauucuucucuaaaacugccuggaaaaaauuauuuaaaagggcucaaggaugcagagaauuacaaguaaagaaaggauuaaaaggaacugagaugauuaauuauugagagaaauguucguggaaauuugucuuucugaaaaaaaaauuuuacagucuaaauuacaccuuaucauuugaauucucaacgacugauaucaagugguggcuagcagagguauaucauauccuaauuuuaaaauaauuuuuugcagucuuuuaaaauaaaaguuacuacuagaaauucacccaacucaugcacugaaaggauccauucauagaguucaguauucuugagcgucacagguaaauuaggggugugagaaugaaagauguauuugcuuaguaaaauaccaaaauguaggaaauuuugauuugaaacaaaaccagagaccuguaaaguugacuacuuguuaagucauggagauacaaauggaugugucacuguuuccuucccugccucacuaaacccacaugacacaggacaaaugugaucugagcguggccaacauaacucaccuguaccauuguuaauugcggucuggaucguggcuucuggccccauagugucauagucuuccuucauuucuucugugggggaaaauuaucuuuagcauuugagaauuguagaaaggcuuacuauacuaagcaugccaagcacaggaacaaggaagauucuuuuaaaggaaacagagaaaaggcuuguuguagaccucuaaacaauagcuuuguucaggcaauugaaugaauccaauagugcuagcugcacaagaacuuauuuacuuuaagcauuacugcaagcugugaaaaacagaagugcuuauuuggagcaaaugaagggcuuuucuucugguggcaguucuagugacaaaugggggaaagauauuauuuuuucaauaagagucaaaagcaacuaaguauuugcacucaugaagaggcaugcuggcugcuaugccucuggaaacucuggaugcuuaguggcaagucagaauuucacauuuuguuuucaugcuuuucuuuccccuugggguggcuauaauggugcuaaucuaugcaagcauacuuuuugaaaaccuaauucuacauaucaaaacuuggaaugcccaguuuguacaacaaauaucccagaaguaacaacaauaccuguuucacugcuugauacaaacuucuaaaacguaccugccuuauuccuaucccaacuacuccauaaaugucuuguccucaucaugauuuaugccccuguagguaaucauaaucauuuucuggggaaacauauauaacaacagcucaguguucugaugaaggugaauauauauaauguugaaguuaaaaauucauaaacaauuaaaggucauugucaaaaacugcaauauuuuaaaauaagggagaauuugaaaaauaggggcacucucaaauuuucugccuaccagauuguagaggacguaggaggacagagcaggauagcugauaguuaaaaaucucuuaaguaaauuaaacgugaaguuuaaaaauuuuuauuuuuacuaugacaauacuaaugagaccaaauaugcuccaggaugaauaucucucugugauaaucauuuuacuuaaaacaagggaaacuuuguaacuaggacucuacgaauuuccaaaucuguccuggucauucuuugcuuaucauauucuaaucuacuuucaugaaagaacagguucuagaaaauguuacagcaaaaauaaaauaaaauauauuuuacaagcagugcagcaaaucucuuuauggaaucagaacugaaaaaucaugauccucuuaagguaaaauacacagauauaccuggaugcuaauuuaaucucacuccucauaauaaucagauaauuugaaugauauuuguuuaagcuguacaaccacuuaaauucauuccugagcaaggaauuuuccuuuauuuaaaaaauauuuucagagagacauuuuacauuaaacauuuagaaguuuaauauauagcaauauuguauugucaauuguaaucauugaucauuugaaagucucccucaucugauauuuuuaucagucucugcaaggaaucauauuaagguauuucugagaaguucagggcuagauauaaauauagcuuuugugucuuucuuccuugcucaucucaugugauuucggguagccaagagucacaagaaucauaaguuuuccaucugagagcacaucaagucacugaggggaaaacaguuaacagcauuuuuuuuuuuuuugcauaauagugguaauguucaagauuucugcugcacuuccuuccucauugucauuuucuuaugaaaaaguaaagagaaguuacaguaguugguugcuucccaaauuaauaaaugcuggguauacaaauguguagucagcacauuguguaaauugcauuuuguaguauuauuuaguuauaacccuuuuuauccaaagacugugcaacugagaucuuucagagacauuggaugagauggugucacuuuuaccuagaaaguacuuugcuuugauucacugagcaucaaucuuuuucuuuuuugaauaucaagcucaaugugugaaaaugaaacacuacuaagccuuuucagguauguauuugaaauguuauguauaugccuauuuaauuaaguuucaagugaauccauauucagaaggacauaaugauacacaguuuaggaauauugccuccgaauuaaaggcaaucuggcugucuuucugccuuaugucuaaccuuaaacauucucuaagacaccucugacucagcauacugugucuaaaaccacauaguauauuuauuuuuaaaacacuuguaaaaguuugcgucuuccagucaccccugggaugaagauuuguaaaaauaaagagcacuuucuuccuuaagaugaagaauccuugaauaagcagaaagaggccaagaugcaggugauuuauuuaagucugugucaaugauaaugaugucaugguuuccagcacacuguguccaccccauugugggacgaaagaaugucaaggacaauuccaaacacaaaacuuugauugugcuggaaccggaaaggcacaguaagaacuccacugcgcucuucaguucaaaaccugcauccugcagacaaacuccagaaagcaugggagaaagagcaaaggagagagggcuuaucucagaguaaagcuaugugcugagguaugacuguagacagccaggcaccggggauaaaacacuacuaaauaaaacugcaccagaauuagaguuauugucuauauuguguguuuugaacaauaaauaagaaaaauauuuuaucagaagaaaaauguguuaucucagagucaggauaaacaaugaguagcuuuuuaagaccaauuucuuuucauuagacaucaaggcaccacaucagagcacuuuuagaacaauaaaaaaaaagaacaauaaaucauuaguaaucauuagaacuagacagguaauagccggguaaguuucuugguccaaauagccaaaugagauuagggauuuacauuuuauuuaauuauugugacuccagaaugcugguuuauuuaccauaaagguaagagcaaagaacagccuguucacuuguaucacaggcaccauuaacuacaggugauaacagggucugcaaugcauucauauggauuacuguauauuaaaacguuuagaauuaugauccaugaccaacacaaaaagcugccacaaucacaaacuacuacagcuugacauugcuguuuggcuguuuuucaacuauugauauuaaauuuuuuaaauuaaacuuuuuuaaaagagguuuggggcuguacauuuguuacauuguuauuaauuauucuucuaaggguggaaauucuaguaauugguccuuacccuugauuucuagauauuaaaauuuaaagcaucagaacauucauucuuauagcccugcauaucuaguucauuaacaaauaugaauagcuaacaccagcucauuuaaauaguaugucuuacaugaguucucgccacacucuguuucugucacacugcucccaagaaucauuggcucuuauuauacauguaaauggcuaucauaaaaauaaaaauuucauuuaagauuguuaaugacuucugcagcagucagacuuccuuuaaugaucauccucugccccuaauuaaacguauuuaucuuucaagcaucuuuggcugaguucucccucauaguugaaaaucuaaaaccuuaaggcuuaauggauauaacgauaaauguuuaugugugggauugcugagauucgagaaaccuucaccgaaagcaaaauuggaaacggaaagaguagaaaacuuggcacaguauguuaggaaaacgaaaaacaaauacacuguacucaaauugccaucagucuuuuuucuuuuucuuucaucucacauuuaauuuucuuucguaguggaagugcuuuuauuauccuccuuccaguauaccaaacaauuauucugccuauguuugaugguuuauagucugcgacaucacaacagcauauagguagacuccuucccagccacuucaccuauuuauaaaaaugcuuuuguugcuuauguugucaaagaaaaaacaaggugggguaaacaaugauaacucucaguggguccugggaauagagaugaaggugacaugaggucugaauuagagaggucauuuaaacaaauuuuccaggccacuuuaccauguaaagaugagcagagaaaguucacaggaauaagauuucuuguauuuuguuaaacauuucauaccuuagcgauucuccgucauaagugaauuuuagaccaagacauuucccguuugcacaguguugucggaaguuuuaguuugaauauaauuuaccuuaguuuuauuauaguuggccugggaccauuuuuacuucccuugagagucccaccaaacagcaggaaucauuaucaaguacuuagcugauaaauaauaagaaagcuaccugaccagguaaaagugugaaaucacauucacacuuaacaaaagggaaucauuaaacgauugaauuccaauaggaggugucagacagacacugaagcuacauuaaacugacaguuauuugguuugaaaugcuacauaauuuccacacaaaauauuuuuauauacauauauauguugugaguuuuuacauuugcuuccauuuccuaucaugaaaguauagaucuugaucauguuacauaauuugcacauuguaaauguggugcaaauaccucauguuauguguugaaagugugguucauguuugacuugcaucaaaacugaaauauaaucccuuccuaagauguaacugccgcaaugugauaacauuacuaucacuucauaaucugucaccagcuuugguaucucuauucugcaagggcucaauggaaagaaauauuuuaauuauuugguugugggcgaucugcuagguggaacagauuaguugaagaugugaagaugguacaggaagaggccaagugauuuuagacacuuaccuggaccaucuacagaggcuuguagaaucucguuguugugccagggguguuccacuccacccucccuuauuucaucuuccucuuccucucuuggcaacagagcuuggcucacguguggggaggacucaugguugggcacacuagcuggacucgucuccugguccagaggguuggcaauaccgucauccucagcaauaugaagcuugucuuccucaucuguuucagaaccuguguccacuacauugucauaguucaccacugcagaagaagcacaaaacacacucucuaaacacucuguugagaaacaucagccaccccuaauuguuuaguuaaauggaaaauaauuaauauuuucauaacugaauuacucaaccaugucaggaaaauauaauuaauauccuucagguuuuagcauuuuuauucuuuuucaauuauagcugggugcucuuucugauuuuaaacaauuuuuuccuaaaaaugaugggaaauucuaaaaagcaacagaaacauagacacacaaacuaugccuauacugcauauguaaagagacguauugcaauauguacuuucgauacuccacaaaaacuuauaaaauagaucuacaauagacaauuuuauuagcuuagagacaugaaguauuuacuauauaauguuguacuauaaauacgagaugacuucacuauauuaacugugguuuuuucccuagaaacaguagacacacacacacacguccaucuauuuacccaaauacacaaacacauacacaaaccugcuccaucugaauuuucacucuuucuucuaugucaaccgucaugugcuaaggccauuuauauccuaaucuuuuaagcagaaaaugaggaaaagccauaucuucugggccauuaauacuacuauugagaugucuucauagugucauaauuacagaagauuucaaagugacacaggcaagaccaacacaaauguuaaaauaacucacaagaaccggcgggcugcuuuugcagcccucagucccagcaaugcucaguagcuuuucuuaaaauagacagccuguaaauaaggucugugaacucaauugaagguggcuguuucugaauuagucagcccucacaggcucucggccuacaugcuaguacauaaauuguccacuuuaccaccagacaagaaagauuagaguaauaaacacggggcauuagcucagcuagagaaacacaccagccguuacgcacacacaggauugccaagaacuguuaacccaacucuccagaaacacacacaaaaaaacaaguuagaaccaugacaucaugggaacaagagggagagagaaagggggaaaaaaggcuguggaaaaaaaaagcgcaaacaauuuucagguucauuuugauuucucugcgccuaauaaagcaauccuccgcuaaguuaucaacugagcuaucucaaguggcucuugccagcuaucggauuauacaaaaguggcagaaaaggaggaaaaaaaugaaaaggauugugugucagguucauaaugcuuuuggagaauucuggaaacaugucuaguuacaaauuuuagucagucauaucuguuugcuuugacagguucccagggaguaaaaaaggaacaaaaagagagagauuuuuuuuuuuugucaugugaagcuggggacaaaaagauuacaccgugcauaucugcucauaauaugaucuuuguauaauccgcgggucugcacuugccuuccgaacaacugcacaacaggugcaaauuaaaaugaaaacggcagcggagccgggcaaacagaaucugcugaccugguuugaauaccaauugacgggggaaacaaaaccuuuucaagaggugugaccacaagggcuuaggcaaguucaggcuggguaaugcccucagaucuacaaaaagagagauauucuaacaucucugcucuagcugugugguccagauauaccuuaguacaaucaauaaugugcuucuuuuuuuuuuuccuggugacugagauuuaacuauuucuuagcaacaagcagaagauucuuuacaaauuuucagaaugcuggggguaggggggagugggaaugggggggcuacaacaaaagcuccuaaggccugggaagcuuucaacccaccuccuaaaaacugaucucugggcacaggaggaauaaagaaagguccagaaggagugaauaaaauuaucuaaggcuggacaggcauuaaaaggccuuuauccuggaaaaaaaaaaaaaaaaacccaugccuuuuaaggucuuuuucugcauggaccacaauaucccgugugacacgugaguguuccugcagcaauacaauugaaauauuuucuuguggaaaaaaaagagagauaaaugauuuaugaacagcccuugaggagucccaaauaucagaacaaucuaaacaagcaaugaagucaugucucaccauauagggucaggaguacagcauccaucaccuucacaggacaacaauacuucacaaccuuuaggguuugugcucacaaauaguaguaaauacuuuuaaacuaaauaaauaacugcugucaaauucacuuacagaggcaguaugccaucuuuucuagcgcuguguuaacuaggauaugcauuuccauaugccauuaugcuggugugccacucucccaaccccuuuuuaaauccagguacaacaauucauaacauaguuuuuauaucugaauucaaaugagacaaucucauucugcucuuucugguugaccaucugacaaucaaaauuaaaugcacugagauggacuuugcacuuccugaucccuaccccaugccccgacuucuaaaucccaggauuuuccuuuaaaauguucccucacgucuagucaguggauuugccuaguacaaguacuguggaaauuuucaccauaaaauauucuuacucuagaauggccaauacuugauggguuuagccgcacuuacauuaugaaauaaaaauaagcucauuuucccauuuggaccuguuuugauguuugcccaccaucaucaccacuggcagaagagaucuuaauaauguagcuuugucucugcaaagaagagauucaauuuuguauaauaaccaacguauacugguuuuaaaugagguucauugggcagaauauauuaggccagugucuguuuuugaacuuaugauauauaucuuuuuauucagcauuuaaaagccuggaaguucccauauaacguagcaaaguucuauucaguccuuacaggucaaauaagccacccuuugcaugagucucagcaaaauuuuagacauguauuggagcuacauggcuggcacaaaaacagacaguuacuucaaaaccacaaagaagugggagcccaaagaauuccuuucugcaauucaauaaacaagaggaaagauguacuguuugcuggcucaaaauagacacuaauuuuacaucugucucugaggcauagcaaaaagccaacuaaagagcaguaauaaauguccaaaaacagcaucaguauccaaaacucucacaguagucuucagaggaauuaauuacaauucuguguaacaguugcauuggcaaaaugcaccuauaauuauauacagguacuguacuguauuacagggaaauuugccaugugauacuauguuuacaugauaauugauggauaagauaaaacuauuugcauaugaagggcauaagaauuacuggcauggcucaccauuuuauguggaaucauauuaaaguuucauuuucucuaaaacuguauguauaauaugggguuaccaaagggcauaaagcugauacuuaaauuugcuuuauagcaaaugggccuggaaagauauaucugcauaugcauuacuaaaagccuauauuuaaaaggcuuuauaguuuaucuauaauaagcauuauuuucacuucaccagauuacauuauauuaaauccucucuacucuuccuuccaaguaaacaauacucuaaauuauaucacuaugccaauuaauuuuacagucauaugcaaaacaaauaaugguuucucuuccuugccuauacauauaacuuuuauuuucagauuuuuguguucuggugacauguaauagaauaguagcaaaauuugacauuuuuauaacguccauaccugcuggaaaauuucagcauuugcaaaaauggccuaucauagcauuuaaacauugcugauaauuagcuugacauuugaaauagcagaacuguuguuuugaagaugcccuauacaauguuaccuuacuaaccccuuuuccuacuuauaugcuuucucuacauuauucugucaguuacaguacaaauaagauaucaguugcuaauguauuaacauacagaagaacugaugugaaggggcaauacuucgucuucaccagaagcagaaacucuauugauguaaaggaaaauuacauaugcagcuuauagacagcuaauuguuaauaaggcagccaauaaugauuuccuauaacucuacucaagcgugccaauaaaucguucaaugccaucaucaaacauuuauuaaauacccacaauguggcaaauccagaagauagaaggaagugccauucucaccucaggaagcuuacaauuuauuuggagaaauauaaucacaaaauuguaguuccagaaggacacuugaagucaacucuuugacaaaggagguaauacaggcacagugaggucaaauggcuugucaaaggccguacagcuaguugguagcaaagccgguaccagaaagcaugucuuuagguguacaacagccaaacaaaaacauacaugauaauacaaauucccagugcagaaugcaaucuaaguuuaaaccccacaugaccagaguaagggauggaaaucccugggacuuuuugggauuuucaugccacaaaaauggagauuguugcuuaauuuuaaauuguuuugaugauuguuacuuucauggauccccuuaauuugaguuauagaagccuaccaauuugaucaauuaccagaaucuaacaauacacccauguuuccugcaauaguuuggaaacaauagagauaaagaggcaguucacagaauuaugagcuugaagacuugccuugucccagaaccaacguguaaccagcuguguggccuuggccuaucauccaaggaagcuugguagaaaugaguaaaaaucaugauaaugguucccuguuuaugagguugucauaggagccuacaaaguuguaugugcaauggcacugugugauguauaaaacaguaacauggaaaugcaaggugauguaacugguauaaucacugaaauaccauuguuucagugucuguugucuuuucucuggugcugcaaugugugguggcuacgaggaaaaaggaagauuugaacuugugccagucacaauuuuuguguuggcccuucacuuagaaauuuauuugcaaaugcuuccucaaguaggaaggccaugaugagagagaccaugccuaauccuucagcuuagacgugacacagacauguaacuucauuuuaaaaaugucucugcugguaauaugacuucaaauuuaaaauaaguccuuuuggccagguaugguggcucacaccuguaaucccaacacuuugggaggccaagcagggagaauuucuugaggucaggaguuugugaucagccugggcaagaccccaucucuacaagaaauaaaaaaucagucagguaugguguugcaugccaauagucccagucacucaggagguugagguaggaggauuguuugaguuugggaggucgaggcuguagugagcuaugaucacaccacugcacuccagccugggcaacagaaugagacccugucuuuaaaaaaaaaaaaaaaaaagaaguguuuuggaauuuuaugaaucauuugguuuccuaaaucucuuaugcuuacaugcuuagagaucauuuauguuugagccaguggauuaaaggccuugugggccugcuuucuuacaacgucuuuacauguggcaagugucgggaagaccuucuaagacuuuucuccugaaccuuagccuuuauuccuccuugucuuccccacaaaauuucaauuuccaaguaugugcuacugaggagaggaugcagcuauuuuucaauaauuuuuguccagugacucuugcccauccggggggauuuaucauugacuuuuuuuuuuuuuuuaaaucacaguuaccuuguuaccuccgugcuuggguggguaaagaucauaggacuaaaugcaagguucaauuucuuauuuaauaauggaggccuagugacaaauacguauuacaaggcaaagacaaacucaaacagagauuuucuucugaauuugaacaucugucacugaaaugcaugaaucuugauuucuccauuuaaaaaugggaauaacuuuauuacuuggggaugcaagaugaaugaauuaaugccaguuagaagggaccaugccaauuugaaauauucagauggaaugugcuauccaauacaaaauauuguuauaaauaauuauuguuaacauacuauagucagccuuuauacaaacuagcuuggccacuuuaauuuuuuaucccaggaacauucgaaggcauuaaaccugcauuauaaauuaaugaguuguaaaaugucagcugauaaaacaaaagcaguucucaguauagggauaaaaauguuuccauuucagauuagcuauguaaaaaaauacgcauauuaaauaaaaugagagcagaauuucugcaaugccaugguugcaguggagagaggccaguucugaggcuccuccaacuuccugguuacaggagcaucuugggaagauggcagccacucauucccucuggaaauauuagcagguucccugguaccugggagagguuuucaaauuucaguaugcuggugauuuucaaaaagguucaaauuuccauacauuuguugagguucuggauaggcuccaacaugcagguaauaacaucuuagauauguaauuuuccccuccaaaccucuuccuuaauaucaaaaauauaaacauaauggcaaauaagaauaaaagcaaggacccucccuuugucaagcuauccuaaaaacagauauuggucgaagaauuuguaacaguaaauucacuuucuuucaagaagacacgguauuucuaggucacaguguucucagugaaauuuaugauuucccaaagacuugacaucuguuuauuuuuuuacaaaaguaaacauauucggguuuuccuguauaucuaggacucauaaugguuuugauuaccuuacuuaacuccuaccaaaggaaacuagucauuguauugauguuucaaacauacaggccccugaccgcuccuuucauuuagugaguuuuuguaguuauuucuauccuuuagaaauuuuuucagcuucacuuucugucaacaucuauaauaugcuuacaauccaaggacauaauacuuagcuauauuccagaacacaagucaauaaugcccuuugauggcuaaaaagucuaacagcaccuucaucagcaagccuagcaugauggcaugcugagggaagacccccaaaacaacugcuauacacaaauaauuucauauauauuguacaucuacugccaauaauuccacagacuuucauaaauacaucaagugacuauaugucuuccaacaauaugucaaaaggaaaaaaagauuuuagaagacucucucuaauuauuggaauccacgaucauucaacaacuugcucuauacaaaccaucagaaggaaaguauuaaggggcuuuacagaaaaaauaugcucacuaucaugccugaaggauauucaagaggaaugugaaaauaacuguaauuuauuuaggaccuggaaguaugaaaaaauaagcuucugagccaucaaaauuguuuugguauuuuuuuuuaucugacaugagggcagaccuugucuagcuuuaaguuuuauaguaauaagaccuuggaaauaaaaccuugaauaaacggaauauaaagaaaggggaaauguguccuuguguaaauagauauugugucuaucaccuuccucugaaaagguuacacaacuuucaaagcccauaaaagguguaaagucaguaacugccagaguacguuggaaugugcuguaaaaaauaaacacgaaauagaaaaacuauaaaaauuuucucugauuguuuuaguugccccacccuaaaccuugucuguaacuguacauuuuucuaagauacagauauaacugaaauacacuuuuagcuauuguagucccacgaaauuaaaccaccuccccucaaaaaccuuagcaugaacccauaccuucaucugaaguagcaacagcuugucucuuaaagaaauauuuuucuugcaaaaggcauuccaugcuuccaugaaaaaggagacuggaguucuagccuauccauaaaaauaauugcuuucaaauauuuguccauccaacagaccuauuuggugacuuucuugguuuucugcaguuuacugaagucaauaauaauucuugagucuaaggaauguuacauggagguaccguaaugcuucuacuccaucagcugaaauaaugggaaagaacagcucuuccagaggaaaacaauuaccuucaagguagcaagagguguggcucaucuuaauagaucuuaguggauggggagaagugaaaucauugagggggaaauagagucauaggucuuuagaagagauguggcucgaaguaggggggcuggagaucugcuugugguagagguuucaucaguagcuuucuccugaucgcuguggcuuaaaguaugggucguuacaaacuugaucacaugcaaaaaauucuaaucucagucaaucuugccucuuaccccaaagaaaugccugaaaggggaucaugcaauggaguccaauucuucauacugcccugaccagauuuaucuuugaaaucucaguuuuaagcuacaucuaauaccugagaaaggcauguaaaguucacuucccuacccaaaggauuucucuuaaggcuuagcaguagauucaggucuauugggcuaaugacauuauuuacuguguaguauguuuaaaacugcagccacccuacucacauagcaacacccugacuaggacccuguuuucaaaacagcaucauugcaccucacaauugacaaaaccagacaacggugaaagggacagugacauggcagacacaaaagcucaacacauuauggccacucuaaacagaguacaaaaggaagggagucagugauguguaaaccaaacaaugugaggggaaaaauauugaauaauuucugucaugaggcacugacuacagccaggcucuaauugaauuaaacucccauuuauuugcucaggccuaaacaacaggcugggaggaagaaaaaaaaaaaaaaaaaaaaacuuaagguuugcucaacuguucugagguaccaccuuuccucaccccuguauaaauccaccaucugugcucacaagcacacauguucccucucucaacaaaugcauggagacccuaccaggcacagaagccaaaaaagcacaaggcacacaaaagcuccccaggcugccccaggucuaaaggagcaaaagggguagaaaagaucuuuugcucauugcccaggugagacggccuggugcguccucucagccucgacacgcgucaaguaaaagaaagguuaaaauuagaaaauucaauuuauuugauaauuucccagaauaauuagaguuaauauggguuaauuaauaugcaaaucucucagcagauguucugcagcagggccugugugagaaaacagccuuugcuuucuccuacgugauuuuggcugucaguuauuggguauaauuacuguaacuaaccgaauacacacaaaaccuuuggaauauaaaauuguuacaguucuagcucugcacaagcugcuacuuuucugcaauaaaagcgaacaauuucuuucagaaaauaggagccuuuuuguuccuuucuugauuuaaaaagaagaaaugaaucaaguaaauggcuuaucuuuuucuaugcauaauuaggucaguauuauaugaacauuccaaugagcagugguacaaacguacauauaaaaugauagcucaaaccaccugcaaaaucacauaaaauuguuuuauucagaaucuuuuuuuuccuuccccaccagaacuuugaaaugcugaaugucuuucuuuccaacauugccaacauuuucuaaauucaaaaggauccuacaacuuuauuaauuuuuuuucucuucaaagacacaaaagaauaaaguggcuaaauguuuuuaaagguacauaaaaggguggacucuuuuguaaaagaacuuguguggaguuuuaaacuuuuaaaaaugcuugcacuuugaauggcuauuuauuuacauguuugggcuguucaccagccuaugaaaugcacaaagguucagggaggcuggaacucagacucaugagagauaggcugcuuugcauaugucaaacucaugaauacuucuaaauguuguaaucauuuacuuaagagacgcuugguauauuucuauacuuuguacaauugaucauuuuauugaaacugcuuuauccucauguauuuguaaacuucuaaagguauacucaaaggcaguggagaaauuuuaggccugcucuauacauuuacauuauuuguuaaauacuuaaauccauuuuauggaauuauccccgaccaauuguucaaccucaguacccaaaagcaguauauauauauauauauauauauauauauauuuuuuuuuuuuuuuuuuuuuuuuuuuaacuagugguuaacuuuuguaaaguccaguaaucaccaagcaucuaugaaauaaaauuauucaucccauuuuuuggccagaacaauugagucacacgcauggugugccuuguccaaauuuucuacuuuaguacagggaggggcaggaguggguggcuggggggacccuuuacccuuuaaauuuuuaguugacuaauuuagugucaagucucauuuuacaaaaggauccugaggcuuauauuggugguguaaauugccaacaaggucaaugaacuagagaaaauaaugucacgauucagaguaagagaaagaaaaauggauggauugaugucuuaaccuucagaauguucaaauaauuggggguuggaugacauggcauaugguuaagucuucuugcagcugaugucacccagacuuuccccuuuuuuugccacccaaacugcauguaaacaaacaguccaacaacaaguguccucaagcagggcgcuccaugcuuggagcaaucuaguuugccgccaccagacacggcucugcuuggacaccacagcgccuaacuccagacuugccccuaaagucguucaaugaucacccucuuuuccuuccuucucuuccuuuagcugcacgagagagagagagagagagagagagagagagagagagagagagaaccucaugccucccuaguaugcuucaacugcuucuccccaugccucaauuccccuucccugccgccuucugucauuuucagguaguggaauuugcugacccuggccgcuuggcggccuaagccuggacguggcaaaagucagauagucacagugcacuauugaguucaucugugucacaaaagggcuuuugcuuuagaucucuaguuugguucaguaauuuccauggacuuccuuccuucacugaaaagagaggccaaaucauaugcuucuuccucauuuuaccucaaggaacagguuacacaaguuaaacaaucacaccagcauuaauuuucuaaaaaaaaaaaaaaaaaaggaguaaauuuucacuuucugagguggcaaggaaaauuccucaaacaaagagaccacucuuuuacuguaaacaaauguacuuacaauuuuuuuacucccuaauucuuugggaaauaauuuuuuaaguccuuccuaaguguuuuagacuaagccaccuuuuucucuguuagcuucuuuuuacucaucaagauuaucuguuggcagacagcugcaugaucuaugacccacacccuaaaaaaagggagcaguuugaaagugacuauaaauuuuauucauucucuggccaaaguuaucuuaugaaguauugauaacacauuaucuuacagagcagaauaauacugcacaaaaugauacuaagagguuuaagacuccugccuuacugaaaguuauuauucagaaguuuacauagucugcaaacacuuaucagaagcccugggcagaaagaacagaaccuccguuucauuaagauacaguggaauguuagagguuuaggacagauaaaggccaauucucaaaaguucaaaaucuuccuugaugauaaacaacgacauaaauuaaaaugaaugucucuuggaggugaagaccugaauauggguauucauacaugacuauaaaguuuuaccaagaccugccuuucucaauuuauuaugguggaaaaucacagaaucacuguacaaaucacuuuuguauugagcccaaagaggucacacuguugcauauaugcucuuuuagugaagaaauuccugauacaagcaauaucaaaauauucaguuaaauuauuuaaaaaauuuaguuucauaucaucagaacuacccagaaucuauauaaguucaugaauaugcuuuacauaauguaacucacuaacauaggaaaagaaagcuauguacuguuaggcucacucaauuuucaagccaaggaacauauuuauuguuaagacuuauaagaauaagaaaucacucuucccuuauucuucaaauauuuuuugcaaaauaaauuaaucaauaccuacaggaacaccuaauuuacuauuuuugaaagagguaaaauaaagauuuaagugaugaguuuauucaaaauuucaaauugccugacaaguuaagauauaguaaacauauauuuuaugaagacaucuugauuuuuuuuggugaauaauuuaccuuuccuuacaaagcauguauauuuuaauagaaagacacuuuagguauauuuuucucaauacuauuuuugaacuuacaacacugauaucaguuuaaguuuuuuuaaaaaaucugcacucgccuuuuuucugcacauacauugcguggcacagaaagcauuuuggaguauuguaacauaguugcacuuagaaauaauggcaaaauucucaugugcugucccauuuuuacuggacuuuucaaagaguaaaauuucauuauuuuucaaugauauuuaauuuucacaugacacuuucugaaauguuaaugcagucccuuaucaauguagauauuuuucaaggccuguguuuuuauucaaacuuagauccuuggggaaaaguaggcuaaugacaauagggaaauaaauauuacaguuucaaaaaauagaucauugaaauaagaguuaaaaaaguauuuuaaagaauauaauuuaaaaauaaaucuuaagagaaagaauuaucuuaaagggaagauauauggcauuucaaaauguuuagaaauguuuuuagcuaaagaauccacaaaguuuuuuagcuaaagggccauaugcccuauuuuaauaaaaaggaauccauaaaaaauaaauuacuuucacuaaguauaugcaaauuccaauguaagcaaucagugcaaaauuaauuuugccagaacugauuaaaagcauuaauaaaucuauaugcaguauugcuucaaucugauacuguaaauuuauuauacuuccuguaagauuaauuauaaugcuacaauaacauauuacgaugccagaacauauuacuguacauucuguuaauaacaguuaagcguaaccugaguuguaauuauggacuguaacaaaguaauuugauagugauuguuuucuuuaacuguuaauguuagaugggaaauaaaauguguaugugcuuguguucauuauauuuuucucuuuaauacaauaccuaauuaaaaucaugaaacaccacaguauuuguucucacagauuccuuucacuuuucgcuccccaccaaaacugucaggcugccugagauaagggaagguuaaaaacaaaguuauucaagguuguugugcauucuuguccugaacgaaagcaagcuuucuugaaaauguauuuaaaaaaaaaaaaacaguuuguacuguucaggacucaucauuugaggucuucagaugacauagcaauuuuuccauguuauucacacaucccacaaauaaguaacaaaaugcuugagagaucauggugacagcagccauuccagguagcaaaacaaagacgcugaaaauccuuuaugaagagcaaaagaggccaaacagaaacuuuucuuuuugguagcuucauccaaacuuucuauugucuuugcacucuaacauucugacugcaucuaccacaauacuaagcucaucugaucugauagucguagaaacauaagacuuugaugacaucuauaacuuaugguccuuuccauuuuguuguccuuuuucgaaagcugaagcagcuacguaugcacauaacuuuaagaacacaaaaucugaggcccuuuagaauacuauacacaaacuucgaguggcaaacagguuucuggagaaguaccaaaagaaauuauucaaguuaagcuuuuuuuggauauauuccugauuaagccugaacacaaugaaaaaaacagugugaagcacaauucugaauggcaucugugcuuggagcuucagaggacugcugacugucauaaaacucugugugucaccagcugggggucggggauuuaaagaugucagggggaccuggccucucagaugggauaaagaucagaaggaaagcuguccaggugaugcccaggccccugaacaggccuaucugcacuuucauucaaaugauaaugaguguguaaaucacaucuguucccccucugugccuguauccuugucaccugaauagcauccccaccagguaucaaaugagcuacaggaaauagguuuucuuuuuauccaacuucacucugaaaugagaaaaugagcacccugacaaggaagcccacaaaccaacagggauuccaagcccagauuucaucauaauaaagaauguuuaauuguuagaugaagguucagucggugagggggaacaccaagguuuugauacaaagguagcucucuggcuccucacugcccaauucuugaauagccucagaaaaguagccugauaauuaguagucacugacuuuuaaugaucugaucucauucuaauggcacaaccccaaaaucucaggcaagaccagcaauucucaccucucuguguucuuuuaaguauggaaacaagggcugaugagauggaagcacuccuggaagccugacaguaaguaauauuuugcaauuaaaacauuugcaaauauuuaauugucuaaaacaacaauggcaagauggagaagaccccuuauuuauacuuucauauguaaaggaaauuuugaucuaagaauguauuucuccucuggguucaucauccccugcuucuaucauuucuuuccuccucuuuuuuuuuuuuuuuuuuuuuugaucagaggcaugaaagugaguaagugugaaugcuuagguaccugggguauggaaaggugguaauuagcacagcgggauaauugauguguagauugcagcaugaacaaaugcuuugacuuguuuguucuucucacucuuccacauucauucucucucucuuccucucacucucccucucucucucuuugaaaacccugccuagcuaaugaacaccuuaccugcuuaguuaagcugauuacagauacacauuuaucuaaaggaagcacccuagucucacagaagaugcuuaggugguaccuuuugcucucaguugcaaaccaagaaugccuuuccucccuccagagcuuccauuucacaaccccuaacugagacgcaacaauaccacccaaccacacacaaaaugacagaaaugcaccccucauuuuuugggggaaaauggugaagaugaucgaaaauuuuagaaauagaaaucagaaucagagaaaauuccuaaagaauuuuaccugaacagcaaaugcacugucauuucaggcaguauuccuaggacuuuccacuuuggggaaucucagaauuauaauuacuagaagcucugcugugucaaugguuucagucucagacaguuauuaaauugaacucuuuagaaauaaauugaaaacguauccauacuuuggcuuuucagucgcauuuguugcaucagccuuucagaagagguaagacauguggggauacucuaccugcagugccgucucccuucuucucucucccccuuccuuccuuccuucccugaacuuaagugcucaaauucuaaccuucauaaggcaguuaaacuugggaaucccuaguucagaguuagcccaccuaucuuaaaacauaccuaaaugcacuugcacugugugggcaauaacauuuucaaacauucauaugaugcuuucaggagacuccaugcaccaucgucuacuuccccaaauaggccauauguuaguagucaaaggauauugaaucauccuuuccccucuuuccguccuuccacauccuuccuuccucccuucuuuucucccucccuuccuugcuuccucccucuauccuuccuuccuucuuuccuuccuucccuccuucuucccucuccacauccccucugcuccccuuucucagccuaguaagugagcaauuaagucacguagucaauauggaaaagauacaccuuucaucuucaggacuccauuuucacaaaacauguuacauguauauauuaucuucagcaagguccaggcucuuuagaccaauuaucuauccagugccuggugcucuuuacuauggguauucguagaucccaggcuauuuuuaauagucauuaaucaaucuacucucauuuuuuuuucuucuuucaaaaacuuccacauaugaguuugaugacucaugggcaccguaccaaagacuaacaauuggcuggacgcgguggcucacaccuguaaucccagcacuuugggaggcugaggcaggcggauuaccugaggucaggaguucgagaccagccuggccaacauggugaaaccccaucucuaccaaaaauuacaaaaauuagccgggcaugguggccugcaccuguagucccaacuacuggggaggcugaggugggagaauugcuugaacccaagagauggagguugcagugagcugagaucgcgccacggcacuccagccugggugacagagugagacacuguuucaaaaaaaaaaaaaaaaaagaauuaaguuuaauaacuguaaauuucagucaacugauuuuaaaguuuuuaaaaaguuggagcacuuuaguacauaccagugaucauauuucuuuaaaugacauauucuaaguucuucagaucccaguucuguuuuacacgcaagauuucucuggcugcuaaguacuuggucgguaauagccuuuacuguauaaauaagaggguucugacugcacuggcuuccucugcuuuaugcagugguagcaauggaaaaaugacugggguaaucaauaaguaguucauaaaaaaguagagaaaauuugcauaacugguucuucuuagcuuacccauaaaauguauuaugauauuucucauaugucuaacaugccuauauauguucuuccuuccaucacuagauuuuguugagggccuacaaauaugcucuuuauuauuuauuauuaucccuuaccacaucccccaguuacucccaucuuguccauucaucacaacuacaggagaauuuuugacuagaaaacaacacauuuucucacaacucuaaauucucccaacuuaucuucaauuaaagauaaauuaaugagccauaaaaacuguaccaugguacuggacuaccuaaacaugcugaggccauuuccccuuugaagcaugauggucccuaacucguagcugaguaagggacugcagcuucgcaugcccuucugacgggcccaucuagccgcuuucagggcccaacuucaaauaggaagugcaaagagaggaaacaaccuugccuagaagcuggggcagcucagccaugugaaugcuccugccugauagacauuuuauauuucuguagguucugggaucaggaugcuucaauuugaauccagcugacuaacuuccuaacuugugacuuuuguuaaguuaucuaaccugccuccauguccuccuuuauuaaguggaggacaagaauaucuauccacugggucaguggaugguugugaagguuacauguaaagcaccuagagaccagcucccagaaagugcuuaguaauaaaugcuagguauuauuauaauuauuagccaagucuagggacaguuuuuuggugacagugaguuccguaucauucuuucacaugcuaauuuugugacaauccuauugugacuuacagugguaagauuuuauuuuuacuccguuucuaaguuggauaaagggcaaugcagggcauugaaaggucaugacauuuaagcaugaaauauauaauuuaggaguuugggggcaccugcuguggaaagggggcaucccagacacuaaacuagguuccaugcugccacccuaugagguaggcagccggacuccauuuuacagaagaaaaugcuaaacguucaagaugauaaaggacuuacugaaaguucacgcagcuaaguggugaaauugaguuuuccacuuuucaucugucucaccucaaaaugcaacaucucucugaacgcugcaucacacuuuucaaacugugcaugcaagguacaugcuaaaaagggccuuuaugguuuuugacauuuacguugcacacauucagaagagauaaaaauagacuccaugcugcugauauaauuacuagaggcuauaaaagccaugcaaaaucuggagagggggcgugggaauagucaaggaaagaacauaaacaagggagcagugacauaaacuaggacuucaugccauccuuaauuccuucacagagcuccacacaguccuacagcguuccaccauguaaaaucaggccuucauuuugaacuuggaaaucuccccacucgcaggcaguggcaaugccagcaagccacaggugggcaccacaugagcaggugagaaaugccacuaguaaggggagguugaggaucuggugccucuaaaagagcacaucaauccuaauuauccugcguggguguaccacuuaugucguacuuagguacuuauuuuuuuugucaggcaguuuaagagaguuuuaggcaaaugaacguccgugccuuggaaaucccugagaagacgugaagcagccucagaaagagaaacuggcugagcuuucagccugcgcacgcuggggcaaggaagcugcacuacacugagcuggcauaacugcccuuggccuggccggcagcaucucguccugcaaacugagagaaaccugagaaugaacuucuacacugcaccucagaagggagcaggcgggagaggaagccggguugggaagucagaguagaaucugaacacagaagacagggggagcuauucaggaaaaugugcuuuguuauuuccuucuggcaccuugcucauuaccauucuaauuuuuaaaaugcaaacugaaacccauacuaacuuuaacauccuaaaugacaaacuaaaagcaacacagcucccccuuccacuccaguaacaccccucaucccuaaaaaacaacaaugcuaacaaaacccaugaacaccuauaacaaguacagcuuuaaaauccaaauccuugcuuuucuuggcuuuuagguugaaagguaguggaaaguggcugaguaagaccccgucagauucagugcaaggugaagacuggucuugaaacuuuguaucuucccuucuugauuagaaugaagguagaugccuugacucagaauugguggcuguuuuaaaagcuggccuugcuuuggaccauuguugggacugucuucuucagcaaacagugaucaugaaaccaaauucagcuuucuucaggaaaaggacaaaaacuggggugagaugauuugcuagcgguuaccaacugagucggggcaguguaaauauuaaaaccugcagcccuuaagauguccagcuuaguacaguauaggacucacacaacucggauucagaaaaguugccaaaacuuuuaaugcuuuaagaaagaggaugagugacuuuuggguguuucagacauacagccuuucugauuagcuauuuuagauggcguguaauagacuugaguaguaagcuauguuguauuuauuguauuaauuccagugguagguauaccuggaauuaauacauuguauuaccacuggaauuguauuaccacuggaauuaauacaauaaauacaacauagcuuaguacuuaauaaauuguauuaauuccagguauaccacuggaucuacuauggaaaaguguuugagugaugcccaccuaauauagaagaacuugucauagcucugaugcagcgacaauugaccacuugcuuuuacauaaacacuaggaagaaaggcauggcaucaaguguuuugagagcugaauuacaucaauauuuccuuuucagaaaaucuaaaauuauuucaaugcacaaaagguacauacugaauguaauuauaacucuucaaaaaaaucaaucucuuucucuuuuuaaacuuacauaaaaauaaauuaucugacuauuuuaccuuuggauuauucucucuaaucaacacucugauuuagaauaaugcaagaaaguaacgccuuagugucuuaguaccauuuauuaauuccagguauaccacuggaauuaguacaacaaacaaauacgaauucuacuuuccaaucuuuaaaauaagaaucaugcaaagaaguguguggcuuacaacugcauguuacuuauagcagcucugaguauggugcuuuuuuuguuuuguuuuguuuuugagcuggagucucacucagucacccaggcuggagugcaguggcaugaccuugguucacugcaaccuccgccucccggguucaagcaauucuccugccucagcuucccgaguagcugggauuacaggcgcccaccaccacgccugguuaauuuuuguauucuuaguagagaugggguuucaccauguguuggccaggcuggucucaaacuccugaccucaggugauccgccugccuuggccucccaaagcgcugggauuacaggcaugagccacugugaccagccugguuuauuuuuuuuaaaguuagcuccuucucuaggcagugccccugggucuccggaguggacaagugauuuuagaaacugagagugggggagucauaaaaaaggaagagauugggaaaauacggagggauagaauauguaaaagaaaacacauuuaaauuuauuacuacacaugagaucauauuucuggcacuuuguagagguccuauagaagcuguuaguucccauauagaaauacuagagugaauaaauugguguuaaauuuaaaucuacuuaggaaguaaaagucuaucuccauuccugguaagauucucuuagguaaaucuggaaaagagagguccagugcagaaaagauuuuucuaguauuucauccacuguuuuuucgguauaaaugaauuugugcuuaggaaaauaaauauccagaagggaccugcacauuguauugacuuagcgucucuuaaauugguaaguuaaagguguuauuaggccucauuaagaaaaauuaguauuuauuuuucuuagguguagaaaugauuugaagguguacuaggaaaacuuggaaauuuugguuuuuccauagaugaauauuuacauuuuaaaacuuggaaauccuaaaggauaagcaucuugaaugaugcaacuuccccuucugugguucauuugggaagcuagcaauacucuuaccucccauugcaguuucaacagugacaccuggaaaccuuuguccaaucuuuguuauuuugcuguauugcgagaaaguuuauauucaaauaagccuucuauuuaauuuggaaagaaguuguugucuuuuugcagaaacuuuuaacucuuggguuuucuauuuguccauauggacacaucgguacgcaugccuauuacauaugcauuacaugugccuggaccauauuuuacaagguccaugaagcucauuuugauuaauuucuuugucaagcuuuuuaaacauaacuauuuuuuuucuccaaauaacaucuuccuauguguuugauaguugugggagagaugaggaaguuaugaagacugcguggucaccucucagcaaaccccccuuugacauaucugggguccacggcuaguuucuaaugagcuccacucacucguacuguaucuuugcugacuaaagccuuuuaauguuauuuauucacaaucaccucugcauuuagucagauucagaaacuucaaaugccacuuuggaccugauauuuucuugugaaaaaugccuagacggguaggaaauaugcuuuugaaugugccacaaguuuccgauaacuuuucuguaccacaugccacaaaucuguaugauaauucucuccuauacgcggcugaaguaaggggggaagcucugacuuaaugccaagaagaagagggugaaccaaggaaaaggaaaaaaaaagucaaggggugcuucuaaggagaggaaacaaauagugaugcagcacagauauuauagauaaaguaaauacagcaucaccacaaaaggcuaaacacuuguuaaacugucugguuuuagaacauuucagccauacaacauuauucaacuacucaucacugugagaacaggcaaucaggaaagcuaauuucuuaauuagcucugcuccggcgguaaugauugcagaucgugucaacuaaaaucuguuuggauuucuguaaauuggaguccgacaagccugcaguuccgucgccaaccugauaacucucaccccccugucuuuuguuuuuccuuccagccuuuuuccugucgccaucucgguauuuaaucugacaccgccaggcagcgagaagggcuuacucuuccccuuaaagagaaagagagagaggaggaaaagcaaaacauuuacguggggacaggggggcuggcuacacaggaaaccuggucccaaccuaaacuacugacaaaagccuuuaaucuuucccacauuccucaaggcauucuccuucuguaauaagacauauuccuuucaaguaaauccugauaagggaauucauuuuuuuuuacaggaaauguauauccuuguaagucuaucaucuuauuuaguuucuauauuauagguccuaacuaauccaaaaccauuuccuuaucaucuggcaugcuaacggcgcagucaucaaaacaaacaaucuguuaauacaacuaagguuaagcaaagccaagcaguucgugcuauauuuaauacgcauacaacacagcuuagcuuucuuaaacugcuugcuggucagaaaggaccaauuuguuagcuaccaaaggaugugaguugccucacagacucugugaagcacucaagucuggaugaagcacuaaaacauauaugcaaaaguccccauuugucugaucuggacacuuguggcuaccaugaggcccacuuggacccagggcaggucucugaugaucaaaucauauucuuugucuccuuuccccuuaccuucuuuugcaguguuucaucucaaauaauuuuucacugacaggauuucagagucagaaaguuuuagcaaacacaaagguggaaaaagaaaucauuuuuaugcagacucauuagcuuggagucuagcuucacugucacuuuaaauaaauuaaaaugagauuuagaaaaacacaaagggccuggucuguaaaucauucuauuaguaugucugagugcacuuaggugauuaccugaugucugugugauuaauacuaaccagaggugugggucaaacuccggcacccccucaccccuuuuguggcgacaaagcaaggaggaagggcaaucaguguggaacucuaaguugacaucacucaacaaaaaacaaaagaaguuuagggagcacagaacuguuauuuucaaagaacuauucuuuuuaauagcuaaugagagagagguccaaagguaucugccauuuagggaauacaacuaaagaauuuagcaaaaguauugcucauaauaguggugacauuuagacaaaagucuugaugacagcgcaaugccguguuagaauauauuaguacauaccuaggaauguugugcucacaucugaaaaaugaagauucaguauuugugacuuuuuuacucuucgucaauuaccacaaaucucuguuguuuuaaacuaggauuuauaaacaaaguauauuauguucaucacaaaauaaggaguauuacuaguaugaccuuaaagaugguguuuccucuuugcaaaguaagaggucugggaauaaaagauguugcuucguauuugggaaauacaguuuauuuuacauugcuguaauaggauuagaaacuaugaaacauuauccgauaguaacuuuuuaaaaaacucaccgacugcuuaaaaacuaaaaguugaacuacugaaacucaggauuuccagagcaauuacaaacuauaaacagaaggauaaaccugauccuaauuguguagucacuauuaagauuccaucaaaagcgaacaagaagcacaagauaaaccuggaauuucccaugccacguuuuuuguuuuaucauccagaggacgcuugcuaucacuagaaccccucccuauucaaaauuuacacacaaaccuggaugagaucaaggauuaacuuauuuuaccuaaaucucuugcuuugaaugcagcugcccuuugaugaauacuuuugugaaaaccaugcucagugaguaucuauuguguuuugauuaauauugcaguucaaacucuuuugaaacaggauguccuuauaugaaggcucauuauucugacacccacaugacugucuccacuuauaguuuauucuaaaagcuucaacccugcucagaauguagggauuuuguuugaacccaggauuuucaaaguugggagagaauccaugaaaugaucccucguuccuguaaauguacacacaugggugugccugccuacaccaucagagcaucacacacacacacccugcacacacaucaccacacacacccucuaugcuaaaucugccuucaauuaaccaaaagcacaauuuugcccugacagagaagauuucauuugguccacauaugacuagggagccgauuucauuuccuguaaaaaacccccucaaacgcugcaaaguuaccugacucagcugcuuguagaaaucaaauucagucagagauaacagcuaaucauuugucacaguaagaagcaauucccugaaaucggaagggaaaaccugccgcuucaauccgcaggucugucagauugcuagaaauuacauucugcucugacuaaccucugcacuuggauugcuaacaacaagcagccugcucuaucaaaagagaauaucauacaaccaggaaccgcuuuugauucguucuguuccaauaaccugagaaaaguuuauggacaugccuugcugccuggaccucaauuuccaccaaccugcacacuguuuugaauuuauagcacugcagcuccauaguaauguagguaaaauuuacaagcugacuaucugcuacuucauugaaagaaaauuaagaguugauuuuauaaccacacgacugauauuugccuucugauacuuugaggaagcauacgguuuggaagcuucaauuaaaaugccaaaagagaaaaaacaaauugauuaacucucaaaauacaauuuauauuuuuuagaaaugcuucccgggagggaauuaacuuuauacucuucuauguaaacacuauuugugcagcauaaguuuaauaaaaaugauacaucaccucucuguuagguuuauaauuugcauagcaauagugaauauggaauuuuggucaaaauguuucucucgucucucucucuuucucuuucucucccuccccacaucucuccugcaauaguacaggaucguuggaaauggguaaguuuaauaucuuuccuaaucccaagaagccauuauuauuacuuaaaguauaucucaagguagguuauuaacccccaagaaguuacagcuuugaguuagaaucacauaaucuuaaaaaaggacaacauauuuuccaagcaguacuuaaccaaauacucuucuuuaacucugacuagauuuaugaugaauacagauauugcaacucuuauaagaacuuaaagauggcgaacucagagauucagcauuuaagaaggcugccucuaagacuaagacuaaauccaucccaaguuuguuccauuguuuuuuuuuuuuaaagcauuuuauuuuccacaguuggaaucagcugaggauacagugugagcagugacucugaauuuccuuugcuuuugucaaacugugucacaaccauaaaguuauuuuaacugaguuuauuugccuaggcauuuccuuucucuuguaguaguguaagagaaaggaaaacaaccauuuaaaauguaaguacaguugaguggauauaagggacucuuccagcuccuaucguaagcagacaauucgaugauaaguaugugggcuuuuuaagcuuuaaaaaauauucauaaaucccuuuuuggauucuuucauuucaauuuucuucaagcaaugagaauuagacaaguuuauaaauucucauuucuaccuuucuugggccaguccugauuacucuuaucaugguuaauacugguucacaugggggacuuccacaaauucuuuaauauacuguguaucugguguaaaaaaaauuauguaaaauacaauaauugaugcuauuaauguauuuggugagauaaucuaauagauuuccuugaaguaacucuaauaaauuuuucuuccuuaguaaaaacaaccccuuggucuuagauucugcucuuguacagucauccguacaguggccagggcuuaagcucugguacuguaugaguaugcaaacaagcagauuucacaaucagaugacacugagacuuaggcuuacugugccagacucucuuuggugacuguucucucaucuugggccagccuagggaucugagaaccugcuguaguuagaaagaagucaccugaccucgaaguuucccuccugucuuuucucaaucguuccagcucucacacucaagagucagagcucuccaccacuguccuggccagagcagcaccccccaaaggucugcauguaccucuggcaagauaaaugcauauagaagacaaugcauuuuuagucccuauagacuuucuauaacgucuacguuuccagaaucucaugugugccuuaaaaacccuuuucuucuacauuuaaaaggacaguuugauuauauaauaauaccuggauuuaugcauuaauccacugacagcagagcccguuaauagacauuuuuccacuugcuccucauaacaaaccuuugaaggggggagcaauuauuaugaggaugauuuuauagaugaguaaauugaaucucagaaauuuuaacugacuuuuucccacaucaccucguguuagaaucuggaucugauuccugacuccagaaacuauuugucucuagauucuaucugugcucucuucaucaccuuggguguacaaaucuaagugagcaaacaaaagccaaaauaggauuuuuaacuauuuaacagaguaugguggugucaguaugaaaucuuguucaucugguuuaguggacauaacugugccugggcagaagagagaaggaggagagaagaacaaaggcaaggucaagagcaacuacacugaaauugggagaaaaagcaaguuagauauaaggaagaggaccugguauguaacagguauuaaugggaucagugacauccaucauuugugaauggaacagguuuuauuuugcuuggaagguuuuuuaaauuuuuauuuuuucaugaaaacucaacaaauuuacaugccaaucuccccccauauuuacucucaucucccaauuucucugaacauaaaauucaaauggauucuacaaaugaacagacagcuguauacuaaauaacucacauaaguacuuuuuuguugacauuuuguccugucccaauuaauguuucuuucaggauuugagguuagguauucaauuaaaaauaccauucuuuucuuggucauaagaauguacuuggagcauuuauacuaaggcgaauuuagagaucagauacauaaugugguacauucuguaauauacaugccuuaugcuacagaaacuugaaauugggccucaauugccuauauuucugggcuguuuucauugcuacuuuaauauuaucuaucuuauacacacacauacacacacaaacacacacacaccccaaccaccaccaccaccacacaacuucacacuuuucugguauuuuuauuugcugaaguaaagguaaauuuaaaaagcaaauuaaaaaugucaacaaaguuuucauaacaucuuaaaauuaccuaacuuucuacuuuuaaaacugaaauaccaacucuggaugacuagaaauugaaucggaaaugccccccagucuuuagguuggcacuagggaaagaccuauaacaaguugccugauuuuccuaagaauacauugagagaggguuugcaguucucgccagcuggaggagucuuccugguauugauugauuaucacaguauucaccuuggaaugauauagauauacuggauauuaugaagcuuggaauuuuaaaaaaauuaccauuuuguaauuuuguucacauuccaacugacagaagacacaagagauacuucaauuuucuaagagaaugaaaaaaaaaucuugcccauucuucugaaauuuaaguaggcagcccuugaaagaucacugggaaaagucuguauuuucucagguuuaacuaaauaauuuaugcauacuuucacuuuggcaugaugaagcaauuuuagccuuuaaaacccacaacuacucaggagggaaaaggucugguuccugcaacuuaaauaauuuaaacauccagguggaaaugcuuucagcaguuucccuuuuugagacaaaggacgaagaccagaauuuugagauaccaagaauaaagaauugauaaaagacguaagcucggauguauuuaauuuagaaugggaaucuugcaauauuuuuugaaugauagagaccagagugaggugugaggugaaacgucugcuugccugcuguuuauaauaaaugaacacauagaaaauaacaugucaguauagcccuaagccacacauauauguauuacauauauaaacauagcauacacaaauagaaauaucuauaaagcuacuauaaccccauaacccacgucagcccaagcuuuaagcauuagguagcuacuggagaucuuagaggaagcuguguuaagaaauauugugcuuuaaucccuggcuucuuggguuauauaaauguguauaucuuuugauauacaacuaaggagaguaagauaaaugaaaauggaacaaaaugucacuucuguaggacacggggcugcaaaaaggacagaaggaacuacuaaaauacuagaggagauuuugauauguagguacccagcacaaucagcccucucaguccauggccucuuagccugaagucagauuucagaacugccauggggaaauuuaccuucucacuugcaggucuguaaugauauacuuguaaaggagugugggacuuggaacacugcccguguaaauuuagagcacagcuuauaaucagaaaguuuugaggguuaaaaaauuuccugcugucuuaucaacauacuaaaaaaaugcauagggcacuuuguguuguaauuucuugugggagagaaaaacacuucacaacucauaaagcacuggucguuauuauuucuaaaaaaucuuugucacauccauaucugaugcucauguaaagaugacaaucagcuaagguacgaaauaagguaacagagcuaaagagaauugguuuccuuuagaguuaagcauaaccaaaauuauacaggaaggguaaaaagagaucuugcuacguauguauucuuuaaaaugagugcaggcuucauucucucauagaggaaaacaggcucguagauuuuaacacuccgaaacuuuuggcccugugcaucauaggcaugcaacauacugggucccguaaggagagauccugaagaaaauaugaagaaagguuacccuccgagccaacaggaaagguuaagguuggccagggcugcauaagacaggguugcugaaacccaaaggucacauccugaacaagguugcuauguuaugaugauuucauucugaaugcaauucuggcuuuguuuuuguuguggugcugugggugagggccacccaagugacguagguuagagauguggacuggggaagagugauuaaaccauggacacgucaguguuguuaagggauuuaagaaauauuauucuugaucuauguaaagagcuugaacaucaacggcuaagguauacaaugugaagugaggccuagaaagagacugauauggggugggugguuguucuuucauuuucuuuucuuucucucucucucuauuuauuuauuuauuuuuuggucauccauugacuuuaauuaagcccagccagccuuauaagcaugggaaacuuggagaacuuuuuuguuuaaagugaccuuguucccaggauuugcccuacaacuucucucagcuccacugcaaggaugaauauucacauugcugcucugaaucuuagaacggggcaccuggcguaaaaaagaaaauuucaaucucaucuuaaguguaacacugagagcacuguuuuuuuuuaaggaaaaagaaaccuuucuccauaauccugcugguuauacuucuuaacuguauuauuuuaagucaauuaauucaaauuuaaaaauaaugaaauuacuagcagagacucuaaacuucuuuuaguauauuaaauugggcagauugcuucucuccuucuaauuaugaauguugcaguuacaaaagaaacugucauuuugauagagcaaaagacaaucugucugccaaaaauguccaaccauaauucuaaaaaaaagucaucggcaucaagaacaugcuacuuuguuugauguacugucuuauuggaaaccugauuugcuuucaaccucugagacaacacauaacauaaguuugugugacuaauuuuucuuggaaauaugaguaauuagaauuaggggccauuuucauagcgggaguggacagguuuucaaaaaauucaaaguaagugcuauaguuauuuucuuuucuuuuucuuuuuuuuuuuuaucacacuccuaaaaccaaguagaaggggaaugcugggcuuuguacuggauaaugugaguccccauguaaauugugagcgauugcaaaguacggaaagguuuauuaccuaaggugagcccucccagagcucccggaguauaaaagcauuaagcgcauguucuaacaaacucauaaaaaucaauaaacaggaaccccccaccugugcaauggccccaguguuaaguuuuauacguguaguaauagugcauaucaauuuucaccacccuuccuacgcuagcuauuacagggccuaccaccaccggagggacagcgagagccgcaccauucauccaucccacagaguugucuacaugccaggcccauugcaucauugucaguuuuauucuaucugcaacuggacaaggcugcagcccuagcuucuauacacccacucaguaccgcaacaauugcaacugugugccucuguuuaaagaguuuacaaguccuucugaaagaaaaacagaaccguugcauauuaaugcccccaggcccuggacgaucacacaauggaaagaggaaagacaugucacuuccaucgauaugugaccuuguccaacugcugcagucuguggcuucuccaccaagguuuaaaaaauaauaaugcauucuugauaagcaucuggaugaccagguuucuacagcaacuaguuauaaucagagugcuccuuaacagccaaaagauucggagagcgcagaucaccguuuuauuacacacgugguaacauaugcuaaaaauuaggccugaaauaugcagcauuuucaccagguuacagaaauaacuacuaacaucacacuuauuucauaauuaaaggaaauccuccacccaccuccccauuuuuaccaauaaaagcagaaaauaucacugaauauguaaccuuuguaccacagccacucuuugccauccuuuccucuguacaggguaaggaggggggacaggcuuauuaaaaucccagcacuuguuaguaaagaggugcaauaacuuugggaggaauacuucacuugaggcauucugggaaaaaagaagaauaaaagaaaaaaaagaagccucguuuuaauuauaauccaaauauaacugcucuggaguaaugaggagcauuugagaagacagccuucauucagacacggaacuugggugauguuuuucuuccuuuuaaaugguucuguugguuauacaguuuuaacaugccugaaaaacaaaagaaggcccuuggugaugacuccgcuucuccccuccccagcaaaaacaaaacaaaaacaaaacaaaaaacaaaagaaaacaaaaaaccaggaguuuuauccaucugagguugccuuugauagcacucacagcacggaagugccacucacggguacuuagagcugcgucauuuaggagcauaaaaauagaauaaaguugugcagcaaaugagaaauuaugauauaacucaagugcuauggcaugaaaccggcaaaaugagccaucuaaacauuuuucagaaccaaaaaauuaaagaaaauggaaacugcaacucuagcaugauuucugugaagguguguuugaagucuuacuaacuucaaugcccuccaugagaauaguugcuauggauauuaugagaaaauuagacauuucuagcacugcaaagaaagugaagcagugcaguugugaacagcuggcauacaauagauaauuuaagggaaaguggcccucauguauaauuuuuaacugaagaacugucaggccccauuaguuccaacagggccugccaggaccaagaucaguuuauaggaguauuguauuagcacaguuucugaaagagcagugugaaaacauaauauggggauuugguaaauucagcauuuuaaaaaauuguacacauuauuuguuauacugacaccauugcucucugcuuauggguucugaaugcaaaccccaauaggguagcaacugccacgguaaacaauuugugaaaaagcccuucugagcaguuggacuauggucagaaguaacccccaaaguuaaaagggcaaagcaaaugguggcuaucguacgccguggugcugaaugcuucugacucaaaggccuugaaagaaauagggcaaaggacagaaaaacuauauaauauaaacucagucaaccgaaguucuuguuagaaguauggaaauuuuuggacagccugugaaggauguaacgagaucuaauugggaauauaacauguauguuucaaaacuaauagccaaagcaaaucauaagaaaaaaaaagaaaagagguuaccuauucuccgucacauuggcuauuuaagcaaauauugaagcuuucuuggcaccugguuaucucauuuaaacacauggugaaauaaaauaauauacacgugacaugccauaguuucaaauagcaccaucuuuauugaaaacaugggcugggugcaguggcucacacuuguaaucccagcacuuugggaggcugaggugggagaaucacuugagcccaggaauucaagaccaguuugggugacauagugagaccccgucucuacaaaaaauaaaaaaaaaaauuaucugggcaugguggugcaugccugugguccaagcuacuugggaggcuaaugcaggaggaugguuugagccugugaggucaaggcugcagugaaccaugauugugccacugcacuccagccugggugccagagugagacccugucucaaaaaacaaaaaacaaaaaacaaaaaacaaaaaaagaaagacagagagagaaagaaagaaagagcaagcgagagagagagaaaagaaagaaagaaaagaaaaaguaaaagaaaaauggauucaugguacaggaaagaguggauacugaggcucagggaaggcuucauggggaaagaggucauggagguaauauggagcuaauauguauacaaaacacuuacuuagucuagaaccuuguagcucgauaaauggcuguguuuagcaucugguggaacacauuguccuuaauuuuacugugugauauugugcaguuuaaaaucauguuugccuuaccucucuauccuuagggagagcugcuugauauugucuuguugguauuccuuggcguaaauguuuugaggaaauuucagacacuuauaucccaaauuaaugggauucuuggcauccucucucccuuuuaauguugcacugauguggaauuaaucucucuauuuaggugguuugucuuugcuacaaauauuaaauaaucaagucaacaucuuuauauauuuaaaucuaccauuugguuauuuagaaaggcaacuauucaauuccauaauuacagccacuuaaaucaaagucuacuaauuagauaacauagcugggcuuuacagguauuauagaauauucuuuaccagacacuauauuacaagcaaucauuagcucagcuauaaaaggguuuaaauacuaaugguuuuuuuuaauuuguuuuauaaccuaaacaagcaaucaauguacauuaauaagcauaauuguuuuuuuggcaucuguccauucauuugguccaccuugacagcucuagcaaaugugucagcaaaacucaguacacacaguacacaaguaggaaucaccagugacaucuucucaaauacauauuaugcauuaaauuauuuugauauugaaagauuaaaaccucugcaguguccaugaaaucccuuuuacauacauuccagacaaagacugugacagguacuucuaccucaaacaugacaucgaaguggccauaaaacaagccuuaaugaggcgauaaauguguuuaccuuugauuaggugagcuucuugauaagauaacauggagaagcacuuuccaagaguaaauauguacagaaauugcuggccacuacuguucuguugagauuccacaugcaacagaaacaccucacuuguccaacucaccuuuccgccagcuaauuuggcuuuggcaauggaaagaguagcucguauaagaaaucuuuaccccguuuguagaccccaacaguucucagaaaacccuuuccuggauucuaaacucugugcuauuauacaacucaaucauaacucuuuauauguuguaguguaacuguuuucuuauuugucuguuccucaguaaacuaugagcacugagauuuuacuucccucauguuugucuccuccaaagcuaggauggugccugguccaugguggacaguaacuggucuguuuugaaugcaugaauuuucaucguaguuuuugugauuguguuuaugaagacacuggagcaacaauguucugcaauucuagagaucuugaugugguggcagccuuguauccaguccuauguauguacauuuugauaucuuacugccuuuugccaaauagggcaauaaacaccccccaagagcgcuauccaaucauauacucuguauuuguuucaggugagcuuccugcagggcaacuuuggcauauucucagcaaacacagaguuguuggauuucacauaaggagacuguuaucauuugguccuugacaacuuucauaaacagucacucuuagcuuaacaagcaaguguguaacaguuaaaauuggaagaaaaauaaggccaaaauggcagcuuacuacacaacuugcaugcauucuaaaauaaaggaaauaugaauaaaagguaacuuauucagugucacucguacauauuuauaguuuaaaaauuagucaaaguuuauguccugagguuguaccuacaggaagccagaugugccuucugcacgugaccuaagacaggccuagagcaacuacuagauaauuucucgcucauccucuacaccgucgauugcggcggcuuucugaggugagagaaacugacagcacuaacucuccagggcagaacuuuccagucaaguggaucaacggacugaaaaucucuuaugaauagucauuaggccuucacuacaaaccccucaaaacccaguucucuuuucgcaaccaaaugccuuuugucaucuucacaaggugcaucauuuaauuaccaauugauuucuuuauauaugacaacaugucagauagcaaaauacaguguaucucccuuaggggggaaaagucuguuaacuaucacuaugccagauuauggaauuaucugaaaaauaggcaucgugcauacuguuucuucauuuucacuacuuuuucuaacgucagaguuucuuuuuguugagaaaagccaauaaaagaaaaagaagaaaaaagcuaaugagaaucaugauggaguccucccauacccugaaacacuuuucaaauuagugagaacacauuuuaagcuuucuuuauaugaaaaacgaauacucaacaacauauagggaauauagagugaauuccaaaaugcaacuauauagagaacuaccauggcccaucuuucuacauaaaaaaaugucaaacaauuguucucauuauaccaagaauuuacucagcuucugacuuagcuaaugcacugaaucuuccgcugugcaacugcagccugauaaucaagucaguacuguauuaauaagcugaauaauaagggaauuucaaaaauguacaggacuauuauaccguaacaauaaaaccucaaacggaguaaaccagggcagugcugaagguaggcgucagaaaauaaugaaaccaguguugcagcaaugcacuccauugugugguaguguaaaugccugcuucuuucauacacagaagccacauuacaugaguccgaaauguucucagagcgucacugugacugguugugcuagaaccuggcaccgacaggcacugaaagcugacauuaugcuguaggaugugcugcaggugugcaggccugggaacgugcucuaauuacauauuuuccugccgcgcaacaauuaaggucgccaaaauaauugccaguuucuuaaucccucccuaacaagacugacauaaggaaugguuuauuuuucucugguuguuuugaaaguguuccucaagauuuugguuuucuauggaacugcauaaaacuaauucuuauguucagaugugugauuauacccauuguuaaauaaaaaaaaaaaggccugucuuugaauugugguaaaacuaaaauaauuuuuaaaaugugaauuguauaaccugguaggugguuuaaacauuuuuccucuuaaagaagguaaauuuugccuuuaaaacccuacguuucuacucucugaacugcucaaaucauguggaauguuaaaaugggcugggaaaaaaagcagaccacaugaaaacauagaccaaauaggugucuucacuuauagcaaugauucuucaccuuuuuggaggcggauaguggggagacauagagccuuuuaagaaucugcuuaaacguauggacccacugcccaggaaaaaaaugcaucaauauacuaaauguuacauacaauuucuggugguuugcagagucuuuaaaaaauccauuaaugaauuccagggaaagaaucccagucaacuaauaaauauugcaauuauugacacacucuccuucauucauccacuucugcauucucugagccaucugaccaccauaugaagcauacaguaucuaccacaggcaucaggaaccaaguuugugggauuuauauucacaacuaaaacccauuucuuucauuauuauuaguugucaauuucccacuuugguugugcuaauugggcagagcugaaucacucagagaauucugagccagcuuacucagucuugcccccuuuccuacaaaucagaagauagcaaugcgugcugauugaguacuuagcagacaaacugaaguuaugucaagcgcauuacgauuuaacacaggcugaaugguaggggcagcagauguaacuaaugggguuagggagagaagaaacuggagcagugagagaggggauggaagggaaacaaaagugauuguaucgguaauagagacuucaaaggggaguaguuuggaagaucuggguuggggggaucuggcaaauggaaaaagaggcacaucugccuauagaguaacugauagaggagacaggaagagccugccgggagagaaagcagagugggaaaucaaaggcaagaaaauguauagcugcagaagaagggaagcucgauuccauuuauagagguaaugacacaaggccuccuacaguuggaacugucccaaauuggccuguuuugagugucccauccaugacuuguugcuaaguuggacacaaaaagcaaacuuuaauaauuugauaaaaccauuucaucuugauguuugaaaaauccuuucauuacaagaauagugggugauuuaaauauuaccuguuccucuuuccaguuuuucuuaugugucugaugcuuaaggacaauguuuggucaaaaaacugaggucucaugauagacaacucaaaugugaguuuuauggauacaaguaaggaacaggcaugccauuuccuuuuuuuaggagaugcuuugauucuugaagggguggacagucgaauuccaacgauggaguuagcacaugugugugugcauguguguguacaugcacacacauguuugcguguauuacaguacaacagggggugaggacagaagggcaaagaccaaauucuuaaaguggcuuugaggcaugcaggggucagaaaugggcugugcugcuaaaacucagagcauauucugggaugcuguuucuaccaccaguggcucauuccuguucauuauucacaugcuacaugccacucagguguuuuuuuaaggccagcucaagcauguccuuucugaccuguucagggagggaaacucuuaguuccuccuuguacauauaucaaaucgaggacuuaccuugaucaucccucaauucauucuaucagucacucaacaaacauuucuugaauacucacaaugugucacacucuuacccuugccaagcaguucuuucugacacuaaucuguaaggcucugugaggacucacuuuugaaccuuuggugcuggcacaugguaaguagcuaauauuugucaaauacaauaaaugaauugagugacuauaaaauagcuucccaaacaaaucaaaggcaggcuuauaguaaaauguuucaaaauaguuguaagguuuuuuaaaaaugauuuuucuauacagaaguacacuuauuaguaaaauaaauuuuuaaaacauugcaguucaguucuugguuuagucacaaucauaguacuacugguagcuuucuccuggucacggccaauucaccaacuaacacacugccuucguagagcacgcaaagauguauccagcuucauuuuugacugauauaaauaccaucagccaguacugagcauugcacacacugaucugagugcuacagacucccaauuagucacuauucauacaauucuacaccuagcccauaacaggcuuuuuuucccuuaacccaauuuccuugaccuguguuuuccuucuaaccagaguucagagacaaaggcagagcaguaaaucauuuucuuagaaaaacaccaucaggcugcuuuaguccuuugggcuguuauuuauaugcuguaccugaaaaaguuauuuugggauaguguagcucacuaaauuauauuuuccucauuaucauuauuacuucaaaaugaucauuaauuugcucuuuggcuuucuaagagggaaaacaucaaagaaacaagaguucccccuaauuuaacuuuucuugaaagguaacugauuuacaaacaaauuacuugugccuuuuaaggaagagccaagugcaucugcucauuugauacauuuucaaggguuacaguguggaaaugaagcucuaagaagcuccugugugauccacaaacaacuucacgcuguauuacacgugcaucagauacagagaccaaacccucugaguugcaagcaaccugugaugcagaaugcuugcuuggcagugccugaaacagcuuauuuaaauugcaaacuuugcagucaccacuuacaggugauuuugaaaguucauuauauaaacuaaacagcuuaaucuccauacuuuguuuuuaaaaucauacauauauuaucucugaaagaugcuauuuaaucucucucucucaaaaacucaucaacucuguuaagaaauugccuuagagaguaaaaauguauuuaaaacacgcaugaaucuuaaacaaauguuucaacuugagggcaaauaauguuagagacacagguaggaauugccaggaugaaguuugccuugaauagagaucacaugagaaaaaauuugaagucauaacuuuauaguacaagaugaucaaagccaaguauuaauacuuuuuuaucagcucaccuucuaaacaauauuucaguagauuuccuuucacacagugauauuuguaauaaauguucugccuuuguuuuaaagucagucuguagaaagaugacaucagcuuagcaaacaauaaagugccuguaauauugucuccagagggcuguuacauuuacuuuguagcaguaaaauucaauuuucaaaaaacacuacaugaaugauguuagguuauuaacccuaucaccaccguaaaacaucauuauugugugcagaauguaggucacuaucuagaagccauaaguugcuuuuuuguuaaauaauccacuuaagcuucuuuucuuuccuagagccuggguugugucccuucuuuugggaaaaaaauauuccagcaucuagucagcagacuggaacaagaccccuacacuuuucauucuaaggcucucuuucuuuguugccauucaguuauguaccccaguucugaaguaacccuuugcauuuacuuauuaccaaagccuguuguucuucaaugaaaaauuaguauaucaucauguuuuuucaaguggcagagucauaacucucacauguuucgguucuaggacaaaaagaaaauaaggaugugucucauugcaaagccugaaucacucucacauuugaagaccuugaacacaaaugcuuuauuucuggaccuuaauauguuucacuugcuaugccugcauaacagcgguaguuaccugauauaagugauuaaaauccuuccuguuuagaaagaagaagaauauuuagcgacaggacaucagcaugcaaagaguuaacuaguuaaacuucuacaaacccccagaguaacuuuccaaaagcugacaauaaguaaaagaagugcugguuauccauuuuuuaaagggaugggauugguuuuagaagaaagggaaagaggaucaaacaccucaaugcaacaaaagguugugucagagggcccucaaucacaaaccuccuucaacaacagauauuccaaccuuccagagcaguuacccaggcagcacagcuaaaaaguuccaugacaugaaaagaacaaaaaccuaagggacagagguaguuauugucaugcacacucuucucucucucucucuuucuuuuuuuuuuuuggcuuggguuuuucccucccccacaaaacuuuugcauaagcuguuagagaaaaguaaugguguggcuuucuaaaaagaaauccccuauuuguaagccaccuccuagguagugagguagcccaguggacuuucuguaagaaacaccugguaaguggagagaucauuuacacgaauauuucaaaagagacaucuaaaauuaauaagcacaauuacagcccuguaaauguggucaacauucccuugaaaucacuuguguuuuuuuuuuuuaauugauguuauuuucuuuucagacaaauuuucuucagugcacaguggauauauguuauuugcauuuucuguguugggucuuagagguaucuuaacagcuuguaugaauuuuccaccaaaacguaaauuauuaacaagucagaguuuucauuuguuuuaucuccugaugugagaucuaaauaaguauguagaacacuuaaaauucuugccauuucucugcuuucugaaaaauaaaucucaugcauacugcacaauauauguucuuaugcauaacauguuuccauuuaaugggaaaaaaaaacuaauuucaggaggaauacuguauguuuccuggacacuucguuuuauaagcagaguauuaacccaaagaagcauuuggucauguuuucuucaucaucaucaucaucaucaucaucaucauaucaucaucauucuuaucauaauguucuuuauaaucauccucaaaaagcauuuaaagucuucaucuuuaccugguuugauauuagguaucuucgauuaacuuugcccugauuucuaagacauaaacuacuguuagaaccagauuuuuaaaacccaguuaugugguccucaaaauuuacaugcaaggauaauauggcauacagcaugauggugauugaagcggggugugauuggggaguccuaugagauaugauaauaauacuaauagcaaacauguuaacagugcuuacugugugccagcagugcucuaaauaaaugaucuuauuacucaucacaacaauccauuuuacagaugaggaagcugaggugaagugcugucagguaacugcccaaugucauagguagcaagugguggaaauggaaguuuugaaccugggcgugcucacaaagaggacacuuugcuacaucagaaaggaagcacggauggacuaccgaaagaaagugucagaaucugcccuugagugguguguaccaggaacauguauaccaugagaagaguuucugaagaagugugagaacgauaaaaaaagaaguaccagaagagcuuaccuccaaaaagaaagaaaaaaagauuggaacaauuaggagguagcuggaugaagaggugacauguaugaagugaacauuagaagccaguccagagagcagcuggcagucucaauggagcucagagagaaugaauggaccaaaaacauagacaagagaaaaaaaaauuugucaguguuauuaaauaaaguaagcuggaauuugauaugugaauguggugggagaggggaaagaaggcugcaaaguccccaugggccaaggccaaagccuagacuaagaccacaacuaugagaauggaaaggaaagggguggauucaggaaacauuggcaaagaaaaaguagcaacgguugguaacagacugguuguggggagugagaaagacagcagugagacaaaaauaaccaugggguuccugguugggagguccacgauagggugguauuucccacugcaauggaaaacuaggcagauagggaaaaugaguaguuuuaugucaugguauugaauuugccaaagccagugucauuaaguuuugaggucucuugugggaagagugcuaugugguccuaaaacguggcuggcuuaacuggugcauaccuugauucuuuuuuugguagagacagggucccacuauguugcucaggcuggucuuaaauucuugggcucaagccauccuaccacccuggccucccaaagugcugggauugcaggcauguacaauagaggucaguagucuaguagcugaaauagcaagcaagaggcugucaggugugcaggaaucugaugaggcggcauggauaagggacugcuagagaacaggaugugcacaugaggaaugccaagaagaugaucuagaagcagagguguaggguuguuacagaggugcagggaaauugaacauguagcguggaggagagugaaguggccgaagaaaauacuucaggcuaagucauggugaaugccucacacccaggcuuuaucuacuuuggguauaacagcagaccaauucaugguuuaaauucaaggcaaggacauuuucuuuaaaaaauaagauguacguaugcaaaguaauguagcaucagucuuucgcuuucuggggucaauuauuugucuaaugauucauccgguuuucucaaguacuguuucuaggagagcagaguuuauagagaauuuaaagaaaguuuucuccagugucuaauccugggucaucguuugcaaauacacaggcucauuaauuggccuuguccgggcaguccugagcagcgccccuccugaagacagcacugaggaaagaaggguauuauuucagcugggagaggagcagagcccugggaugagacugauugauucagaccagauggauggccucacauaggugugacaaaaauaguaacacauugcagacauuccaggaacuguccucuucuccuggccuggaggugggucgccuguguugucuccuuaucuaccucuuaugugcuuccgaaucaaagaaugucaaugaugcuaacucuuuuccauguuagcaccuggucacaaggcaucagacuugaaguuccauuaaaaaagucuaaugaccauugcccaaguuucccuguagguaaagccaaagcaaaucauuuugccuacugccuaaauauguuguuauuguuucaauuuccucuugcacaugaagaguucuaaggugucagaaacugaucucugcuacccuagaagagaaggguacauuaauaaaugauaccaguguuguaaucauugauuauaacuuaauucacgggucuuaaaagaguacuacguaauaacugaggauucugaucugguuauaggcacuuuaacccuaaauugucugagccugaggacucucuauuaaaaagagauaggaccuuacauuagaucaucaccauccauaaccaugaccauucauucauuacccucguuauuauuugauguuuaagauuucuuuuugaguauuucgguucucauuucaauacauuaguaaauuuugacuuuauaaacuaagguaaggguuuauuaacuugauaacauuggaagaaagaaauauaacauuuuuauuuauuacaagaauuacuuucuuacuugaaaggaaacucaacaagcaugggaaauuuucugucauucaaagcugaagugcagaaauuaugcacaaauuugaauguuuaucaaaauuaaaggaaacuccaaaagcuuuuuguaagauaauauaaaaccuagagaaauggugagcauuuaauaacaacccagugacauuucaacaaguaugggagaggcuuugucauaauaaaaguaugguuuucucacucucuaccucaaauguccugcccuguuuugucccagcaugaaguuuuaguuuaugcguucucacauaggccugaaacuguuaucuacuuguuauaaaccaucucagauuucacugcuguggguuaaucuguagguucugauugacauccuugacugucucucacacucacuaugcagcucacauguaacugccaccugaagggcaagguugacuauuguuuucacuuugaucucuauucgcaacuaaaaaaguaauuccuuagauauaauugugaaccuauuacacauggaagaaauuauuauucaaguuuaaaagccauauauauacauauacauaugugcguguauauauauauguauguauauaugucauuuuucuuuccacaauauugcuggcacauugcugucaggacacccaucuggaauuaagauuccacagcagacuuuucucauagaaguauuuauucauuauugcaugucauaauuccuagaaguaauguacuacugauagcucuugaauuugcucugccaguagacugccuccuuaaaaaaaauuauuccugugcagguggagauuagcauaugaaaaaugcuuuuaauuuguccacucuuggacuuaccuaucugucaaacccauacaugugacagcuguuggauucaacuuaucucuaccaccucaguagcagguuuuaaauaguccaggggcuguuaauuauuuguaagcugaguuuauuuaacucgcuuucucaaaaacaaaccaaauaaaauaaauagacaccaaacuguugguuccguuucugaauaucagaaacaaagaugaucauguccaaggaucuguaaaaaccuacuuccuucugacauaaggaaauaaaacagccagugcaaacuguuucuugauaucuacuucucgagaucuggugguucuuucaguguggaacuuaguuuacuuacugcuccuguguacuaauauuuuacacuggcuauuuuuucuacuacuuaucuuuuuuuuuucuugcgaaauuuaaccugccuaauuuuguaguucucauuugcgccauuugauuucugcaaaccacagcaccaaaggcuucagggaauuaaucgaaaugagaugccccaauggugguauggcuguggaucuauuauggcuucaugcuucacuaaaugacaggauucccacagggcaguaccuaucaugaagugggccucaagggguuaacaugggcugagucucaaaauagacuugaagcucagcacaccuacucacuuaaaaagaaugagcaguaaauaugugcaugcaaauucaauuucaaaggacacuuaagugaugguggaaagguagaaugcucuuucucaucauucaaacuagaagaucaggaacacugggcaccuugcacucuucaaagggacuagcugagggcagcaccugaaacaacuuuucccuaccaccuacagccaugagauuggaacaggaagaaacuucucauaggaaaauaaacuagcucaggcuucucacaaauuagcuuacuucucuauauuuuuauuguuucacuaaguuccuggguguucagcuuuugcaauucagaagaugcucccaaaguucuacaauuuuauguacugaaaauaaacauuccuuacuauguuaaucagaugcccuaaugaaugggcaggcauggggguuccauguuucauguaucacuugcugauuucgcacugccuugacaucaucaaaauccuccuguuuugaacagugaguggacaacagccaaaugcaacuuucaaacuuaaucuauucugaucauuuaaaaacauucauggggcaaugaaacaaaauuuauauauuaucuauuaucucaaauaaauauuguucuuaauaauaaacugucugguagauguaugaaaccuguucacucuccuauugauguuuuacuggcaauaagagcugaggcccuacccuauuuuaaauuuaacucuaugaaaaugggcacuacccaagaaaaugcuagcacaauuccagauaaaauauaauguugugaggcugaaaagugcaugcaaagcaagcugcauuauuagaauguuuaaauauuaauuauaccacuguauaguaaagaugaucaaguaugagugucaacuaauuuucuaaaagcugcaacauuuacuuucaucuaaacuuccuuuguuaaaaguaaaacuaaaagcccagcaaguuuagucuacuugaguguguuuauuuuuauugguuucugcauaauuuuuuuucuaccauaaaccaacuuuaaccccuuuacuguaaucucugccaguauaacuccaacagcacaucauaaaauuccuauaauucuucaaagccacgaaguuggaaaggaaaagcuuggguacuuuguaacaaacaccagcuauaagcuucagccaguuacauuuaacucuuacaaacccucuuuuuguguguguggauaaacuuacagauugaugcucuauggucacuuucauuuccauuguaaguauucuucagcuacuuuugaguuugaagccugcuccauuucgugugaauaccgugguggagguagcaccuagcucuaauagcucaggaugcugggcugacagauggggagacagauguacagaaccauguaaaaugagagagacuuauuaccuuacaaggaagccuuugcugauggagaugaggaggccugaaaagugggcauuuccaauaaucucuggugaugaagggguuaagcggaaucacugucacuuucccugucucuuuuccuagaaucuauugcuuuuuuuuaaugcuuaaaacaacuacuagaaucaggcaggaacauucuuagguagagacaaaggaagagcaugugugugaaggagacgcucggguuucaucccgucacccauggaugcccagccaggguuucccaccugagacagauugcgacacauguucggcucacucaugcacaagaagcaauacacaaguucaguguaaagccacuuuaaaagcucaucgggugcauacuuuacuuguacaaaauaccuuauucaugacggagcagugagggccuagguaauuacuugaaucaagguggccucagaaguguuuaaaucuacaaggacacuuagagcaugaauaaugcaaaauaauuugcaucuaaauuuuuuaaguguucuuuauucaaaaacuaaaaugcaguuccgauuaaaguuugaugagugaaagcugagcacuucguacccacugugaaaugucucuuauguggaaauuauuucagacaguggugaagggacaaaagaguuguauauguguguguaugcguguguguuaaaaucuaaauugugauuaaguugcacuucuaagccuaacuuucuuuagguuuugugguggcuaccaaguuaauuccugagcuugcuuaucagguacaaguccaaauuucaauccagcccuuuaggaaacacaaugaaaacacuuucuuagguccaguaauuugccaaacaaaauagcauuuguauucaacgccaaugcaaugaaacuuucuuuuucucucaccuacauuuuuaaauucaaauuauucuuucuuugaaaucauuagaugcaaaauaucuaugcucucuguuacugcuaaagcuuagaacacucuauuucauuuccuugauauuauauuuauacuccugugugaauauacauuaucuacuaugucacugggaaaucuuuaguguaaagcuaagaaguaucaauauguuagcccauguuuuuaugaaaacaagauugaaaagcuaaaaaucaauugaagaacccaaaggcaacuuugcuacaguaacguauaaaaauguuuaucauuaccuuugaauaacuuuucuucaucugguuuucuaaaguaaaacauauuaaagauuauuccaaaugagugcuacaauaaaaucaaacgucauuuccaacuuauacguguuuuugucagggauugaaaaacaaaguaaaucauaguuuaaaaauaauuuuuacuuuucuuuugcuaaauuuuuaugaucuauuaccacuugggcugcauuaccauuccuggaauuucacaaugcuugcauuucauuugaacuugugaguauuugagaaaccacaauucaagaaacugccauuguuuccccggauucuuuugccauguguuaagagagugcuccuggcccuucucuucuaccugagauaccaguaaagcucaauuagaaacuaggccuuucuugucuaguucacaggcaccccucacggcuguguggagguggccugcuggaaugcagggagaaaaggcugugcggguccugccaggcuagcaauaggcuugaccuugcaagugaauuuucaagguaggccacacugcaauccgcagcaccuaaacuuuaaaggcccuugcaaagggaaauuauucuccugcuguagcccuuauaaagacucccaauuuauggcaugcuccaaagcaggcuucugcuuuauuggaauuuuagaugaguguguuugccauacucuuagugaguguguaugcuacuuuuuuuugggggggggggcgggggguggacuuugaacaaugaaaacauuuuuaaacucauugaacaaagauuuccccagcaacagacccccugcucagcaggucaccuaucuuugcgacaguuuuucuuuucccacgcuaaccccagggcucauuugcauaaggucucuguugugacaauuaguuucaggugagcugauuucuaugcagcuugcccaagacgaugcacaagccccgggccucccugauccugguccuaauugcgacugacuggcaccagacacaaucauccucuugauucagcaaauuguccugcuaguagcuuguugugaccccgcaaagcacaaaucauaucaugucaguccagucuaguaaacaacgaauaaaauacacucugaaugagcaugauaauaucuuuuccguauuuuaggcauaguugacuaaauaaaugcaaaugaaagcaauagucuuuuauuugauuugauuucugcuugggagugauauuauggcuccccauaaaaacuuuuuagaaaauaggacggcccccauauuuaaauuccaugguuccauagccccaucaccugggagaaauuccccagguaaaauaacuggcuccuuucaaauuucucuuagcuuuguuguuguggaaauaaguaauaugcucuuucaucaucugugaagcuacaggguacaucaauaugcacauuagcaggguucccaguagucccuacuagacagaaaagcauuuggagccaaugaaauuucacaucucugcauagcaacccaaguuaggaaagaacuuuucuuaacucuaggaagcaagugggaaacaaagaugagugacuuagcauuacaagaauguuuaaggacaauuguucuuaaaauguugcuuggcccuacucuguuugcaauucuuaacuuagcucuauuacgcuauaaguggcagcucccuuauaaauucuuucugcccugauaggaaugcugucugccauccugucaccuuacuuagccaccuaccugucaucucuauuuucucucuauacuaaaaguuaaaaaaaaaaaaaagaaaaaaaaggacaaggcuaauaaauguucccaaagcuauuuggcuaguuucccuacucauauaaaauaggcaaugucacuacugugauaguuuguuucuuuuuuuaaaggugauugcauguaagcaucugcuuucacgauaugaaagauacagucauucacauacucucuagaaguagaaaagauuuucauacagauagcugcuuuugagaauuuuuguaucuugcuucaaucuguuuuuuucuaauaauuauagcauuauuuguuaguaccacaauacauugauuuuguuuuucuuuccuggcaucuacaccuuugaguugaagaucuuagacaaaggccagcauuuauagaggaaaagagaagaaagaggagaaacgaagaggaaagaaaggaaggaggaaaagauuaaauuuauuauugaagagaacuaauugcuucaggcgcuuaugaaaaaauguuugcauuuguggcagagggauugucuaccaccuucaguaaauuaauccucuaugugcccugaccucaagugugccccggguuacacagcccacuccggagggcugcaugcuguauguggcccgagcacauggcccgggugugacugaaaguacacaauucucauuuccuccuguuucuugugccuguuaugacuuuuaaccccauuuuuauagcaacauggaaauuguauuucuaaagccauuauauuaacucaauugaaaagguagacuagaaauaguuggggaagggagacuucuaaauucuagagccccaagggguacacuuuuagaacauucagggcaaggaaguauuuuaaucuagauaaaugaguauacacagcaucaagguaaagaauuauugaggagucuacacaucuuaauuacaaaauagaaucuacaaaaaauuuuugaugugaaaaaucuguaaaucaaacuuuuugaaaacucaagagaucuucaguauaagcaauauaaauuaauaucuagaguauguuuugccauaaaugugugcacgaguuacuuuauaugcauuaugaauuuguugaaagaacaauuucaaaacugaugauuaccucuggccucauucucacaugccacuauagugcgucacccuucagacagauaaccaucaaguuuaccuccccuuuugaaacauuucuaaaguaaaaaauugcucauccuuguacuuuuccaugugaauuuauuauaauaguguuauagaaaaaugagaaauaagggagaggauccgguuuuagaaaagggacgccaauacccauaugcuuaaaugaauaauuccaacagaaugccucauuccuuucaaugcuguacgcuccauaacuuugauuugcuguuuucucuuuccccuaguuuucccccuucuccccguucauuuucucuuuuugcagaauguaaccucuugcuuucucaccuugcugggguggguucccuccaaauacaucuuaagguuucuuuuuauuugcagguucccugaagaauagcuucuccgucuucaucacugcagugugcggcggucccagucaugaucuucccugacgcauuucauuuuucaccuccaccuaccauagguucucaucucauucuacuuuccacccaugccuucuuuccuuuuaauaucauuucuccuccucuccauugacauccaaagauuucucuuacuaauuuuuauucuuucguucuaaccauguuaauuuccuuucucauaauccaaauguguugagccugucgucaugggguguugugaugaaaauuuacuuuccucucaaugucugaaucccuuaaaacaucccuuucaauguuucacauuuaccaucauccucucucaagucuuugcucagauuucuggccugcagguuuuucuuccacacuuccuaguuguuacuuccucuccaguguuucccauuucucuccuaccucuguccuaaaaguuuucacuucuuaaauuacuacggagucuucuugcuguuuauuucucuuuauauuucugauauuucuuuuuuuuuucaacgguucuaucuucuaccuuuuuacuuuuacaguuagacucuucccucaccaccuuauuuuuccagaaaccucuaccugccuguuuuaugacuuuuuauugccccuccuccauuugucuauaucauuauuccuugcacuaugcuuccauggauugugcuuuuauauauggagggugcuuuuaaauaucuguuagcuucccuuaauaaaaauccagcauucacuuaagaauagcuaccaaaaaagauucuucauucaacuuagaaaacauugagacaauucaugagacaauucccauuuaaccucucaauucuuguucaugacagagagagagaaaaagucaguguuuagguaagacacacacacacacacacacacacacacacacacacacacacacacauacccuaagacacuggaagcauacugauggcauggaaaacauuaaauauggagccaaaagcuguagauuugaaucccggcucuuuuucacauuaagcaaguaauaggucaauuuuccaauagucauccaacuuuucugggucucagacuccucauuuguauuaaaugucuucucugucuagcuccuacaauuguuguaaagaucaaaugagauauuuuugucaaugcaccuuguacaauauuaaacacucuauaaccaugagucgcaaauguuaccuuuuguguuuaaaguggauacauuuggaaacaugauuuacaaaaauauaacuuuuaaaaucaauguaguuccuuuacuuuugaagaagaucaaacaguucccaggccaauauaauuuguuugcaauuacaugaacagaaaaaguucaugaucucaauauuuaugaagauguuaguuuagagugggagaugugaaaaaauguuaacugaagggccuuguauuauuugauuuggguuuuaaagaaucuacuuuuggauaauuugcaaaauacacaguucgcuguguagguaauagugagucaggagccaaaccaucuuucuuguaacuaccucaaaggcuaucuuugcugaacuauuccugccucccauuaucaaauuucaaagucagcauuuguucuaaauggggcugauuuauuuggccuaagauaguuccaacuuuuaccugaugcugauuguauaaacaaauaccuuagcauucugccgugaauauagaaaccacuauggauuaaguauauuucuuauggucaagcaaaucauauuuggaauucuaaaacuagagcuucaaaggagucuuggagagaauuggggucccacacucaaaugucuacacaggccaagcaggugagggaaguugauugauuuuucuuacggaacucaaaguuguucccacauggucuuuccaugcagcuaugugggcccgaaacaccagaucaucugaguucuccaggggagcuggaaaucuggauuugugugugugugugugugugugugugugaaauagcccaauuuuuaaauauuggcaaccaauucaaauguguuuaaaauacugugugggacaaaucaaacaucugucagccaccaguuugcaaucucuguccagucccugcauuuuaucauuaggaaugugaggcccagagagguuaaggauguguccaaggccaugcugagauuggaaggcagggcugggugggccaggagcccaaauuuccugaaucaaauguguaggacucuucuuguuauacugagucaugaucccagaucuucacagaucggucagcccacucugauggaaacuaguggaagacacauggccuaaucaggaauggcuucuucuguauuucucccacccaaaccuuuuccuauuugccauggccacugcuugugaagcuaaagguggugaaggcagacacaggcaauggggccaggagcauaugccuuucaauuccuuccuggcaaccuuccugucuucuccuccacugacucuucccucucaucacccucucuauggugccaaaauaggcuuaguggaaugcgacugaagugggaacccacuuauugccaggggaaugucaguacacgguggaacauuuccugaacucucugcccagccuguacagaaauuaugaagaaaaaaaaaagcaacugucaaaaaacacaggagcaguaaaaccaaagaacguggaguucagaacaugcagcuccauaagucuaaaaacucaccacccgggcauacugaauuuucugguccugggucccuucacucuuggcauacauggcaauuauaaccuggcccuucagaguaaagagucacuuagcaugaaaauaagacuauggaucuuggggccacaauaucaaaaccaauaaaaauaauuaacauacaaaacugcaucuugucccugauuuggagucaaaaggcugguauucaaauccugguucugucaguucuguuucaauuucuacccaaugggaaaagucuguggaugaguauaguugaaauccugguuccuuccaaguucuaaaauuacaugaaugcucucuagggaaaaugauuuagaaaauuaaauauaaaugccagauuaugcaaugauuuuaaaauagaaaaggauguauagguaaaugcuaauuaguauuaucauuuaauuccaaaaaucaaaauuuuuagaaauuuggguugggauauuuuuuauagaagcaaaaaaucugcagggauucuuuuaaaaaauauauuugggcuagaugaaauauguguccucacuuaccuaugcuaguguuuggaugagcagaaacauuuacauacuuggaaaacuaaggaguuggggaguuauuucuuuaugccauaaacuguuucacgaagccauaacaucagccaucuaaugcugccuucucucuuccuuuucuuuuauuucuuuauuuauuuuugcaucagagucucacgcugucaccugagcuggggugcaacggcaugaucucggcucacugcaaccuucgccucuggguucaagcuguucuccugccucagccucccaaguagcuaggauuacaggcacucgccaccacgcccggcuaauuuuuguauuuuuaguagauacgggguuucaccauguuggccagacuagucuccaacuccugaccucaggcaauccaccugucucggccucccaaagugcugggauuacaggugugagccacugcgccuggccucucucuuccuuuucuucuuagcuuaagaaaguaaaaaggaaucggugauuuuaaacccucuccuuggauauacaagauauuuuugaguuaguguuauuugccaaaaccucugcauuuuuaaggcuucaguguauuuuauaccaauagugacauauauuuuuaccuaugauaugagugauacucuagaugaauccagaagucugauugugaagugugaggugccuuaccugaguuuacaaaauuuuauauuuggcugaaaagcacucuugcaaacaaaaacaaacacaucuuuucuugaaaagauuccuucauuguauuuauaucucucuucugacuaaauuuuucaccuugaucacaaaaauguguauuucuacauuuuuuuggucgaccugaaaaaauagguaauucaacgaacauggagaaagaaaaugucaaauaagguacuagaagguuuuuuuuuuuuuuaaagaaagaauauaauguacuuaacuguauuuucauaaaauaaaagaauggucauucaaguggaacucggcaauuaauuuuauccucuccuuauuuccauguguauucuuuuuaaaacuaagacuaccuugaucaugguuuugauuacaaaucccgaaaacaauuauggaaaugaucuuuaauauaauaauauauuuuacugaaaugucucagcuuuuucauuccaacaacugaaacagagacaauucuuugcauguugaaauguguaauuaucauguauccaaaagggaggguguaauuuucacaucugauuacaagggaaggguguaagugaagcugccuggguaaacuuacacuuguuuacaaagagcaguaccuuugauauuaaaaacucaaaacaugcaaaacacugggaaaaaucaagauuaacaagcacaaaacuaaacaaaaaccuaagaauuuuucuuggccccauuacaaaaauaaagucaauucuucugaacugguauuggucuacauauuucugaugauuuuggggcucaaacauuauuuuauuuugcagguguauuggugaugguauuauuaaauguuaggaagcucaaacacuguacuuaauuugauaggaaacuucaaauccuuauuaugcauauaaacuuccgugaucaguuuaaacuagaaaaugauuuucauuucaauagaacacacuucucccaaauucaacaucauugcuugcaagauguacauuuuugauguuuuuaucucucugcuuuuuuuuuuaacuucugauuuaccuuugauaagaacaacuucugcucaugugaacuuaaguuuuggacaugcaggaagauaugcuaucaaggaaagccaguguugugaugguagcuaucacuuagcaagaagagauuaaagauagguacaaaggcacacaacagguaggaaaaagaaacugccccaacagccagcacauaucaggaacaauuuugaaugauauauacuuaugauugguaagugauugugguagauuuuugaaaagcuuaaaaagauugacacugaauauuaaguaugcuugccauaaaacaggcaaaaaaggagaaaaaaagaagagaaaaagggaaagguaaagaaauugauuuaggaauagaagauacaaacuuauucauacuaaaaggaauccacuaaaaauauucaguuaucuauuuaacuuuacaauuauauagaaagcaaugaauuuguuagaaagcuuacuagguuuucaaaugcaguaccaauggcaaagcugauuuugguauacuuuaaaaaucagguuggcuuuuguuuuuguuuuuuuguaauuugcuaaaacaaacuugacaaguaagaucucugaaaaagaauucaagcuaccaaaugauuaaaauuuaaggauaauuacgguaaaaaguuauucugugaaaaagaacuagggccugcauucuuuauuaccuaaagcauuucagcaauacucaaaguugaacuuuuauaaaaucuuagcuuuuuuucuuuauauaggauuucacugugagccuuacaugcuguuuuccauuaaaucaaaaagcaaaacaccugacaugaaucuccuuccccuucuaauucaauggggguaucugagcugcugucuccaugaacgggugggagaucacauggauguaucuaaagccaggggagcuuuggaggagaguggcaguuuccagguaguucagaggcccacccagcuucauauaucuguguccacagcauaccaaucaaugcuuagugcacagcacauuuuucacuguguuguuagaguacauuugcuuauauuuugcacaauuuuaauuuaaccauauugaucaaacugaacacucaauaagacccuaggcaccuuaggcuuauuaaaauuagucaacauggagcaagugagcuaaggaaguaauggaaacuguuuggagauuuaaauacaguggaacccacuuaaauaaauaccuguuaaugaaauaaaucuauuaaaugaauuuauuuucucugaaccaaaucaaaacacauagaguaauacucaaggggaccuuuaaaugaauacugcuuaaaugaauaagcaucuuaaauggacaugcuucucuugaaaggcaaacaguauuuucauguucucuaaguuuaauuaaaggaagaaaauccaugacuuuuuuuuuuggauguauugucauucuuuggaauuaagcaggaaaaguugcuuaaauaacacuuuaagugcuauaaauauuauuuuucuuaaggauaauugcucgugugugagugugugugugugugugugugugugugugugugaugggcauuggcucaugggagacaaacucuugaaacaacugagcucauccauuuguuaggcaucuuaccuacgguaaaugaaguuagaaaaacauuaaaguuucuaaagugccugccacaacccuaugagacagagaaauggacugguuacuuuuaacauauaguuuauuugccucuuuagaaaguguuguucuuucuccagcaugguugacuaaaagcaucaacucccuuaaucuaacgaugauuuguaauaagaggcuccuuugcacauacuggguacucaaaauaauguuuuuaaaaaggcaugaauguucuuuuuuauugugauaaaacauacaagaugaaaucuacucuauuauugcuaacuauggguguauuguuguucagcagaucucuagaauuuacacgagugcuauuuaacauaaaguuuauguugggccacaucuuuaacugaucagucccucuuuucucagaaggggugaccuauggugguauguuauuacaaugaaagaaaaaaugcagcacauguugaagucuuaaaguaauaauaucuuuuuaaauacagugggcacacaauccacagagauuuuuucagacccccuuuauuuaguguugccuuuagagggccuuguuuauucauguuucuuuuucuuuuuuuccucuggccuaauaaaacauauuagcucuuuucccuaagcaaaaacacuccuaucaugaaucaggcaacuagugggagacugcuggccagguuucaccccacuaaaauucuaaucuauacuuugucuuuuagaauuaaggagaaaaugcauaucagcagaaucuccucucuacuuuauuucauuuauaaauuacuagaaugaugcuauuauauauuauuaauuucugcuguucuccaacucugcugcagcagugagcugcggauguuggaacgguguaauuauguucuaguaggguagccauccguuuccuuucaaaaauuuacaggauucuuaaucacgcugcucauuugggugcgcagcagcgaggauggcgaaacacaaacagggcacguucguuuacauaggaacaccugcuuagcaugauagcagaugucagucaguaagcagaacacaaaaggaaaaaaaauaucaacaacagcaaacucgaaccauuuugauuuggugcaaggaaaucuuuucaggacugauggcaacaguggacauuccuucugaaacacaaacggaggcucugaaauucccaugucuuguuugugguuaacauguugucagagagaaaggcuguuuuugccucuuguugcuuucugguauucauucugacucucuuuauuauuugggggaauuacuaaaauuacccugccucaguuuccugaucaguaagcagacaauggguugggauauucuaauuaaacaccuaguucccugaaagugaugaucauuagaggcaaugcaaugguaagagcaugacucuccccagauauaguucaaaucccaccacugucacuuagugguugcaugacaucagucaaguuauuuaacuuugcuaagccacaguuuccugauuugucacaucugcugagaaaauuaaaugagauaauguauacaaaugccugccacauaauaaugauacaauaaaugggagcuguacuauuauuauuaauaucaccacugucauuuucauuauuauuuggauccucacagaaccuuuccuacucaacguauuauuuauuagaagucuagaaugacuaccaacagaaaucucuugcagagaucaugauaaaaugugguauuuuugaugugcagaguucuauaacguuauuauaaugacacuuacuacuaacacuacuguuauuuuacaguuagagauccugccaucauuucuacuacguuuucuaggauuuacaucugagccauaaaaaaguuuucuuggcuguacccugccuaaaaagagccucgaugaaagugaagugcuuucugcaacuuugacacaauaaaaugaagcuauggaaaggaaaaaaugacaaguucaucaucuuccuauguccacuccacccuuccacuuuucgcacucauuuuuuaagggcuuuucggacuauacugguauuucccauucucuuccuuuucccaaaaugguuaaaauucaaaauggaaaacagcuaucacacaugggcaaugacuaauuuuccuaaggaauuuuaguauucggaaugugucugcucgugcaggccucugcgauaaagccucccugaguaggcauugacuugauacccaauaauggcugcuaaggagccguuauguagugccgugucagugauccgugcguugaggacuccccgaguacgcauugacacgauagaccggaacagcucagaagaagcuguuauggucuaucaugccagugaugugcggauauuggcagggccucuggcccuucuguggaaaugauggagucucugaaggagcuggggugggcgccaugugggcgccaucaguugagccuagcagcagcuccauuuucccuuugccuuggguuuacuucagaagagucagcucggaaaaguuguccaauuacuucaguggucccaauauuacaccaccaaaacgugagcaaaagugaaagauauucuugccacuucgucuuucguuucuucucaagagaaaaaaaaaaaaaaaaacgaccuaauacuguuaaugaaaaaagggggcacaaaagugaagguaacaguuugucauguuuuuauaaguuucagauuauaaauauaucuuuucugcuuuaggaauuucaucauguacauguagauggugccgggcagacuuuuuguuguggugguggugauuuucagagauugaaacauuuaauccaugcaaagaaaacuaccuucuucauauguccucaguaguuaaauagguacucagaacucagcauauaggaaaugguucaaaaaaccuugggaagagaagugcaaguucaagaauaaaguuuggauucacacaugcuuuaccaacuuaaggcaguaauuaauucacuuaugguauuuacaugccccucuucagauacuuauggagaacaugggaauuuuaaauucacaauucagugcaagauuuaaaaugaucuucauuagaauuugaagcuauacucuaaacugcuuuauauacuaccaacagggagccucauuauguaguacuauauuuggacuaccuucuuuacauuuuguagcuguagauuuugaauguauuucugguaugcuuaagcagaaucaaacaaaguguuuuaaucaacucuauuaacuaaccaauccacacaguuguguggcaaacguauagucaagagaccuugugcuucuucuuuucugaugucuucaaaggaucgggggagaagagagaucugagauacccaagcacagaaugauagcaaaggauugcagaaacaccaaagugcuucacuaaaaaagaugaugggaacaaagaaaccgucagauuaagcggaaaauagcuaaaaugauugugauucuaaguacagaagguacuucugcaugcucauuuccuugaguagaaaauagcccaauuuucauaaugaaauuuggaacagggguaagauaucuacccaugguauguauuaaauguugauugacuuguugacgggcagaaggagcucacuaaaugccaacccaaagugaaugcucaagugacaaagaagaguggaggaaggggacagaacauuaaucaccuacuaugugcuuggcacuuuaccuguuaccaguauuucuucccaacugcccuauaacaugaguauuauuaugagaagcagagaugcaguuagacugaacaacuugcuacaggucuuauggcuuguaugaaaguagaaaccaaauuugagcccagauguccaaagccuacacucuuccgagcacccacacugccucucugccucccugacucccaagucucaaaggugucauugagaaaggcagagagccaguugauuuaaauacaaacuaaaaacaaaaacaaaaacaaaaagcaaacccacucaaguauucaaaauaacauagcugucacaaagugaauuucaaaaaguuauuaauauggugguagggaaucugacauaaaguuacccaaagcuuuuuucuacauaugauaauguauacugaaucuuuaauauacccgcuguauucauuauaccuuugcuuuaacgaaacaauuuuuguaugucauggccugagcugagaugggcaagacugcccucaagccauuuacacauuuguggggagacaaauaggaaucagauauuuuaagugcugugacaaaagucaucucagaauguauucuuuuuggaggagaugcuguuucuauaagaaaaaguaccauguauauuuccuggaaauguagagguagaauagcaugccaaucacuaugacuauuucuuuuuucuucuuuuuuuaaguacucuccaaagaguaaaaaaaaaaggaacgaauaucucaggcuacgguuauuguuuccucuuuucaagaauguuucagcaaggcccagaaacugaagugccuccaucguaggguuccuggcauccugauuagucacaccuugaaacagucauaaucagaauuuagugagcguuuucuaggcuccagacacugucuuuagaauuuuguguaauacucccaaagauucuauaaaacaaauacugcuccccauuuuuaagcauuaagaaccgaaguucagagugguuaagaaacgcacccaggggcacauggcauggagaguaaauggcagaaucagaauguggacacaaauuuguuugggucugaauccuguguucuuuucauuauaucgagugucuggccuccuuggggagggaggagaacugggcuccauuuguuacaagugaauagaucuagagauguuauuggagcaggagucugggugguggagauuggaacaugaaacagugaagcagcucgccuugcagccucuagcagacagcacaugcagaguauguggaccaauucauagcuucuaacuuucauccuuaguuguguaaccucuuugugauauuaaaauaguaucuuaaauucccaucccauucaccucucuuauggcugcuguccaaauccuauuauuuaggaacuuaauaauuuaaaauagcuuggucuuuuuagauugucaaaaacggccaggcgcaguggcucacgccuguaaucccagcacuuugggaggccgaggcgggcggaucacgaggucaggagaucgagaccguccuggcuaacacagugaaacccugucucuacuaaaaauacaaaaaauuagccgggcgugguugcaggcaccuguagucccagcuacucgggaggcugaggcaggagaauggccugaacccgggaggcggagcuugcagugagccgagaucgcgccacuccacuccagccugggcgacagagcgagacuccgucucaaaaaaaaaaaaaaaaaaaaaaaaauagauugucaaaaacucuaauaaaacaggaauauuucacacaugcacagacccaauucugugggacacccaaaggcuagcucuuaaacuauguccuaucaucagugaagagguaaaaucuagacuguugaaaagcacaaugcaaauaugaauuccaaugaauccuugacagugcaaccuaugugaaaaucacuauucugcuuauuaucuguaucuauuaauagacuucaauuguaaugauaaggcagacauuucaaucaaauuuuuagguugauaacugacauaauguuaaauuguuguucucuuuggacaauguaaauucauuucugaaaagguacacaucucuaaguucauuuccuuaaauucuagggccuuuaagaaagguagacaacguaggaauaugcagcuguaauuuuuuuuaaggcuacuguuccuuuaaugcccagcugguucugagauguaauaaaauugacauauugauuccuuugaauuuacaaaugccuguuucauaaacuccaucuccaaagccuaggcaucuuuagagcacugucauuuuuuuucuccaaauggaucaauuaugugcccacguaauccuguuaccugugaaauccaugcauacuucucccauuugcugcaguucccaggcggacaaacuugcauuauguacgcauaaacaaacagcgcauuuuccugauauuagagauuguuuucaaagugaaagacaaucucugggguccuuuacucagaaaaagaaaagaaagaaaaagcaaaaagaaaggaaaaaaugccuauuucuucaagaaguaaccucaguguauacacacacacauauacuaucucuugucuacauguguauuuauguugaccacucugaauauuucauuuaaaucacacaguuuugcuauguucgguccuugaacugcuccaagcaaggaaauucuucauuuuaguuaaacuagucuaugcagguuuaucacauuuuuuauugcuauuuuuucuccuuuguugauaacuaguuauuuaagggcaaaucauucccaagacaccuugaaacaauugagaaaugaaaacccagagugaacuggguuauaaaguuugcagcugucuuauggaaagaaaaaucuucaguauuuuucacugcagcacuugacacucuggcucugagucuuccuuaaacacacacagaguccuuuauuaaaacaauuguagaaaacaaaaagauucugcuucuacuacauuaggagggaaacgccucagugaacuaggaggccuuucccgugucuuaaaucagcaacagcaaauugucuucucauauaagcauguuuacauguucacauguagacacaccuaccaguacaaaaugcagaaagaaagcuuacgugcaaauauauacgccuagacuguggcuauagaauccccugaaaauaacccacaagcaaacaugcuuuugucuaugugugaacucucugugugagcaaaguacugugcauguucugcacagagauaugaauucuugcuucauucuuucagccugugcuguaucugauuuuccucacuucacugggcacccagcaguccaguuacacugcacuugcacucuacaauuugucucuaagagauuccccaaaucacaaaaugucuugucugcuguccaacgugcucccuauaugcagaaaagauggucugaaaaauuggguugugcuuagagcccuguggcuuggcccaccucugccauugugcaggagugguuuuaaagauaaauggcugcauguuaaccagauuugacaugcuguacaaaggcaggcaccuuuggucccaugacacagccaaacagaaaacacaacaagcaagccuggcaaagauguccgaccugaauaaaagcacaacaauuugucacauaguuguuacaaaauguuagcagcuuuaggacuugccaugggauggcagagauaaggcaguguggagaauuuagaaguuugagaauuggugagucuuaggcaauggaagaguuaaaucagaaaagggggaaaauagucaucgcaaaaggauuauuuucaucugcuuccucauaaggccgaggaaggccuuaaugucaugaauuagaucagcaagaacaguguuccaggguuuaccaaauuccacuguuuugaaggguuguauguuaacugucucuuuccaaacucucaaagauguagcacauucuaggauuaguuucuucaggaucaacaaccauuuuuuauuuucuuuuucaaacugacauaguaaugaaagaaaaaauaaauuuugaggaugaaacauccuuacaccccacuuagucucacuauucacucagagaaacagaaucaaacugccucacucuuuuucaaacgcuggguuuucuuuuccaaauguccuucuagucaaugaucauuauugccuguguugcuuguaauucuagaaauuccaugauuacaguaacauguaaccguagacuuucuuccugacuccaggcucaugcccuuucuaaaccuuaauuuccucaucaguaaaaauaguaugaaaauaauaguacccauuucacagcauuauuguuggggcgagaucagaugacauaggcaaaauucuuagcacgggucccagcacauuguuaaguacucaacaaauguuagaugauaauaucuuucguacaguugccagagacgugucacugaaacgcaaauauaauuaugucacucuucuauaaaacaugguucgcaagcucaccaucaccuauuuacuggauacaagccaaaaauaugggauaggacauucuucugcucccugaccaccuuugcagacucaaaucaagcccauccucuuugcucaugcccuguguuucagacaucucaguuggcugacaaugccugcgcuguucacccuuucuccuggcuuguacaugccauccucucagcccagcgugcugugcccucacuugcuggugaaauccauguuauaugacaacagucuccucaaaagucaccucugccaugaagugaccccucaccaccuucucccagaucuaguugugccauccucuguacucucucuguauuggguagaaaguucuuuguggcacuugccacauuuucaucauaucuuaaaugcacccccauuucccacuagacagcaagcuccucaggggcccaggcucuagcauccauuuuuugauccacagaccucagccagagccugcacauaguagguguguaauuaaugcaaaaugaacaaacacuguaguuuucugcugacauaccacaggaagaccuagaaaggaccugaugacauacuuuucaauuauuguacaaugagaaaauuuuucuuuuuuuacaauucaaagcucugaucacucucaggaauaaaggugaaagaagcccucaguagaaaaagaaaaugcgcauuuuucuuucaugaaucugauaacagcuucaaagaggugaugcuuguaauaauagcagaaugaacugaguuaagcucacauggcaaacuuugaaacaaaaaaggacuuaaaaaauaccaaucuagugcugggacaggcauguaguccaggccuuuucugacaaucuugaugacccuguaagaguacagagaugauacuugguggagggagcuuguauaaaaagacacugucauucucaacauauauauauauaugucauucucaacauauauauauauaugucauucucaacauauauauauaugucauucucaacauauauauuauauauuauauaauauauauuaauauuauauauuauauaauauauauuaauauuauauauuauauaauauauuaauauuauauauuauauaauauauuaauauuauauauuauauaauauauauuaauauuauauauuauauaauauauauuaauauuauauauuauauaauauauauuaauauuauauauuauauaauauauauuaauauuauauauuauauaauauacuauauauauauaugaaacauugguggcaucucacaaguaacuccacauugcccugcuaagcucauagggcacuacgaaccaaacguaaagagguaagauuucuacugcaaauauuucaagggguaggaagguccucgcgcucuauugacaucugugauucucuaacccuugugaccccuuguaaacucagaaccagugcagccuggagcacgucauaauaccuccuccaucccaccacucugcugaaauuugagccaagccccaugugguugcggaucuuauguucacagguccugaaggaaauccaggaagccauucuuugaugaagucugcacccacccucgcugaaagugaacugacugcuggaauaugaaaucgucaucaucacaguuagugggaggcaagagcuggugaaaggagagggaucauggaguuaacuggugaccuuucaguuuccuccauuuagaggucucauuuuauuucuacuuguaauauuaaaugggaaacagauuuaaauaugagagaaacgauggcaugccacuuggaacaaccagcugagcugucaccucuaaauugcacuuuucauuuguguccuaaaaaugaucaggaagggucaugagggaaggcccgaaacuaggccugaaaucagaggauagaaagauacucccagagaucccuugagcccaggaaucucagcugcugugagcuaggauggugccacugcacucuagucugaaccacagagugagacccugucucuaaaaaugaaugaaugaaugaauaaagaugacacucccagagauacaguauuucuuauuuuucaccuuucucccgaaaauguccguauuaccacaaaacauaacuucagagugaagugaaauuauugauuucugccugaaacagcaaaaaacacguagaauauuuuacaugagagaauuugaucaucagauugaucugccacaauuaaauaagcauauucuuaggaugagcuuuauauggagagaucauuuugcagaaugccaaacacagaagaggaugcuuaaaaagccccacaaagucucuuaacuccagugguaucaagccagauacucaaaccccauauucucaauucauuauuaaaauauuuuaaauucauauuguucagagggucagaauaagcacaugaaaguuaaauuucuuccauuaaaagauuuuaaaagucuagcgguuuaauaguaaaaauacagcguaaauagaaauaauuuuuaaccaguaucuaaucuauagaauccacucauuugccaauagaacgcuugaaauauaguaaguugauagcauaauguuuuguagaaaguugcaucuuuguugaaaggaaagaugacauugaaaaacaguuaauuucuguaaacgcuuuuucuagugauaacuuuauuaacugguuuuagauguuucuagauggaauaacaaaguuacgguucaagauucuaagaaaaauaucagccuuauuauaaauuuucuguuucuuucuuaaacuuuaaaaauuuaaucucaaguauuuauuggauugguuaauagucauucuguuuguaccaccuacaccauggacagauuuccccccaugucucuauuuuauugaugggagcauuucacagccaaccaaaucuccauuagucagaaguucagguguacaauuuugacccguguaacaauuuuaggcuugcaauuuguguuguuauauuucuuaaucuaggucuaaaauaugugcagcauuacuuuuagaaaguaaaaaacugauggauugugccaucuauggcagcauuuguucagcauuugguacaaaugggagaaaaaagauacagaaugcauggauugauuuucaaauuaccucaauauuuugaaaacauuuucaccugcaugcugagaaugcuaagaauggcaaggaaggcaauugugcauuugcacagccuccacugcauucauuuauaaauuaccucaucacugacugaaauuaacacugauucuuacaggcaauuucucaauuuccaaugcuaauuacauuuuuuuuacuuuuaaauucuguaccaccuguuuugggcaagacaucuuaggcagcgcgaccgcauuuaaucacaauuuuaauuaaccgcccuguagaugugaaaaagaagcaauuauaauguagaugaaugaugauuuuucugcauuaaauuguuuuguuucccugguauguugauuguaacacagcacacaaauacaguaacuguacaauuuuuuucuauuguaauuuaguaauuguuuuuggaaaaccaguuugggaaugagugacuucaucuguuuacaaauugauugauacuguucacucacugauugcugcggcguauauuuugguauugcacagccuagcauaaaauauaauuagagaugcacaggcuuugcagcaccauuuuggaaucugaaaaucaacuguaacugaaguauguuuuccuugagcauacuaguaucaguuggggcugaugaaaugauaaucaaaacaaugggcuuuccaauuccaccacaguagaaacccuugguuucaaucugauagucuaauaugguaaguuuaugaauuacucuguacuaggccugggagcugggggcuggcaagucugaagcuugcacaacucacucagaucuguaucacaaggagcauacaagugagguaaagaaacaaugaugaaaaauaaagaguugcugcuuuggaaauggaaggauugcucccgacacccaggcacaaugcacuggugugcuguagcgcuagccuaucucaucucuacacuaugauacaauaagaucacauucaugcuccuggcuugcagauacagaucauuaaagcuguaccucauugcagauaaauucaaagaucguauuuauaugaagcagagccuguuccucacucagcuagaaauuggauggggggguagcggggggaaagagccaucauuaccuguuuaugaaaccuuacgcuaacugauagcuagaagaucuacacuuaauauucucacaugaauuagagcccuucaggaauacccuagccuaaugucacacccacucccaaucucaggaacuuucuccauuaauacacugcauugguaucguagggcuugugucucccuccaaucauccaaugagucauucugaaaugugcucacuugaaugaguccugggcuaggccauuucugccagccuggaaaaaaggggaaaaggccauguaagcaauuguggauguucaaaggaaacuauuuacgagaccucuucaucuccugcuuugcuucuuuuuacacucuauuccuuagaagauccuaaaguagaacaguucauuaaaaggugagaagucauguugguccuagccauggacuuguuacaaaacauaacuagaauuaugacuucauuuagaguaauuuaaagauagaauguuauaagcugacaggacaaagcaguuaauaccaagauagggguuggggguuggggaaggaggacuauuuggaugaacugcuguuugucucuuccauaaacaguugcuaacaaaguauuaauaggaaaccccaaacugaugccaaaauucacuuuauauauuaaguaagaaucugcccuauuaauauauuaaaagcucucuucuuuuccagguuggagauuacaugucuaaaucuuguucacaccuaugggauuggacaaaauuuucucaugaaacuaagagaacaggccacagagugucuugcaaucuaugcuguuagcaagugucuuucucaugccugauguuauacaaaaacuagcaauaaaggcuuauucuuuccuagccaccccgaccuguaucacucuuucuggcugugggaauuauuuggcauaagugaacauggagaaaaacuaccacugaaaagaaauggacaauucaucucagucacugcuaagaaagcacgcuuagggcagguagaaauguggauguguuuuaccccggagauuccauuucagauucuuagugcagucucaccgguuauuagcagcagcaauacuuuuaggcugcugaguauuuuucucuccuuugccaccuuccucaccuaacucguaacagcucucaagaaagaugcuguuuuaugaauggagguaaaaauaaccuugaauaucucaaauuauagccucuuuacauaaugaaaaaggaguauucuggcagcagauuuuuuuuuucauaaaguuauuccagcaauaaugcuuguuuggaaguuucuaaaagugguaacaucugugcuccugcuggcagaugccaucccaccaaccuuucuaugggcgguuugucuuugagagaaaauaaaguaccugaucccaggccuuagucagucuuagcucccuguaucuucucacucugacccacugcgcguuccuucaagcagagagcugccucccauggcuaccuccucaauauaaacuugcuaacuaaucucuuagcaaacacuugaagaaaaccugaagaguggaaagagaggcagagggggaacaaaaacccagcguagauaaagcucaagacacauucaacgggacgcuggaaucuaaauuuaguaccaaacuuaagauuucuuuagauaggcgagcuguugccucuggaacagggauuuucauaacaauuauuuuguuuuuaagucucaaucuuaauucuucugcuaucucuuaaauagggcucacuuuaacauaaacucccuugauuuuuuuuuuucucucaguggugaugugccuacccuuauagguauucuuauaggcuuucuuuuauuacugaauaucucuuuaauaauuugucauuuuaaaaagucuacucugacugcacugaguacacacaagguaacucuuccuuaggaauuuaugugacaauccaguguuggaaauaaauaaugacuuucaaccaaugaucaaagaaaaauaaaucuuuuauccuaauaagacuuuuaaagacuggaaucccauuuuuaaauggauaacagcuaagaggcuacuggcaaucuauuuauuuccaaagcuguguuuuaauguuggcuacacagaaacuggaugagcaaauggacccuaggguccucaaaguuaaagcuuuuaaaauaaaguugguauguaguauuugaaaacauauuguucagaauuuaaguuuuaauaucuaggaauaaacagagcauuaaaucaagcaaaacugugacaaggccaauaugcacauggaugaugccagcaaggcaucuucagcccuuuguucacagcuuaacaaaacugugccgucacaccacuuuaguucaacagugccugucgaaugggcaucagcagaucagccaaugccugucauacacagagcuagaaaacgguuugaaagcaagggcuuauucgacccccaagucuaguuggaaaguaaggaggauuuuaaaucaucuaguaaaaacaccagcccccucccacuccaaaguuagaagagacggggaaggaugacaauuuuuuuuuuuaagacaucaaggagaaaaaauguucucaggcaaaggaaacacuuuucauauuuguuuucuuuguaaaagcaauuauacaaguuuugcaaucauagaauuuuucuuaaagugaccuuguugagaguaaaaguugaguaucuuagacaucuuaagguuuugccauguuuuuugaccuuuuaaacaacuuaauacguguucucauauuaccaggauaguagggcauuauuugacagagaacuugcaaacccaugucauucaaaggaguaucucuucaaauauaauuuuugcuacuuguacuggcuuuuuguuagccaaaaugcauuagcuuuugaauggacaguccccugagcucuagucucugugaacauuuaaucuacucagaagagaacccccaagaaaacaaaccugguaaagagagggauuguucacuuuccuacaaguuaacaauuagaaaaaaaaaaaaaaacaacaaaaaaaacaaaccaccuuaauuuccuccuauaacacugaucaugagauuuggcuuucaagcuuuaauaagugcuggggaggugccucagaacuuuccuuccguuuaauuaagugugcccacuccucuuuaggcauccaaucagauuaagugagagcaaacccccggagcaaggcuggugagcccuagugguaagaauuagcugaagguguucugaaucucaaccuuucaagcuccuucaggauauggugcugcugagaucaguacaggaggagcugagauuucccgcacacuaaaguugaaaagcucucgcucucaaccuccccccaccccucugucuuucacucugcugcugucaguuugcugccuguacuuuggcugucucuuuuccagucucuacccugugaguuucuggccugccaauuucaacuugaagcuugacugggcugauuugaugcaaauaccuccagggaaaacccugaaacugaugaacaguuaugucaagucgauuuugcaccaucgggaaaagguaaccucugcgagaaaaaaaacaacaagguuaaagagacaagggcuuuucacguguaauaccucugcugcacaucucguucacuguuuaccaucccucagaaauuguaacugucagaauuaguccuaauugcagaugcgaaagcugccauuauaauaaaaacagaggcagugcaggcauuaaauguagcagccuaauuugugagacuacagaaaagguagaguaaaugaauauuucauuacuuuaauuaccagggacuacucuuuucuugcugucuuaugauaaguguugcuguaacuagcaacagcaaacauccacuaaaacauaaagugcaauaaucguccugcugucaggaucaccacuuuaaaauacgagcagggaaaaaauauaaugguuuaucuauuucuuagagauugcagaaguagaagauggaaauucauuuaaugucagggggaaaaaacgcacacacaaaggcaccaguaaacagguuuuagucagagaauaauggcuccaagagagagaagaaaaaaaaaaaaagaccaguugacuauacauuugaaauguuagcccuaaaagaaugcuagaaagugaaaaguaagagguaauaguguuuggauuuuuuaaggcaaaauuuugucuguguugcacaauguaauagcuugaacauuagaaaauaaaaagcgacugggggaaagacaaggaaagcaagugguuuucaagugauuaagcaaagguggaaaaaguucaaguuggcaaaaguuuagaagcucaguccaguuccauuuaaaaagacuagauaaagccugccagaaaaaggacuuugccugcaguuucagaguacugauucauaagauuuggggaguaucaacaauuacucaccacugacaccuuaaaaaauccugggcaccucuauauaaaugucaauuucagguaaaggggcaaaguggagugggagguggcuggauuguaggagguaggaggugggcugggaguggggggugugguugaggagguugcugagacugguugaagccagccugucucugcauuuaucacucugucccagaggagguguuuguucaacauagcaguuugacagcacaaaaacacuguggccagaagcccuaucaaagaaccuacugacacguaucauuuguggucuugguuucacagggcaaggcuaccucacacuuaucugcacaaguauaaaacuccacacauuucuaaguguucgguaugguuuuaaaucucccccacccuuuuuuauucuguauauuguaaacacuaguuuaaaauaccaucuuuauucaggacuccagaaugcuguuuuaaaaaccauaauaauuugcaaucaguuuaggauaaucuguguuaagauugguaauacugaaggaaaaugggagaaaacaguacaaaagcagaaagcuaguaauuuauccuaaauaauacacuuaaagcuuagauuaauagguguaaguuucguaagaaucauguggcauagggaacacauuuccccccuacaauaaauccuacuaaacaagaaucuacauuaauucuucgccucuacuauuuuuguuuaaguguauuucauucacaagcuagaugacuguagugaaaguuaaagaggaaaauucucagaguuuggauccuagggugcauuuguguuugugugcaugugggaaugugugcacaugggcuguauuuaguuuucaaauucccaucagcagagcaaaggugaugggaaaucuuuagaggacaaccauuuugcucagagauauuucccucuuaaugggucuauuuauuaugaaaacacagcuuacugaguuccuuauauauaaaccucaccucuuaaaacugagaauucucaugaugugaaacacuuccauugaugugcauggugucuaaaauagaaacuuagguacuuccaagaauaggcaauugcaauuuccuugauuacaguuacuuggauauacaagacaauaaauacuuucuuaaacuaagaaacauugaaagcaauauauuacauuuauagaucacuugggcacugaauuccuugaaauuuacucauccauuugagagaaagaaaaaaaccucagauuuuauauagcacaauauuuuaaucuguucaucuauuacugauuauuucauauuugggaggaggggguggcuaucaucuugucaggaguaccuuuccuugaguuauuauaaaaaaauaagaaacaguauauaaagaacaaaaaucacuauguugucuaugggcaacguaacuauuaaagagaaauccauuacaguuuuuuuaauguagaauacauuuuaggaaaucauuaaugacaguuaccuauucccaggaauguggucaucuaccucucucaccugagauuauuuuuaaauguucccaccuuaguuuauccugaagauuuaaaaguauaccuucauauauuugugauauauaaagguggccaacugaccaguucuguguuuacuguuugauuaaaagaacaucuucuuuuacacaggauuuaaaauuuuaacuucaaaagauucaacuguagaauuagaccucuucuaguuuauaguaaaguguuguguggguuuaagaugaaaucauacacagcaaacaagaaaaauuuacaacuuaaaaauggauuagauacaauagaguaugacauuuaaucccacagauuauaggaaaaguuauuuggagucuuaauuuuauagcagcguuaaaaagaaagaaagaaugaaagguaaccugaauaugcacacuaacagcuccguaucgucuucuaguucuaaccacuacuucaaaucucaaucccuggacccagcucagugauagaacuaaauuuguaaauaaucaugaaucauuaugaugauuacauuccucaauugaaaaaaugaaagcaaaguacaaucagacccuucuugaaacguuugcuccccuuacacucuuaaugugucugugcugccugcucuuccaaagucugguuuuuagaaacccauauuaauuucuaaccaaggcugcagcagccacuguaaacguacauggcuuuaucagcucucauaguuucuugggucacaaauguaccauaucugaugacacagugaucaucuuccuucuccuuucucuuuucagauccucuaacuuuccugucagaagccugaaaaaauaugcgcaguuacuguugcugaggggagacaaaguuuaacuucuggguuggcaaucggagaauaauucaugagcagauuucuagcaaaugauaugauuugcuaaauuuuggucuuugauuuauauuuauguacuccugcuacugcuaagguuuugccaaccucaauuagaucaugaaugagaucauuuuaauucagcccccaaacugugaccugaccauggucugaaaguguucaaaaaguaauuuuaagccucccuuugauuugaaaaggaauacugcaugcuuggucguucauacaaauaacauaaaacuuaauuauuggaugauuuggcagaggaccuucuugccaaacaacagucaaugccagcuacugugaugcuggcgcugcccgggcccccgagcccacagccuccuuguauacgggcguuuguucauugugucucagggcaagaugcuuucaaauaggauucacggaucugggaggcagggugcaacucgaaggguguaccauauuuauaacucaaguuuaaaaaugcugucucaccuagaagggaaguagaucugcgcugucaaaucaccaggaggcugugacaaagggagcuugcagccugacacacgguguaacaacauagcaaacaccuuuaauuccgucaugucucauacccuuuacuuucucacacauuuguggcugcucgaauguugacaccuacacucuuuuucgaaacuaaauaaggcaaucuuauuuaagcccaaaugcaacaccuguaaaguuauucuugugcccagcaaaaaauaaccauuaacuccuuccucauaaaugccucucugcuugcuuuggaaagucucaaguugguaacggccagccugaggcccugacucugagguucacaugaccucccagguuuggacagauaggcaguacuucccccuugaaaagaugcgaaggcugagaucauaucacuguccgaacuggccucucauagcuuuucaaguugaagccccuuucuucaucacaaacuucuggugucuuuuauaggaaggagagaggccccagcugcuucauucccucuagcuaccguagucuaauauuuuaaaagcuagaaaugaaaauagcuuuucuaaagauauuuccuggaauuuuuaaugugcugccuugauuccuuuuuucuaucuuuuuuuuuucccuugccaauuauaaaccaccauuuggagggcuuaugagcaauguaaguccaccucaucuaauuaaaccacauuguuuuaaaagcuugaacaguuuucaugccuauaagacuugucugaauaauaaacugcuagagccagaauucugagugucuuuggagagccaggauuuuaucugcugagcgcaaggggccaggcacucaaagaguuaaagaguguucccgcauugcuggguagguuaauaucacagcugccugguaaagcauuauccccguaccucacuuaacaaaagccuccuuuugcaaacagacucccacuuuccccgcaaguguccaaagguguuuacugaaguaaaucugccuaaauccuucauugcuugggucauggggguggauaggagggguggaagguguagggauaaucucuuuuuguaaauucuguaaaucuucugggaaaaagaaaaaaaaaucaggaaucugugucacauguucgcacaacuucuaauauauccguuaguuuugcucuuauaagugaaaucuuccacaaggguuauuggaaaagcccccguuucaaaucauucacucugcuguuggaagagauugcacuuccaaaguuuguguguguguuugugugugugaauguguguguguguggugcaugugugugagcgcauuguauccuuaaucuaauuguugggagaaaauuauugguaucucaaaagugguuucagaaaggggaagaaaaagacaagacagucuaggagcaagauaaugucgcugaaaaguugucacgagagguuucugcucuugcuguggucucauuccaauaccauuaacugcauguuacuuuugcauguugaaaaugguggcaaauaacacaguaaaaccugacaggucugccugcgaggguuuaaacaguucccaggaaggaggccuuuaggcacaaacuuucucucacaagagaacgugaauaccaccaaccccuccccuacaaauccugaagcauccaguuugagauacaaaaaggcugucaucucacaaauguuaaacauacuaaaaaaaucugaaaaaaaaguauggagaaggugugaaaaacguggcacuuuacagcccucaaagcuuuuuaaaauagcacaacuuuucccccuaaaauucuuuucagagaauuuuuuuuuuccuuuuuggcucauuugagaguuucuucuuggcuuuuuuccccuuucauuugaaaauaugaauuaucauaaaaagucagggggaaaaaugggaaagucuuuuccaguuuuccugaggauuuaucaguguguucaggcugggugugaggacccgucacugaaaccagaccaggggcccagucuccagcucgcccgucccucccacccccagggcccucaccucucugguccgcugguaaacaaucagacuuauuaaagccaaaucguaggcagcacuuaagggcgggaaguccacacaccugaccccaaaucuaacaggcuucugggggagaauucgauccccuccugacacuuuuuaccucaaguguugagcggguggccaugaauaguacagacaugccaucuuguaacacuauaugccugucaggagggacagggccugguggagcaucagcuauauaaggcugguaacuaggggaagcccaacaaacagccacaaacaccuaaguuauuuuacucagcuacuacccugugccucucucucucucucucucucucucucucuuucucucucucuuucuuuucaucuuggcuuucuguggcagaaugcaaauggagccugccggcggugaaagggcugaauugugauuaagaagaagaagagcuccuuucuuuguucuccccucaggggauguuuacugggagagacacagcggaucagauaugaaaggcauucaggucagcauugaugugagcgaaagugaaaucauaccuaaggcauucaaaagaccgccgugucagggguucagcuaacggugcagcuacugggugugugugugucuucccggagaggcaaaaaucuuuucacagacuggcaguuuuuuuccccucucuaauuuacuacaaaauuauaaaaguuuuucccccauuugccucccaccagaugacacaagaguugguauuuucugucuucauggaccacacgcgaaaucagaccaacuucuaauaacuguuguuuccuaaaugaaccagcaaggcaccaucugaacugugauuuucuuuuaaacagguguauucaugugggcuacauauaugcauaauauguaggagagaacggaaagaagagaaaagccaaaagauacacgcauggauggcuuuucuucuuaccuccucagaggaaacacaagacaaaacacacacaugcacauacacagcauaaaaacacuacagaacaccuuaaaaugaaauccuuuauuuacuuuguaacuacuaguuacacuuuuccugagagauuucacucugacaugacugucacacaagauaaaaguauuuggcacauagcuauuaaggcaaaggcuuccauggagccuacugauuauuaucguuuuccuuuuaaaaacugcuugaugaagaaauacuuggaucuuacuuuuuaaaaguuuacccuccccacagcccaaauagucauucaauagauuuuccaagugguaagcugaugcuguuggcauaaacagagcuauguaaauauauacaaaauucacaaaucacagcaaacauacaaauaaugaggaggugccuggauguuucaaggcuuaaaaaugaaaaggaaaauuacauuucaucuucugauugcuaaagacagaaaagaaguaaagagggggaauagggcuauauuuauugguuuaaaucauccuucccucugcucugaauuauuuuuuucaaccuucacaucuuggcuaaaaagcauauuugggcuuauguuaacaucugcuuuuguggugacauuuaauucuguauauuuucaacuaguguuucugcaucacagauuuuccuccuuuaucucuuugcucugaaaagacaaccaaagagcaaucaaaaaggugucugacuuggccauucagacaauugcccccuugugggaaugcgggaaugaaugguacaguggacaccccagcaccauugacguuauaaacauguaaaugaaacacauuagggcagacaaucaauugucugugagcauugcaaaccugcacucccucucucugugacaggcacaaaauagugucuaccuugggaagccacggugcugagaggaaaaggacaaagaauuuccuuucacacagaagaaaaugcaccuuaaaagccuuggaagaaugcagaugacaaaaacuguugcaaggaaaagaaucucccacaucuuagaauaaacgcggcacugcuagaggcuagcaacgcccuccuuuccuaccuucaggguagacauacauuuuucccaggaaauauucuuaauauggcaucaaggucuuuaauaaccucuuggaauuuucuuuaagcaaauuaagaaggaagggaaacacugaaaccuaugacauagcaguugagcagggaacuuuaaucuugguuuuacccuauuugaaaacaaaugguggaagacgugaauuuauuuguaucugguaacagagaaacaauguaaaguuuaaaauccucagcccacccuuaguccugguggacugucacucuauggacaccagcagccuacuggcucugcuacgaaggaaagcauguuucuaccccaauuggcuuaguuuuuccagaccaaaauaaaacaaauagaucagccuagauacauagcccccagccuugugugugugcagcgugacaaaacuugcagaagaucuccacagagaaaaaaggauggagauggauaucuuuggagcgcccucagaacugguaccugccacacaaccugccccagugcuuugaaagucagcaaaacaggcucccuagaagcucaucaacuuuacgaagaaagcuacuugccaaagauuuccacacuuugcaaagauaaccaagucuggacugacagugauccgaaggaaacuuccuugucuaaguguguaugacucucguugccccaucccaacuucaccucucagggaggagagcuaggaggcaccuccuggagaagggguugacugcauuuucuuuccuuuucauuuaagcaucucugaaacgggagcaacuucuccgucccucauugccucuaaccaucacuaccagcaccuccacuccuuuaaggaagugguaaagagugagggcuuauuuuaaacagggauaaccauuucugcucuucugauuguuucuccucuaggauccaaagcccugagaacauucaacuugaucccuguucuuugccacugaaguucagagaccaaaggcauuuguaaaaagcuccccuucuccuucacacuguccccaacccuuuaguggaaacucuggagaaaaaucaaauuuaacuuuuccuuucuucuccuauuucccuuuucucuccuccuaauucaguuuuucuuuaaaagacaacuucauuucuuucucugaaacaagcaguuuccggauuugauuuuugcuacaacgugcaugucucugugagauuuuucagaggcugaugcuggaagguggcgggauggggaggcagacccucuucccgggcuccgugggaggcaggagggaagcaggagcaucccaggacccgcugcccgaaucaggggcaaaagcaacaaacuuugcaaguuacaaacgggccgcaccgguggcaagcagcagcagggcaucucccgcuccgagugcucauuucugacuccaaggcuguguggagauagugggguauaaucaggggaaagaaaaaggggggcuggguuuucccccuccucuccagcgucagugaaaguguuacaaagugagucaggcgacugaggaucaucugacugaacuuucuugaaaccgacacacauucuugucugcgggcaacucgcuuuuugccuccuucccccucaccccacucccucuuuccuccugcacaucuuauuuucugggaagagauuucauccuuuccaugugggggaaaggagacugacugcccgcuauggguuaacuuggcccuggcacugccucugccaggcaucuugcuagccugagaaucuggaagguuguauuucagauacuuguuucucucuuuguacauuuauuuuucuucaacugccuccuucuccuuugcuuuuuauuaaauguacauagcauugucuucuaacucacguucuugaccagccuuuaaaacacacacacugcuuuacacguuuuaucuccuugucgccuuagucuauauauacacuguugacuucauuaaaauuauauaaagugccauucuagguuccuggaugaccaucuuuuuuucccuuccagcuucuacuuauacgauuauuauugccauuauuucuuuccaggaauuucuauaugauuuugauaagcaucaucauauuuaguguuaucagcaaagacacaagcucaaaagugacaucuuuuccaugaauccaggaaagaagaaaaauccacucaguucagauaaauccuagcaauucccaaagggaaaggcauuggauauguguuugaugagaaagaaaaugaaaaagggguggggugguaguacucuucuaccugcuucucaaaaccagaacauugcucggucagauuaaacccagugaaaaacacuuacaauaaccaguauacagcauguuuucccacagcuuauuuggaaaaaaagacagguaacagucaaaguuagagaagcuguaagcaauggacaggcuugauauuaagugugcaggaucugggcuaaaugccuuaaaaugugcaauucaacuuuccacuucugaauguggaggcuucucccaaguuaguggcuggguggaggggaaauacuugcaguguccaugacugcggacaucucuggcacuccauuccaccugcgaagcgcccaacgggccucccucucugccaggucuccuagggguucccaggaagccaggaucccucuauuuccuuagaccugggcucuggccugaccucacugcuagggccaggcuggucaacgguggcaaaaucccgaaggagguggaaggaggaaggcaagaagaaaugcacacuuuaaauagucuucccugcaaaagaacacuucugggagccuuguuuuaaaucucauucucuuuuucucucaaaaaaaaaaaaugacuguuuaacagaagagggaaaaaagccuccuugacacaaagcuuuuguuauccaguugaucagcaacgugcuuuagauacuuguaagagggggaaaaaagccccacaacagacauugauuuuagaaaaucaauaaccaacauuuaauaaaaggaacagaggaaacacaagagaggagagggggacauuagguguaauuuuagugucuacuaaauuacucagagauggggaaggggaggucuccuguguaaggaccaccuuaaauaaugccagacaccagagugaaaaaaaaauuaaauuaagagagagagagagggagaaagagagagggagagacuuaaaaagaagcagccugaacugaaucuuggggaagcagcucggaauauauuauuguacuuguuuuucuguaauacuaagccaagcaaauagaucaaagacagcacaaaggggaaaggcaggauaacguaacgaacaguuucugacuaaaauuccucuaucacucccccauauggcucgacaccuccaccacaacaagcaaaagacacacacacgcacacacacgcguacacacacacaaaaccuagagagagagagagagagagagaaaagcaucauuugucucuaaucaaaauucucucgucuuuguguuuugcuccuuccagcaccucacacugcgcccccagccgcccccuccccgcgccgcgcagcucuggggcaggccgggggcgcgcacaauugucuucucuagaggaaaguugcuccaagugggcccgggcgguccccgcgaggcgcgggcuggggcugcggaggccgggaggccgggugggcgcugcgucccagcgccugccucgggagcgucuacgcggccccgcgccgggugaucgggcugagagcgaggggagcgagaaguuuccuuuccgagucugggcuggcgcucguucgcuuguuuguuuucggggguugguuucuuucuuuuuaaacucaguuauccuccgucagcucccccacccccccccggcacccucgcuaguccccagcccucuccccucccccaggcgccuuccgcgcucuugccaaucacuuuucucuuuuauucccacgauuuuguuugggguaauaccuagggggucucucucucacucucuuccucucucucuguuucucucuguccccccgcgucccuucucuggcugucuccaaaacggaccuaccaaacucucaccccccccuuuaauaucccaccucugaucugcgugugccccucgaacccccaucuccuuucuccuuccuccuuccugacucagccuggauaacgggcuccuccagaccauguagaaacugccgggaaaagucucgcugcgcccugcgacuccuucaguccccggccugggggcagagccugcuggagaggagucauccguccccgagccaucaucgaccccaccggaccccgcgcggggccggccgacucccucccaccccggggucugggcgcgaugggccgggccccgcugcccgcggaccguuacuuggcgcaccgagaagcggccgggcgacuccggcaagaaacuuuaagccucgcugaggcgcagacccgguuccccucuccugccuucgcagucucucugccacccccgcccccgccccgggauccugcgcgauccagcgccugggcccccgcccugccccaggcggacgcucccgaagcccggccggagacccggcgggccgggcgcgagcggagcgggaggcggaggcggagggagggcggaggcaggggcucgaggggggcagcggggcugggggcgcggggccccggccggacccccgcgcucggacccccgggugccugacgcucacuuugcccggcacuuccccaacaccccccgguccagccgccgcgcgcgccgggcuccggcgccggccgcggagggaggcucgcccuagagcccugggcgccgccgccgccgccgccucgguuccuuuucccuuucccccuccuucucccugggucucgagccgcguaguggcccggaaaaguuugguucgggcugcuucuuaccguuuuuccuccugggauuggcuuguuugcgccucuugcaccgggggccauccgccaugaucggcugcuucauugauaagagcggaucagauggcaguucgcauggacucggcgcccugcuucggcagcacgcaggcucgaucuagcaaccaaacacagcgacaaugugggcaucgcccgcgcccauugaaacgcgcgcgggccgcccaggggagccgggccagggccccggcgagcacccauccgcgccccccaacgccaaagcgaaacuucggcggcccccuccccgccccccacccccagccuuggccccgaggcgcuuuguguuuguuacuguuugguguguugcacccgcgaggggaucagagagacaagaauuacaucuucaaaaugagucauaacuccugaccguaugagggaaugcacacggcgguacaguaagaccgcuugacucagggcuaggcggacccuuuccuucgaaaaguccucagcccccggcucgggaacuuggggugaggcgagguuuucuuuucguucucaucuuuucucauccccccaccccccaauucccagaggaaacaaacaaacaaacaacgcgaaacagccccuggaugaagcacacucgggcaaauugauaauaguaauuauaggaagcccacucgcccagcgcccccuccccuccccuuuuggaguuuaucgaggcacugucucuuccuccccccacccucgcccccaaauuaagauuucccguuuuacgccgcaaugauaaauauaauuauaagccucuuuggacacuguccuuuaccccacccccccucgccacuuugacaauauuuacuuaaguauuuccccccaccucacucacacacaugcucccccacacugguucccuuaaauaguuccaguagaauuuuuuuuuucccuuaagaaaggaaagagaaaguccaaccacuacggcaauacuuuuaagcucuacuaaaugaucguauccuuucuggcuucgaaacuuuuguaccuaaaaaucgagagaggcgcugcauuuuuucaguugaaacugucaaaacuuggagaagggggaccucggaggcaggcaggagaggaggagaauccugaaaacucgguggagguugggaagaugcugugccucgaggauuaguuuaaacagggggcuauaaaagauguaacagaugcaaacuguaacacaagggccauuaacccuuucucugccgggcacacucaguccccacgccccacaccuauugucuccugugcuagaagcuuugcagaaaaccuggaaagugaguaucaguuuccacacauuugcugagaggggugaagggaggggggcagagagaaggggaaguggauauuuuagaaagcaccuuaaauuuaccuaggcauacauaguaggagacuuuuaaguuugacauauuuuaucauuucuuuccuuguccuauugauuugaaauuguuaggggaaauccugaaauaaagaaauggucacacaagugucugggaugaaacagcuggccugucuauauucauccugagacacacgacugcauauaaauacauguuuaauaaaguaaguugcuaguuuuaugggcaugugugugugugagagagagagacagggcauuugugcuguaaacuuuaucuuugccuguuacuccuaagucuggaguuaguaaucuugccuucaucauuacagggggagcauguaaaauauaucaguaggugggagauaaacacauucauguuagccgggcucaucacuguuccugggaacuccugcuaucucucucucgacuuuucagugccaaaguauggaaugggauauauguguguaugugucuucuauuaaauccaugucuauauuacuuugccacuaaaaauacaauuuuaaaaguuauccuaauuuaaaacccugauauccugacagcaguuuucuucccagcuguagugccccccccuccacuuugguaaacgacucaaguuccaugaggacuuucacuucuuuauuuauaaucacagaagugagguguuacuucacacacauacacacacaaagaaugaaauaaagaaaugaaacucgcuaagcagacaaaaacagacaacuuucugcuuagaaaacagccuucucggugggagaggaugaacugccaugucuaagagaaagacuugcccccgaauuuguaggucuguaacugaccaaguuuuguaauuauuaacagguauuugccaaguccuaauugcugaauauaaugaauuggaacuagaugcgaaaauagagcaggaccucuccccuugaugaguuuuuauuccagccauauaauucucaauaaaacuuuuccugggcuggauagcaaaggacaccuuugguuaccugaaugaacagguacaggggaaauuauuugggggagggaaaaaggagagaaaagcaaggagagagagugugaguguaagagaaagcgaagaagccacucuugagaaaagcuugccauaaaggagcuaaacccaccugaaauuccuacccacggacaccccuucucacuucagacucacauccccacucaaaaugagaaaauuagaaaaggaggauggaggacgagcacaccaaaaagggauaaaaagagagaaaaggggaggaaaaaaaaccuaccugcgaagucuuguuuguaguuuuggccagaaauggugagaagaaaaagcaugaagaagccgcgaagugugggggagaaaaagguggaagcgaagaaacagcucccggagcaaacuguacaaaaaccucgccaagagugucgggaggcaggaccguuauuccugcagagcagguuagaacugaucucuuucggccacuccaggaaacacaaaccuggggacggacugacguguuacgccucuucuaaugacauuuuuuucuuuuucuuuucuguaggagagagacgagagacccugaaacacgcgccaccuaucuuuguggggagggauaauugaagcgcccugagcgugagcaucaugugaaaacgugaucgccaaguuucucucugggaaaggaucugggauagauuauaccuugaagucuccgcaaacgcuuuaguggaagaaaugaaauucca

SEQ ID NO: 21206 - RNA, 19466 nt, Homo sapiens
agacaugguuacuuuuuuauuugaagaaaaaaaaaguauguuuuaauaaauacugcggaaacauugaccaaacaaacauacacagugacuucaacaguuuaaaaaaugcaacaaaaguucugcuuuauaacaguuauaacuuauuuucuuuuuacaauauuuaaauacagaaagcacucgccagcuauuuuguaauacugcccaaagcauaaugcugcaucaaucaaagcauauuauguugguaaaaugucuguauuuuaugggaaaugacuggaaucgaauuuucuugcagagacaagacaaagugcuuguaagacauagaacugaguguuguaauuaccuuaaucucuccugccacgauuuaaggggagcacagcuucaacacuucaaaaacgaagcacuaucaugggaaagaaagcucguuuucaacaagcgccaacaauaaacaggucagaucugguuucuucucugaaagaaucucuaaaaggaacuggucaaaaauaucuguaaacuauuuuaaaugcuuauuauuuuacguaacaacagagaccaagugcugaacacagaccuuggcugcaucuguucagugagguuuuagcaaugacacucuagaaaugcccuaguguuaugucaggacugaaaguuuaucauauaaucuuccacuagggauucucuaaagcuuggguaaguggcaucuucucucaucaauguucauuuaaugaaaagugaaauaaaccaacagauuaucagaugcugucaguuuuggagcuucaacccaaaauaauaguccuuuugcuuuguauuuuugguaacuuaauuccagacagcuuuacucacaaacugugcuuucugcuacuauucuuuccuucacucauuaccuuuucuggugaaaacaguaacuaccuuuuuucucuccuuggaucauucuaugacaucaaaccaagacaccuuuuauuugacuuugcauuuuuaucaacgauggcaaaaaaucacacaacuucuaaacagcgcacaaaaauauuacauugagcaauuuaccacuuuuuaaugacaaucacaaugaagaacagaaccaucagacugaauaaaaaucgacauuuuuuuuccuauuugaucuaugcgaucuuuguagugcuggucuacaaaucuugcaagauugcaaaggcuuuccuuagaaccauccuacucagcuaucuucaggaaggcaagauuucaaagccucauaaaguuugccucuggauauaucccauggguccugauacaauuuccuuuuuaaugaugagcuagaaagaaauuagaucacauccucuagaaaacuaaaugcuaaggucacagugccaguucccccuugaggacgguauauuaacguauacuuuuuguaaaggagauuaaaacauuuaaaaauuaaaucaaaguggagauccaugaauagauuauaacaaaaaaaaaaaacccaaaaaugcaagcaccauucagagugugauuuuucuucuuggagguacucgcauccccccucaucuuccucuagcucauuuguaucucucauuuuuuggcauauuuuucaagucacacuuaaaaacucuuccauguauucacuucucaucacuuggucuacaugccgaaccuaaggucaggauuccaaaaagaugaguauccucucaaacgccuccuaagccucugguauacaugacuuuggcugugcacuucauuuagacuucaccuuuuuguuugcuguuguuuuuuacacuagauuccuuugucuucauuaaagauaaugaaagauucacaucacagugcagcucuucgcuuuguccuuucguaaguccguagcaacugccgagaguucuggucugcuaggcaugugugaaauccgcuuuguggcucucugugauuuguuccgcuuaacguuuuuauuugucuuauuuacacaugccaagguggcaacgugaaaaaugucucugacgcuauuuuccgacuguaaagcugagcauucgauauaaguagcugcuccaaucuguuuggccauauuugcccccugagaagcaaaagaagggauuuuaaccagcaauaagacuuugggggaaaguuagcuagcaucuucuaauaccacaaaauaauaacacauugcaaaacguuugcugauauguuaacugaauuuuccaagugucauugcaaaaaaaaaaaguuguuaaaauguaaacugccuuauuuauuacuucauaacuauuugcaguccagagcccaucccuaagaugcccaacucucauggcucauuagagguguuagagcucugaauaaaugcuaaaggcugaucuuaacaaaggaagacccugguuaucaaacacuuaacaugaggugauucaaagaaguguagaguggagcuaacgaagugauucaucuucacuaucaacugcaagcaagaguuaacugguuauucagguuuuccagggucacagcaagcauggaauggcgcagagaagcuuacuagugaaguaaguuagcugaaggucaugaacauaaacucugcauuuuccacacagcucuggccguggcgauguggccuugagaaccuguuccagcgccucauggugcacuucauuucucuuuucuugaggguaaauggcauucaagacuagugacuagguuguaccaaaaacaggggcaaugaaugaaauuuaaaaucgauuuugaaauguaugugauugugucuuacuuagggccgaaaugcguugaggaaaggaauaauacuauuguaacaucuguuacuuuaugaaacacaacauauguaauuucuaagugugaaccauaccaccaacguacacaacaauaagcaugugcacauuaaccaaaacuacuuauuuaaaauaccaaauuuuuugcuaaugagaaauggaagacuaagaagacugcgguauuuaaaaugaugauucuuaauaaaauuuugguauuucaacaugaacucucuuuagaaucugguuguagguuuuaugagaaugagcuuuugaaacugauucucauuucuaaauacuugggggaaaugcuuacagaaaugaagacucucugaaagaugguguuauggaguguuccacuuuacuggcaacagccuuauuauuguacugccgacuguaaaaucagauuaccccucuuaaagaguauuacugauuuugaccacauucucucuuaaaccuauuuaacuuuaaaccuacugggaggugcagaaauauacaagguuagcauaucaacuguuuauguacccgaauaucauguaauuacacuaauaaaugacagcauuuuaaauuucacaacugaccacugggugagccuuuagaaaagcagcuacuuuuuauuuuauuuauuaugagugauaguccauuucuuucacucuuucuaaaauccaguuuugcacaugggcaacauacauaccuggucauaggacacuggcgucugccugugauuggagagcucuacuaauguacuaacaucuguccgcagaucagacuugcagccgaccaagagcauuuugguauuuggacaaaauuccuggauuucaccuuuccacuaugaaagaaaaaaaaaaaagauuaaaaaugaacaaaguaacgguauccauaucaugaaaaccauuucuccacuggcugacauuagaaugaaacucagaaaagauguuaaaaauggagugucccuugagaugaagaagcaaacuuugcauuuaucuccugaacagaugugaaguuuuacuacuuuuuaagcauuagagaauaauuauguauauuaugauugauucucccucucugugacucaucuguugcuacugaaagagacuugguagauguuguccaaagguagcuucaauaaugucuuaauuauuggugugucucuuaaagauaaaugugucuuaagaauaauuauauauccuaacaagugaccacauccuucgauguguggaucugauccuccuucacuagaaggcuggggauaaggcagaggcaacacuagcacaaguaugcauucccugaucccaucaugaaacacugaagcaugccaccacgagcugaggcucuauuuuaaguaccugagauaguuaauaaaacagaacauccugccuugaaggaguuucuguucacaugguugcaucaacacagaccaugacauuugcaaaggaacaucucuugggucaucgggaaggcagcugguccuguagcucauaugccuucaaguuaguuuaaaacuauuucaaucuauuccaauuugucuaguuguuucaugaucuaacaagaauuauuagaaccuucagcaaugccuggcuuggaauuccaacuguccucuuuaagaacaagcaagcagcuuuuuguggcuucauuuccucaagcuugagcucugcaacagcaugggagucaagaguucagggcggucacaggagaucuuuggccuuugagggcagggccuagagaggcugagauggggaaguggcgccugacucuucccacccacauucacaaauauguaaguguucuacuaaguacuguggcagugacaaugaugacuaagacauagcugugucuucuggaaggaaauucacagaauacugggggugaugaagucauguauuaaguauaacacuagauaagagggacauccugcaagaauaacuuaaaagaucacuagaggagacaucuccaaaucuagggguguacuuuggguaacgaacucuagugcaaacuacaccagaggauucaaaggaguaauauacuuuccauaagagcccauuuuguccacuuauuccucccuuccucccucccucccucccuuccuuccuuccuucuuuccuucuuuccucccucccuuccucucucccucucucccucacuccuuucagaauuauguaggaacaccuaccacaugcuagguggcacuggcauuagaaguggaaggugaacuggaaaaaaaaaaaaaagaaauccucccuacuucaagucauucuaaccuccucuuugauagugaaggacuuaaaggguuccauuaaucaagacaaaccgcagggguuaucaugagccuuaaaccucacaggaauguaaaacauacucauuaauaucuauaagcccaaagucacuauucauuuggucuuagaagacaaaagcaaaauaaaacaggagaaaggcuuuucaucauaaauuaugcauagccugauacuacaucaaguaaaaucucuaguaaauaagcaaccccuuuuaucuccagacagaacuagacauguuguuauguugcucuucagcuguguaaugacuuuggccucccucugcaugucuagcaauuguuuacaagcauuaaagacaggaaagguguauuccugccuggauuugacaagcauuagcauuauuuguguuagauauguauuacucaaaauugaaaggagcuaaaaaggaaaaaagagucuuugaucuauuaagaaagagaucuacuaagaguuuuauugaacucuguuuguaauauuuaguagagacagaaggauuauuauacuucaaauccugauuucacaaugacacacaagccaagcaaucaaauauaauaggggaauguaaacuaauaaaaacacacaaaauacaaauaaauuccacuaaaaauuaaaaugaaaaaaacaaaaccaaccuagccacaccugcauguuugucuuucucaauccauaccauacucagacugggcugcaugggucaccccucaguugacacugccuugcucucagccacauccgguguugaagccaguguguggaggagagggagugcuccaacaaggaucugauucugaaaccccacagcacacaggccagggcugagaaaauagcuaguggcuaauaaaugcugauccauggacuaacacggcaugugccuucuacaacuaccuggaggcugagucucaacugcugaaggucaagaaacgccccuuccucccacuggccucccuaguuccugugacccauccuguaauagguccucuuccucuugaucucccccugguuccuuccaaccauagcuuccuuaguuagguuccuacggaaccugacuuaccuuugccuccauaaacuauguguacauuauaauauauaacauguuuacaagcacugcuuccauauuacuagaaagauaccuggucauaauuacuagacagauaccugaucaucagacaauucacauuggacacaucccuauuccuccuacacuaguuccauuucuguuucuaauaacaccauaacuaaaacacagcuucuuuguuaaaauagccauuauugcauuccuuucacuaucugacuugaggucaaauguaaaucuguaaacuaagaugcaaucuguugagucacugaaagaaggaaggaacacaugaauaugauaguaaucaaauauaacuguuguuagcuguaccauuuuucucccaaaggacaaacaugaaggcccuuaaaagguauuuuguuucagagcuucaugaaauaaaauuucaagcaaguucaucaucaaaaaguggaaaccccauuuuggugugaaaggguucuuucuaguguuuaauuacaaauuguaaggcagggaauugauuagagucuuugagcuucccaacaaaccccacguuucuauuuauacaucacccaguacugaagugugucaucauuucccagcacuugccuuuuugaggacacuguccagggucucuggucuacugaugucaaagcaaaucagcacagcauccgaaucaggguaagagagggggcggacauugucauaguaaggagaaccugagaagaaacaaagacacacaaauuuucagaugagaguccccuugucugucaugcauuaacucuacccuuuccggcuaaguccuuugacugucacaucacgacccaacucccacuuccccuaauucuuggaaaagaauucaaacagacacacaaaagccugcuuagaaauauaugaugaaugaagccucacaugugucugacauaaauucaagaagagggccaggaucuuaagugaaaucuguaugguucaaagacuagggccugaaguuaccugggugaaguagggaagcaccuggggccagguggucuuguguguaaaccugccuccaccacuaaaaagggagggggcaagguagcuuuaggacccugugccucugauucuucacucauaaaaugaagaugcugacaacauacauaccugagauuaaguaaacccaggcagggccuggcuuuuaguaagggaucaauacguauuaacuaugggcauuaugguuguauuacugcuguuaaaagcugagugguagcaagaaccauaaacugaacuacuucuugggaaagagaccaaaacucaagaucaauucugacagcaggauaggggugaaugagggagagaggaagaggaaggguucaacuaugcaaagagaaaccacaucaguguuacccaucuccaagauguaaguuuacauaggccauugaccuuugagcuugcuuauuuuaacuuaucgccaaacccuauauagauuuucuuccuguuacaaucaagaauguaauaaaugucguauaggaucaugucgcuuuuuuacagagucccaucucugagagugacacugaggcaugaucuaaggaucuuaaccugaauuaaguccaggguacccuaaagguucaaggcaccagccaauuaauuuaaccacagaacucucuagucaaucaaggaaguuucuucuauuucuuuaagaauuccaaaggaugggcaauuacaugaggccuauaguuaugaaaugauugacuagaaaacuaaauacagccugccaaaugccgcuuguuuaagaaaucauuuuccguaugcugacauuucacaagcaucacaugaaaaugauuuuacuaggcaaauauauacacacguauguaucugacuccagaguagaaaaagaaaaucuaaaccaccaaacucuuuuuaaaagucuauuucauuuugacaucacuuuccauuuugagcagaaaaacaggacauguugucccuugauaaaucaaaaccucaauaggcaaagucaggaagagagacuuaaaaagcagcuuuagaaaaaaugucacuguuuauauuucuaucaaaacaacauuugcuuggaggcuguucuugugaucuaaaaggcacuauagucagggggcaucgcccucuauucacacaguacacucugggucccuggcaucugcuauggaaccccaggcaacagugcagcuuuuucucuagcuccuuuacgauggagagugacaacuucaagccacgugugucugcuaagcaaggaagaaaagaauguuacaagaaucaggaagaaaagugugaauaaauagagaauuaagucagagcuguucaugagcugcagcagcugccuacccacaucuggaaccaggacccugguagagcagaggcugacagcugaaagauauuucccagaagcuuaaagcguuuagaguuuaaaaagucaagucauuuuaaguaugaagguauauuagaaugaggccgucucugaaaaugacaagcuguggcugccuuuucagucgcugaaaguacucugaggugaagagaauaauucacaaauaguucacccauuugaacauucgaaaggcaucagaaacgagaugguugaacacuauuuauggcuacauuaguauuuccauauuaguucuaagaaguucacacuuucucaacuagaaccuuuccuguuucuguguccaaagucuaacucuagcacggcaccugcuguaaacauuugaaugacucuuuccaaacaggcagucagaaaauucuagaucauagaguggagcuccaaauacuggacauauaaaugagaguuuccucuacuccucaaaguccgcgagagacaaccugaucccagacccaggaaggcaaagcugccaacaguuaggauugucagaaaccuaacgaggcuucagagaucuccuuucccagaaaucacucacauuaggaaaaaccacucucucccuguggagagcuuccaguacaagcagaccugguaucuuuagagaacuguuccaggugccuaccagcuccuuucaggauacgauuuguaugauguuagaguacucacugcuaauuccagauguaauacugcucuaugacaauggagaccaucuuuuccaaauaaaaaaauuaggaaaagcgauugaagaaauacaaagaggauaaaagaguuuaauuaaaauugagacugccaggaaaauccugaggaaugguuucaacauucaggccaccacaugacugcugggaauaccccuccccccuuuguggacuauguuucccgucccccacccauuuuauggccacaaaggagaucuggcuuugugcucagcccugagucaccugcuggagacugcuaccuacuaaaaucaagugggcuggcuucugugcuuagugcauauaucuaaauaucugcaaaauuuagacucuggccugauuuuaaaaugaaacggaguucuccaguuaaaccagauuuucagggaaguuuguaucugcuuuuguuuuuauccgguuaacaguauaagugaaaauacauauguagugcaaagguuuaugagaaauaaaccaccgugcuuguggagguagacagguaauuuuuaagagguuuaacaugaucuaauuagggaugacacuuugaucccauucuauuacuuuugcuaaugaacagugcugcuuuuagaucaacacgaguguccaaagguaauaguaaaacugauucccauauuucuuaguuauaagcauaauuugacugccaaugacaagaguaauuuauuuaaaauaacaagaccauuuauucacuauauuuuugauagguuaaguuuaucuugucuuagauagaaauaucuauugucucuauuuauucacagugaaaaauauugauauagaauuaucaagaacugucccaccaggaaagauguaagucaucagcucagcaggacuuucaggauaaaaaaaaaaacaaagcaaaacaaaaaacaaaaacacucacacacaaaaacaccuccuguguaacuuuacaguguuuacucuguguuuaagcacuuggaauccuuccuuuucuuccccauaaagcccaagagacugcacaaaggaaguaaggcaagcaaagcuggagagggcacgguggaaucacagguaugcgugagacaacgcaugccaaaaaaaaaggaagaggaauuccagaaaugacucugugaagugagaagcaauaaagaggggcagaaaugacaccaaaggaaggagcugaaaguaaguggguaaagcaggaacaauaccugccccuaacuccuauaucccuccagaaaagucuuacaacacccugugaagccaaacggcaaaaaaaaaaaaaaaaaauuaacuucuauagguguuuuuaaaagaugcacaugaaaaacucccaaggugcuaacuguagaacuaaacacagcacaagcaggagggcucaacaauuuuuacuaaguaugaaaguauucaacuuuaacugcaguacaugguagguauugauauacacagaguaugugcucuaguaccuaagaaugcacuaaaguccaauaacauuuagggacugcguuuggcuugucaaaugaaacucuuuuucagcauguggaauaggcuucaugcauauggaaauucucagaugcagcauuucucugguacuauaugaaacuuuuaagcucgcaacccuauuccaagguccuuuuuaaguaaccugccacaccucugaaggaaaaacuuagggaaacucuauauuguaaagaaacaacuacacuauauaugcaaaauguguaccccgcucacccagaaaauauaguugaaaggcuuugcuggggguagauuggaacaaguguacacuugggguucucugaguugcucaaguuuggcaaacaucagcaaaguucuagagagcuuuugaaauuucagaucuacccaucuuuguauucaagaucauuaauucugggugagagcaaaauuuccagccaaagaauagucacaacgugccucacccagaaacuaauucuucagacacauaccugccugcugaagucacccuuucgcaaauauagaacacaccauauauguacauaauuaaauguauauguaagaagauucaugcccaaaaggaaggcuuuauggaaccuuuugcaaaguaccaguuuaaacacugugaggcuuuagaggaguuggagaacugaaaacucuucuuguugaauauuucauaaauauaauuuauuuaacuugaaccuucaucugaaaagcuucccuuucccccuuaagaaauuuuuaccaagaagaguaagcuaaagcuauugcauauuuuuggcagagaaaaguagauuaacuuuugguauauuuagugaccaccaugagcacaucugaacgcagcagcagcuaacaugugagagggcaugaucugcccaauuauuacaagauugcauuuccucaugccaucucuaaucagaggaaaagguuuaaauuagcagcaaucucaagaaugugaaucaagucugggcagaacuuuuguaucugacucaguguaagacuguuuaguucuuguuucaaguagucugcacaacaaauaccaugccugcaaauaugcaacaaacacucccaggaagaauauguuuguuucuuccauggauucagguaauaggaacuaugaacagaucuuauaaaauuuugugggcauuuauguguugcuauuaaaauggaauaaagauuuucuauuucugggggcaauguagauacaaaauuagaaagucagacagguagauauguuuggccuuuaaauaaaguuuagcuuuaaacuccuaaucuuauugagguacuuaaaaauauguaagaaucaaaauauuuuacugacaguggaaccaugguuaagucaagagcuuuagggaaaagaguauauguauaugaauaugccuaaaaguaaauagggauaauggauucaaguuuuuguuucauaugauaucuaagaaucagauuucuuggaguagaaucccaugagugaauucaucuuuccacaaacuaugucaucaggcucauuuuucaaaaccaaugugcacaacaccuggucaaacuucugcgucaacuacauuccgugucaauaaaauguuugcuuugccaagggagacucugagaaagugaccaauauguagcaacugagaagucauuuaaaggacaucagaaaaugacugagccacgacuaauucauuuggcagagcccgccaggcaccaugagcuaacuggagaaaguauugguucuuggugucauauuuacaugcaaaagaacuggauuaaugaggaaacaucugguuauuucggguguuaucagaaugaccaauuuggaugcuucauugaaaugugcaacuuagcaagaaaccagauuggaaaaaaaacagcacuaaaugcggcuaaaaaaaaaaaaucuacagacagauguagacuuagaaagagcauucauacugcccccuccccuuuuuaggagguuccuugguuuaaauggaaauuacugcaugguggacaaaucuccaaaugcaguuuuauguacugcuuauuggaaaccaccauacaaacuaucuguuuuaccuuaacccaggucuuuuacauaagaguuucagugugaaaacucguuaagaauuaaaccuaguuuugaaacccuaagcuccaauggaucauuacuaccugaugaaaugcuugguuuccugcaauuucacaguugauauucaaaucccaagcauccaugcuucucuggcuccuucauaaauucuuaaccucuuccuuucuccaagaacguuaauuuaaguuauaauucucagcuuccagaaucuuguuuuaucugagagccacuaaauguaagcgaguuuccacguggaagaaacguuaaaaacuucuuagaacuuagucaacuucuagaaaggaagggaauuguggugggccucaaugaccauuaagucaugaguuagggagccugggcugcccuuguggccuucaagaacucuuuggaucuuguugcuccuugaaaaauccagguuuagaaccuccgggcucaccauccuauaaacagguauuacagcacuagacaggaggaagucuuucuauguccucuguuuguccuguggguauucaaagaagguugucagggaagaaggaugucuuuacccuguucaaaucucagucuacuggcaucuccucucaccuaaacaccugacacuuaauccgggcuucucauuugauuucuuuuguuaguuugggaaagccugaauauuuuaaauuuuauugucacucauguuuucaccaugucugucuuaucacauggugaaacugugaguaccuaagggcagaagcugcucucacccagcucuguacuccucccauagcaucuagcagauuguaugcacacagaaagcacuaaaccauguuuacugguuuuauaaucauuuuuaugucuugucuagauguguucauuuauaugcuaaaucaccaaaaaaaaaggggagggggagagagagagcagugauccccuuuuaagcugcuuuucuggauuaauuauauacuaaucuccaauacugcugaaccauuuccaucccuguuaagaaauauuucauuagagagcuugucaccaagaccauucuucauacuugauguacaauaaucuaaauauaacagcuuagauagacuucuguuuauagagaaguuuguccucauauuaaggccauuagguaacuaagauauuuuuccucucuuuuucucuaagaaauaaaggauaccaccuuaaguguuaguaaugcuaaaaacuaaaauaggaaguacuaacuuuagcacucagggcuuaaaagaaacuuggaucaugacaagauucgaaagaguguucaugaggcaauagcauaguuauuguggggaauuuagcagcugaauugaauauguuaaaaguaauaauaagccuuaaauaaaaugugcauuaacuugccuugguuaaaaagcuggaaugaaugauuauuacucccuaaaucacaugugcugaaauuacacugcaaucaaaucucuuaggaaaagauacagugauccuuaaaugacuacauuucuauuauuaguaggcauuuggcuucaugcuacaaauuacuucuaugcuuggcaaauguggccaauuuugaagcacaagauauuagaauuacuuuggucuuacuuauuacuucacaauugaaacuauuacccauuguuuggcagaaacucauugggugaaauuugaaaaucaaugggagcauuucugcaacuauuaagaauguucauuuuauaaugaaaaauauuuuuuaggaaaaugaagaaguuaugggccuuaaaaauucccucuuuuagaugauuccuacagcauuuuuacaaagguuuuguuuacuuuuguugggggggcuggaguacuguagcccuaagaauugacuggcaaaaugccuuuuguaguugcuuuaacuggugugugcaaugggcggggguggggggggcggugcggggguagcuguuuccuaucugaagaggauccagaggaucuauaagcccuaggaugucugacaaaggaaaaacauugcaaccaaguggaaaagggcacugggguucaaggaccugacaaaauuaggugcaucaugaguuguuaaugaaauacacgcuaaaccagaagagcuucuuuuucuccauuaccccaccugaacugucugcuucuuaggagcaggaccaugcuuaauuaacacuguaucucuaaggucuugacagagggccuguuuauaguggaugcgggaaaaaaggaagagauggauggagaaagggagaaaggaaggaaauauuaaguuacugugccuuaaaaagcaggaaauuauuuuuuuuucuuggugcaaagagacuucacauauccuacuuucacuugguagucuuucucacauccaaauuggcagaguuugccuaugcaugaucaugacugcugggggcaaaaguagaccccuuaugagaagcuguccaacuaaagaggccagauaagagaggaacuguuucugucuucuaaaugguugcccuucugcuaggaggguaaacaggacaggaaauaucauucaaaggacaauguucaucccguaucucucccuauauaagagcagucaggcacacccaauuuuuccuauauaagucucuuucacaaaguucuaggagggaaauaaaaagugcaauuuaucugacauuuagaacuuuacagacuuggcugggaucuuuucuccagaguuauauugauggccuuuggaaaaaauaaauguaucaagaggcauaaggcauaugcaauuauuuuuacaaucugaacuaaauaaauguuuuagugggcaaagaaaaugucaaacauuuaccaaaaaauaguccuguccagaaauuugccaugaaaagcuuggaauuaaauggaaaaauguuaaagauccuugaaauaauuaguugcugauucaaugguuccugcuagauauaaacaacaaaucacuuuugauggaaacaggcuauucuuagaauuuaaguaagcagugcuuggugacuguguuuaacuaacuaacauuucaccucaugaacaacauaauggaauucuaaauaauucccuuaugccucuuuuuuccauuuguuuaaaucuaaauucuaacuaagauuucauuaccggauaauuuugcaguacaaaauuuucuucaucacauuuucaaaccuuuauauuuuaguuaaacauacauaaguuuugguuucauuaaauaaaaagacaagugauuauuucacuacaaauucauuucagaugauuaucuuuaauucgaugaaaggcaauguuuauaaaguugccauucuuugugcacagguaauucagugugaauaaaugucagggaaccucaucuccuuggcaacuaugcauaucauuacucauuuacucauucaucagauuuuauuggauaacugcuguaugcaaggcauugugcuaugugugcagagucuacgaacugcagaguuuugauuaaaugcaugaagauaccugaagugguauuuaccugcacauacgaaggacagccuccaacuacaaacugcccacauuuugguuuauguucuagccuuuaucaaacaaugugccuuuucuccccuaaaagaaucaauuuagcccuuuaggcaucuauuccgaaauauccauuggugguccugucacucuugaagcuugagauaggaaauguauagcccagcauuccuauaagcccacccauucccccucccuguccagauggguuucauuccuaaauccaccaggaagccuggcucugcccagaaccuggcuugcuuugcaggcugugaaaaccccagcacgggaugccagauccccuaagacuaagagcugaagccaaccaacauccugggaaacaaaaagaccugccuguccagcguaauaaagccaagaaguguacagcugggagagauccugcacaucaucuagcucaguguccucuuuuuacagaugaugaaaaugagacccagggagauaggggauuugcacacagaaauccaugguaaccaggagcuaagaucuaaacacagcuuuguaucaacgacugguucagacacacugcuccaccccgugccaaaauaauuuuuaucgugcauuagguccaaacagggcugccgguuggggcagggaguacuggugcuuauuaucgguaccacaccagcugugccauccaguaggcauaacaaauacauaccaugauaugucugggaaucagagcccauuaaguaccaggcuguaaaauaauucugauaggaacuacugaaauaaggaaccacuugaauucugucuaccaacaccuucuccagaguuucgagucuguguaccauccccaacagaaaacacggcggcaaaguccugauucugcugcccuuggaacggcugagaaagagccugacuccagggggaaacaaaaucagcccuucucacugcagcagucggagcaucuggcaccgaccaugagaggcgcucgcucgugcgagacuucucgcuugccuuugugcugggacugccucuggcgacccugucagucugguuccuuccucuugcucucugaacccccgcgucccucgggggcuccagcgguucaagcccagcgguucugugggaagcucacagaaacaccuccacgaggccacuccccgcugggcgcggcuccaccucggggccuccccgccuaacagcaaaccugcuuguuggcacuugcgcguuccuccucgccaguuucacccggauuuggcucgguccgccagcaacccagcuccuugcuaaauucccagcccuaagcgcaggggccuuuacccagccuucccaguggguccugcuuuuccauagccgacacccuucuuggaaacaaacucgcuagacaccgcugguuagggcggcgggugccuaugucccagcccaagaccucagauggugccccccugccacuccccggccuuugaccuggccuaaaccccuaacucagccggggggccggaugccuucccaccgggaggguaccuagcccucccuaccaccgcgcgccagguaggugggugggcgcaugggaaagcaauaacccggccuugaaccucagacccaugaauauaacccaccgcggcgccaauaauucaaguagacuggaaggucaaaggcgaauaguguugcccgcggccuuggaggcaagccgagugggggaugcaauagaggucaggaggggcugguguggugaaggggaaacggacgugaucacugggauggagugggggaaaaagggaaaagcucgguacaggugggcaccgaggcaccgcgggcggccggcagcgcgaagaggagguucagcugcugcccggccccugcgccaccagcgcauuccuggguguaggcgucacgggcgccgcggcugccugcgcucaguuucuuucccucaacagcggcaauugcacguaaccgcgucgccucugggauuuucucccgccucccaucacccccgcggcgcuccccgccuccccgccaaccagcagguuagaucuaggaggggcgcccgccuugagccgggugguuccgccgaggcgcacgcagcgcccaugcaacaccccacaguaucgggccaccucggccgacccaaggcgacuugaccacgacuccgcgggcggacugcgccuggccacuaguggcuccaaccgcggggucacccugcgggcacacagcgcucuccucuccccacugcuaucuccucguccacgcugucgucugccgcccccacccagaagggauacaauuuucgcccaacagggaccgugggaaucccuugggaggggcgcagacggcuuguagcgcgcgguuucccgagacccgccgcgcaucccccagcgacuggaaacccgccccaagcgccacgcgguccucccacucuuacccgaagugucccacaggcucaacucuauucuuugugugucgauuucaaaacuggccguguaauucucaaacacuguaggaacguaauucuggauagacaaaaugggcaaaagaggaaggaaagagggcaaagagguuacguuuaaacgcacgacacccauugaacacccuuccccuccccgcuccccaguuaagaaagaaaaccuucacacaucagaccacacacuaagcacauggacccuuuccgaaaccccuguccuacuccccacucaccccacccggcucucacagaucugcugacccgaaucucccaaccccagguuaugcacacaggaacgaacaaguuucaggagcuaaccagcccaugugcaggcgcgucccaacccuaaaagcuuccagcgcacuuucccuuuccccgcagucuaaucaggggaaaguaguaaggaccgagaaagacuuuuuuuuuucuuuuuuuuuuuuuuuaagggaaaacggaugaaagcggggaggcccaccucgggacugggaucccacuggccgacccccucguggaagccgcggccggccacacucaccucggggaagcaguccuuggcgaagacauggagcagcgcaguuuuuccacacugacugucucccaccacaacuaucuugcauuucacguucugauuaggauccaugauagauuugcuggauaauuucuggcuggcucuucucuccuucauugauguugccuuauuuucucuuggaacaggaauuuucucuuaagaagaaaaaaaaaaauauauauauauauauauauuucucucuuuauaaaaagcagauauaaaaauaaaucacaaggcugaugggcaaccucugaaacgcggcgcagacgaggaggagagcgagaggagcaggcugguuacuccccuccaacaaguuuuaagccugacuccucaccgcgccucccaaguccaauuccgagccgacugcuu

SEQ ID NO: 21207 - RNA, 19466 nt, Homo sapiens
aagcagucggcucggaauuggacuugggaggcgcggugaggagucaggcuuaaaacuuguuggaggggaguaaccagccugcuccucucgcucuccuccucgucugcgccgcguuucagagguugcccaucagccuugugauuuauuuuuauaucugcuuuuuauaaagagagaaauauauauauauauauauauuuuuuuuuuucuucuuaagagaaaauuccuguuccaagagaaaauaaggcaacaucaaugaaggagagaagagccagccagaaauuauccagcaaaucuaucauggauccuaaucagaacgugaaaugcaagauaguuguggugggagacagucaguguggaaaaacugcgcugcuccaugucuucgccaaggacugcuuccccgaggugaguguggccggccgcggcuuccacgagggggucggccagugggaucccagucccgaggugggccuccccgcuuucauccguuuucccuuaaaaaaaaaaaaaaagaaaaaaaaaagucuuucucgguccuuacuacuuuccccugauuagacugcggggaaagggaaagugcgcuggaagcuuuuaggguugggacgcgccugcacaugggcugguuagcuccugaaacuuguucguuccugugugcauaaccugggguugggagauucgggucagcagaucugugagagccggguggggugaguggggaguaggacagggguuucggaaaggguccaugugcuuaguguguggucugaugugugaagguuuucuuucuuaacuggggagcggggaggggaaggguguucaaugggugucgugcguuuaaacguaaccucuuugcccucuuuccuuccucuuuugcccauuuugucuauccagaauuacguuccuacaguguuugagaauuacacggccaguuuugaaaucgacacacaaagaauagaguugagccugugggacacuucggguaagagugggaggaccgcguggcgcuuggggcggguuuccagucgcugggggaugcgcggcgggucucgggaaaccgcgcgcuacaagccgucugcgccccucccaagggauucccacggucccuguugggcgaaaauuguaucccuucugggugggggcggcagacgacagcguggacgaggagauagcaguggggagaggagagcgcugugugcccgcagggugaccccgcgguuggagccacuaguggccaggcgcaguccgcccgcggagucguggucaagucgccuugggucggccgagguggcccgauacugugggguguugcaugggcgcugcgugcgccucggcggaaccacccggcucaaggcgggcgccccuccuagaucuaaccugcugguuggcggggaggcggggagcgccgcgggggugaugggaggcgggagaaaaucccagaggcgacgcgguuacgugcaauugccgcuguugagggaaagaaacugagcgcaggcagccgcggcgcccgugacgccuacacccaggaaugcgcugguggcgcaggggccgggcagcagcugaaccuccucuucgcgcugccggccgcccgcggugccucggugcccaccuguaccgagcuuuucccuuuuucccccacuccaucccagugaucacguccguuuccccuucaccacaccagccccuccugaccucuauugcaucccccacucggcuugccuccaaggccgcgggcaacacuauucgccuuugaccuuccagucuacuugaauuauuggcgccgcgguggguuauauucaugggucugagguucaaggccggguuauugcuuucccaugcgcccacccaccuaccuggcgcgcggugguagggagggcuagguacccucccggugggaaggcauccggccccccggcugaguuagggguuuaggccaggucaaaggccggggaguggcaggggggcaccaucugaggucuugggcugggacauaggcacccgccgcccuaaccagcggugucuagcgaguuuguuuccaagaagggugucggcuauggaaaagcaggacccacugggaaggcuggguaaaggccccugcgcuuagggcugggaauuuagcaaggagcuggguugcuggcggaccgagccaaauccgggugaaacuggcgaggaggaacgcgcaagugccaacaagcagguuugcuguuaggcggggaggccccgagguggagccgcgcccagcggggaguggccucguggagguguuucugugagcuucccacagaaccgcugggcuugaaccgcuggagcccccgagggacgcggggguucagagagcaagaggaaggaaccagacugacagggucgccagaggcagucccagcacaaaggcaagcgagaagucucgcacgagcgagcgccucucauggucggugccagaugcuccgacugcugcagugagaagggcugauuuuguuucccccuggagucaggcucuuucucagccguuccaagggcagcagaaucaggacuuugccgccguguuuucuguuggggaugguacacagacucgaaacucuggagaagguguugguagacagaauucaagugguuccuuauuucaguaguuccuaucagaauuauuuuacagccugguacuuaaugggcucugauucccagacauaucaugguauguauuuguuaugccuacuggauggcacagcuggugugguaccgauaauaagcaccaguacucccugccccaaccggcagcccuguuuggaccuaaugcacgauaaaaauuauuuuggcacgggguggagcagugugucugaaccagucguugauacaaagcuguguuuagaucuuagcuccugguuaccauggauuucugugugcaaauccccuaucucccugggucucauuuucaucaucuguaaaaagaggacacugagcuagaugaugugcaggaucucucccagcuguacacuucuuggcuuuauuacgcuggacaggcaggucuuuuuguuucccaggauguugguuggcuucagcucuuagucuuaggggaucuggcaucccgugcugggguuuucacagccugcaaagcaagccagguucugggcagagccaggcuuccugguggauuuaggaaugaaacccaucuggacagggagggggaaugggugggcuuauaggaaugcugggcuauacauuuccuaucucaagcuucaagagugacaggaccaccaauggauauuucggaauagaugccuaaagggcuaaauugauucuuuuaggggagaaaaggcacauuguuugauaaaggcuagaacauaaaccaaaaugugggcaguuuguaguuggaggcuguccuucguaugugcagguaaauaccacuucagguaucuucaugcauuuaaucaaaacucugcaguucguagacucugcacacauagcacaaugccuugcauacagcaguuauccaauaaaaucugaugaaugaguaaaugaguaaugauaugcauaguugccaaggagaugagguucccugacauuuauucacacugaauuaccugugcacaaagaauggcaacuuuauaaacauugccuuucaucgaauuaaagauaaucaucugaaaugaauuuguagugaaauaaucacuugucuuuuuauuuaaugaaaccaaaacuuauguauguuuaacuaaaauauaaagguuugaaaaugugaugaagaaaauuuuguacugcaaaauuauccgguaaugaaaucuuaguuagaauuuagauuuaaacaaauggaaaaaagaggcauaagggaauuauuuagaauuccauuauguuguucaugaggugaaauguuaguuaguuaaacacagucaccaagcacugcuuacuuaaauucuaagaauagccuguuuccaucaaaagugauuuguuguuuauaucuagcaggaaccauugaaucagcaacuaauuauuucaaggaucuuuaacauuuuuccauuuaauuccaagcuuuucauggcaaauuucuggacaggacuauuuuuugguaaauguuugacauuuucuuugcccacuaaaacauuuauuuaguucagauuguaaaaauaauugcauaugccuuaugccucuugauacauuuauuuuuuccaaaggccaucaauauaacucuggagaaaagaucccagccaagucuguaaaguucuaaaugucagauaaauugcacuuuuuauuucccuccuagaacuuugugaaagagacuuauauaggaaaaauugggugugccugacugcucuuauauagggagagauacgggaugaacauuguccuuugaaugauauuuccuguccuguuuacccuccuagcagaagggcaaccauuuagaagacagaaacaguuccucucuuaucuggccucuuuaguuggacagcuucucauaaggggucuacuuuugcccccagcagucaugaucaugcauaggcaaacucugccaauuuggaugugagaaagacuaccaagugaaaguaggauaugugaagucucuuugcaccaagaaaaaaaaauaauuuccugcuuuuuaaggcacaguaacuuaauauuuccuuccuuucucccuuucuccauccaucucuuccuuuuuucccgcauccacuauaaacaggcccucugucaagaccuuagagauacaguguuaauuaagcaugguccugcuccuaagaagcagacaguucaggugggguaauggagaaaaagaagcucuucugguuuagcguguauuucauuaacaacucaugaugcaccuaauuuugucagguccuugaaccccagugcccuuuuccacuugguugcaauguuuuuccuuugucagacauccuagggcuuauagauccucuggauccucuucagauaggaaacagcuacccccgcaccgccccccccacccccgcccauugcacacaccaguuaaagcaacuacaaaaggcauuuugccagucaauucuuagggcuacaguacuccagcccccccaacaaaaguaaacaaaaccuuuguaaaaaugcuguaggaaucaucuaaaagagggaauuuuuaaggcccauaacuucuucauuuuccuaaaaaauauuuuucauuauaaaaugaacauucuuaauaguugcagaaaugcucccauugauuuucaaauuucacccaaugaguuucugccaaacaauggguaauaguuucaauugugaaguaauaaguaagaccaaaguaauucuaauaucuugugcuucaaaauuggccacauuugccaagcauagaaguaauuuguagcaugaagccaaaugccuacuaauaauagaaauguagucauuuaaggaucacuguaucuuuuccuaagagauuugauugcaguguaauuucagcacaugugauuuagggaguaauaaucauucauuccagcuuuuuaaccaaggcaaguuaaugcacauuuuauuuaaggcuuauuauuacuuuuaacauauucaauucagcugcuaaauuccccacaauaacuaugcuauugccucaugaacacucuuucgaaucuugucaugauccaaguuucuuuuaagcccugagugcuaaaguuaguacuuccuauuuuaguuuuuagcauuacuaacacuuaaggugguauccuuuauuucuuagagaaaaagagaggaaaaauaucuuaguuaccuaauggccuuaauaugaggacaaacuucucuauaaacagaagucuaucuaagcuguuauauuuagauuauuguacaucaaguaugaagaauggucuuggugacaagcucucuaaugaaauauuucuuaacagggauggaaaugguucagcaguauuggagauuaguauauaauuaauccagaaaagcagcuuaaaaggggaucacugcucucucucucccccuccccuuuuuuuuuggugauuuagcauauaaaugaacacaucuagacaagacauaaaaaugauuauaaaaccaguaaacaugguuuagugcuuucugugugcauacaaucugcuagaugcuaugggaggaguacagagcugggugagagcagcuucugcccuuagguacucacaguuucaccaugugauaagacagacauggugaaaacaugagugacaauaaaauuuaaaauauucaggcuuucccaaacuaacaaaagaaaucaaaugagaagcccggauuaagugucagguguuuaggugagaggagaugccaguagacugagauuugaacaggguaaagacauccuucuucccugacaaccuucuuugaauacccacaggacaaacagaggacauagaaagacuuccuccugucuagugcuguaauaccuguuuauaggauggugagcccggagguucuaaaccuggauuuuucaaggagcaacaagauccaaagaguucuugaaggccacaagggcagcccaggcucccuaacucaugacuuaauggucauugaggcccaccacaauucccuuccuuucuagaaguugacuaaguucuaagaaguuuuuaacguuucuuccacguggaaacucgcuuacauuuaguggcucucagauaaaacaagauucuggaagcugagaauuauaacuuaaauuaacguucuuggagaaaggaagagguuaagaauuuaugaaggagccagagaagcauggaugcuugggauuugaauaucaacugugaaauugcaggaaaccaagcauuucaucagguaguaaugauccauuggagcuuaggguuucaaaacuagguuuaauucuuaacgaguuuucacacugaaacucuuauguaaaagaccuggguuaagguaaaacagauaguuuguauggugguuuccaauaagcaguacauaaaacugcauuuggagauuuguccaccaugcaguaauuuccauuuaaaccaaggaaccuccuaaaaaggggagggggcaguaugaaugcucuuucuaagucuacaucugucuguagauuuuuuuuuuuuagccgcauuuagugcuguuuuuuuuccaaucugguuucuugcuaaguugcacauuucaaugaagcauccaaauuggucauucugauaacacccgaaauaaccagauguuuccucauuaauccaguucuuuugcauguaaauaugacaccaagaaccaauacuuucuccaguuagcucauggugccuggcgggcucugccaaaugaauuagucguggcucagucauuuucugauguccuuuaaaugacuucucaguugcuacauauuggucacuuucucagagucucccuuggcaaagcaaacauuuuauugacacggaauguaguugacgcagaaguuugaccagguguugugcacauugguuuugaaaaaugagccugaugacauaguuuguggaaagaugaauucacucaugggauucuacuccaagaaaucugauucuuagauaucauaugaaacaaaaacuugaauccauuaucccuauuuacuuuuaggcauauucauauacauauacucuuuucccuaaagcucuugacuuaaccaugguuccacugucaguaaaauauuuugauucuuacauauuuuuaaguaccucaauaagauuaggaguuuaaagcuaaacuuuauuuaaaggccaaacauaucuaccugucugacuuucuaauuuuguaucuacauugcccccagaaauagaaaaucuuuauuccauuuuaauagcaacacauaaaugcccacaaaauuuuauaagaucuguucauaguuccuauuaccugaauccauggaagaaacaaacauauucuuccugggaguguuuguugcauauuugcaggcaugguauuuguugugcagacuacuugaaacaagaacuaaacagucuuacacugagucagauacaaaaguucugcccagacuugauucacauucuugagauugcugcuaauuuaaaccuuuuccucugauuagagauggcaugaggaaaugcaaucuuguaauaauugggcagaucaugcccucucacauguuagcugcugcugcguucagaugugcucaugguggucacuaaauauaccaaaaguuaaucuacuuuucucugccaaaaauaugcaauagcuuuagcuuacucuucuugguaaaaauuucuuaagggggaaagggaagcuuuucagaugaagguucaaguuaaauaaauuauauuuaugaaauauucaacaagaagaguuuucaguucuccaacuccucuaaagccucacaguguuuaaacugguacuuugcaaaagguuccauaaagccuuccuuuugggcaugaaucuucuuacauauacauuuaauuauguacauauaugguguguucuauauuugcgaaagggugacuucagcaggcagguaugugucugaagaauuaguuucugggugaggcacguugugacuauucuuuggcuggaaauuuugcucucacccagaauuaaugaucuugaauacaaagauggguagaucugaaauuucaaaagcucucuagaacuuugcugauguuugccaaacuugagcaacucagagaaccccaaguguacacuuguuccaaucuacccccagcaaagccuuucaacuauauuuucugggugagcgggguacacauuuugcauauauaguguaguuguuucuuuacaauauagaguuucccuaaguuuuuccuucagagguguggcagguuacuuaaaaaggaccuuggaauaggguugcgagcuuaaaaguuucauauaguaccagagaaaugcugcaucugagaauuuccauaugcaugaagccuauuccacaugcugaaaaagaguuucauuugacaagccaaacgcagucccuaaauguuauuggacuuuagugcauucuuagguacuagagcacauacucuguguauaucaauaccuaccauguacugcaguuaaaguugaauacuuucauacuuaguaaaaauuguugagcccuccugcuugugcuguguuuaguucuacaguuagcaccuugggaguuuuucaugugcaucuuuuaaaaacaccuauagaaguuaauuuuuuuuuuuuuuuuuugccguuuggcuucacaggguguuguaagacuuuucuggagggauauaggaguuaggggcagguauuguuccugcuuuacccacuuacuuucagcuccuuccuuuggugucauuucugccccucuuuauugcuucucacuucacagagucauuucuggaauuccucuuccuuuuuuuuuggcaugcguugucucacgcauaccugugauuccaccgugcccucuccagcuuugcuugccuuacuuccuuugugcagucucuugggcuuuauggggaagaaaaggaaggauuccaagugcuuaaacacagaguaaacacuguaaaguuacacaggagguguuuuugugugugaguguuuuuguuuuuuguuuugcuuuguuuuuuuuuuuauccugaaaguccugcugagcugaugacuuacaucuuuccuggugggacaguucuugauaauucuauaucaauauuuuucacugugaauaaauagagacaauagauauuucuaucuaagacaagauaaacuuaaccuaucaaaaauauagugaauaaauggucuuguuauuuuaaauaaauuacucuugucauuggcagucaaauuaugcuuauaacuaagaaauaugggaaucaguuuuacuauuaccuuuggacacucguguugaucuaaaagcagcacuguucauuagcaaaaguaauagaaugggaucaaagugucaucccuaauuagaucauguuaaaccucuuaaaaauuaccugucuaccuccacaagcacggugguuuauuucucauaaaccuuugcacuacauauguauuuucacuuauacuguuaaccggauaaaaacaaaagcagauacaaacuucccugaaaaucugguuuaacuggagaacuccguuucauuuuaaaaucaggccagagucuaaauuuugcagauauuuagauauaugcacuaagcacagaagccagcccacuugauuuuaguagguagcagucuccagcaggugacucagggcugagcacaaagccagaucuccuuuguggccauaaaaugggugggggacgggaaacauaguccacaaaggggggagggguauucccagcagucaugugguggccugaauguugaaaccauuccucaggauuuuccuggcagucucaauuuuaauuaaacucuuuuauccucuuuguauuucuucaaucgcuuuuccuaauuuuuuuauuuggaaaagauggucuccauugucauagagcaguauuacaucuggaauuagcagugaguacucuaacaucauacaaaucguauccugaaaggagcugguaggcaccuggaacaguucucuaaagauaccaggucugcuuguacuggaagcucuccacagggagagagugguuuuuccuaaugugagugauuucugggaaaggagaucucugaagccucguuagguuucugacaauccuaacuguuggcagcuuugccuuccugggucugggaucagguugucucucgcggacuuugaggaguagaggaaacucucauuuauauguccaguauuuggagcuccacucuaugaucuagaauuuucugacugccuguuuggaaagagucauucaaauguuuacagcaggugccgugcuagaguuagacuuuggacacagaaacaggaaagguucuaguugagaaagugugaacuucuuagaacuaauauggaaauacuaauguagccauaaauaguguucaaccaucucguuucugaugccuuucgaauguucaaaugggugaacuauuugugaauuauucucuucaccucagaguacuuucagcgacugaaaaggcagccacagcuugucauuuucagagacggccucauucuaauauaccuucauacuuaaaaugacuugacuuuuuaaacucuaaacgcuuuaagcuucugggaaauaucuuucagcugucagccucugcucuaccaggguccugguuccagauguggguaggcagcugcugcagcucaugaacagcucugacuuaauucucuauuuauucacacuuuucuuccugauucuuguaacauucuuuucuuccuugcuuagcagacacacguggcuugaaguugucacucuccaucguaaaggagcuagagaaaaagcugcacuguugccugggguuccauagcagaugccagggacccagaguguacugugugaauagagggcgaugcccccugacuauagugccuuuuagaucacaagaacagccuccaagcaaauguuguuuugauagaaauauaaacagugacauuuuuucuaaagcugcuuuuuaagucucucuuccugacuuugccuauugagguuuugauuuaucaagggacaacauguccuguuuuucugcucaaaauggaaagugaugucaaaaugaaauagacuuuuaaaaagaguuuggugguuuagauuuucuuuuucuacucuggagucagauacauacguguguauauauuugccuaguaaaaucauuuucaugugaugcuugugaaaugucagcauacggaaaaugauuucuuaaacaagcggcauuuggcaggcuguauuuaguuuucuagucaaucauuucauaacuauaggccucauguaauugcccauccuuuggaauucuuaaagaaauagaagaaacuuccuugauugacuagagaguucugugguuaaauuaauuggcuggugccuugaaccuuuaggguacccuggacuuaauucagguuaagauccuuagaucaugccucagugucacucucagagaugggacucuguaaaaaagcgacaugauccuauacgacauuuauuacauucuugauuguaacaggaagaaaaucuauauaggguuuggcgauaaguuaaaauaagcaagcucaaaggucaauggccuauguaaacuuacaucuuggagauggguaacacugaugugguuucucuuugcauaguugaacccuuccucuuccucucucccucauucaccccuauccugcugucagaauugaucuugaguuuuggucucuuucccaagaaguaguucaguuuaugguucuugcuaccacucagcuuuuaacagcaguaauacaaccauaaugcccauaguuaauacguauugaucccuuacuaaaagccaggcccugccuggguuuacuuaaucucagguauguauguugucagcaucuucauuuuaugagugaagaaucagaggcacaggguccuaaagcuaccuugcccccucccuuuuuagugguggaggcagguuuacacacaagaccaccuggccccaggugcuucccuacuucacccagguaacuucaggcccuagucuuugaaccauacagauuucacuuaagauccuggcccucuucuugaauuuaugucagacacaugugaggcuucauucaucauauauuucuaagcaggcuuuugugugucuguuugaauucuuuuccaagaauuaggggaagugggaguugggucgugaugugacagucaaaggacuuagccggaaaggguagaguuaaugcaugacagacaaggggacucucaucugaaaauuugugugucuuuguuucuucucagguucuccuuacuaugacaauguccgcccccucucuuacccugauucggaugcugugcugauuugcuuugacaucaguagaccagagacccuggacaguguccucaaaaaggcaagugcugggaaaugaugacacacuucaguacugggugauguauaaauagaaacgugggguuuguugggaagcucaaagacucuaaucaauucccugccuuacaauuuguaauuaaacacuagaaagaacccuuucacaccaaaaugggguuuccacuuuuugaugaugaacuugcuugaaauuuuauuucaugaagcucugaaacaaaauaccuuuuaagggccuucauguuuguccuuugggagaaaaaugguacagcuaacaacaguuauauuugauuacuaucauauucauguguuccuuccuucuuucagugacucaacagauugcaucuuaguuuacagauuuacauuugaccucaagucagauagugaaaggaaugcaauaauggcuauuuuaacaaagaagcuguguuuuaguuaugguguuauuagaaacagaaauggaacuaguguaggaggaauagggauguguccaaugugaauugucugaugaucagguaucugucuaguaauuaugaccagguaucuuucuaguaauauggaagcagugcuuguaaacauguuauauauuauaauguacacauaguuuauggaggcaaagguaagucagguuccguaggaaccuaacuaaggaagcuaugguuggaaggaaccagggggagaucaagaggaagaggaccuauuacaggaugggucacaggaacuagggaggccagugggaggaaggggcguuucuugaccuucagcaguugagacucagccuccagguaguuguagaaggcacaugccguguuaguccauggaucagcauuuauuagccacuagcuauuuucucagcccuggccugugugcugugggguuucagaaucagauccuuguuggagcacucccucuccuccacacacuggcuucaacaccggauguggcugagagcaaggcagugucaacugaggggugacccaugcagcccagucugaguaugguauggauugagaaagacaaacaugcagguguggcuagguugguuuuguuuuuuucauuuuaauuuuuaguggaauuuauuuguauuuuguguguuuuuauuaguuuacauuccccuauuauauuugauugcuuggcuugugugucauugugaaaucaggauuugaaguauaauaauccuucugucucuacuaaauauuacaaacagaguucaauaaaacucuuaguagaucucuuucuuaauagaucaaagacucuuuuuuccuuuuuagcuccuuucaauuuugaguaauacauaucuaacacaaauaaugcuaaugcuugucaaauccaggcaggaauacaccuuuccugucuuuaaugcuuguaaacaauugcuagacaugcagagggaggccaaagucauuacacagcugaagagcaacauaacaacaugucuaguucugucuggagauaaaagggguugcuuauuuacuagagauuuuacuugauguaguaucaggcuaugcauaauuuaugaugaaaagccuuucuccuguuuuauuuugcuuuugucuucuaagaccaaaugaauagugacuuugggcuuauagauauuaaugaguauguuuuacauuccugugagguuuaaggcucaugauaaccccugcgguuugucuugauuaauggaacccuuuaaguccuucacuaucaaagaggagguuagaaugacuugaaguagggaggauuucuuuuuuuuuuuuuuccaguucaccuuccacuucuaaugccagugccaccuagcaugugguagguguuccuacauaauucugaaaggagugagggagagagggagagaggaagggagggaggaaagaaggaaagaaggaaggaaggaagggagggagggagggaggaagggaggaauaaguggacaaaaugggcucuuauggaaaguauauuacuccuuugaauccucugguguaguuugcacuagaguucguuacccaaaguacaccccuagauuuggagaugucuccucuagugaucuuuuaaguuauucuugcaggaugucccucuuaucuaguguuauacuuaauacaugacuucaucacccccaguauucugugaauuuccuuccagaagacacagcuaugucuuagucaucauugucacugccacaguacuuaguagaacacuuacauauuugugaaugugggugggaagagucaggcgccacuuccccaucucagccucucuaggcccugcccucaaaggccaaagaucuccugugaccgcccugaacucuugacucccaugcuguugcagagcucaagcuugaggaaaugaagccacaaaaagcugcuugcuuguucuuaaagaggacaguuggaauuccaagccaggcauugcugaagguucuaauaauucuuguuagaucaugaaacaacuagacaaauuggaauagauugaaauaguuuuaaacuaacuugaaggcauaugagcuacaggaccagcugccuucccgaugacccaagagauguuccuuugcaaaugucauggucuguguugaugcaaccaugugaacagaaacuccuucaaggcaggauguucuguuuuauuaacuaucucagguacuuaaaauagagccucagcucgugguggcaugcuucaguguuucaugaugggaucagggaaugcauacuugugcuaguguugccucugccuuauccccagccuucuagugaaggaggaucagauccacacaucgaaggauguggucacuuguuaggauauauaauuauucuuaagacacauuuaucuuuaagagacacaccaauaauuaagacauuauugaagcuaccuuuggacaacaucuaccaagucucuuucaguagcaacagaugagucacagagagggagaaucaaucauaauauacauaauuauucucuaaugcuuaaaaaguaguaaaacuucacaucuguucaggagauaaaugcaaaguuugcuucuucaucucaagggacacuccauuuuuaacaucuuuucugaguuucauucuaaugucagccaguggagaaaugguuuucaugauauggauaccguuacuuuguucauuuuuaaucuuuuuuuuuuuucuuucauaguggaaaggugaaauccaggaauuuuguccaaauaccaaaaugcucuuggucggcugcaagucugaucugcggacagauguuaguacauuaguagagcucuccaaucacaggcagacgccaguguccuaugaccagguauguauguugcccaugugcaaaacuggauuuuagaaagagugaaagaaauggacuaucacucauaauaaauaaaauaaaaaguagcugcuuuucuaaaggcucacccaguggucaguugugaaauuuaaaaugcugucauuuauuaguguaauuacaugauauucggguacauaaacaguugauaugcuaaccuuguauauuucugcaccucccaguagguuuaaaguuaaauagguuuaagagagaauguggucaaaaucaguaauacucuuuaagagggguaaucugauuuuacagucggcaguacaauaauaaggcuguugccaguaaaguggaacacuccauaacaccaucuuucagagagucuucauuucuguaagcauuucccccaaguauuuagaaaugagaaucaguuucaaaagcucauucucauaaaaccuacaaccagauucuaaagagaguucauguugaaauaccaaaauuuuauuaagaaucaucauuuuaaauaccgcagucuucuuagucuuccauuucucauuagcaaaaaauuugguauuuuaaauaaguaguuuugguuaaugugcacaugcuuauuguuguguacguuggugguaugguucacacuuagaaauuacauauguuguguuucauaaaguaacagauguuacaauaguauuauuccuuuccucaacgcauuucggcccuaaguaagacacaaucacauacauuucaaaaucgauuuuaaauuucauucauugccccuguuuuugguacaaccuagucacuagucuugaaugccauuuacccucaagaaaagagaaaugaagugcaccaugaggcgcuggaacagguucucaaggccacaucgccacggccagagcuguguggaaaaugcagaguuuauguucaugaccuucagcuaacuuacuucacuaguaagcuucucugcgccauuccaugcuugcugugacccuggaaaaccugaauaaccaguuaacucuugcuugcaguugauagugaagaugaaucacuucguuagcuccacucuacacuucuuugaaucaccucauguuaaguguuugauaaccagggucuuccuuuguuaagaucagccuuuagcauuuauucagagcucuaacaccucuaaugagccaugagaguugggcaucuuagggaugggcucuggacugcaaauaguuaugaaguaauaaauaaggcaguuuacauuuuaacaacuuuuuuuuuuugcaaugacacuuggaaaauucaguuaacauaucagcaaacguuuugcaauguguuauuauuuugugguauuagaagaugcuagcuaacuuucccccaaagucuuauugcugguuaaaaucccuucuuuugcuucucagggggcaaauauggccaaacagauuggagcagcuacuuauaucgaaugcucagcuuuacagucggaaaauagcgucagagacauuuuucacguugccaccuuggcauguguaaauaagacaaauaaaaacguuaagcggaacaaaucacagagagccacaaagcggauuucacacaugccuagcagaccagaacucucggcaguugcuacggacuuacgaaaggacaaagcgaagagcugcacugugaugugaaucuuucauuaucuuuaaugaagacaaaggaaucuaguguaaaaaacaacagcaaacaaaaaggugaagucuaaaugaagugcacagccaaagucauguauaccagaggcuuaggaggcguuugagaggauacucaucuuuuuggaauccugaccuuagguucggcauguagaccaagugaugagaagugaauacauggaagaguuuuuaagugugacuugaaaaauaugccaaaaaaugagagauacaaaugagcuagaggaagaugaggggggaugcgaguaccuccaagaagaaaaaucacacucugaauggugcuugcauuuuuggguuuuuuuuuuuuguuauaaucuauucauggaucuccacuuugauuuaauuuuuaaauguuuuaaucuccuuuacaaaaaguauacguuaauauaccguccucaagggggaacuggcacugugaccuuagcauuuaguuuucuagaggaugugaucuaauuucuuucuagcucaucauuaaaaaggaaauuguaucaggacccaugggauauauccagaggcaaacuuuaugaggcuuugaaaucuugccuuccugaagauagcugaguaggaugguucuaaggaaagccuuugcaaucuugcaagauuuguagaccagcacuacaaagaucgcauagaucaaauaggaaaaaaaaugucgauuuuuauucagucugaugguucuguucuucauugugauugucauuaaaaagugguaaauugcucaauguaauauuuuugugcgcuguuuagaaguugugugauuuuuugccaucguugauaaaaaugcaaagucaaauaaaaggugucuugguuugaugucauagaaugauccaaggagagaaaaaagguaguuacuguuuucaccagaaaagguaaugagugaaggaaagaauaguagcagaaagcacaguuugugaguaaagcugucuggaauuaaguuaccaaaaauacaaagcaaaaggacuauuauuuuggguugaagcuccaaaacugacagcaucugauaaucuguugguuuauuucacuuuucauuaaaugaacauugaugagagaagaugccacuuacccaagcuuuagagaaucccuaguggaagauuauaugauaaacuuucaguccugacauaacacuagggcauuucuagagugucauugcuaaaaccucacugaacagaugcagccaaggucuguguucagcacuuggucucuguuguuacguaaaauaauaagcauuuaaaauaguuuacagauauuuuugaccaguuccuuuuagagauucuuucagagaagaaaccagaucugaccuguuuauuguuggcgcuuguugaaaacgagcuuucuuucccaugauagugcuucguuuuugaaguguugaagcugugcuccccuuaaaucguggcaggagagauuaagguaauuacaacacucaguucuaugucuuacaagcacuuugucuugucucugcaagaaaauucgauuccagucauuucccauaaaauacagacauuuuaccaacauaauaugcuuugauugaugcagcauuaugcuuugggcaguauuacaaaauagcuggcgagugcuuucuguauuuaaauauuguaaaaagaaaauaaguuauaacuguuauaaagcagaacuuuuguugcauuuuuuaaacuguugaagucacuguguauguuuguuuggucaauguuuccgcaguauuuauuaaaacauacuuuuuuuuucuucaaauaaaaaaguaaccaugucu

SEQ ID NO: 21208 - RNA, 47537 nt, Homo sapiens
cacuucgcuccgcgcagccgccuggucugcaguuuguuggagcucugcguccagcgccgcugccgcugccgccgccgccgccgccgccgccgccgccgccgccgccgccacuaccaccacuugauucuugcagccacccugcgaacccugccacacugcgaucgcaucaucgcgguauucgguucgcugcguucccgccgccaccgccucggcgcccuuucuuggcccuuguucccccaaaugucugacucugacucucggacugagaaacgcaagguaaauaccuccaaaucccggggcgcgggccuggcaccgaaggaagacuagcgcuggagcccgaacggcaccaccuacugcccgcuucccgugcacgugcgagcggagacgcuugcaucggcgccgcuugucgccggcgggagguggggauccguguggaucggguucccucucgggcagguucucuuuaaagaaaagucguucacgcggaaccugcaggcucuuggccgaagugcggcuugggacgggaugcugcgcgcgggccuggugaagggucguagguccgggcaggaggagaggcagcgcgugccuuucggcgccggcccgggagcugaggaccugcucguaguaucgggcugugcgcccagcuggaaagucucgccgccggcuccggcgcccucagaguagcggccgcgcagugugaggguguuucgugucuugguuuuuuggggcgcgugggccuguugcggaggauuugcggaacugcgguggugauuuaacugacgagacacggcuuuuccuuuuacucauucaggccaagguuucggggccacugcugcguucgcuuucucaagcguaccuggggccccugcuugcucugcaggaguccugcggccugugccauccgcacgauucccuggcagcgagaaaucuagguccuccccugaccaccuggaccgcgcaggggacuagucgcggccggcagaaccugcucggucccugggccgggcuaucuuagcggcucacgcaugcccgagcacacccgacccgguucgcggugcaggcuggcggcgccgugcccucugggaccuguugccccaggguuggcgcugcugguggagggcccgacggacgccagggcggagggugugaauuuacucgauggucgcggacgugcgcguccgcggccagggguggcucuucggcuuugacucgugucugcggcgcaccaggagagagaggaaguuguuggaggagaauaguugccacagccagggcggugacggccguuagggucugcccccgacgggccaaaacaaggacaaguggcgaggacugggccuggggauggcccugcggguccgggcgcggcgcaaguccugcuuugucuccaggugacuggcuguccaggacggcgggagcugcuaaggcuuguguccggaaggagcacagggaugggcaggguggccgggccagccggcccucaaauccuccgacgaagcggcagccgccacgaccacggccagagcagcgcucggaggcgaguuugucaacaaucgccucgccuuuggcggccugacccguaggcgccgcccccaccgcggcugccgauuggcugcggcgcggagcgaccgcgcgcggaccaauugggaacgcgggcacccggcgccagcggcgcggggaggucggcggugccggcggcggcgggcgcagagcgcgaggggaggagcgggaggaggcggaggauguucccggcggcugcggccggggcagcgcgggccagaggcgcggcgugcggagcccucggcugcccggcggagcgcggcggcgggcuggcgggaaggcgcgggcuuugcgcugcgccggggacucugaacccgagucccgggcuuugucuccugcgcugcuuucguggugacggucagggggcgcccggucggcgaagggcgcgggccggacgccgcggggcuuggucccuggcccggacgcugcgcucugaagggaaggcgcggacgugaguuucggugugauugccuucugaggggagggucugugggaugaaggcggcgcggcgcgcaccggugucgccuagccugcggaccuaguuguagaccuugcaggcguucgcuucgucgcccuccgccgcccccuccccauuuagagaugugcaccucacggugugcaccucagagaaguucugucugauucggugcggcgugcgguacgggagcgggagggagggagcacgggcggagagagcgccagagccgggccgagccgcgcuggaguuacaaacucuauugugacgcacuuacuacgacugacggccgcugccagaccuuccccagacuugcugcccucagcauuuucggcaaacaauggggccggagcagggaacgcggccagccgccugcaaucgcugcaucugcgcccgcuccugugcuccggcguccuaccuaaccccgggaagucagagccgcugggaguuucugacuuacucgaagaagucuguccugggcaaagagcacacacgaauagacuucagauuagcugcuucucuggaaacgcaugugugugugcaccaguuccgcaagcuguugacauuguuacuguauuuuguuuggggguacccucuaccaaaaaaaaauuacaccuuuauuauuuuaggugcaauuuuuuuauuugggagauugucagaaaaguauagaacaaaguauuugggauuaacccuaagaauuuuuaaucgcuaggugagagcuaauuuguuuauucaucgauuuuuuuuuuugcuuaaaauaaucuuaguuuuuauuuuacuugcagaaaaaaagaccaaauggcaaagcaaccuucugauguaaguucugagugugaccgagaagguagacaauugcagccugcggagaggccuccccagcucagaccuggggccccuaccucccuacagacagagccacaagguaauccugaaggcaaucacggaggugaaggggacagcugcccccacggcagcccucagggcccgcuggccccaccugccagcccuggcccuuuugcuaccagauccccgcuuuucaucuuuaugagaagauccucccugcugucucgauccuccaguggguauuucucuuuugacacagacaggagcccagcacccaugaguugugacaaaucaacacaaaccccaaguccuccuugccaggccuucaaccacuaucucagugcaauggguaagcaaugccuggguaagaggcaguugacguguggaugguugaaucugcuugaaggcuguguguggcauuuaaaauccccuuuuaaaaccccguaacugauuuauuccaucuuuagaugggaauggaggaugugucaaacuaucaaaccaacuuuuuuuuuuuuuuuugagaugagucuugcucugucgcccaggcuggagugcaguggugcaaucucagcucaccgcaagcuccaccucccggguucaagcaauucuccuaccucagccuccagaguagcugggacuacaggcgcgugccaccacgcccagcuaauuuuuucuauuuuugguagagaugggguuucaccguguuagccaggauggucucaaucuccugaccuuguaaucugccugucucagccucccaaagugcugggauuacaggcgugagccaccgcgcauggcccacaucaacauuuuuacaaaguuacuaacuuuuguggcagugaugaguugagguccaaacauuagcuuucaggucugucuucauuaagcuaaaguguguuuuaaccaccaggcuuuacauaguaaugacauuuugcuugaaagggaacugaucauuuacagaaaauagcuuaauaaucaaaaguguaaagaaagaugacaaucauuuuugaaaauaacacuuuuaaaaaaaugaacuaguucaugaaagcaguaccaacauagaaccaugaaaaugguuuguuuucugccuaaauuccucuuugugcuuauugcucagaggguuuggacauaguacuaaucagauuagguuguagguuuuuauuucagggauuaaaggcaguaguaggguuugaaccaagaguggcuaacauaaauaccacagaggcccacagcaaaaucauggaaggaacugaccugguggagacugguaaauuggagaguauuugccccuucuauguuugggccacaccuaauuguggcugugagggcauguggucucaggguggguuuuccuauauugcaagauaaccuaggaaugcaaaauugaugccagauacccuguuucaacauugacagcugauucagauuuugaaaacauuguacaagcugaaaagaaacaucugcagacuugauuuggcccuugaaccuacagcaugugacuuuggguacauacuuuggguaaccuuggugaggggcugagucuguguugaucgacuugcuguuccccaccaauggaaaagguucaugucuugaucaguagucaaucacauugaccauuuguccagauuagcuugccauacaugaacaagauagaaguaaguugguagaguuaucaauuaggaaacccaguacagagucuauuauaauuuagauuguaccucaugaugaaggcuaacucaacaaacccaucagaacagacacuggaacaaaaugacauuucuaaauaccauccagcucugucuucauaggcuucagugagguaaaucaggcaggccuuugcccauguuauagaauuggaaagaaccucagagugguggucacuugucagagguugggcacaccugugaggugguggggagaaaugacagacaucccagcagcuacacaugcuggcugcacgucucuugccaaaugccaggagguaauuuuuuagggucccuccuuagggaaaggggcuggaaguuuuauuauugcuguuacuacugcucgugaacucauuucagccuuagaaguucuuggcuuguaguuuuuguuguacucaugaaaaugcucccccauauauaugaucauucucgcuuacuauaacauccuugcuuacuaaaugaguuaacagggcuuuaugguguguaucgugaaacacacgugcauuaaagacccucuggaagguauuagcuuuucacacuuucacaacaaaagcuucacacuugugguuauuaagcuauuuucucuaaccaguucccuuucaagcaaaaugcauacauuggucucuguaggugauggguuaaugcauggaaauaguuucuccuucccuggaacugggaauagugggugagauaguguauuuuuuaauguaaagacaggcacaaaugcuuuuuuuguugauaaauacuauuuuacaagcuaauuauaaguuaagcacuguuacuugagaugaaauauacagggcuucaaagaucauaaucuaaauaauuaugcacagcuaaugguuauaccugugaaguaaaguaguggauccugagguguaauuuuauaguauuagcugcauuucaguagauggugugaugaagaguuuaaugcauaggauuaaaugagaaguuacgaggaguuuguuuaaaguuaauguaccgagguaaguuuucaguguuaaguuuuugggagauuuguuuugggagaggaugaguugggguugggggaggaaaggacuuagccagaugugaguuucuuaaauugaagcauaaaauuuacaauuuauguaguccauaauuuucucuggacauucuacagucuuaguucaugccugaagaccacugaaauaaugcugaguugauaagugguucucuugacuuuguuuaguauucuuuacucaacccuauccaugaaguucuucaaugaagcuuuugauaauuuauugcaaaauacauuuuccacaaagaagucauuaugauugguuugaacuaguggaacacaaaugugagguuauaaagagguucgccuuagccaggggcuccuuuagcugcaaagcaguuuuuugcucagcaacuugggguagagaucagugugucuugaaguuuuguuuugcaaaacuuuguucuaaugagaaagucaagucuuaggaggaauguauaguaguugaguguuuguauuaacacuguuuucauauuuuccuuuuaugucucugauuuuucugaagacaaguucaaggaauauauuucucuguggggcaacagauacaguuuuuucacuuuuccucaauuuuagucuccuuacacucugggaggauuaacuugacaaaugauaccuuagugaauaacugauuauuuuuaucaaaaucacucacauguguugguuuacugagugccuuuuuggaugaguguuuuaugccauauguguuuuuaauggaaauuaaaguguagucaguacacuaaaguguagucaguacaauuggaaauaagaguugagaaaagucaggauauggaggaaugcucccuagugucauguuaguaaaugucuuaaauuuuauacuuguucccuggcacauuggaauucacagaugggaguuaauggcuuucuuuuuuuuuuuuuuuuuuuccucagcgucuuguggguacuucucuuauagcugguacuugucugaccccuccuuuaguuugugagcucccugggcggggaauaauggccugcagaugcuagcgagugccugacaaagaggagaagcccaggagauguugagagucaguccagcucugccuguuagccuuucagacaaauaaaguugaagaaggcagguagcaagaaaaagauccugaccucugcucugccaaaguguuuuuaauuaccuggaucuagcuguaagguuugccacguaguggugacagcugaggucuagcucagcacuacucagcagggaagccacacaugcauuaagcacuugacauaggacuagucugaacugaguugugcugucauuauugauacacacuggauuuugaggagacaaaaaagaaugcaaaauaguuuaauuguuuucauauggguuacauguugaaaugguguuuuaaauauauagguuaaauaaaauauaaacuuguauugcaguuaaacacaaagcguaaaauuuaccaucugaaccauuuauuucuaaguguacuguucaguaguguuaagugcacuuauuuuguugugcggccaaucuccagaacuucuucaccuugcaaaacagaaauucuguacucauuaaacaacuccccauuucccccuccccccagcuucugacaaccaccauucuauuuucugucuauuaauuugacaacuucagauaccuuauauaagugaaauuuauauaguauuugcucuuccaugacaggcuuauuucacuuagcguaaugucgucaggguucauuuaucuugcaacaugucagaauuuccuuccuuuuuaaggcugaagguuguuccaguguguguauaucacauacuucauuuauccauucauccaucaggagauacuuggguugcuuccacuuuuuggcuauugugaguagugcugcuaugaacauggguaugcaaauaucuuuugggggauucugcuuugaauuuuuuuggauauauacuuggaaguggaauugcuggaucauaugguaauucuauuuuuaauuuuuuggggaaccaucaugcuguucuccauagaggcugugccauuuuacauucccaccaacagggcacaaggguuccaguuucuccacauacuuaccaacacuuuuuuuuuuuuuuuuuuaacaguagucauccuagaggauauaggugaucuuucacugugcuuuggauuuauauuuacuggcuuagauuuguauggccaccaccauagucaagauacagaacaacucaaccacaaggauuucucaugauaccuuuuuauagccacagccaccucucucccucuuccuugagcauuuugucauauggucauuggugauuaaauaaaauguauuuuaauauugacuuucucuguuucuuucuaccuuuuuaaacauggcuacuagaaaaaugcacaauuagauuuguggcugguguucuguuucaucuaaacaggcuggccucacagaggagcuggagugugcagugcugcucuagcaagccaggcuugacucuucccacucagggcacaucacuuccaugaagcuuacuccuuggguuguuugguugacuuaggagaauggaagugauuagcagaaucuuguaagcauuuuaaacauuaaaugagcauuguaaacagcggcauucuucaggcaaauacaguuuuguuuuaccucuuuaaauuccaugguauauucggacuucaaaaaguagaugguagagcacaugcuuucucagcaccuucaggcugccuggagccucccaauagaggugucuucgagggagucccagcucugucucugaaaccccaaaguuacuuguuugacaccaagagaaauaaggaaacuuuuuagguccuaaguggggagagaaagugcuagaagagaaagauauuuuucuuuacuaguuccaaacacauuuauuaauuguuaguuacccaauuuuaaauuuacaucuuaaaaaaauuuuuuuucagauaauuacagauucacaugcauuuauaggaaauaauacaaagaaauuguauaugccauucacccaguuuccuacgaugguaacaucuugccuaauuauaguauacugucacaaccagcaguugacauuaacagaauccaucuacuguauugagauuucaucaguuucacaugcaguccauuucaugugucugugaguguuuacuucuauucagguuuaucaaauguguagauuuguauggccgccaccacagucaagaugcagaacaacuccaccacaaggauuucucaugguaccuuuuuauagccacagccaccuuucugucucuuccuuacccaugauaaccacucaucugaucuacauaucuguacuuuugucauuucaaggaugcuguauaaguguaaucauacuguaugugaccuuuugagauuggcuuuuuucacuuagcauaauucccuugaaauuaaucggagauguuguguaacaauagugccuuguuuuuuuauugcugaauaguauuccauagaugaugcaccacaguuugcuuagcuauucaccuguugaaggacacuguguuugcauguucuggcaaggcccuggcacagcuggaacucagggaggauuaaaagaaguauuuauuguacuuuuacuucucuuuuuuuuuuuuuuugugacagucucacucugucacccaggcuggagugcacuggugcgaucuuggcucacugcaaccuccaacucccaaguucaagcgguucuccugccucagccucccaaguagcugggauuacaggcacguaccaccacacccagcuaauuuuuguauuuuuauuagagauggguuucaccauguuggccaggcuggucucgaacuccugaccucaggugaucugcccgccuuggccucccaaaguguugggauuacaggcgugagccaccacaccuggcccuacuuuuagcaucuauguguucacuuguaguauauagaaauacaauugauuuuuguguguuggucuucuguugugcaguuugcugaacuccuuaauucuaagaguuuuucauagauuuccugggaggucuauauaguuaugugaucugcaaauagggacaguuuuaugucuucuuucugaucuguguacauuucuuuuucuugcccaguugcaccagcuagaauuucuaguguuuauguugacuaggaguggugagagcaaacauccauaccuaguccccaaucuuagggggaaagcuuucuguuuuuaaucauuaaauaugaugcuaaguguagguuuuauaugggucgucuuuaaaagaaugaggaaguuuuaaccuguauucccagaaugcugagaguuuuugucguaaauggauggauguuagauuuuauaaaauguuucuguaccaguugauaugaucccaugauguuaauuuauauuaaccuguugauaugguacguuccauugauuugcaauguuaagucucucuuggaugucugagacaaauccugcguggguagggucuguaauucuuuuugugcacugcuggauugaauuugucgauauuuuguugagaguauuugcgccuaaguucuugagaggggucugucgucuucuuuuaagacugguuuuuauaucagaaccuuaauuaggaaggguucccucuuuuauuuucaggacgauauuguguaaaauugguauugauucuuuucucaauguagaauucuguagugaaaccaucuaggccaggagauuuuuuuuuuggcgggggaugggggcgggggugggggggauggggggcgggcgggcauuuagauuauagauuuuuuuuuucuuaguuuuuguaggauuguucagguugucuguuucuucccaguugaguuuugauaguuuguagcuuuugaagaauuggucccuuucuucuaaguuguugaauuuaugaaugugaaaaguauuuguagcauuccaauauuuuuaauggaugcaggaucuguugugauaaccccugcuucauuucuaauacugguaauuugugucuuuuuuaucucugucagucuuuccaaaaguuuaucaguuuugauuuuuuuaaucagcuuuuuguuccacugauuuuucucuacuuuccuauuauuaaauuuauuguuuauuauuuccuuuugcuugcuuugugcuagguucuuuuccuaguuucuugagacagacacuuggaauaauguuuugagaccuuuccucucuuuucuucuuauuguuuucucagaaagaaacauuuaauagguauuuacaaacagaaacccuaucucgggcagccucaagaugagaugguagauccgugcaugguuacacuccagacccagggcuuaugagccauagggaaaguguauauaugcuucagaagggauguauaggacaguuggcuuaaguucaggauuuauggaaagauaauaucaaacuaaggacaggauugaugguaaguacaugcucauacccaaggaacaguagauaaaauagaaaucuuggaggcauucgcaaaaccaggguuaaucagaaguuaacacagcagauuagcauacaagauggaguuguuuggccuccacacuccagcucccaaucuggcucuuacagucucaugugccuugcucuucugccauggucccugaaccuucagugggugugcuucauuuuguauagcuuuaccaguagugccuuggcaauggaaaauaaaucgggcacaguggaauuccaaaugagggagauucucaggcuuuguugaaucauuuguaguccucagaauaccaugauucugguuuucugggaagaaguaaaacgagauaaauacuguuaauaugcacacaaagauuauaaugaaaaagaacaugaagaaaauuagaacucgguucuucuuuagagacuuguagcuaggaaguaauucaggaugcaguuugaguuguaggcaaauaauaaaaacucaaaaauaaugguuagggcuagaaucuguuaacagguauuguaguuuucuuuggagcacauuuuuuucuccaguuuccccauuccuaccaaggaccaauuuauuugcaaaauacauuuuagucucauuauacuuagccugauuauuugcauaaagugcaacaagaauagugauuggccauauaggcucuuuuuaaguuggcuuugcuggaauuuuuucauaaggaaucucagauuagacuuuuagaagccuccaggcuugaaagccaagcugaaaauuugccagcaaacauugccuguaauaccuacagaucgggugaauuccauucuccucgaggucccaaaguaucuugagguuccugggccugucggaaaaugacauucuuugcuuaucgaagaucaggaaccuuguaagggaacuguguagacaagguaccaggccugucuuuuuucaaggggcuuuuuauucuuuaaagcagucuggucauaucugaaaauacgcuauucagucaaagccuugguaaaauaacccaugucuccaauugcauauagaacauacucuauacaauuucaguucuuuuaaaugugucaagguuuguuuuguagcucaggauauggucuauuuuggugacugaacaaaagaaaacagauucuuaacugaacuuaugcaaauaacuauauugccauaaaauaagaauacucaugaguaguuuccaaauuuuggagaacucagaaagguaaauuuugcucaugaaaguauacuuuacucaaucauaagcuauaaauaacucaaaagcaaaaggauuuucuucaauuagaauggcagccugccaaacagcgugcugugcauucaccuuggaacugccauccacaaaccaagcagccaugucucaggagcagagaugguggagucuuacccccuuucgcuuuucuaauguacgcauuuauucagcgcuagaaauuuccuuuccaccacugcuuagcugcaucccacguguuuugguauguuguguuuucauuuucauugaguucugucuauauauuuuuaaauuuccuuugagaccuccucuuugacccuagguuauuuagaaguguguuuuauuuccaaaaauaccuaaguguguuuucuguuacuguuuucuuucugauucuguuauggucagagagcauauuuuauucuauuucgguuuacaaaugugucgagaauuuguucuguagcucaggauauggucucuuuuggugacugaucuaugcugcuuggguacuugaaaacaucuguauucugcugcuauuggguagaguguucguuauauauacaucuuucagaucuuacugguugauuguguuguucaguucuucucuguccuugcugauuuuacugucuuguucugucaguugcugagaauguggugcugaaauccccagcuguuuccuuucagcucuauuagaguuugcuucaugucuuuugaggugcugcuguuuggaguuuacacauuuaaaaugucuucagguuggauccaaucuucuaucauugcuguaaaauguacuuuaucugguauuaauagcacuucugcuuuuuuaacauuaauguauuaauguuaacauaguauuaucuuuuuccauccuuucacuuuccaucugcauauguuguauuugagauaaguuuuuuauauauggcaugucuuuagauaaaccuguuuuaucuagucugcccaaucugucucuuaaauggucuagaccauuuacauuuaagauaauauauguaagucuaaaugccuuuuuguuauuuguuuuuuguuuccucuguuccuuguuucuuuuuuuguuuuuuaaccuuacuguggguuauacgaacauuuucuaggauuucguuuugauauguuuaugguguuuuaaaauauauugcucuguaucauuuucuuagugguuguuccagguauuacaguaugugugugaaauauauauucuaagucuacugguaucaauggucacagcauuuuaugaugggagcugaagaguagaaaccuuacuuuucuuuaggcuccguuagccccauuuuuccaauauaauugucugaaguauuuccuccauguacauugagcacugaaugaguugguauuguuauuuuugcuucaaccaucaaauaugauuuaagaaaguacuguuagucuaccaauagucgcuuccauuuuuccccuuccaauguucuuuccuuucugaaguucuaagcuuucuucuuuugucauuuccuuucuguuuagagaacuuccuuaguucuuuaaugauaggucuguuaguaacaacuccucugaguucuccuucugggaaugucuuuauuuccccuucaguccagaaggauaucuucacggaagauagaauucgcaguugauguaucucuuucaguacuuggaaaacaugccacuuucuuagggccucuaugguuuuagaugagaaaucccuugucaucugaauugguguucucaacuaaguuaugugucauuccuauguggcugcuuucaagauugucuuuuaguauuaagaaguuuaauugugaugugucuugucauggguucuuuggguuuauccuuuuuggggugcacucagcaucuugaaucuggaguuucacguuuuaugccagguuugggaaguuuucagccauuaugucuuuaaauacuuuuccagucccuuccucucuuuuggaacucugaugauaagaauguuagugcuuuuguuaguccuguaaguuccugagacuguucauuuuuuuccaguagauuuucucucucuucagauugaguaaauucuauugauuuugccucauauucacugauuguuuuuaaaauuauguuuaauuauauuuuucaauucuaagauuucugccuguuucuacuagguaaguuggaaguucagauuucuccuuggcuuugcugguacuuuccaaacaaaagaggggccccagugcacacugcuuuauuguguccaguuguugggggagauguguaagcuuggcucccucagccacugcugacaccaggaagcagggagaccauagagggcugccucauaccuuguuucugcagaguagaggucagaacucagcuucccucugagggaagcugaccccaccaggggugggggggucagguacaacaugccaaccaggcccacuuucuacuaccugauucucccucuuugaugcuagaugggagaguucucuuuuguucucuuuaauuagccagauggggcgaagacucaguacccacugggugcccagacacccaaggcuggggcugggagagccgaugggcccaugaacccuguuuugcacugucugguucaguggguguguguaaugucaugucaacuaacuaaccccaccuuguacccacccguugcuguuuaguagagguggaggcuuagcucacugcucacugcucagccccacuaauguaacccugggaggggauguuagauaacugcccuacuaacacugcuuuggcagggcagccggaucaccucugccugcuucugccagggagggucugggagaucggccugcugacaccaucuggugguggaaucagagcaccuccugcuuccccugggcuggggaugggcuggaagaucaacuccccacucuggccacgcggugcuguggggcugcugccaggggcguugugguuuucccguugcuguuuggcuagaguagggcaggagucauggagugguuuucuguuguuaggucacccucuuuucagucccuuggcgauggagaacaggccucccauggagcuguuaucuacgccucuuggaaaggcccaguuggagguuucuucugcagcaugcuguccaggauacaugggagugaggaaaacggcauacucccuguccgucaucccucaaguccugagguccccagcagccuguccuauuucccgcuucaguuuuccugggccugcuugcuguguucucucuaggguugucugagguucugucucggguuuucaguugggagaggaaggaccuggggagauggcuccuccaccuuaguggaacuagagaucugcagcuuccuuuagguguuuaugguggcuauuugucuuagucccuuugagcugcucuaauggaauaccugagacuggguggcuuacaaacaacagaaguuuauuucucacaauucuggagggugauaaguacaagacaaaagcagguuuggugugcggugagggccacuuagacggcaccuucgagcuguguccucgagugauagaaaaugugaggguuucucuggggucucuuuugugagagcacuaaucccauuccaauggccccaccuccuaacacccaucacuuucaaggucagguuucagcgagaguuuugggggcauguaacguuuauaccauagcaguaucaguuggcucuggcugcaaagacuacucugaauuguagaaguuacuucuucacuccuuuuuacucuccauguggaauaacagacuuacaaugauggaaagagauuuagcugugauccaggccaccuuuuucagaugauaaccguaauaucuauugcuguaacuccacugugugugacucucauggugugaccauagggcgugcucugugcugcuuucgaacaucacuccugaaaauggcuggguaacccaauuccgauuuuauaugccuuaggggggacuucuuacuaaagauucagacuuguuuuauauuuagaguacuuguaguagguuuagagauacacaccuaauugccaguugaaugcuguacauucugaugccuugcugcuucacuuacuuuaaaaccauuaaaucugaucauuggcccagucuccacacaccucaugucuguggucauccugccugucacaggacucgcuaugaaccaccaccucucccugcccaucuccaccucccgcaccagaauuaaguugucuccauuccuucuuuguuagaccagccucagucucuugguguauuccucauguggugacauuucuagccuaauccacuucuggucccugcucggucaauggcugagacuugugcuggggcaucugaccucagacugcuuuccuucucugcaagucucaucacaccuguccuuggagaccucacaggcuugguccugugcugacuguaagcucugugccacccacaucucagacccugcacugcaggcauagagcagaagauguaacauuccuccccacuuuuuuuuuuuuuuuuuuuucaggaaaugcuagcagaaacauauaugcaaggggguucaucacagcauuguuuauacagccaaacgacuguccuugguccucuaaugggaggggagaaucuacauuauucugcccuuuuuuuggcagacuggugcugucuucaugguguuaaaaagaauaauggcauaggggaaaugccuguuggccugauguuaaguuuuaaaaagcugcaagauuauuuaugauagucuaguuuaauauuaaagaaguucauuggcauaucaaaaauauaagaauacauuaaacugucaguaguggguauuguuguauuuucguuacaggugggcuuuucucccuuuuuucuuucuuucuuucuuucuuuuuuuuuuuuuuuugagauagaaucuuacugucacccaggcuggaaugcagugccaugaucucagcucacugcacccuccaccucccagguucaagugauuguccugccucagccuucugaguagcugggauuacaggcacccaccacgacgccuggcuaauuuuuguauuuuuaguagagacaggguuucacuauguuggccaggcuggucucgaacuccugaccugaagugauccgccuaccucggccucccaaagugcugagauuacaggcguugagccacugcuccuggccacagguggucuuuucugugugccuuuguguauguacacaauugucauaacuaguauuauguuuauaaucagaacagauuuaauagauaauacuuacuaaaacuuuugcucuuuauaauuuuaaucuuuguuuuuggcauucccagcagccugucacugggcaugcauaccuuguuugugugauucaguguuaaccguugugucuuuugcauuguugaagauuuuguccaggcugaucaagcuuuggucccaucaggaccaucaccgaaaguacucggggugaacauuagcccccuaauuuacucuuuuggggucugccuuuuuauuuuuugcaaagugaguaaucucucagggaacaucuccaucggacaggaucauggauggauuugguguuggcagguugcucuugguagcugucucccccacaggcugcucuugggucuggagcagguuuugggucggguccugccugcccuccauggaaccugggcggagcagugagucugucugagcuucagcuuccucagccaucaagugaggacauagugcucaccucugagggucauggggaguuuuuccauaagcaaaucgacagaaagccccugguagaaacucgcacaggaaucuuuccuugccccucaaugagcccucagcccuggcagguuagugagcaugacuguaaugaagugcucucuacugcuuuccguggaaaggagcugucguuccaggaguauaggaaacuccuagggaagugaauucaucuggaaaugcuacuauaauucuaauccccugggucccagaacaaacaagcaagcaaaaaagaacaucuuuucuagaaaguggccuggaggggggcgugggaagaggaggucugaaucaccccuaaccugccagugaaccaaacaucaccugagaagaaccucagcuucuuggguaaaucauggagagacaucuggaaaccugccccaccccagcgcugucugaauugggggugaguuggggacaccugcuggagacggcccauuugauuuggcagaaacuugacuauaauucaaaaugugucuugagacaugagacauagacucaaguacuuuuucuugcaauccaaacuuacguacuuuuucccaaaauaagggauacauugguugcucguggauuuaacauuaggaguguucauugugugaaugaaaucaagacuucuacaacugcguuuuccuucuuuucccugagguaauuaaacuccuuuagugagaagacaauuuagacagacuguuggccauugauaaucaaaauuuugauauuucuaagugagugaguuauggauccuucuucuugguaaccuuuuuucacacacuaugagguagcggaaguaaaccgucaguauaaacaacauguacccgguuuaacccguuuguaagaggccaggccuucgugguuuuaaguauuugcuuagaaugaauuugucuccccaguguccucugggaaaccaaaaugugcuuuguauuuucucuucucugccuuggaccagauccacaugauucgugaguagaguugccaagacagguguggcaagaaauagcccugagacagggcugcuggcacgcagcucuccuccuguucugccuuucuguguggaccacgaggcagcagugagggcuucccauggagcaugucucccuuucagucacacaucuugcgcucacagucacugccagccaguugacugcaagugcugugucuguaaaccuugcaguggggacuugacauugcuuucagagugaggaaaccgaacuuggggauuuggacaugagucugggcugugcuuaguguuggagccccggguugaacuugggucuuugguacuggcagacugcccucugcacaguacauaaugcuugguuuaguuuggacuucccuuucuuaggagugagaugguuuugaagcuaaaauuuaaaaaaaaaaucauuucaagcugauaagaguguguguguuaaauggaaacacguucaauauaaggauuucagcuauuugaaauaccuuggggccuuuuccccccaaaauauauuguauuccugggucauaacaugcuucccauuccaguuccuaaaacauuuuacuauuagcaguuuauagaagacuuacggagugguuugauacuuuuuucaaagaaggcagcuuaaguggauggaaucugauuuucucuuaggcacgugcaucugcgaaggugucugaggugagccaagcucgauaaccugauuuguugagugaguuacuuuucugugggaugugugguggagaaaagacuagaaguguauuuucuuguugauuugucuguuauuuggucccuugagaaaggcauuaaccugaaguagucuauagugaauucugaauagauacaauguuaguauauaugugaguuuacaccucauuuuugcugauacuugaucauaaauucuacuaaauuagucaaaacaacaacuuaagaaaaaguuugauacauagcaggagugcaauauuuguugauuuaaagagacucucauuagcguuuaaugcaauauacgagugccaccaguuccuucucuuuucacuuggauuucaccagggugcucauuugaagcuuagaacucuguccucggcaaagaaagccuggcauacacuguacaagguguugacucaucuuuguguuccucugcuccucuagugugagguguggaguaggagguuccagcaggugacccagcccagccuugguccucccauaggccuauuaacaacccuggggcaaaugccuuagccugccuggaaaucucaguguuagggccauggcccuuccgcaguggucauagcaguguagggaguuggugccuauggggaacuggccuacauugaguuagaacaauccacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuauugcaagaacaaaaaaccaaacacugcauauucucacucauaggugggaauugaacaaugagaucacauggacacaggaaggggaauaucacacucuggggacuguugugggguggggggaggggggagggagagcauugggagauauaccuaaugcuagaugacgaguuagugggugcagcacaccagcauggcacauguauaccuauguaacuaaccugcacauugugcacauguacccuaaaacuuaaaguauauaaaaaauaauaauaauaauaaucccaauucuugugaguuuuuuuuuuuuuuugagacggaguuucgcucuugucacccaggcuggagugcaauggugccaucugagcucacugcaaucuccgccucccagguucacgcgauucuccugccucagccuccugaguagcugggauuacaagcaggugccaccaugccuggugaauuuuuguauuuuuuuaguagagacagguuuucaccauguuggccaggcuggucuugaacuccugaccucaagugaugugcccaccucagccucccaaagugcuaggauuacaggcgugagccacugcacccgaccagaacaaucccaauucuaucuguaucacacaguguguuucucaucuaggauacagacucacugggcagcagccgugucugcccuggaaagugggggcaucagggaggaggaggaaugugugaaccuaaacacauggaagaccuucaaaagcaccagaacacagucuuucagcacagaauucuuuacauccuuaacuugcacuugugcuaaugaagacucuaccuccuguucuuuuccuucugugacaaaacaaguuaucugucugggaagacauggcacaauuuauuuauacaacauuuuuauggcuugcagaugacuccgcuggauccucccucagaauugcccuucauagggaaguucaguggccacucaagugguuagcaaaaucaaggugaaaaguuuuucuuuuuauucaaaaugggauaaaaagaagcagcugccuuuugugacuuuuaagugagaagcuuucauuaugucuuagcccuacaguguguuaucaauaaucauaucuguguuaaauuguacuucacuuuguauaucaccauuguaaguuuuaaccguauacauuauaggcuuuuuccauuuuuauuuuaaaaacuguuuaagguguagcuuuuuaaggauucuguuuuugcucuuauuuuuuaccugugucuuggucuuucuuaucauggaggugaaaacaguaauacugaagaccuuaaugugaguuuaggagaaaagauguuaaucaccaguuuccugcuacugguuuuaaauuucauagaggaagccacacuuauuuugucaucagaaauucuuauauuuuuuguuuaaauucucaucucccuccccucuugcccagaucugguuuuuuggcuagaaacaacuuacaguaacuucaaauuaagcauuuuaauucuaaggaauggucuuaagugaaccaauguauauagaguuuuaucuuuacuuuuaaaaggucucuaaagcauuuuucuucuuauggggaaauaaauuggguaguuuaccucgucaguagaaaaaauauagggauuugugucuuugcacuaaaguaauuucaggguuggucuucuuuuagcuguccuuaguuuugggauuauuuuuguuuuucagaauaaaauggcacaggucagauacuuuuaauccccugaaaguaaucuaaagcuauagaaauggagcuguggcugucgcagagacuuacuaggaugaagguugguguagaaaaacuaaggaguaguagcaguauucagugucccgugucuuuccccagaagaacacuggcagaacaccaggggcagaacacugucacacacuauucagagcagcgauuucaggagcacaccaaggcgggccagguggucaaggggcuucccaggggaugucauacaaggcacauggaaagaacugguuuaggaccagguuuggcacagguucacugacaaaaaguggggugaugauugagagggaucauagauuuccuuuauagucccaggggcagaaucaagauugaaguggggcuuagaagggaacauuucaauucccuacgaggaauagcaucguagcacucaguguucuucagcgaggacagcagugccuuaggaaaugugcaucugucccaggaagcgggcacacaggcugggagucuuagagggcuccugcucaggucucccacauggugcaagaugcugggcuucugucgugacucagcuggggauguccuugaguauagggaucacagcucagucuggguuugcuccuggcuuguccccagcugcuaguaaauauguuaauaugugugucggggacagcucuggugacauggauaauuaguuuuucugauguugaaugagaaaugaguaaaaaggcauaacacauuaaucuuaaugucuuuagacuuguauuuuuauuauaagggacagauaauagugaaugagggaaaaaaucucaugaacacuaguuuccagacuucuguccaacuucacagccuugguuuacuggcaguuuccaaauggucaggcuggaaauugaugaaagcuguuucuuuugaccauggcuccauaaaggcaaugggcagugcacguugaaagaguaaguaugaaaacacuggccucaucucauaaacuuuauuauugauaguauuuuauccuagcagcuguuuuugaagcacugucuugaauucaugugacugcccaggcuuuugacacaaauguguuccagggagacagauugaggaaucuuugaguacuaaugcugucaucguauuucucauagcuuuuguuuucauccaguggcucagcggaauugauugggauugccaaaaaauaaaaugauacaagugagaaauagaccuggagggagguguguguguguguuguugguuacuugcuuauuuuauuucugagaaccgucagaguugaggauuucaaacaugauucugauagcauuuaccgcaaacgcugauggcaguugcucuccuuugccuuauagcuaacugggacuagaaacagcuccaucacccaggugaguuuuauaaggaaacauaagggggcuggucuguugcuucccuccucuuguaagcuuuggauaacucugaauuuagaaagauauuucugaagauauuuaaagaaggagacuuacagaguugaauaaacauccuggaauuuuucuuucucuaaaugaaugucagcuucagagagcccaccugcagacagaggcagugacuccccuaaacauuuucggaguaucucuuggaauugguuuaaagcugguuucagaguccacaaagaaauggcccuuuacaggauccuuuauugcuuuuggugguuaaagcagaaucucucuggagaguaaagguagacagcccugcaaugucugaaggacaggccuucuuucuccucacaccccugcagucccuggcugugccuggcuguuucccgcaagugccagacagaaugugcacuuuuuggcuaaguauguucuauuauguguguaaaauccucucucaguucugaguugaauaucgauucaaagcuuaauucacgcugaugacuugaaaaucuaaucuugauucuacucgaguguuuguagauaucugaacaucugaaaacaguacagagugcagcguuccugugaauuuuaauuugguuucugguacuacacuugaaauuccaguaaugauaagaugggaacuaaaacagcagcugccccucggaaaugagggucgcaccaccucguucccagacugaggcugcaguugagaaugcuugugugugacaugccccugccacccaguacacacaccugagucauuagaugucacuuuauggcaucgucacagagaacaacuggguuuuggagagagaaugucaugaugugacuucauuuccuuggagcacugggauagaggcucuuggguuagaagcucuuggacauuaaagagaaaucagaagguuuagccugacugauacugagcucauuauagauugacaaucucucuuuuuuuaaaaaaaaaaguuuccugccguggcugcugcuacagaaaguccuuugugaaagccccagccugauuucacuaucaaccacuuaaccacgguauuaauuuuucaguuguugaacuuuuaagauuuuaaauuacuuaagacuuuaaaaauagucuguugcugagccagaauaguuuguuaagaaacaugcaucuuugaguagaacuaaagucccuugguguuggaaaaugcccuccacacuccuccaaaaauggauuaagaauacuucaugguauuuucccauagguaguaauguuaccaguaaguuccgggcuucaaaaaaugauuucuaagaaguuugaagauucaguggacacacuuuuggcaaaaauugcuuauaucugacauauugcauuauaaaaguuuugauuaguggcuuucuuuuuuuuuuuuuuuuuuuuguaacaaguaaagagaaagaaaacauggaucugccuaggaagucaccucugccugagucugcuacuugcaggauuggagcuuuugcugcagauuacagcuuugaagucacuuuaccucaagagcaguuuauauuuuauugugcuuuaaaaaaaaaauuuagugccagguuuauggagugaagugcuuucauaaaugcugaaacuacauuuucuguggguaaaaaugcagcucaucagaauuuccccuuugaagaauuuuuuauguucacauaaaauugccaaguuaaaaauuugaucucccuacagaguaagagcuuucauuucaaauaaaaccauuuuauagaccagguaucaacauuuacggcggucagacacauugcagauagcaaaauaaaauauuuaugcuugguucuuacuuuucuuauaaacuagaaaugucaaccuaaguuaucuuuuugauagcucgaguauguuaggauaggaggaauuggguugaguauccagguaagauuacaggagugaggguggagcagcguguguuuggagauuucuguaugccaaaccccacgggcuccaggcacgcuuuuggaagaccauaccgguggaucccuuugucaucgugguggcaaagcaaacugaugcuaaaggaaauaacaaaacuuaauucucgugcugaucggugccacuguggggcuuacagaccccauucauuuguucugguugauuucauguggugugagacucacuaacauugaauuagugaugaaguuaaagagaggcuuucucuauccccauagaagauauuuugucacuuaagaaauaauugaacuuuauguugcacuguacuaacagauuaaaacuacccuuuuaaaauacaggaauaaauaagaguuaaaauaagaguuuuuaucauauagucuuuauagccauguacuacugugugcauacuagcuaggucuuauugcaggaugaguguuugccauuacuuuuagguuuauaaauucaggaaauaacuguauuugcaucucaaaaaaacaaacugguuuuuaaaaaaauagugauaggugcuaguuagaguagcccuuacagaucagucuuuuuugcaaaauguaauuuauaguaucuauuuccauaauaacuuuuuaaaacuacaccuaaguacaguugauagcucuuacuaauguaguuauugccaauuccaguauaagccuagucucuaaaccauuaucuuugcuuaauacaacucuccuaacucugaaaugcuaaagacacaucucagggcuccagagcauugccaugguuucuugccuuuugcccaccagggucugguugggaaaccgucugcaccagaguugcuuagggacuugaaagaguacagccuccuguaucucucucucucucucucucacacacacacacacacacacacacacacacacacacacacacacccgccauuucucccugccagagcuuagggauguguuuauauccaugaauuuauuuaggcuaauuaauguuaacuacugaacuuuucuuuuuguacaagaaacaggccauucguuuauuugcuucugccaaagccagcagggcauuuaucucuuaagaugaguaaguugaaauuggcuaauuuguuaaaagcuccuaccugcuggcuagguugaaugcauucacuaagugcuaguuuugauagguuggcuucugacagagacugccccuugauaguauuuggugguauuugcaauugccagcccaagcacgagccauguggaagcuucuaaaccacagacacaagucaaaguguuaaagagaauccaguggacuuaauuuacgaguuaggggaaauugacagggggaauuauuuuuguuuugucuuauaaaaaguauaaaauaugucuccuugucccaaagaaauuuagcaguuaguugaaaucaagugguuaaucuacaagaagguaagccccgugggagcagggcauggccuccuuuguugcuauacccagagcaccuccuagaacaaugucaggcaugugaguguuuguguuuguugaguggauuugugaauaucauugauguauuaaguauuggguaacuuggccugcaauuuuuaccagucugccaacuuuauaaaacaucaaucuguaguucacagauguccuuuugauaauugguguuuucuucacuucugacuccggggcugaaggcaguuuucucucucagucauguguagugagaaacagguggagcuugaagcucaggagaggugggugauggugucuugcuggcuggacguucacuugugcauauggguaggcacaccuccuuuaggaggacugcaugagacccuugugcagugggugcccaaacaaaacacacuuuucuucuuccccuaagggcgaacuaacuuguuaaaagcuucuaaaucagggaaagaacacuuaaaaagaguagcucuuuaaggggcaguaagcccaggaaaaggaacuaugacaucagcaucaccucauaucacaucuacccagaaauuuuguuuucucccaguuuaguucaaaaauuaauuuuaagacuuuuuacagauuuguuagaaauauuugugugacacagguacaaucaaaguaaauuuuguaugauuggauguauucagaggccaugccugacauccugaaaguuuccccuucaucagccuuugugcuucuccaccagggcuuccuacagcaguuccucccucugguuuauucacagacugcagauaacucuggaggggaucggugugugucccucuuaccccacugccacccccacagggguggugugauauucugccucuccuaggcccucagucuuugugggauuauuguuaaauucacuuggguauaagaugaggcaagagauuguagaggaauuggcaaaaacucuucaaaguguucacuuuuaaguguuuuuauagagcucugaaucaguaucaguuuuacuggccuuuuacaaaaauaaagacaggaaguuauguuccuucguauggcaaaauccuauuaucguagguuuuuaccuauuuuguucuggugaaaacguaauauguguguuuaauugugaguacggugugcccauuuuuacaguaaguuaacguaagucacacgugaauagcgguggaaauccaagaauuuuaucucauuuccuguacacguuacugaacuguucaccucugaguguaaugcuuuccugguggcacauggagaauauaaucuuccuaaugcauaaugggaucuuuugacaacucacauuuuuguucuccuucauuuuuggcugucacauggcuuuuaaugguuucauuaguaaacagaugaauguacugggugugaauguuagugacagcuuaaugaaagggcaguccucccucuuucuucuccuuucaaaaaugccuuugcucuuagacccaaaaacauguuuucucuccaugugguguuugcagacuugagcucaucuugauuggcugcauuaauauugagacaaaacaugcaauuaugcuuucauuuggcccugggguagccauucugaagacagcugucuguaucauuguaccugcuuucauagaaaccaacuuauucagguuucucaggguuucgcuuauuuugcuuugaaugggacagccauuucaccucauauuuuuggaugauguuugaaaguuauauaggaauauuugccuuguaauaagaucagaaugauuauuuuacugaaaaacuaaauuguuauguuauaauuauguuucaagcauauuucuuuggcaguauuuuccauuuucuugugaguaacuucuggaaauggaaguguguaugaauggguuggaauguuuucaguucuugcaauucugaaucuccaguuuuaaaaaaggaaauuuuauucuauaucucuuauucuuuaaccagaguuauguagaagacucugccacucuaaucuuuaguacauggcuguaguuguugaagucagggagcucccagaaaugugaaagagugugugagaugggcuugccucuagagacuuaucuuuggaacuuucccagugaucuguggaccacaaugugauuuuuguuuuguuuuguucugaugcagcuuccaugaggcaggcugaaccugcagauaugcgcccagagauauggaucgcccaagaguugcggcguauuggagacgaguuuaacgcuuacuaugcaaggaggguaaugauguuuucuuuacccgcuuuucugcucacacccuccccuuccacacuauauuuuuuuaaaaagacagugacuucuuguaacuacaugcuaauucuggaaaugauuacuguugccuaguugugaccuuucauuguuucuccuuucccauuuuucauuuguuuuaugacuaaguaauggcacuuaaauaaaauaauacaguaggaggcagcaaaggaauuuuaugagcacagacuuuaaaacaaugcuaaaaaagggauuauuuauagacuuugagauagucuagaaauacuauuaacauagguuucaauccauguaguguguuucuguacuccccuugugcauuuuaggucaaaguuaaagguaauuuuuaaacaacaucuuuugucacuuagcgcaugggagcgaugccagcacucauguaaaagacucuccugcaauuugcaggguggcccgaggaagcagggagccauugcccuugcagagcccauugcugucuuuggacauuuaauuguugaaauguauuaggaggccgcuaaucaauagccuguaauuugggcuguaaaaacuuuauauuauagauaauugccacuuauuuugagcuauguucuugauuuuuuaaaaauuuuagccuaugucaucuucuguaguuaguagaagcgguguuuuuuguuuguuuuaccugggggcaauguaggugaccauuuggacaccuuuuucacaugggacacuuuuguuuguuuguuuguuuguuuguguguguguuuguuuuugagacggagucuugcucugucaccaggcugaagugcaguggcgcaaucccagcucacugcaaccuccgccucccagguucaagugauucuccugccucagccucuugaguagcugggauuacaggcgccugcaaccacacccagcuaguuuuguauuuuuaguugagaugggguuucaccauauuguccaggaugaucucgauuuccugacucugugaucugccugccucggccucccaaagugcugggauuacaggugugagccucugcgccuggccgcaugggagacauuuuuaaauguguagacuuugacuccaggaguuaguaccauugggaacaccugugacugcuuccgcuaaaggguacacuagcaaaugugugauauaguguauuuacuuguucacagaguuuuaaacaccucauauaaagguauuaauucaguugauuuauccaaaaggaagacacuaauucuuauuuuguggaaaauguuauaguuguuaauaucauuuauucuuaccccuucucuuuuagcucuuuuuuuucugaacguuguuguuuuauauaaguaccucuuaaaaguuuuuuuuuaaucuguuuucuaggggaggucaugcuugguuaauuguugcuaaguaaauggauuuuaccuuugauuauuauuuuucugccuuuauacaauguguuuuaggcuucuuuuagacaaauagacauuuucccauuacaaaggacacuaucaguucuucaguauggaauuucuguaagagucaagaaaacacacaucggaucuuccuaccuuucuguggggguguuugaggagagugcuguaguaaugauucuguuguaaaaugggaagugugacauugauggacuuaagaauuucuuaaaauacugucuuaagcuggcaaaacuccuggcauccuccaccugacauaaaccaguucacagaacauuccagccuagaucugaaaugguaauuuuuuuggaacuuugguugguuuuauaacuugucacugaaguaaccauucccuccaguuccucugccuugguuuaccuaaagggauuuugguguuccugugugugacuggaaguggcugucucuauugacuaggaagaacuggugagaagugggaccacaguguauucaggaucaaaguggggaggacaugagucccuuuaagaggguaggugaauacacucaagucccgauucugguauuguguccagaauccaacaggacagaucauuucugauggguauggagacaucucugaaccuaggcaaugaacugaccauccccugggccugucuccuucccgucuggaaggggcuuuguagacacccucggggcaagaucugccuuagauggggcugccugagagaaagagguggcaguaggccuugccuggugcccacagugucucccugcugccaagagcucuggguacugagauaagcuugcacauucucaaggauucuguuagagauuuugaccgcagagcugguuguguuaaaggauauuauacaaguuucucuuuaaagcaugcaauaugaaugcaugacuccacaaggcuuuccugugggccugcccagauggaccugguggaugcaccuccauggcugccaugaguggucagugacaagacauaggcuaaggcuggcauggggacuggagugcaucccaguccccggccauccucuugugaaggcugucaagguggggaauaguuugagucauaugcagaugaaaccuaggcugcuggguugucuuuguuaccuugccucucuguugaggaugugauagcagcaccuaacagguucauagccugccuccccuccucuucucccaaugucauuucacaguuuaauguuuaagcguauguuuaagauggucaugucuguguuuccaauaagaugcaaccuauuguucccaugcuuuugguaaauuaaauuugucugauugcaguauuuacaagguuuugucauugugcaucuuuugcauaucuuaaaaauaauucagugcaaaaauacagucacaaaucauuaaaggacuuuagcuuuguuaguaggcugggauauuagggggaaggaguagggauagauucuagguuauaacccaauuuuucuaaaacaaagguaaauauauucagauuuuauaaauagcgcaaaacacaaggcuggguacgguggcucacaccuguaaucccagcacuuugggaggcugaggcggguggaucaccagaggucacgaguuuaagaccagccuggcuaagauggugaagccccgucucuacuaaaaguacaaaaaauuagcugggugugguggugggugccuguaaucccagcuacucgggaggcugaggcaggagaauugcuugaaccuggaaggcgcagguugcagugaacugagauugcaccauugcacucuagccuccacaagagcgaaacuccaucuaaaaaaaaaaauaguucaaaacacuggaugaugcuguggauagugacaccgugaucuucaaagccacagacacccgucuugauacuuguuagauuaaaaacaguccauugucuggaaucacacuuaaugguccauuguuaaauauugggggcagaaaucugggaagguaaugggaggccguuuugggaaauaaugaauucaaauuaccugcugucuucacaagggaauuauccucucuuggcaagcgaguguaucucacugugcugcuuuaggauggauauuaaccuuuuaaauguugagugucuuuauuugcuuaaugcuauuacaaugccuugucuaaaguguuagucuuuuauugccacgagccuugcaaagccugacaggauauuuucccguuuuuccaguuagagaaauagaggaaguugucguguaguugucauguauucaguccacuuaagggcaguggggaagcguuugagacggagcuguggaggcugaauccuugaaggaggaggugagagaggcacaggugagcgcaaagucccagugcauguccccucuucucucccgaugcagugucauucccaggugaaccugccgggcugaacggccuggccccucuauucagucggaguuuuacuacuccaguggauuuugguaacuucauuuggaaauaauuucagacuuacaaaaauguugcaagaaugacacaaagaaccacccuuuuauaucugccccacuuguuuucauguuuucccucuuugcacacauguacaauuuauuucagaaaaaacuacagacaugauacugcuuuuccuacacuaaaaauacuucaguguauauuucccaaaaauaggaguaaucccuuauguaaccacaguguaauuaucaaaauucacaaauaguguuacaaaacuauuaucugaucuauggaccuuauucagauuuuaccacuugucccaacaaugcccuucucagaaaaaaaaaaaaaaaagaaaaaauguauuuucuggccuaagagccaauguaggauaaugcauugaauucacguguuuuaccucugguuccguuaauuuggaaccguuccucugucuuugucuuuuaugacagugacauuuuugaaggaucagggcaguuguaauuugcagacucccugaguuugauuuaucugauauuucugcaugaugagacucagguuuugcauuucugaugggagcacuccagaggugaugugucaguguggcacagcaggaagcacaugauguccauuuguccuguuacugaugagguucacuuugauccaagguggaucuuggaucaaagaucuuccacagucuuccacugugaaguuaguacuuuuccauuuguaauaggacagagauuauaaaggacaaagagcuuuccuuucucucuuauauaguuauuuaguauaacaacuuggauucauagauuccuguuuuauucaaugggcugcaaugcguuacugucaauauuuauuuugaugcucagauucuuaaugauuuggcgggaggcaccaguagugcaggcacagggagaaccaguugugggacaaagcccaggggcugugaaggucacggagcucuuaaaagucauuuguugcggaaugaacuuuggccagagggcuacugacccucacagcucuuccuaugcaggucugcugugcagggcacucuuaaaagacuccaagcuugugagacuccuuaguggcgaguagggaggcuauugguaaaggcuagguagcguaaggauguuaguaggcauggagggaagagaaguucucugagaaacuaaauauuuuggaauuugugagaaagugagcagcuugccuuuaccugaguggugcaguguuuguauuucugcagccugcaccuucucuuccuggugagugugucagcccaagacagccagacuguucuucaguagcgguugccaguuucuuucaucacccaaacugugugagcgcauguaccgguucaucugcuggacgcagugccagcaaguguagauugcgacccucuguagaugugggccggagguacuggaaggauagugucuacuugggugggagucuugaccaugggcuggggcugcagucagaagcccuuagaauguaaaaaugcuuacucuuggaauaacuggacccauucugcaaccaacaugccucccucuuuccccuccauaaccccuaauacugaagcuggaguuguuuaccuucuguggcuucuagguucuucacagucagguuguccagcucaagucacuccaugugcaggaacacugcucuuggcuaacugugaccugggcauguccugguggugggcugcaguggacagcagcacaugaagcugcucuccagaugaggccagcagugaauaaaaacccuuucauuguuugaucacaagaaacagugaucuuuuguuuacacugccuacuuccuacucuguccagggcaugugcagacaggaauugauugaagugcauguagaccaaaaucuagcccugaaugagacaaaguagaguugagaaggugacuugcagacugauuuugauggaaagaauuuaacgugucauuacauuagcauuuuccugugcucuguaugaauuugaaauacuuauaugcucuccuucuugagaagugaaauccccagugcuaucucauucuuguuuuuauaaaugguagucacucuucugugaauaauguacaaaggcaaggacuaaaguuuagccugcuugguaauugcacaaacugaacacaaacccaaacguguguucucagcguacuuuggaggucuucauuaauugaauguuggaguuuaguaaaagaaguugcuuucuguuacuggcugugaaaagagucguggaaaucugcacaucagauauuaaauucaaauuagaccuaacucaugcaaugauagguugccccacacuucacucacaugaguugauagaaugucaguuuucauaacaaaagcagucaugaggagcuuagauaaauugguaccugccauugaucaguggcacgguuuucauucagguucagcaagaguuuuccuuaaagcuggaggaggcagcucaguguuuggguuuaggagccuuucuuuccugucuuagacuaccccguuuccgucccagaaguacaauggccagaggugaugagcuccuugguucuuccccucagacuuuugggagaacauguggcugggauuauguggacuauggauugcugguuuuccaaacaagcgcguucuguuacucguugaagccagagugugaucucguaggaaaacacgacucacagagaaguguggggacuuuggggucagaccuagagcccugacucuacccuuaaccuuuaggaggccaauugucuggucuaucccuuaggcauguaguggagauuaaguaagaacauuuagagauggagcuagaaaauucuuauuaucaucuguuaucguaauucuguuuccucucacuuugaacuguaauugaaacauuuuucaaugggucuucggcguuuagaaagggagaugccaggaacucuguucaccugucuaucuuuuaaauacucuggaacugcuuuuuaaacaaguuguguguuugacccuacugcacaugcugugucuggguguaggcaaauaugagaugaggcugaggcacugguguguguuuaaauggcuggaugggcaucgggcuaaaggacuugugcuuguuugcaccacgugugagugcucaucuguuuggcaggugccuacaccugcagggcugccuugcagcucuggaucaaggccauuaacacauaaccaugaggaaggagaugcaggugccuggaaggggacuucaggaggucuaacugggguuuuuuuuaaaucucuugaggaggaaaugaagaugcacacaaacuaaggcuuggcccugcugcagacguucaaaaauaauaagcuucucauaucauccuucacuagacuucuaccaccugaaacaaaguggagagguuuuaguugugguuaaacuauguuacgucucacuuagcuuuuuucugaggcugaaacauuuuggaacaguguguuucuucucugaaucuaauauuccaacuacuggugccucacacagaugucagaacaaucugucucuucucugugguuggccauagaacagugacgauuucagaaguggcaggugggaguuguuccccaguuuagccagcaccaggucuggagucugacaggcuagagaccuaccaaguggagggcugugcugugcugccugaagagccucagugcacagccucaccuggacauucacuggagaagagauuugugucacaauaagccuuaacuaucauaauuucuuugaaauagugugucaaaaauaggauaaaaguuugguuuaugcaaauguaguuuuuaucugacuucugaagaccacauugucaccauagcagaucagcugcagcacccauagcuuugcaacgcuaggggagagugcucuccugguuuggggugaagguaccaugcaucugggagggaacuuccuagugcccuuuccccagcuguggugacaucaaagugcagcaggcacaagcuaugcaaauauccauguugccuuggugaugaauagaaaguggauuugguguugggcaguauuguagcaaucuccucugacaccugaaaacagcaugcauauggaaccagugcugaaauaccagcucagcugccguuugacugugguuguuggucugaaaguggagagagaccagaucuuccugaagagcuccacaucaugcucaacugugugcugggccuuuuucucucugacuucugugucacuuaguugccaguuaaaaugcuguuuagacugcuggguuaugaacgagucguggagugguaguucuaacagaaucaggggggugacuccuaguuccaugucccacccugccaccucagugucccuaaagaugccgugacagccccuggguauucucaggcuccuggauguccaucccaggcccucucuucugcagccuguggggaucagacaccaaccagagagacugcuuccucaguugccugagccuggagcagagauucccucuguccuuccuggucucacaguccaaaauucagccuccuauuauauauaauguauaauaauuuauaguauauauauaaacacuuaaauauauauaaaaaauaaguuucaggacauccuauacauuuacuguugaaauucuguaagaaacaaguuuuugaguaaguuaaauuccucugcaucucagaguucuauagguauaccuuguuuuugaaugccucuuagaauuaggaauugagcuugcuuugauaugacaaugaaauugucguuuuucccucguugcucugacugccaggaaacucuuaacuaaacuguggcucucuuacagcacaucucaccccugguucccaggauaacuccuugaugucaugucugaucucaaccuuuuuuuuuaaauuguguuacacacauuugcgcuuucuuaauuuaaguccccuuugagccaugcuaugucuaggucuguguuguacuuaccgaguccuugggcccagugggugucagcccugccuuuggagcauggaugagugggcuguauucugagcugcauuguaggaaucacuuagugauucucaauucgcacuccagaaccucuguggccucagcucagccugaaacaaggccccuuucaggucugaggagcaacgggcccuucccagcagaggcacaggcacaggcacagggugugcgaggagggaaggugcuggccugaaagcccucguuuaacuucuuuccugcuucuggcauuccaucuucaugugggccaagaguacccauccuguccugccacugucuucagcugcacuuugagucacuugcuugaccucuguagucacuggcugcaaaacagcauagggaaugcuacccuggcacucaggguuguuguggggacugaaaagcaugggcuagguuauuucauuuagugguggccauggcaauucuuccauccccaagcuugggcacacaaaguccaaaggccuggagugcccuaggcagcuuuucaaagguucgacuccucucacuguuggagagugaagcugaauccaaagcugcauucuauaguugucugcuguucaaccugaccaguucccuggggccagggccucuauuguuuuccaagcaucugcuucccuggacugagcaagagagugguguucugugauuauuuuggcauuagaaugucauuaaauucccugacacuuaauuggucgucccaaguguaaauugaagaugcuucugcccugcacuuaauguuccucgcugcaguggcagcuccagccccuggcaaggcagcaggaaccccacgcuagggcauuccugugguacagcuccucccagguugccacccagaugagcuugugccaucuggugucauggggacaugugaagaacuauuuaggaauucccuguugaaugcucgacaccgucucaaagggcauuguucauaucuucagagaaagacugcuuaagucuaugcugaggaacuuguagacacauaauccuaugccuuuacacuuagagggcacagucugugggggagcaauccugcaacuuggcauaaucuuuccuucugguuuaugauaaauacuuauccacuacugagauuaucuuuacugaacugcuggccccuucugccuguuggccuugcugccucugcccagcuucucucuccaccugcacugcccauucuccucuuguccuuccaagaaauucuccucuuccuuuggggcuugauguggggauucacccuggugccuuccugcccuggcucccccacuuccucucuggccagugguuuuuuucccucucauuuuauuugccucuguauuguccuuacuuuauuaucuuguuuacuguuuugugcuggcgacacagcuauuaccaucagaccuaguggguacacagacacgugccuugaagucaggccccccaccugaugcuggucagcaacagggccacuggagccccuuacccugagaggggcaggggcugucaggaacugguuccuggagggacacacaagguugugaauguugaaggagucaucuucuggacacaugggauggccacaaaaggcaguuaccuccagguaacccaguccucauauagcucuugauuuaggcuauggagauuacaguacccaacuggguggggcccuccucuuugugcacuugugauuguguguaugugugucugcguagagaaagugagagaggagagaacuguaguauauggucacuucaguuguaacuuacuagcaaauuuggucuuuaaaaauaaucuccuucacccaaaugaguuguuauaccuuucuaaaguauuuuugcaauuuagacuaaaacagaguuacccaacucuguaagaaggauuguuuucacuuaaagagugacagacugagagcaucagugaaaguguguauuagucagcuagggcugcugugcagaguuccagagacuggguggcucacacaacaggaauuuauuuuucuuaguucuggaggcuggaagucugugaucauggugcagacuuagccuccagaccuguagaugcugucauccccugugucuucacguggucucccuccguggguuucuguguccugauugucucuuaccagaacaccguggauuagagcccaccccacagugaccucauuuuaacuuaaucaccuuauugaugacccugucuccacuuacagucacagccugagguccgggggguuaggacugcaacagaugaauugaggggacacaguguacaguucagcccauaaagaggaagauacccagaaguuucaggagggaguggagcaucuucccugauuguauuuauuuuaauaguuuuuuaaaaaacgcuuguaaucaggaaagacagucugucuuuuuuauauuacccaguuugggaguggcagaacuuaaaugcacuuuugauucacagaugccucuuccaccugauuaagaaccacuguagcagacgcagacuuauuggacacuaggcgggaggccagcucugcagacagcaggucucaggaagacggucaaggcauggcugcugaugauccgcuuauggguguguuuauugucuuagcccauguuagaugcgaggaaccacucacacugcaaaugacagcuccuggcucagucuuagugucauacuugccuuuaacuggcaacuccccugcaauacagggauugucaucuuuaguccugacuuuccaauuccaucuuggaugugcuacccuggccagaagccacugggugugcccuuacuuugaccuuucaccaguaaauuccaucuuagggggcuuucucuaauugcuucagacucccuccugacccuuuauaccaccccaaaaccaaaggcccugguuuaggagcugaauuguagcagccguuccucaguaucuagaucgcagggagauuucacuggagcuggcugaagcuguuggcgcuuugagcagcguugagccaucaguccuaguucugcgucuuugccccacugcagcuuuuggccacuugccccaguuuagugucaccaggccccgacuauaagccacaguaauuuuuauggcugcagguauuagagggcagccagucuacagagguaggggcugcccauccuccagcugucuuuugcaauacgggcauacacuucgagccaacagcagcuccagccggccgugccagcugucaaaugcuuucugggcuggcacggcucuuugaauccgugguaauggcuuccucuguugaaugucguccaaaagcaauugcuugucagcuuaaaagcgugugccauguugucaugcccgccgucugagagggcaggcauccccgcacacuugcagacugggaugcuguagcaucuucucaugagucagggauuggguguaacuuuugccaaaauuuccugcauuuuccccacccucuccaacaugucuuugaauaccccauauccuuuacauuugagaugaaaguggaacucuaaaaaccuuggaaagauucucuugugaggugacuucuacuuaagcuuggucacagccuccugcuguccucaaagagugggcaggagauuucuucccuuggacgcugccagugcuggaauaugaaacuuaccaagugucagcaguuggggucuguccuucacguugacccagcccccucauugguguccugaugauuguggacacccagucagccccauuuucuggccacaccaagcauggcaaugacaccagguuggcacaaaacaacucugccuggauugauuacuuagcccaucauagcguacacuuucuucauuuuaguaaguugugguuuuauuuugaauaagucucuuucaaccuauuaauauuagucuacacuaaaauuaaccuuccccuaaauuauucucacacagaggcagcaaaguaauuuugaaaguuaaaucaaaacaaagcaaucuuguguguaaaacagauaaaaaucacagacugugguuacagagugccucuacaggaaucgcuuacauaaagcugauuuccuccaaucuuguuauggaaggaaaaggggaaaugcccuggccuuaucacaaucccauucugucaaacaagcgcggcagagcuuguguaaacaguggagcugcagcugcggcuggugucugugggggccauucggggucugaggggacaguugucucagccugaugcauggcaggugguucccgcgacgguguguuggagguaucccccacccaaugagaaggggguuuguggagagacagucauguagcccggucucguguggauuagucauuaagaaauguccagggcagauuucagacuugaacagugaaccagguuguagcucauggcgucgagguugagguguuguguugccgcugccuuuggugacugugaauuuauaccuugcacauacucacaaaauggauuagaaccugaaagugggcgcuguggaagaccugaggacccugaaagcauuggauaagcuggugauuuccuuuugaacaguuucucaguuuguaacaaacauaugcuggucacugacacagagacuuuuuuauguucuggauugcucuuuccuucccauaccgagaaggugggaggauggggguugacauugccugugucugugaccaugggcaccccucugggucacgguguuuaucauagccaagcagccagaggcacaauggcgcaucacugcgagacuuuauuuagcuucuuagggcagauuacuccaaaucacugguuuuucaaauaaauuacagcuaccagaaauucaccccugggggaaucugcagcauauuugaaugucaguuaacuugggugguaagauaguugcuuuacauccucuuugaguuuuucaaacauuuuuuugagugcuuuuuuuuuuuuuuuuuuuuuuccuauuuuaaggaguaaaucauugguaugccugcccuuuuuguagggaugucuuccccuuugcagggaaaugaaaacaaguuuucuucacaaucucugggaggcaucgugcuuugugacacagugcucuugaagaggugccuuucauggugauuaagaugggauugguuguucacuuaaauaugggcucccaccccuccccacccccaaauuagggagaaacuaagaagcuuuccuuuuguuguuucagguauuuuugaauaauuaccaagcagccgaagaccacccacgaaugguuaucuuacgacuguuacguuacauuguccgccugguguggagaaugcauugacagguucuuugcggagccgagauaccaugcagacauuuugcuuguucaaaccaacaagacccagcaccgcggucuccuggugccauuauuaugcagccagcgguucucuuguggagggggcaggugacguuucagaagacaccgagcuggaugggacuaccuuucuguucaucaccacacagcagaauuucuaauggaaguuuguugugaauguaaaggagggagcauucuuugcuuuuuaauauacaaaccaugguuuuuuggagcaggauuuuguguaagaaugguguuuacaugcaguguguuuucccccucaccuucaauaagguuuuucaaaaaggaaauggaaacuuuuuaaccaauuugugaauaacuuuuguauuaaaauuuuaagaaccuacggccuauucucagaggauuauguaaccccugcaguggaaacugagccagcuaacuuaaaaagcugccuuaguuuauuuuuagagauuacagaauuuuuaaacagggagacgugugauauacucccucccuucccuacuauugccucucugaccuuuuuaaauuauuuuuaauaccaaaagaguucuuuugaaauggaacugauuaaaagggcagagggucuguugccagccugcauugauauaccagucccauuuguaaauauuuacguaccuuuauaaauucaguugcaucuguggcaaaauuucagacuauuuuugcgucuuuccucaucacuuuuugugaugcaacuccagucuggacucagaugcauagauuugguccaguguauuuucaugauaaagugaaauugagucagaacaagaguuaauaucugccuguaucuugcacaguucgagcgaucuguuauuaacugggaagcauuugguguugguuuucauuccauuucgacgagcauguuauugggaaguauucugaagaggcaauagcaguaauaacaacagacuuaagugcuacgccccuuugugcugcuggcuuuucugguugcaggcuuucccauggucacaggaugcacugucagcaucaggucccagagggccaccguguccauuacagcagaguccagcugcagcauccagcucacgcccucaugggaauuggcacaggccuggggcagggcuucugauggccauuugcuuggccuccugcauuuuaguccaacucacaguccacuagcuucacuccuuuaaauucacuuugaaacaggccucaucccacuuccaccagcaccauagaagaauaauucugggcagaagucuguuuuuuuucauuuuuccaggacaguuggauauugucaggccacuugugaccccagccauguagugagggugcucuuucucugugccugcuccuuaugagugcaguggaaggaagccacacacuggucagucauuucagaggcagcagaugcccagggagacccaagaaagagucagguuagggagcagugaaagugaggagggaagacaauucugugaacucuguaacucuuaaaauuuuugaaaacuccaucguuaaacaacuuuuaaaagaaauaacuaaauuuucaaaugaguaagcagugccaccaacuaguguuuugcccgauagaagagccagcauguucacguuauuuaaauuagguggaaaaaucuaaacauuuuuaucuucauaauuuaaaaaauauauauguauauauugcauauucacuuuuuccuuuagguagagaugauuucaauccaaauacucuuacuuuaaaaaauuuccuuuccccaagaaucuccuugggacuuugacuuauuuuuaaagcuguguuggagcucaucuuguucccugaugugucucgagcccauugguagggucauacaaagcccacgguuacaagcagugguaggauugcagccgugggccugcuggacacacacauacaccaaagauguauuuggaucugggcacccccucccaggaucccuguacucacgugccagucuccugacuagagcacuuuacucuguuuccucagcccugcagccccugggagcacacacugggugcagcccugggccaggcacgggaggcccugcccugugcugcccaggggcugugugcaccacaugagcacauuucccucuggccuggcggccuccaggcuggcuguggaaacaguuccugaggaaauuagagauucuaugaauuguaggaguauuaaagaccaggcuguuggcaccagaacuuaaagcgaugacuggaugucucuguacuguauguaucugguuaucaagaugccucugugcagaaaguaugccucccguggguauacguuuuuaccuuuuuuaaaaaacauuuuuguagaaaaaauaauuaaauccccuuuuuggaaacuuacugcagguuuugugccuugacaaccucucccuaugugagguuuguaaaaaguguccugugacuuaacacagaaacgcaauaaacacacacaaaauaguuucaugagugauucuucagaugcccuucccaacugguuaguugaucaagaauuuuggggguggggguugcggagaaaucaaguuuaaaauuccuucugauuaaaaaaauauaguggaauacaauugucugccguuuccccuucuuaauguauauauugugaguauuuauuagauucguaggucauauuacuuaucaacugagccaaaugucugugugcaauuguguuuccuuuaccuuguaaaauuuuguacagcauaaauaaguaaaaaaaucacuguuuuucucaacuuuuucaaaaucaaggauuguaaauauuguagauucuuuuucugugugauguguccuacuguuucauaaugcuguaacuuguagaaauauuguauauuuauuuucugcuuauuuaaugucuuaauuucugaaaaguauuaacaucccugucucccacuccccugccgucccaugaaguuaacuccugagaguugucgggggugacuggagagcucauugcagaccacgugguccuccaggguggcucuccaccuucggguccugguauuuccagucaaguggguuucaauucuugggcuuugccgcccuuaugaugaaguguguguuugaugccagugagaaacucagucuggcaggcuacaaaauucuacuccaagaaauacccagcaaccuucuguuuguuccaaagcaacuagcuuaucaugcaagcaaauuuugcugacuccaggcuuuaucuuuaggaaaacaaaaaaaccaaaguauuaucagcaggugggaaagauuuuucuauugaaaauuuaucccugacaacucagcguuuagaaaagaaauaaaaugugccacuuccagaggugcugcauugcaguuguucagggcuagggccaggcaggacaagugaaugggugggacagguggcuccugccuaaggaccaccucaggccacuaaccccuuguggacaacugugaguagcuggguuuucccccaccugcugugcaacuuccugugcuuugagguuggacuaacuugucuucaggagcuaauuaacuguacagcccuccccacgccccacccauacggucacugcauuuggucagccugcuucuucaggucgaugcccuccuucugauacuccaucuccuucaggggagguuggggccccacuggacugggugucaagaugugaaagcuuaugggagcuuuaaggagacuucauggugguuccaugcaggugguucugccaucccugcugauuuagccuggugccuguguguguccacucacguacacguggggugggggaaacgugucuacagaugacgcuaaaucaguuggggucuacucuaaacagcauuguguguaagaagcauccucaagcucccaguuaaguaacuugacuacuuuuauuugggaauuucagacuauagaagcucucuuauguuuuauguccagauucugugaccacuaguuacuguaucagaacucaucagguacccacuuauaaauagcacugaucuggcuguauacugauccaucacuaaccuguuuucuaggacccagcguauguagcauuuguauugcaguuucccuggcuuacuuguguuuugcacugaugaauuuugacaggguaauugccacuuuacuugugcaauacugcuguaaauaacugcagauuuuuaaacaaucuuuuauguuaauuuuauaaaaauaaaacuuucaacuaguuuugg

SEQ ID NO: 21209 - RNA, 1205 nt, Homo sapiens
cauuuuccguaucugcuucgggcuuccaccucauuuuuuucgcuuugcccauucuguuucagccagucgccaagaaucaugaaagucgccaguggcagcaccgccaccgccgccgcgggccccagcugcgcgcugaaggccggcaagacagcgagcggugcgggcgagguggugcgcugucugucugagcagagcguggccaucucgcgcugcgccgggggcgccggggcgcgccugccugcccugcuggacgagcagcagguaaacgugcugcucuacgacaugaacggcuguuacucacgccucaaggagcuggugcccacccugccccagaaccgcaaggugagcaagguggagauucuccagcacgucaucgacuacaucagggaccuucaguuggagcugaacucggaauccgaaguuggaacccccgggggccgagggcugccgguccgggcuccgcucagcacccucaacggcgagaucagcgcccugacggccgaggugagauccagauccgaccacuagaucauccuuauaccgacggggaaacggaggccagagagggcgugggcgcuugcaccacuuccgucccauccuugcggguaccuggcuaugcgggggugccuaaggagccuggaaaaagcgcucccccgucgugcuuccuggggaagggggcguucgcugcgcucggagcggcgucccuuccaacccgccggucucauuucuucucguuuucacaggcggcaugcguuccugcggacgaucgcaucuugugucgcugaagcgccucccccagggaccggcggaccccagccauccagggggcaagaggaauuacgugcucugugggucucccccaacgcgccucgccggaucugagggagaacaagaccgaucggcggccacugcgcccuuaacugcauccagccuggggcugaggcugaggcacuggcgaggagagggcgcuccucucugcacaccuacuagucaccagagacuuuagggggugggauuccacucguguguuucuauuuuuugaaaagcagacauuuuaaaaaauggucacguuuggugcuucucagauuucugaggaaauugcuuuguauuguauauuacaaugaucaccgacugaaaauauuguuuuacaauaguucuguggggcuguuuuuuuguuauuaaacaaauaauuuagauggugguaa

SEQ ID NO: 21210 - RNA, 1205 nt, Homo sapiens
uuaccaccaucuaaauuauuuguuuaauaacaaaaaaacagccccacagaacuauuguaaaacaauauuuucagucggugaucauuguaauauacaauacaaagcaauuuccucagaaaucugagaagcaccaaacgugaccauuuuuuaaaaugucugcuuuucaaaaaauagaaacacacgaguggaaucccacccccuaaagucucuggugacuaguaggugugcagagaggagcgcccucuccucgccagugccucagccucagccccaggcuggaugcaguuaagggcgcaguggccgccgaucggucuuguucucccucagauccggcgaggcgcguugggggagacccacagagcacguaauuccucuugcccccuggauggcugggguccgccggucccugggggaggcgcuucagcgacacaagaugcgaucguccgcaggaacgcaugccgccugugaaaacgagaagaaaugagaccggcggguuggaagggacgccgcuccgagcgcagcgaacgcccccuuccccaggaagcacgacgggggagcgcuuuuuccaggcuccuuaggcacccccgcauagccagguacccgcaaggaugggacggaaguggugcaagcgcccacgcccucucuggccuccguuuccccgucgguauaaggaugaucuaguggucggaucuggaucucaccucggccgucagggcgcugaucucgccguugagggugcugagcggagcccggaccggcagcccucggcccccggggguuccaacuucggauuccgaguucagcuccaacugaaggucccugauguagucgaugacgugcuggagaaucuccaccuugcucaccuugcgguucuggggcagggugggcaccagcuccuugaggcgugaguaacagccguucaugucguagagcagcacguuuaccugcugcucguccagcagggcaggcaggcgcgccccggcgcccccggcgcagcgcgagauggccacgcucugcucagacagacagcgcaccaccucgcccgcaccgcucgcugucuugccggccuucagcgcgcagcuggggcccgcggcggcgguggcggugcugccacuggcgacuuucaugauucuuggcgacuggcugaaacagaaugggcaaagcgaaaaaaaugagguggaagcccgaagcagauacggaaaaug

SEQ ID NO: 21211 - RNA, 39171 nt, Homo sapiens
uuaauuggcauuaaaaguuuuuauuuaguauuugauccacaaucuauacaaguuauuuacaaggcaugaaaauggaaaacagcacaaaauacaauugagguauaagcucagagcacaguaugucauguuucaauaaauauaauucaaaauuuguaaacuaggugaccagauacaugagucuuauuuuuaguaaaaccauauaaaauauuuauuucacgugagguagaggacaguuuucugugucauguaaugcaaccaaccacagcaacuuuaaccauaaaacuguacaucauuggcaaaauuuuaacuuuaauuauggucaauguagccaauuauuuguuucaacaguugcagaacagauauuucauuuacugccuucacagauuagaaauucaaaaguaauuuaagacuacuauguuggcuuaaaauuaucaggauaaacaaauacuucuaacaggauaguaaaaacaaguaaaauuuuauuucucauaaacuaauuccucaaaagauguccuacauuuagcaacuguuuucuaggacauguuuacuagaacuacuuuaaguaugcugugcuuucuuuucaagugagguaucuauauugaggaaaaaaaucuuauaaauuccuuuuacauuaaacuaauuuaauacacuauuuuguuuucugggcugaauuuuuaaauuuuuuucuuacauuugaucacuuucuaauucaaaaauuguagcacuacauaggacauuuaauucuauuacuaaauaggcuccaaauuacauuauacaguuuagaaaccauuucaaugaauggauuuacaaaaaaaaaaaaaaaacuguccuuuuaaaugaaaugcaauauaaaauacuaauacacuuuucuuccaaaaguggaaaugcuuaaguacccuauacuagaaaaaaaaaauuaggcuguuuauucaauuccacaauguauaauacagcaguuuuaugucccuuauugcugacagcuucgauaaaaacuauuaacaaguaguuccaagcacagaaacagauguacaguaugagcacgauuuuucuuuauauuaauuuuuaauguccuaucauguggauuaaaugcauaaagggcaaauaaaaaugaggaaucuucccuaaguaaucaaaacauaugccuuauugagaagaaaauuuuagaagcugauuaaaauccuucagcacuagcuuugcaauuaauucuggagaaauaccuugacacaucuuauaguauuugaguuuccuuauaacuuuaccuuccuucaaacagaagcuaccuaugugcaaauaaacugguuguucugucaggacuucuaaaagauauggauaaccggcaaauauauacuuuauuucaccuacuuuaauagcugcuuuacaauucgcuauguacaaaugauuuuauaucuuaacugguaauauauuaaauauguuauaaaauuaguucaagaagcauaaaacacccuaacucucaugaacacagaaauucaagcaaaagaauaugcuuaaacaaaaacuaaagcacacagcaaacguaaauuguuggucaaaucuuuucauaguguuauaaguuacauuugugaaauuuaggguaguugaagagcuuccucaauaacagcaagagguuuuacauuuauuaccuuuauagaguagguacacuuuucucauaaaguuuagccuacagaaacuaucgccacccaaauuaaacaucacccaagcuaauauucuuucuuccuucuaaagaugagcuagcaaaacuuuuuauagguugucccuuuaaugcagcuuuuuagaauaaacauuuuuacauuuuuucuuaaaagaauuauuuuuugaagucugaggaaaaauccgcuugccuagugaauuuggcacacaaagaguaacaacaaaucaaacuuuaagcuagcaaccaacacacaaaauaagcaugcaaagaauagaauaaguuuuauauggauaagguauuuuagccaacuccacuuauaagguauuacaaaaucucuauauuguuuugaagcuauguguugcaguuuaaaguuacuuuuaacaauaauacguauauuuacaauugacuuaaaaaacuauuuucaaggaaguuagaaaccuauggcacaccaacgcaucuucuggaaaaugaagacgauacaaugucauguggcaaguuuucaauauaugaaggacuagaaaaaauauuucuuuacucaauucugaauuacaaguucauaauaauuuaaugguguuuaagcacugcuuaaaauuuuccaauaacauauuucaaggauuaagcaauuuauuuuagaaguuuuggguuaaacaaauuaucauuuucuagguaacauaaagcagaaagguuccaagugaauuagaaauauaaaugaaauuauagguguuugaguuugucuuccaaaaagcugagcugugacacaaauaauucaaaauuaaaauaaaacuauaucauaaauaucugauuuuuccuucuccagaucuaaauagauuguauugggagaauaugucauuuuaaauauuuguuucuaaaaauuagccgggagugguggugggugccuguagucccagcuacucgggaggcugaggcaggagaauggcuugaacccaggaggcagagcuugcagugagccgagauugcaccacugaacuccagccugggagacagcgagacucugucucaaaaaaaaaaaaaaaaaaaaaaaaaaaaaaauuuguuucuacaugucauuuuaauauuuguuccuccuugagaagauuccaagacucaacgaauuaaauuagucuuaauauagcaaaauuuaaauggaaaauagaaaacacacauuuagguuauacucaauuuaguaaauaaauuacauuuggggaaguacaaaauucuuuuuggauauguacuauuaagcaaaauaugaaaauaacugguuaaaugacaaccuagugauucuuucuacaccauuagauuaucuaccuucuaugcuggaaauagaauauaaccuuaacccuagcuaauuuauuuuaaaauaaauauagcucucugaaguaauuucauacauaguaucuuauaagagaacaugaaaaacauuuauuaucccauaaaauccaugggguaauaaugucaauuaaugauaguuucaggaaacucccuuuaaaaacagaucuaagaauuuuaccuaauauauuuugagccaagaauuaacaaauaugaaauuugccauuagagaaugacagacuuuucugugcaaaaaaaaagugcagaagauguugucccuccugaaacuauggaauuccuuuaucuucuaaaacuuaucuaaaaaucuuuuaguagcagguaacuaaacuguccuauaugcaccuaucauguacuaucaguugacuguaaauuccugauuuugauauuaaguaguaaaugaaaaugguccauucgugcaaauuuugguaagacaacauuuaaacauacagaaguccaaaauaaccuucaagguguuuaacauuuuacaacuuaaaggaaaacaaguccauuauauaaauuuuaguaagacucauaacuacauguaaaaacuguacaggaggauuauggauuguauagaaacugauacacaacagugguaucaguuuuucucaagaacguuaauauuuucacaccacuauuaacaacacaaacaaaaguucagaaauuaucacauuuuauuuuugaaaaguugcugcuuaaaaaaaaaucuaacuauaaccacauuuaaacugaaaaacaaauuacaacugcugcuucuguuuagcagcagcacauaacaacacauucuucuuccccacugugcucaugggguaugcuauaaccucaguaaaauuccuccuaggguacacauuaaaaagaagagaacugguggaaauucauuccacaaucugaacaaaguaaaaguaaauuugguguauguuaaugaguacaccauaucaacuuagaaaaauuguguuaaugagaaaaggggagauucaacuccuugaguagcucuauauacuuaaaauauaaagccaccauuguaucuaaaauugagucugaaauauggauaacaaaauugaccacagcuauuuuccaacacauauugcagcuuuuaaaaaguacacaauuguuaaguuugcauuagaaauauaagcagauuaccuacuaguugaaaccauauaguauuguuacuaagcugauuuuuuuaaaaaaguacaaagaaacauacauuuucauucauuuggaaaauguaaaaauuuaaguacuaauauauaaucucuucacuuucucugaucuacaaauggauagaaugccuaguuaucgucaugcagauaaauucuucagaauucaauuaccaaagcaagcaacaaacaaaaaaaaccuugucaguaauacacagaugaaucucuuuaacaguuucuauucuuuagcagucuuugaugauuucagaauuugcagcuuuagcucuuuuaucaucaucucuaacuucugucuugcuucccguuccugucugaguucaucuuggaguucuugccuaucggccucagcaugguccaaucucugccucaguucugccaacuaugugauuuaaaaggcgcuaucaauuuuaauuguuuuguuuuuccauuuaauccucauaucauagaaaauaucuauuuucaaauuacuuuuuacaaaacgaacuauuucauguauacuaaauccauuaagcaucuaauacuauuaaucugacaucugacaggacacuaaauuuaagaaaaagcaaaggaacaagaggaaggaacacauccagcauguucauguucauuaugcccuauacuuuacuauaccgcucaucacagccugcucauguuaguuauuuguucauguuccuuaaauugugagauucuauuaacaaaagagaauugcuuauuuuugcuccagugcuuuugaacauaacaggcaacaguuccuguuuguuaauuuguagauuugaaagcucauauacuacauuaaaauaauauaacauauaauauucagagggcuagagauuagcaauuuagguaacuaaacugcaguaacccgauaaaaauuuaaacuaauaaaagcaacaaacaucaaaauaaucaucuuggacaauacagcauaaagcuauguuuaacagaauuaucuauuuugaaaucuagcuuaguaaacugagcuugacaaaaaguaauuccuuuauuagagaaguaacgguggccgggugcaguggcucaugcuuguaaucccagcauuuugggaggcugaggugggcagaucaugaggucaggaguucaagaccagacugaccaacauggugaaaccccgucucuacuaaaaaauacaaaauuuagcugggcauagugucgcacgccuguaaucccagcuacaaucaggaggcugaggcaggaaaauugcuugaacccgggaggcagagguuguggggagcugagauugugccacugcacuccagccugggcgacagagcagucucugucucaaaaaaaaaaaagagagaaguaacaguuuccauuuccaugcugaaagggcaccauuauacaaacaguaauucuuaccuguccugcauauucagccucuuugucuuuuucuaaauuugagucacagguacauuuuugcuucauuaucugcuccaauuuuuucucuaagucuuucuguucaacauaaaauucuuccauucuuugagcauguucauucugcaaagauucaagcucuuucuguaaauucugcuguucuucagugaguuccuucauagauuuugaacuacucaacauuuuuacuuccuguaauguaaagaaucacaauacaaguuuuacuuuauuuucaccauguuaaaauuuucaguucuggaaaacauagcacagaaaauaccuaaaauucagcuaucauuaucaguucuauauagagguaauuauuuuaaaaaacuauuuucucaaaaaauuuuaaaauauauuaaaauugcuuuucaguguaaaacaauaaucuuaaguacauuuguagcaucucguuuugacuuuucuuacuaagaauauacaggggggcugggcgcaguggcucacaccuguaaucccagcacuuugggaggccaaggcugguggaucacaaggucaaaaguucgagccuggccagcauggagaaaccccaucucuacuaagaauacaaaauuuagccaggcaugguggcacgugccuguaaugcuagcuacucggaaggcuaaggcagaagaauugcuugaaccugugagguggagguuucagugagcugagacugcgccacugcacuccagccugggcgacagagcaauauacaaaaguaucuuuucauaauggacuaucauuuagauaacaauuuuaccaucugaaguuguugcuucuuuugcaaaaucaaguuuaguuuuuccuguuguuuuaaauaaguucucauuacuucuuccaugauuuuucccuuaucauccucacaaaugacaucuuucacaagaagcggagaugaagcggcagcaacaaggccaauucccacuuuguuuaugucucugacuaaguugcaaguggcagacucagauuuccuuuuacuuguagaauuauuugagauugaugcaucuuggagagaaaaaaaucaaguaacaaaguaugaauaucacuccauuaaaaaaaucacuagaacaauccauaaauguaauuuuuaaaacauuucauuuauaaauuagaccaaaacaaauaaaauaggaauaaauuuaacaaaagcagugcaaguacaaugaaaacuacaaaacaucacuaaaagaaauuuaagaccuaaauacauggaaagacaucccaaauucauggauuggaagacuuaauauuguuaagacaguaauagucuccaaauugaucuacuuaucagugcaaucccuaucaaaauccccacuggauuuuuugcagaaauugaaaagcaguuucuaaaauccauauggaaaugcaacaaacccaaaauaggcaaaauaaucuugaaaaagaauaacgaaguugaaagacucacaauucccaauuucaaagcuuacuacaaagcuacagaaaucaagacugugugacaugauuuaaagauagacauacagaucaguagaacagaauucagaguccagaaauuuaaaaaacucauacuuuauaaggcaauuguuguugacaaaggugccaaagcaauucagucaggaaagaauaaucuuuucuggccaggcgcgguggcucacgccuguaaucccagcacuuugggaggccgagaagggcggaucacgacgucaggagauugagaccauccuggcuaacauggugaaacccugucucuacuaaaaaauacaaaaaauuugccaggcuugguggcgggcgccuguagucccagcuacucgggaggcugaggcagaagaauggcgugaaccugggaggcggagcuugcagugagccgagauagcgccacugcacuccagccugggcaacagagcaagacuccgucucaaaaaaaaaaaaaaaggaaagaauaaucuuuucaacauacggacaacuauauccacaugcaaaagaauaagguuggaccuuaugcuguauacaaaaauuaacucuaaacugaucaaagaccuaaauguaagagcuacaacccuuaaacauaaauuucuuggcuggaugugguggcucacgccuauaaucccagcacuuugggaggccgaggcagguggauuaccugaggucaggaguucaccaccagccugaccaacaugguaaaacucugucucuacuaaaaauacaaaaaaaauuagccaggcaugguggcgcgcaccuguaaucccagcuacucaggaggcugagacagaaaaauugguugaacccgggagguggagguugcagugagcugagauggcaccacuguacuccagccugggcaacagagugagacucugucucaaaaauaaauaaauaaauaaauaaauacauaaauaaauauuucuuggaauugggauuaggcaauaguuucuuagauaugauaccuaaaacaagaaaaaaauagauaaauuggauguaauaaacauuuaaaacuuuugugcuucaaagaacacuaacacggccaagcgcgguggcucacaccaguaaucccaacacuuugggaggcugaggcagguggauugcuuaagcucacgaguuugagaccagccucaacauggcaaaaccccaacuccaccaaaaauacaaaaauuagccgagcauggugguacaucccuguagucccagcuacuugggaggcugaggugaaaggauggauuaagcccaggagguagagguugcagugagccaagcuggggugauacagccagacuuugucucaggaaaaaaaaaagaacacuaacaagaaaguaaaaagaaaacaguaugguaaaucaaauaucugauaaggauccaguauccagaauauauaaagaacucuuacaacucaauaguaaaacaaccuagcauuaaaauagccaaaagaccugaauagacauuucuccaaagauaugcaauguccaagaaaaacaugaaaagauacucaauaucaucauucacugagaaauugcaaauuaaaaccaugaaauaccacuucacaaccacuaggauggcuauauucaaaagacaaacaauaacaaguguugacaaagauaugcaaaauuugaaacucccaagcuaccacaggaauguaaaauggugcaacugcuuuugaaaaguuuggcaguuccucaaaacauuaaacauaauuaccacaugaccuagcaauuucacuccuaaauacauaccaaaaaaaaacugaaaauauaguucuacacuuaaacuucuacacaaguauuuauagcagcauuauucuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuuuuuuuuuuuaguagagacgggguuucaccguuuuagccgggauggucucgaucuccugaccucgugauccgcccgccucggccucccaaagugcugggauuacaggcgugagccaccgcgcccggccuauagcagcauuauucuuaauugccaaaaaguagacccaaugcaaauguccgacugacgaaggaauaaaaaaaaugugguauauucacauaauggaaucuuaucaggccauaaaaagaaguacugguacaugcaacaacauggacugugaaaacauuaucuuucaugaaagaagcauaagcuucuugaccagacaugaaaagccacauauuguacaauuccuuuuauaugaaauguccagaauaagcaaauccauaaagauagaaaauagauuagugguugccagaggcuucgagaaagggagaaucagggagugacuccuaauggauuauaggguuaauuuuuggagugaugaaaacauuaugggccgaggcggguggaucaccuaaggucaggaguucaagaucagccugacuaacauggcgaaaacccugucucuuacuaauaauacaaaaaaauuagccaggcguggugacacacgccuguaaucccagcuacucaggaggcugaggcaggagaaucgcuugaacccgggaggcagagcuugcagugagccgaaaucaccccacugcacucuagccugggcgacaagagugaaacuccaucuuaaaaaaaaagaaagaaaagaaaacauuauggaacuaaauuagcugugaugguugcacaacuuugugaauguauuaaaaaccacugaauuguaggcuuuaaaaggguaaauuuuaugguauauaaauuaucucaauaauuuuuuagaagucauuagaauuaauuuaagaaauaaaauacaauguaaauauggcauaauagucauuacuaauuuuuguuuaccauauuuaaaucugaagaaaacugaguuuuaaaaaucucaaaauuggccaggcaugguggcucacaucuguaaucccaaugcuuuaggaggccaaggcaggaggaucacuugaggcuaagagcuuaaugccagccugggcaauacagugagacccugucucuacaaaaaaaaugaaaaaaugaggcaggcgcaguggcacaugccuguaguccuagcuacuagggaggcugaggugcaaggacuaugagcccagcaauuugaagcugcggugagcuaugaaugcaucacuguacuccaccagccuagagcaacagagugagacucugucucuaaaaaagaaaaacgaaacaaaaaacccucaaaauaaauguauagaaaaccccuggccgggcgcgauggcucacgccuguaaucccagcacuuugggaggccgaggcaggcggaucaccugaggucaggaguucgagaccagacugaccaacauggaaaaaccccgugucuacuaaaaauacaaaauuagccgggcgugguggugcaugccuauaaucccagcugcucaggaggcugaggcaggagaaucacuugaaccugggaggcggagauugcagugagccgagaucacaccguugcacucuagccugggcaacaaauacgaaacucugucuccaaacaaacaaacaaacaaacaaaaaaaccagaaaacccccacccaagaaucagccaggcgugguggcucacgccuggaaucccagcacuuugguugggaggccgaggcaggcggaucaccugaggucaggaguucaagaccagccugaccaacauggagaaaacccgucucuacuaaaaauacaaaauuagcggggugugguggugcaugccuguaaucucagcuacucaggaggcugaggcaggagaaucugggagguggagguugcggugagcugagaucucaccauuuuacuccagccugggcaacaagagugaaacuccucaaaaaaaaaaaagaaaaaaaagaaagaaagaaagaaaagaaaacccccaagaaucucaauucucuauaaaaacuuaaauaaauagaggacccuccaacuguuccaaugcagcuaaaguaacugucacacugccuaaucacuaagcaaagcugugcugcuauauggaugguaacacaggcaauaucugcagacaugucucauuuaauccacaguauuuuaaaaggcacgguaaguaaccagcuauuuuucuuuuaaaugaccagucaauauuccacauuuaugcuauaugccuggcccccagagcuuucaauccuugcuuuauuccauaacuaagcuuccuugaguucuauaccuaacuacucuuacuuacauaauacuucuuauuauuaaauggugucucaguucauggcaaaucagaaagaaaaauaaagguugggugcgguggcucacaacuguaaucccaacacuuugagaggccaaggcaggaggaucacuugagcccaggaguucgagaccagcuugagcaacauaccaagaccaucucuacaaaaaaaaaaaaaaaaauuuuuuuuuuuaauuagccaggcacaguggugugcgccucuggucccagcuacuagggagggugaggugggaggaucacuugagcccaaagguugaggcugcagugaccgcaaucucaccacugcacuucagccuaggcgauaaagacucugucacaaaaaaagaaaaaaaaaggaggaaagaaaaacaaggaucuccugaagacugacagcaaauaaaagguaggaaaggaaaaaaauucggacaaaaauaacuugcagucugaggccagguagccuguaucuaucucagucuccugagcuaucaccacgcuagaaaaguauagcaacugagauuaaaauaaaucacccagaguuuugaaggguagcauuuuuaaagguaaaagcuccaauuaucugaaaauuuagcucaaacaaaaagccuguuugaaaaugcucaauaaauguguucauuagauauuuaauuuuagaaagauaaucucugaauacuuaccuaaacggcuacauaauucucuacuuguuuuuaaauccauuuucuccuguuccucaagugagacaucuggauaagacacuguuuuuugaaguuuaccacuacugugagccuucucugacugucuugauauggacuuacuugccucugucuuugugagcucuuuagacugggauacagcagaaguaagugacacauuuggggcaaccacuuuaucacacauguauaaguaguagcugaaaacaaguaaaagcaaaacaagacauauauuacauauuacaauuaaguaaaaaucaaauauguaacaugcauuucugugguuaaacuuuuuuuuuucuaaccaaaacagacaauauuacaacucagaaaauaaaggucacaguaaagaauucuuaggaaaaaaaucaacacuuuaggcauuacaaacaaaauuauaagggauuuuuuguuaguuugcaaguaacccaggcuggagcguagugguaugaucauggcucacuguaaccucuaacuccuggguucaagcaaucuuccugccucagcaucccagguagcugggaccacacauacccauuuuuuuuuagagauagggucuugcuaugcugccaaguuggucuugaacuccugggcucaagugauacccucccaccuccaacucccaaagcacuaggauuacaggcauaagcaaccauaaccagcuugcaaguaauuucguguuuuuuuuuuuuuuuggcaaguaauuucuaagcacuaaaaagauacacagaaggaaaaucacaggcucuucuccuucccucaaaaccaccugagaauuaaaagcauuaaggacuuuauacagcuguguaacaacucugagcagguaaguuuuacuccagaaaaagaauaaucuauaacuacuuuggaggacuuuaucuugcccaccacccuuccaaagcagggaaucuuugcuuuggugaggcugcuucaguggcagacugcaaggcuauguccugacucacaggaggcucagugaggagcucccagggcucuucuuauauaccucagagagagagcucugaaugucgcccagcuacugggcaguucuuguaucaaaccccacugagcaaucuucuugaaauacuucacuacuuccuacucauuugauaaaauggcaacaauaaauuaugcaaaacuaagauaaaagagauuaccaauuuugaccaaaacucacauaaaauugcccaguagacucaugugagaagcucaugggacaaacaaauuucagcuagauauuuaaguaccauauuuguaacuauauucugaguaacacuuagcaaaaagauguaaccauuuaagacuugacacucuauccccugaacuccagacaaucuccucuuacauuucauuuucuuuguacuaagacaucuauauuguuccccuuuguuaauaacauccauuuuugagccaaaaucucaguuuucugacaggacaagaaaauugacagguuuaauagggcucaaaagacuuacugcaaauacaacagguaaaguagugauuguacaaauguaaauaagacucaguccccuuaucaccauacuuggagggaauacagauuuacacuaguagaaaaaaaucuagggcucaacaacaaaaaacuuacaaucuagggugaacauuuauugaaacaguaaaacucugauuuugagaaguacgguuauuaagaaagcucuuaguuucaaaagaauuucuuuuuaaaauaucaaaguugcaggccgggugcagugacucauaccuguaaucccagcacuuugggaggcugauggcaggugggucacuugaggucaggaguucgagaccagccuggccaacauggugaaaccucgucucuucuaaaaauacaaaaauuagcugggcguagcagcggaugccuguaaucccagcuacucaggaggcugaggcaggagaaaugcuugaacccgggaggcggagguugcagugagccgagaucauaccauugcacuccagccugggcaacagagcgagacuccaucucaaaaaaaaaaaaaaaaaauugaaguugcggcucggggcgguggcucacaccuguaauccuagcagcacuuugggaggccaaggcuggcagaucaccugagguucaaaaccagccuggccaacauggugaaaccccaucucuacuaaaaauacaaaaaaauuagccaggagugacagcuggcgcucaggcucagcuacaggaugccaugacaagagaacugcuugaaccugggaggcagagguugcagugagccaagauccugccacugcacuccagucuggguaacacagugagacuuugucucaaaaaaaaaaaaaaaaaaaucaaaguugcacaccaaauucuugaagaguuuguuuaccucuugaagaaaaguaagaaauuaaaggagaacuuccauuuuuuacuugagggcaaaaagaaaaugaccuauuucuagaaaacacauagaaacacauaguaaagguuauuucaaauauucagugcaauuuacaauucauuucauuucagauucuuucuuugaaauuuuuucuaauaagaguaacaauacaauucaccuaccauuucccuauaaugauaaauagaaacaaaaaauacauuaaauaccaauguacuuauuuaaaaauaauuuugaauuuucuuuuuuucuuuuuuuuugagacaguuuugcucugucgccuaggcuggagugcaaugacgcgaucucggcucacugcaagcucugccucccagguucaagcaauucuccugccucagccucccgaguagcugggacuacaggugcccgccaccaggcccggcuaauuuuuuugcauuuuuaguagagacaggguuucacuguguuagccaggauggucucgaucuccugaccucaugauccacccaccucggccucccaaagugcugggauuacaggcaugagccaccgcgcccagccuaauuuugaauuuucaaagauaaucuaugauuaacaagaaagccugaaaauaaagaaauaaauucguggucaggcacaguggcucacaccuguaaucccagcacuuugggaggcugaggcaggcagaucacuugaggucaggaguucgagaccagccuggccaacacugugaaaccccaucuauacuaaaacuaaaaaaauuaggagggcgugguggugugagccuguaguccccgcuacucgggaggcugaggcaggagaaucgcuugaacccgugaggcggagguugcaaugagacgagaucgcgccacugcacuccagccuggguaacagagcaagacucugccaccaaaaaaaauaaauaaauaauuaaauucccauguccuagaauagugcauggcauauaguuguugaaugaagaaaugaaugaacaaacgaacaaauaaauaccaacucaccugggguguaaaaaugaaugugucugagaaacauggucaccuuccugcuuuauaacaggauaccaugacuguaauuccauuccugauggugcaucugucugcagaaaaacauggaagggaaacauuuauugaaguaaaacugugaagguuaauuuuaugugucaaccugacugggccacuggguaaagacaacuaacauuauuuaagagucaucaugccacgcacagugguucacaccuguauucccagcacuuugggaggcagaguggggaagauuccuuaagccguggagucagccugggcaacauaggaagacccagucucuuuaaaaaaaaaaaaaaaaaaauuagccaguugcagugguguacaucuguggucccagcuacuugggagacugaggugggagaaucccuugagcccaggaaguugaggcuugcagugaaccaugauugaaccaugauugcaccacugcacucuauccugggcaagagugagacccugucucaagagucaucuuccaauaaggcagucuucccuugaagaagccugauuaucaccugaaacucagagacacccacaugaacuaucccaucacaagaacaguuucaguaugcaugcuaacauggaguaccagaaaugacugcaucaaauuucauacuuacgaaaucuauuuuauuuauuuauuuuuuuuuuuuuuuugagauggagucucgcucugucacccaggcuggagugcaguggcgcgaucuuggcucacugcaaccuccaccucccggguucaagcgauucucugcuucaguauccugaguagcugggauuacaggcacccaccaccacacccagcuaauuuuuuguauucuuaguagagauuggguuuugccauguuggccaggcugaucucaaacuccugaccucaggugaucccugcuccucagccucccaaagugcagggauuacaggcaugagccacugagccuggccagaaauccauuuuaaauaauagaacucuauaaagguauagcacuggaaaauugauucuuauuccuguacuacaaucggcuagacuauacccuaucccuacaguauuuguuagcauauuagcuagauaccauucuacagcaauacuuugccaaauuaaauccaaaaccacauaguuugcuaacacuugucauuaaacuauauuuccuaauaaauauaaaaaggauuuuuuaauacuuaaagaugagcuauaacuaaaaauaaagaaaaauaaggagaaagguaacugguaacuuaaugaacaucuacgggcugagaacuuuauacaucauucuuaauucuaacaaauaucccccauuaaauagguaucauuaccauuuuacagaugagaaaacaacugacguucagaaauugaagaggggcucgguucaguggcucacaccuguaauuccagcacugugggaggccgagguggguggaucaccugaggucaggaguucgagaccagcauggccaacguggcaaaaccccaucucuauuaaaaacgcaaaacuuaacgaggcaugguggugcgcuccuguaaucccagcuacucgggaggcugagacaggagaaucacuugaacccaggagauggagggugcagugagccaagaucaugccacugcacuccagccugggcaacagagcaagaaucgucucaaaaaacaaaacaaaacaaaaaaagaaauugaagagaaaaaaagaauaaaugaucugugguuacuaacuucucccuuauuuugguuuacuuuauuuacacuuuguccucccuucauccccuacauauuuccuauuauacgaaauuaccuugcuuuugugggaaaaggauacuuaaaagggggggcaagacucacugguaagggaaaggggaaagaaggaaaggagagcugaaauguggcaugguuaaggugaccaacaaaaauaggaaguuaacagacaaacccaggaaacugagggagaaugcgauuaggaacgaguuaaacaagggaaaaaacaaaaaagagagcuggauauuucucuaaacccuaccuuuaagagguuccauggccaggcgcaguggcucaugccuguaauccuagcauuuugggaggccgagaaggguggaucaccugaggucaggagcaagaccagccuggccaacauagcgaaacccagucucuacuaaaaauacaaaaauuagcugggcguggugguacgagaaggguggaucaccugaggucaggagcaagaccagccuggccaacacagcgaaacccagucucuacuaaaaauacaaaaauuagcugggcauggugguacgcacuuguaaucccagcuacucgggaggcugaggcaggagacucacuugaacccaggaggcggaggcugcaguaagccgagauugcaccaccgcacuccagccugggcaacugagccagaauccaucucaagauaaaaaaaauaaauaaauaaauaaauaaauaaauaaauaaaagaagcuccaauucuggucgggugcagcagcucaugccuguaacuuugggaggcugagggagguggaucaccugaagucaggaguuugagaccagccuggccaacauggagaaacgccguuucuacaaaaauuagcuggacaugguggugagugccuguaaucccaccuacuuggguggccgaggcaggagaaucacuugaauccgggaggcagagguugcagugagcugaguucgcgccacugcacuccaaccugggugacagagcaagacuuugucuccaaaaaaaaaaaaaaagagagagagagagaguccaauucccaauucaacaaauuaggaaaguagcaaagcuguuuugccugaugucccaauauuccaguuuggaaccaagaaacuaaggacugcaaacagaucucuggauguuaagcaguagugauuaaaacaaaaucaacucuaaacuauccaaacucugguuugauuacugagauccuacuaauggaggaaaucaaugagaaugaagaaaccugggagagaucugacaaguaacccacugcccucaacaaaacaggcugaaaacagaaaggaaaccgcucuuagaauauguaucuuaaaaucugaucagucaggagaugacuuagggccaacuaaaggacaaaaauaggcagggcacaguggcucacgccuguaaucccagcacuuugggaggccaaggcaggcaaaucacgaggucaggaguucaaggccagccuggccaauauagugaaacccugucuuacuaaaaauacaaaaauuagccagguguggugguacgcaccuguaauccuagcuacucaggaggcugaggcaggagaaucgcuugaaccugggagguggagauugcagugagccgagacggcgccauugcacuccagccugggugacagagcaagacucugucucaaaaauaaaaaaagaaaaaaauauguaugugggagaucuuuauuuuuguuaagaauuaggccaggcacaguggcucacaccuguaaucccagcacuuugggaggccaaggcggguggaucacgagaucaggaguucaagaccagccuggccaagauggugaaaccccgucucuacuaaaaauacaaaaaaaaaaaauuagucgggugcggcagcaggcgccuguaaucccagcuacucaggaggcugaggcaggagaaucgcuugaacucagagggcggagguugcagugagccgagaucgugccacugcacuccagccugggugacagagugagacucugucucaaaaaaaaaaaaaaaaaaaaaaaagaauuauugagcaaugaauuugaaauacuaauaagaccucaaaauuauaagaaaaaaauuaauauuuuuaaaagauuuaagaguugaauauucagugaaggucucuacaugauauguaaauguggaauuaaaaaaaaaaaaaaaggccugggcacaguggcucaugccuauaaucccagcacuuuaggaggacaggagaaucaaccgaaacaggggaacagagguugcagugagcugagaucgcuccacugcacuccagccugggcaacaaagugcaacuccaucucaaaaaaaaaaaggaaaacagaaaacgaaacaucacauuuugaacuaauauucagaaucugggcaaauuccacugcuuauuuauaaaacaaacugaucacuuauuuacauaguuccucagccuauagcuuaguuauagcaguaagaaagggaacugacuucuggcaacagaaauacuaaaugauagaugcuaagugacagcugacagccuaaggagagaggaaaauuacaagaugcaaacacaaaaacugcuucaaaaagcaagacaaucugaguaaaggcuuuagcauagaccggggcaaauaauuuaauauaucucaauuguccccuaccccaauucaacaaaguaugguaauuaauguuuaagaaucuugaguuggccaggcgcaacggcucacaucugugauauuaccuagcacuuugggaggccaaagugggcagacugcuucagcucaggaguuugagacuggccugggcaacaaggcaaaaccccaucucuaauaauaauacaaaaauuagccaggcaaggugaugugugccuguagucccagcuacuugggaggcuaaggcaggaggaucacuugagcccaggaaacagagguugcagugagcugagauugcuccauggcacuccagccugggugacagagccagacccugucucguuaaaaaaauaaaaacucuugagucaacgugacauagcuaaauuauguucuguauaccacuuagauucaaaacuuuuucagacauuuuacaauucaugaaaacaguuuuuuaaaaaaacacaaugcuuuuaaaaaguagcuuaacggguagaacauuuugcaccccagcucuacaugaccaaagaggugucaaugaacgaggauaaguucauucuaacaaaucaguaaaauuuaagaucaguuugagggcaggaacaguggcucacaccuguaaucccagcacucugggaggccgagguggguggaucauuugagguccggaguucgaaaccagccugaccaaauggugaaaccccaucucuaauaagaaaaaaaaaauuagcugggcaugguggugcaucccuguaaucccagcuacucgggaggcugaggcaggagaaucacuugaacccaggagguggagguugcagugagcugagauugcgccacugcgcuccagccugggcaagacagugaaacuccgucucaaaaaaaaaaaaaaaaaaaaaaaggaaaaucagcuugaauuaaaugagaauuucuuuucuagacaucauuuguuaaaaaacaaagaaagcuccucuuuaaauaaguguuauaucugaaagaauucuagauguacugcccaagaaaucaauuguuuccagauuuuuuaaauuaaaacuacuaaaauuggcccuacccaguggcucacaccuauagccccggaauuuuaggaggccaaggcacaaggacugcuugaguccagcaguucgaaaccagccuggacaacauagagagacccccaucucuacaaaaaaaauuguuuuuaauuggccagccguggugacgcaugccuguagucucagcuacucaggggacugaggugggagaaucaguugaagcuggcagguuugagguugcugugagcuaugauccugccacugcacugcagccuaggcaacaguguggggcuugucucgaaaaaagaaaaagaaaaaaauauaaaauuacuaaaauugauuuauauauuucaaaguuuuuccuauaaugaauacuggaaucucaaaucuucagaauaucaagcaaauucuaaauuugcucaaagaccuugacuugaaaucugacucaauuuugaucaaguucauuucaaaacccuacaguuugauuuauaagaguaaguuuuaucuuuacucaugagccaaaccuagcaucuauuuauuucugugucucuaaacuucaggugccaccuuaaauaacugcuagcacauuccuuuauuuuuaaacagucaucccucuuagcuccuauucuuuauuuuauuuccuagucuugaccaacccaguaagagucagacuagagcuucuaaggaaucuuaaagaucaccuagcauaguccccuagccaaugucugaauucccuauuuaaaaucccuguuaaguggcuacgcagccucugcuuaaacagcagcuugaggucaagaaccagccuuaccuuuguauuuuuaauaccuagcacuauaugccuagcauguaguagggacucaucuaucaaauaucuauuauuuguugaaugaauucugaaugacagugcagcucauuaauucccaagguagccuuuuacaagguuauucugcuaccacaaaacucuuggucucuuucacguuugauaucccucuacuccaugaagcaccaaggaagcccaacaguuucuaaggcugcauuuuucagagauauaaauuaaacaauacaaaugauggggacacgcacaacacuaaccaugauaaaauguugcaagcuaauuuuaccuaauaugcugugguaagccauaaacacauuuauaacaaauuauccuaacuguauguuaaaaacaauuaagaaaagcacaauguuuaugauacaacaaaacauucagaggcaugccagauuuucucaucuauucugcauuugugucaacauacaaauuagguuuucaaaaaaagaacaauauaauuaaaugguucagcaguaaugcuacuaaucaggaauaaaaauuagauaccaaauuaugaguaucuacugccugguaucuuaccuuucaacauaggaaucauuuauuuuuauguguauuuaaauuuuaaaauacaauacauuauauaacuugccaaagaaguggaucauuuaguagcuuaaguuagagccuuaacauuucaaaaugcucuuaucacccaauuuccccaucauuauuuaccccaaaaugaacagauagcauccucauuucaaacacauaagcaaaauuucagacacaaaaauuucauuccaaagguucuuuccucuuaggucauaaaacuccaaaugucuaugaauguacaauuuaaacaauuccaaaauauacaguaaaaaaauauaaaauaaguaaaaacuaagaaacauuuuaugaaaguuucucuaaauuucugcaccuuccuaugcuuauucuguauacgugacccuuugauaaucagauuuccuaaugaagaaccacucuauuuuagugauacgaugcuaaucagucucauaaugaaaaauaauuuagagagcuugauuucauuuacaaaaaacuucuugucacuccuuucuaaauacaaaagcuauuccaccugcucagcauuauucauacaaguauucgaauuuguaccaaaaaaaacccuuuaaaauucuuagacauuuuuuuuuucccuugagacagggucuugcucuggggaacagugguauaauuauagcucacugcauccuccaacuccugggcucaagggauccucgugccucagccuccagaguagucaggacuauuggcccaugccaccaagccugacuaauuuuuuuuuaauuuuuuuuguagagacagggguugcacuauguugcccaagcuggaacuuauuuucaaauacuaaaucuugcuuuuagguggcacucuaauuuuuaauuacagcaucagauuacuauuuugaucuuuaauuaaguccuaaugacaaacauuaaugaacuaaagaaaccaagauaaugccucaaaacacuagugggaauuccaaaauuccaacaaaaaucagaauuaagccuuuuuacaaauauaugagccggaaggccaggcacagugacucacaccuguaaucccagcacuuugggaggccaaggcggaggaucaccugaggucaggaguucaagaccagcccggccaacauggugaaacccugucucuacuaaaaauauaaaauuagccaggcauaaaggcugggcacgguggcucaugccuguaaucccagcuacuuaggaggcugaggcagaagaaucgcuugaacccaggagguggaggguguagugagccgagaucacaccacuguacuccagccugggcgacauagcaagacuaucuaaaaaauaaaaauaaauaaaaaaauuagccgggccugguggugcacgccuguagucccagcuaccgagggggcugcaacaagagaaucgcuugaaccugggauguggagguugucgagguugcugugagccgagaucacgccacugaacuccagccugggcgacagagugagacuccgucucaaaaaaaaaaaaaaaaauugaaaauuauuucuaaaaacagaauuuuuaaagugcuauaagugauaaagauuaauuuuuaaauuuguguucauaagacagaagcaguaguguagguugguaaauuuaauagucuaucucccuaauggccuauuuacacaagaaauaaaauauaaugcauaugaaaugcacauuacuuuguucugacccaaaauaaaucauuagcaaccuuacuaaacauaugacuggauacacaggaagugaauauaucucaucagggucuuuuugcuguguauaauacuaagacauucaaguggucaauaaaugauuucagaaguauaaagacacccuaccagauagcugccaacaacucuuaccaaaagaaacagaaucccucaguacacuaucagguuuccuuaauauuuccaacauguugugaguuaguguuucaauaaaugaaacagaacaguguuacaagguagcaaauagcuacuuagagauuucaaggcuuagucuugggccucacuucucuguaaucaauagaauugaucaaauuaaugcaaaacugggacaguaugaucuaagcaucugcacuaacugaucaaaaacagaucgucaggagucacagcaauggcagcuguuuccacaggcugaaagaucauaccaccuaccucacaaagccaauuuuagguuugagauacuuaaaaaugcucacagaaaaugcaaaggcucgaguucuuguaauauuuugcaacuauuauuuugaguccuuaauggaaacaaagccauguaaaguugguaauauaacauccccuuuagaacuugaagaaaaauacacugauaaaaauccuguuaauccugugacauuuuauacugaaggucugugaugcccaauaaacuuaauacugcaacuacauggaaaucucagugucauacacauuauuuuccacuauuugucaaaaauuuuaaucuguauaauucuaaggcuuuacuuuucuaucucauuuuagcauauaugcuuaacaauuuacaguccuggauuauucuggccuucaaauaauguaaacuggcaauuucaaaacagagauugauuaaucuuccuaugugcaauguccucuauuuuccauuuuauucuacuucagguuuuuauguuuuuuaaugcuggugacccacuaaauugauuucaugacccuccuggcgguuuucaauugagguucucaggagaauuuaaaaugccccaaggcauccauuguauguaaugaauuaccuucucuccagugcauuuagaaugguaccaguacgaucacugggagaaaugacaaaaccagcacucaauucauuuucuguagugcuuaaaucuccccuuauggaacccugcuugagauggcuacaugaaugacaaauugcaguuagaaaaacacugcucuaaaugaacugucuuaaaauugguccaaaaguauuauuccaguaacuacuccuuuuguuuuucuuuuucuuuuuuugagacagagucucacucuguugcccaggcuggagugcaguagcacgaucuccgcucauugcaaccuccgauuccuggauucaagcaauucuccugccucagccucccaaguagcucuaauuacaggcgugugccaccaugcccagcuauuuuuuuuauuauuauuuuuaguagagaugggguuucaccauguuggccaggcuggucucgaacuccugaccucaaaucaucugucugccuuggccucccaaagugcugggauuacaggcguuagccaccgcaccaggccuacuacuccuuuauuaauacuuaugcacucuagaaaugcuuuugcacaaacacaguuacaauuacauacgcaaaugaauaaauuccagaggcaguuaucacauggugcaauuaugaggaaauuguguuuucuucuuuguacuuuuuuaguauuuacuacaaugggccuauauuguuuucauaaucacacaaaaaaauuuaacauagacuauaaaaagcauagaagucuuaaaucauuuuuauuaaguuuuguuuugucuuguuuuuuuugagaaaaacagggucuugcucuguugcccaagcuuggagugcagaggugccaucacagcucacugcggucucaaccuccccaacucaagcgauacucccaucucagccccacaaguaguugggacuacaggcaugccccaccaagcccagcuaauuguuuuuuucaaucuuuuguaaagacagggucaaacuauguuacccaaacuuuuaguaaguuucuuaagcuuuuuaauuccuuguucccauaaaaaaugcaaaauauguacuuuuaaugccauuugaaaucucagaauaaauucaacaucacaaauaaaaacgaaaugcugguuuguuuuaaaacuaaaccuguuucccucuucgagaaucacugguaacuuuauagggccacuuagacuucacuguuauccaaaccuuuauuaggcaucuaccacauucuagauucgaagacuguaagauauaagaagacuguaagacuauaagaugaacuccugcucggggggggggggggggcucucucucucucucucuguauauauacauauauauguauauauagaaauauuacauauuucuaugauccacucuuaagucuagaagucaugaaaucaaaaggacucaaacuaauuuuauaucuuuccuauucauucuuucugccuaauauaaugaguuagugauugaagcaaaccacauuuuauuuuauuuuauuuuuuugagacggagucucacucugucucccaggcuggagugcaguggcgcgaucucggcucacugcaagcuccgccucccggguuuacgccauucuccugccucagccucccgaguagcugggacuacaggcgccugccaccgcgcccggcuaauuuuuuguauuuuuaguagagacgggguuucaccauguuagccaggauggucucgaucuccugaccucaugauccgcccgucucagccucccaaaagugcugggacuacaggcgugagccaccgcgcgcagccggaagcaaaucacaucuuacaacaagaugcauuguuuauauauucuuuugcuuucuagagucuaauaaaauccuuauuuuauguaauaugaaucccaguagaauaaaauucuauaugugaacaaaauacagauucaagcuauuaccaaagcuauucucaaacaaguucuaccccuuuacuaggaacaaacugaauucuagcucgacaaucacuuuccacucccagaauucuaaagggauuaaaauuagcccaauucgcugggugcgguggcucacgccuguaaucccagcacuuugggaggcugagacaggcagaucaccugagguacggaguucgagaucagccugaccaauauggugaaaccacaucucuacaaaaaauacaaaaauuagccagcuaugguggcacaugacuguaauuccagcuacuagggaggcugaggcaugagaaucacuugaacccaggaggcggagguugcagugagccgagauugccuuauugcacuccagccugagcuacaagagcaaaacuccuuaucaaaaaaaaaauuagcccaauucuugauuacuucuuugguuucccaguggcauaauugauaacauaugcacugcuacgagaaaacuacuggcugacuaugaugauccaggccuacucugaaaacacggccaucucuuuuuuguuuuucuucuuuaaaguuucuaaguuuuuucccauuucucaaacaaaaaggauaaauuucuaacuuucaaaaaucauaugcuaacaauucuauuuuuuaauaauaaaaauaaagaggcucuauuuccuaaaccacagggggcacuauuugcaaagccacucuacagauuucaaaaaaaaaaaaaaaaaaaaaaaaugccagggauagggaggguccacauauccuguuauuaacagaaugagcuccaaaaacuugauuacucugaaguuauuauaaaagucguuuuguaaaaaaugagaaaggcacuaaacaaaaccuuauccaaucuaagcaggucuguauuggucuccaucauucaaaaccccaaugugguaucaaccgaauaaauggaaugggcacuaucuccaaucaauguaucuuuuuggguaacaagucgaaaauaaugaaauaauucagaaaaugcuucuauaauaaaaaaacuguuucacacuuucuucuugcacacuucauuuuaguaagcaaauauccaacuacuguaauuacuguguaaaaaaaacuauaaaugagauacauuugaacccaacauucaguuaucuuguuugucucagaaauauaauucuagauaagaaaaugaggaaaggaggacuccucaaauacauaauauuucaauaguaguuugaaauaccauccuacauuucugcaguaaaggcucuuaacuuccaaaaugcucauucucuuguuugaugaauuauauuaacaguuuaugugcaaauuguaucuguuuaaagguuaagccaucuuuaaaagaaaauccaaauauucuaaaauauaguuuaguguuauuuuucaaaaaucuauucaguuaaaaaaagaaaaauuuaauugagugccuuugacaugccaggcuuugaacucgguuccaaaaaaauagaaaaaauacucuguaaacuagugggaacaguuacuaauuuuagaaaguuagacaaaaguauucauaauggucccucauaugagcacaaauacuucaucugacucucaacuuauccccacuugaucaaaaauuuugcuaauugcaaaauauaaucuguaucacugggguagcaaaucaccaucaaauccaccacaauuauuacuagaucacauucugucccaacacaacucuuuguaguugcccauucuacuguuccuuaucucaauuagguuuauacugacaaauacgcugccuaauacaaguauaauuaaaagcuugcaagaggggagaaauauuuuguacuauuauuacuccaaugaucucuacagaaaugaagaagugaaacgaaaaugcaaaauuaaacucucaaacggcuaauacgcuuucagggaaaaaaaauuuuuuaaguugcuaucuuuaggucaucuguuuguaucauaaguaaucuauagagauuuuuccccccuaaguagauuaaaaacuaaaauauuuuacuuaccuaagaguaguccagucuaaauguuaaaaguuuaaauuuuagccaggcacgguggcucacgccuguaaucccagcacuuugggagacugaggcugguggauugccugagaucaggaguucgagaccagccuggccaacauagugaaacccccaucucuacuaaaaauacaaaaaauuagcugggugugguggcaggcaccuguaaucccagcuacuagggacacugaggcaggagaauugcuugaaccugggaggcggaaguugcagugagccaagauugcgccauugcacuccagccugggcaacaagggcgaaacuccaucucaauuuaaaaaaaaaaaaaaaggguauauauaguucuuaacuuaguaaaguggagacugucagccacaugcuacaauagggaagaaucggccaggcgcaguggcucacgccuguaauccuagcacuuugggaggaugacgacgucaggagaucgagaccauccuggcuaacacggugaaaccccgucucuacuaaaaaaauagaaaaaauuagccaggcguggugauggguaccuguagucccagcuacucagggggcugaggcaggagaauggcgugaaccugggagguggaguuugcagugagcugacaucgcgccacugcacuccagccuggucaacagagcgagacucucgucucaaaaaaaacaaacaaacaaacaaaaaaagugaagaaucaccuacaacaaaugaccacuuccaauauguuugaaaauaaucuuaaguaaacauuacucuucaaauuuuauuuacaaaugauuaauuugccuguugaucuuuuuuucauacaaacguaauauucaacaaaauuagaauuagaucaaauuuauuuuaauuuucuauuuuuguuuacauauauuugaucuacuucugauuuugcugaauauccacugaagaugugaaaaagaaucaggaaugugauguuugcauguauuuauacaguuuaaaguaaaauaaugauuauuccaauaaaaaacacaaaaagcucguaucagguaaguaacuugacaacauucuguagaacaacauaggcagaucuaaaaucaaguaugugugugugugugugugucuguguguguguguguguguguguuuugagacagaguuucacucugucacccaggaugaagggcagugugaacucggcucacugaaaccuccaccuccuggguucaagccugccucagccucccaaguagcugggauuacaggcgugugucaccauccccugcuaacuuuuguauuuucaguagagauggcguuucaccauauuggccaggcuggucccgaaccccugaccucaggugauccacccaacucagccucccaaagugcugggauuacaggcaugagccaccgcgccuggccuaaaaucaaguauauuucuuauggcgacuugaguaagaaagaguuauuagcuauauuuaauuaaguugucucauuucaaauuauuuauaauuuacaagauacuacaacuuauuaacauuaaaauguauuaauauauuacauauuuuauaauuguaaaauaauuaaguuguuucauuucgaacaacuuacugaguuucaggacuuuuuuuaauccaaaagcaauacuuugauuacauaaacuauauacgcaugucaaaucaugucaguauucacaccaaacaucagguccuuuacauaacacguuaauauauuuaguacagucuuaaaaaaaaaaaaaaaaaaggccaggcgcaauggcucaugccuguaaucccagcacuuugggaggccgaggcagguggaucaucugaggucaggaguucaagaucagccuggccagcauggugaaaccccgucuggacuaaaaauaaaaaaauuagcuggguaugguggcagacgccuguaauugcagcuacuugggaggcugaggcaggagaaucgcuugaauccaggaggcggagguugcagugagccaagaucgcgccauugcacuccagccugggcgcaagagcgaaacuccaucucaaaaaaaaaaaaaaaaaaaaagccuaguuugacuuuuuaaaaugagcucccucugggucaauuuggcuuguuuggcaaccaacucaaugacucacagaagaaaauaaaaacuguuccucagucaaggacuaucucauucucaguuaaauaccuuaguauuuaaauuuauaugcagguuaaaacagaguuugagaaccaucauagaggcugaauaucccuuaucagaaaugcuugggaccaaaaguauuuugaauuucugauuuuuucagauucuggaauaugugcacgauauggcaguugagcaucccaaauccaaaaaucaaaaucugaaauacuccaaugagcauuuccugugagugccaugucagcauucaaaaaguuuuggccuuuagagcauuucagauuuuggauuugggaugcucaaccuguacuaagguaaauugauaagaaaaguuaauguuucucaaaauucaguuucugcuacuaacaugugcuucaggggcaaauagugaaaaauuacuaaacuucgaguuagaagcccuguauucaacuccugauucugguuauacaaccaggagcaugugacucaucuaagagguggaaauauugucauucaccuuccucacagacccuaaaaaauaaguguacuucacaauguucugaguacguuuuuaaaacgugaagugguaagcauaauaaaacaaccacucaaguacguauuaaauaugaaccaaagaaaagaaucuuucuuaaaguauggguguuugaaauuuucuuaaauuccuuuaaauuucucaaauucacauaaaauuacaagcaauaucaaaauacaccacaaacacuaauucaaauacugcaaaauauaacacagcaaaaagaucagaaagaaacucacaccuuccuaaaaucgaaaauguauucaaaucagugaauucugggacaaaaagggauuacaucccagacgaaggaugguuucaguguuaaccaaaccucagcacauuguuucaguuaaguaaauuaauccaucaucuuuuuuuuuuuaaaccuuuaucaugguucucagauguuuuucacauaaacacagagcaagaauauuaggaaaaguaguuuauccaaaauacacuuaugucagacuaauaauuagacuggggcgggccaggcgccauggcucaugccuguaaucccagcaauugagaggacgaggaggucggaucaccucaggucaggaguuaagaccagccggcuaggcuguaaaaucccaucucuacuaaaaauacaaaaaacaagcuaggcaugguggugggcaccuguaaccccggcuacuugggaggcugagacaggagaaucacuugaaucugggagguggagauugcagugaacugagaucgcgccauuguacuccagccugggcaauaagagcgaaacucugucucaaaaaaaaaaaaaaaaaaaaaaaaaaaaagacgggagcaacaauaucuggcaaauguggccuccaacagacauguaagaguagaccaccacugggcaugguggcucacgccuguaauccuagcauuuugggaggcagagacaggcgcauugccugagcucaggaguucgaggccagccugggcaacauggugaaacccccucucuacuaaaauacaaaagaaauuagcugggcauggcggugggcgccugaagucccagcuacucggaagacugaggcaggagaauugcuugaacccaggaggcagagguugcagugagccgagaucgugccacugcacuccagccucggcgacagagcaagacuugucucuacaaaaaaaaaaguacagcaccuaauuagcuugggggcaagauaucacaaauaucaaaaggggcauuccacauuuugaaauauaaucucugagcacaaacuucagcacgggacaaguccaacuguaagcaaguucuacacugagcacuggcuugaagucaauccugauuuaaaauuaguuaauaggccgagagcaguggcucacaccuguaaucccagcacuuugagaagccaaggcggguggaucacccgaggucaggaguuugagaccagccuagcuaacauggcgaaaccagucucugcuaaaaauaacaaaaauuaaagggugugguggcugaugccuguaaucccagugacucaggaggcugaggcaggagaaucacuugaacccaggaggcggaggcugcaaucugccaagaucgcgccacugagcucuagccugggcaacaggagcgaaacucugucucaaaaaaaaaaaaaucaguuaauaacuacaccugaagaauauaaacuuaucuagcagccacuggcaagaaauuucaaagugcuggucuucuggaagcagcaagcagcaaacuaccauaaaugagucuaaaauuauuaucuucauuaggcuuaaccaaugucuuaaacuacacuguuaacuaaauuucccucaaaaccuuaaaggcaccagaauaaagcucaggaucccaagucuuaaggacuaguccaagcucuaacuuugcugugaauaaaccuucagucagucauuuaauaugcuuuauucauuucuucuguaaaauagaaaugggcaaggauauuucaaggaaucaaaacuaauaguggaaaaauucaaaguuccuaaaugaaacacagccaaccucuuguuaagaauuaaauaaaauuauauauguaaaacugcucaagaauaauguuugccacauuuuaaacacuuaguguuaggaacuguuauuacacauuaauuuuagucaaauaggaaaaaauauaaaacaacccgaucaagaaacuaaauauuuaauaaucccaaucuuguccauuaccucggcauucaaaaccuuggaaugaaaauaauaguuuagccuacuagauaaugcagcaggaaaaauaaaauuaugauaccuuggcugauaggugguuguguuuuuuuuuuuugaaauggagucuuacucugacgcccaggauggacugugguggcgugaucucggcuuacugcaaccuccgcuucccagguucaagcgauucuccuggcucagccucccaaguagcugggacuacaaacacacaccaccaugccuggcuaauuuuuguauuuuuaguagagaugggguuuuaccauguuggccaggcuggucucaaacuccugaccugaagugaucugcccaccugggccucccaaagugcugggauugugagccauucauugcucccaccuguugauagguuguuuguuuguuuuguuuuguuuuuugauggaguuucccucgacgccuacgcuggagcgcaauggcacaaucucggcucacuacaaccuccgccuccgggguucaagcgauucuccugccucagcuccugaguagcugggauuacaagugugcgacaccacauccgucuaauuuuuguauuuuuaguagagaugggauuucaccauguuggccaggcuggucucaaacuccugaccucaggugauccaccuacuucagccccccaaaguguugggauuacaggugugagccacugagcccggcagguuuuuauauuaauauuuuauuaguuuaaaauaacuuuuccuuacucuagcugucauuuuuuuuguuauuccuuucaaaucacaaauucuucagauacaugucuuuuccauuuguuucaaauauugagcaagccugaauauccaaacauagaaacaucagaaaucauagguguaucucugaaaaaugcuguuuugagcccacgggaauuguggccauuguaccauuugcaaauggagauaacaccaaagcgcaaauuaucgaguccuagaaaaacaacagauguaguggucaagaagcaagaugugugccaaagaggauaagaaaaagaagcccuggcuggacacaggggcucaaggauguaaucccagcccuuugggaggccaaggugggcggaucacgcggucaggaguucaagaccagccuggccaacaugcugaaaccuggccucuacuaaaagcacaaaaaaaaaaaaaaaagaagcccuaacuccuccacucccuggcuacauaauuuugggaaagucauuuuaucucucugagcuucauucacuuuaucuguaaaacggaauaauagucuuacuucucucacaggauguuuggaaagucaaaugaggaaacauacugcaaagcacuuuauggccuaaaaacugcaauacaaauauaucaaucgguauuuuguuguuguugcaugagcaauguucaacauacagguuaaguuacacacuaaacauagaauuuucauuucaaaguaaaccauuaccauuauuaaaaauugauauaaaaaacuugccuuggauugauuucucuuuccacuucucaugcuaaacuucuccuucauuucuucuaaaauuaucuucaguuucuuuucuucagguguuccuaaguauuuuugguucacaugaagauagcaaugccauuuagcugauucaaagccccaguggcaaguucuuuugucaggugaucugugagaaugcaucacaaacgucuggggugcaaacauuccacaacacuccagacauugaauacacggagcaucaggcugaacauaaaacuggggugcaaauaaacccugacauuugccuaggcauucaugcuccacuucaaaggcacugccaguuuccuuuaacugggccaaugagcuuuuagcaggaaguacgcuaccauuuugaggaaaaguucguggccgcaauaaagcauuacauaaucuuugugcaucaguuaauguaaucagcccacaggauggggcauugaauggaaguaugcccaguaccuuuaagauaugaagcuggucugaaguacaccuugaacaauauauguacaguucaucacacacuguauuuauuugcuggaguguaaauucucggagaacagaauuuaagacuuggggcaaacagagucucuuuucuccuccaacuugaaaacaagaaauagauuccccuuccaacacagucugagugaguucuguggagcuaucugaagggaugagcaaugggccaggaagaaccugaggugauggaagaggcagaaauacaguaggcgacaugcuuucuugggaaugccgagcagaaaaugcugcugguccacccagcgagcucugacuacuuaaauggaauugugccaauguguguuucaaacugggauuuaaaugcaaaguuucaggaacagaaguacagguucgcuuaacaugcucuccaucaguuuccacuggugcuucuccauagucauccaaguguuccuucuuaacuguuggcaccuuguuuaucguuuuuccauuugcaugaauguccguuaucauuuuuuucgcuggggggcugccaucaucucccaucccauucaguuuuuuaguugagcccugaaccaaggagaaauuugucuggagguuuuccaugguacacucuucuguuaaauaauuaagucugagauuagcauuucuauuuaguugcuuauuugaaaagaggaaaguaaugaauggauacaaaugccuaucguaacuuacucucaaacuuucaaagcgagagccccuuaaauuaauaaauuuugcgacuuaguuuugguucuccuuauaaucugguauaauuucacuacaaauccuauaaaauuguucguuuugccucuaauaauaaagaaaagaggcacaccucugaggaugccuuuguuuucuugaauucuucagauauacauauuaaaauaaaguuaccaauuucucaauuaaagauguccagggucaaugcaauggucugguuuguuuuaaccaaaacacaugaaaaguuuaugccauuccuugugccauaaaaucuagacucaaacacaagucaaaaugaugcaaccaaauuuaaucuuuaccaccaaggaaaccaaaaaggagggcagagggaguauuuccucuaaaaaugauggucugcuggucugugcugaaaaacugaagacguguguaaauccucacaccaguaagaacagccuccgacuuaaaaaauugcccaguuaucuucaaggauuauaguucauucuucuuuuaauuaaucuggaagaagagaagggggguuggggaagaguuacauuugaauuugcuccagaggccaaagggccaauuugaaaccaguuucuuuuauuuuuuuuuuuuucuuuuuuuuacggagucucgcucugucgcccaggcugaagugcagcgaucucggcauacugcaaccuccgccucccggguucaagcaauuuuccugucucagacuccggaguagcugggacuacaggcacaagccacgacacccggcuaauuuuuuuguauuuuuaguagaaacgggguuucaccauauuagucaggcuggucuugaacuccugaccucaggugauccgcccgcccgggccucccaaagugcuggaauuacaggcgugagccaccgcacccggccgaaaucaguuucuuaaucuuaaacugaguucaguuuaccaaggugaagcuugagugauuucuuuaaaucuaacaccaguuuacuagaagaacauucauuuaaauaggaaagcaauuuggaguugcguaaagcgagcaauaauauaacauaaaaggccuuucgaguucagaauaugaagacucuuaagcagaucaucucaauuaguaguaccggggcuuucucagcuaugccauuuuaagggagggaaaaaaauccauuacuucaucuccuauuuaaaaacaaaacaacaguuucauccaaaaaaaucagauaggaguuaacauaucuaccauauguaacuaaguuacaauuuuaaguggauuaauucagcuaguccguguacacuauuuuucuggaaugacugcaggcaaaaauuaacuuucucuuaaaaaaagguuagcgauuuuacuuaauggaagccaaaagcuauagacuccacgccugggaaucuccauccuucaacaagacuaauccgggacaaaaagcacaaggcagacaaaccucacaaagaaugcaaauggaggaagagggaaaaagaaaagacucuuuuuccacuuccuucuugagagaaaagccaaaagaaauccaauaaauagaaauuuuugcuucccaaacucucagcacuuuaccuuaaaacagacccaaaggauuaaggaccaaugccaccaaccaucguacagacuuucguccaccacaggaacacaccuuacucaacacaggccaaggaagagagcaagaggcaugaccuagaaugggggagccccuaaaacccugaaguccuccgcccacucaaagccacccaccuaucucuaacccggagagagggagaacaagggacacgggaagccugggggugggugugcaaggggguggagggaaguaaagggaggaguccccccacccccaccggcgagccugggauaaccccaagugcccucccaacaccgcccccccgcgggggccgcgggaaggacuguggaaauccacccccccgcgcacccucucccugggaaguucucgggugucaccucagcgccccuaaugcugcaccuccccgcgccagccccgggccagaacgaagaggacaccagggcaguuuaggcgccgggcgcggaucccugcgccgccgggggcugacggaccgggucgagaccagggcauccccgcggagcgcugcuggacugggggaggggggcggugacgggcguccgggucuccgggguccccgcggcucccgucaacuacagcgcccugcccugccggcgcccaccgccuggggccaacgaagcgugaucagccguggaacacccgccuagcgacccccucuggccccgaccccacccgggacccgcgcauccaaacccccuacucgggccucggugcccggguaagcucgacgagcuuugugaauuccccaccgccccugucgccgccgucgggcuccuaggagggugagcgccucuggccucccgccgccuccgccgcgucgccgccguaagccggagccgcaccugugcccgccgccgccgccgucgccgcucgcccgcucccuucggcugugccggcgcggcuccgaaccccacacacaucgcuacacacagcccucugacg

SEQ ID NO: 21212 - RNA, 4584 nt, Homo sapiens
acuagauuauaaaaacuuccucuuuaaucaaggcuuuuaacaugaacagauuucuugaauaaaauggaaaguuuccaguacacugaaacauaaauccgcaagucaccacacauacaacacccggcaggaaaaaacaaaaacagcaaguuuacaugaucccuguaacagccauggucucaaacucagaugcuuccuccaucugccaaguguguucuggauacagagcacaucguggcuucuggggucacacucagcuuaggcuguggguccacagagcacucaucuggcugggcuaugguggugguggcucuacucaagaagcaaagcaguuaccagcacauucaaacaguguauugaacaucuuuuaaauaucaaagugagaaacaagaaggcaacauaauaauguuaucagaaagauguuaggaaguaaggacagcuguguaaagcuugaggcugaaaaguagcuugccagcuucauuucuuugguuucuuggguagugggcgccggaacagcaagaugugagguucugaaagagugagggaaaucuaagagacaagcucacaccauucuauguacaaccuauaguguauuccacuaccaccuccccagcuaucacccacucagaucuuuauaacuaaauaaagacuuaagcauauggccuuagaagcagacccagaagucuggacugucugccaaguacagaauuguuaauaucaguucuuuugcuauguuuauacagccccagggugucccuuauuaguuuugccuggcagcugggugucuggugucuuaucaauaaauauacuuuccuuugcuuauuuagaacacauccaagaauguuuucgauggagaaugaggcaggggcuaugaucaggcuauauguggccuuaaaaagaauacccucugauugaaugaaagauuacaggagguuuuucagugacagguugucucugaacuucccagauauuuuagucuuauuuuuggucacuaguuuuuuuuuaaaaaaaucccccacgacuggagggggaaggaaccaguaaaccauuuccuaucucccuauuuggguuauacaaucuuauucuuucauucucucaguguagcaguucuauaugguuguuuuuagccagugcacugaccugguucauggaucauauaauggacccaucccugacucugcugaacgccaagauuccuccauucagauucagacaucagauggguuuuagggaccagcuuggcuauguccuugggcagcaugacaugucuguaacagaaacggggaaguggggaauuuauguuaguaccagauacagucucuuagacaaaugccuguuuacaaggccaagaaaggaaagaaaaacugguuuuugaugucagaguuuauauaauuuuauugugggguagcagcagcuagaaauacaggcuauguuauauaaauuccgagaguauauuaaaaauacaaauuagugaauaauuccagugaaugagcacuuaaguucaaggcacauuuucuccgccuucauggaccuuauagucuucuaguugauuaucuacaacauaaugggagccccacggagcacacaguguuaauaauuagaaggaaggaagagaaguuauuuuguggcgaggaaaggccuuuuaugaaguacuguguggacaaguuauuacaaaggaugaaaugaacuaucuuguccuuuaaaaucuaagccaggcaugguggcacaaaccuacagucccagcuacuugggaggcugaggcaggagggucauuugaacccaggaguuugaaaaagauacaguaugaaguuugaaaucugauuaaaauacagaagaaauaggccaggggcgguggcucaugccuguaaucccagcacuuugggaggcugagguggguggaucacuugaggucaggaguuggagaccagccugaccaacaacgugaaaccccgucucuacuaaaaauacaaaaauuagccgggugugguggcaugcaccuguaaucccagcuauuugggagguugaggcaggagagaaucccuugaauccaggaggcggagguugcagugagcugagaucugggcgauagagugagauuccgucucaaaaaaagagaaaaaaaauaagaaaaaagaaagggcugcaaugcacaaugguugugccugugaauagccacugcacuccagucugggcaacaaagcaagaccuugucucuuaaaaaaaaaauuaaaucuauccugaaucuuauuuuccuaacucuggagggauguaccuugagacuuucuggguaaauuccgugcuuuucuaaccaaggauaagucucccuucauagcaaaaaaauuauuacccugaugugaaucaaacuaauccacauagucuucgucaugcucaaugaaaauguacuaaguucucccucugugcuaguaacagugauuccccaccauucuccuaaaagaaaaaauucuaguccaaauauaaugaaaauagcucacauucuaacaccacccuggcacgaaauuuggcuucaauacauacaccaaaaaaccccucuuaaaccaaagugccacugccaagaguuucaucuuccaggggaugaaauggugauuccuucccagcuccacaaaucucuuauaagcacauacaguuuuaaguuaguuuaguucagauguagaggaaaacagcugaggaaaagaaaguuaauuaaaggagggucuggagccgucuuggcauaaagaugauuauguauuugucaaugcacaucgaguucucuggaagacccaaagcccugaacuaggcugggugaagagacacaagaaaagcaaguuuucauuuuauguucuccaacugaggagacaagauacaaaccaggaaguggucuuaauuauuacaauuaauacagauuagcauaaugccaacauuuguggaauccugugucuucccuuauucccaaucuagauuaugcacuuaaaauuuaucaagcccgaaugccacauccagugccaggauuccaucaucaccauccuuggcagauggcuauccagugucuucuaaacaauuucagucaagaggugcuuccucccacauaccuuuuucuuagagucucaucucaggcucugcccucuaggaagcuuuccccaacauucccucuuccguuuuuccucucaguauuuuaaguuucauguucaaggguacaugugcagguuuguuauauagguaaaauccugacucggggguucgguguacagguuauuucaucacccagguacuaagcauaguacccgacaguuuuuuuuuuuccugaaccucuaccuccucccacccuccucccucaagcaggccccaaugucuguuguuccccucuuucugucccuguguuuuuaucuccgacauauaaaugaaaacacgcguaguuuacuacugguuucguuuucaaugguggugaaagagacaucacgcugaauuggcccuuaggacacucccccgcccccaaaccaagcccagggaagaagaccgaccgaaaguaagaggucagccuccaaggcgguggcggggcggggggcguucucgaagcgugggaugggggagcguccuggaguuagcaaaaguaggggacugacuuucuagccccaccucaacccccgcucacagcuaggaagccgcagccuucgggucgccaguucccucuccuuagcaagucuugugugcucccaucacacccuguaauggcuccuugcauagcgugugucaccuuucuggugucugucgguaccacccacagauuuuuaaauuugugaacagcagagaccauguguuauccuugcacuuuagcagaacaccugaaaccuguuaaguauuccguaacuguucccuuugauauuuaaagggcaucuauuagacccauauuaaguauuuucucaaugcuccuagccaguuuuauuccauugcagucccaagcgauccccuuccuuacacaagccagacaaccacgccccuugucuuuuucacgaguuaauaagcaauauucaacucucucagcgcuacucuccuguuagggacgccaggaaacuuccagcuccgcuuuugcuacguucucccacuggauucgacaagauuacugugaaacagucucuacaaggcaaguuaaguuugcccgauaaaguucagagaaugauccagaaagccucaugggugaggguggucaguacccuaaccacgcccaccccucucuccucucuacugagaggcgacuccaaauucgcaaccacuuuguuuuacgagcgccucccaccuccgcgcaugcgccuuacgccuuccacaauaucacaccauugcccguucgcaccucguacgcaugcgccaauucuaucgccucaguuccuguuacuaauuccuugugcccucagcggccaaagcucacgacccucgcuauugcucccgcgccagcacuaaccgauacucaaacuccucgucgucguauuuguccgaauaguaaauuuguuugugcgacaugaucgcucgguuugcuagccuucagccccgcgccgccaaccuccaagcaacucccaacagcacgcgcucccacccacu

SEQ ID NO: 21213 - RNA, 4453 nt, Homo sapiens
ggagggggcgggaauucccgacucuaggccggaagcgcgcggagaccauguagugagacccucgcgaggugagugcgggcugucuggcagcgggguccaugucggcugcccaggccuccccgggcccgggaacaggagucccagcucacgcauucuucaucugcuucccgcgacgcuuggcggccucgcaccccgccuccuggagcccggacuuucaggcaccgcccucagugucgccucaguccgucccgggaccgcagacucuuagggccccucucuuuggccaucugccucuaggucccauccuggggccugaagcgcuuguucucugcgcugggaaaaggggaacgauggagcgauccagcacccaaacuuacccuguccagguggcccacgaagcuacccaagacaucucugcacagcccuagccuuuuuggcuucacccacuccguucgggaguuggggacccggccucuacauuccuuaggggaacuccagcuccagguccuauuuggaggcggcuccuaguuuccuaguuuucugggggcaccaggugaaagggugaugagauauccauacagccuuucucaugccucgguuucccccgugcagucucccugaauaagucacuugggaaagaaagugugagaagagaggaauguuccugguacaggaguagaugagucacccuggguaggggaaggucacaaaguggcuggggccagggagcugcacucugcugaccaagcuuccccauuccuugccccaucuuccuuugcaugauuuuucccaaccacucuggucugucuuccuaggucugagagucacuggagcuaccagaagcaucauggggcccuggggagagccagagcuccugguguggcgccccgaggcgguagcuucagagccuccagugccuguggggcuggaggugaaguugggggcccuggugcugcugcuggugcucacccuccucugcagccuggugcccaucugugugcugcgccggccaggagcuaaccaugaaggcucagguaagccucuccuuuuccccacacugcuaugaaugcuuggcuuagggagggcucuggggcuggcggggagugaccaaaggaggagggaaaggcaaggguagccauuguuuggguugggguggucggcccuggaggggguuuguuugcuuauuccccucugugcuucaccccuacccagcuucccgccagaaagcccugagccuaguaagcuguuucgcggggggcgucuuuuuggccacuugucuccuggaccugcugccugacuaccuggcugccauagaugaggcccuggcagccuugcacgugacggugagcacuggccugggcaugugacuugcgggaggggaaucacacaccucugggaguguugguuuguggagauugauucaugugccacuccaugacuguguggaagacuuuuggcaugugguaugaauugugauuuuugguuauggggcauaauucuuucuauguguucccucccccuuccccauucccugugugaccccuacauucccguugagacaguaagacacuuuuucucaggugugugacuugcucuauggguucucaguucuagcuaccagcaagugcuccaagaaucaucuucacucucucaccacuuuccuaaagggcuggagauagaggucucuguaggccugagaaggauaggaagcgauucccugggucuugguguugcuaaccuuuuuaggcuuuggcccaaggaagugggcugugaggaaugaucaaguccacggcauaggacuugguuuauuauaggaaaaacugaggccguuggauaguggggcaggaaagucauccugggcucuuuccuuuuuuccucuaaaacugaggaaguaacacuggauguaucccuuugugugucugugacugagugaccuguguuuccgugugacugcguauaagccugaauguccugugauauguggcucuauguaugaguauuuggggagaugggcaaugugugaccuuuucauguaugucuacaucagugacucucaacuaggaguguggcuuugccccucaggaaacauuugguaaugucuggggauauuuuuaguugucacaauggggagggggauggagggaacauugugccugcuauuggcaucugguaaguagagaucagaaaugcuguuaaacaaucuacagugcacaagacagcucccaugacaaagaauuaucuggcccaaaauguuuuuguuuguuuguuuuuguuuuguuuuguuuuugagaaagagucuugcucuguugcccaggcuggagugcaguggcacaaucucgacucacugcaaucucuggcuccuggguucaagugauucuccuggcucagacuccugaguagcugggauuacaggcauccaccaccacacccugccaauuuuuguauuuuuaguagagacaggguuucaccauguuggccaggcuggucucaaacuccugaccucaagugaucuucccacuuuggucuuccaaagugcugggauuauaggcaugagccacugccccuggccccaaaauguuaauaguuccaaagcugagaaacuuuggucuacacguaacacugugagugacaccauaaucuguguguacguaucauucugugucaguguuaccaauucacucuaucuuugugugacugagaguagcccugugucugugucagacccuaggucuguguaacugggcuuucaccagauuuugcaucucacucuuccuucccugaacauuuugcugcugcuucugcccacagcuccaguucccacugcaagaguucauccuggccaugggcuucuuccugguccuggugauggagcagaucacacuggcuuacaaggagcagucagggccgucaccucuggaggaaacaagggcucugcugggaacagugaauggugggccgcagcauuggcaugaugggccaggggucccacaggcgaguggagccccagcaacccccucagccuugcgugccuguguacugguguucucccuggcccuccacuccguguucgaggggcuggcgguagggcugcagcgagaccgggcucgggccauggagcugugccuggcuuugcugcuccacaagggcauccuggcugucagccugucccugcggcuguugcagagccaccuuagggcacaggugguggcuggcugugggauccucuucucaugcaugacaccucuaggcaucgggcugggugcagcucuggcagagucggcaggaccucugcaccagcuggcccagucugugcuagagggcauggcagcuggcaccuuucucuauaucaccuuucuggaaauccugccccaggagcuggccaguucugagcaaaggauccucaaggucauucugcuccuagcaggcuuugcccugcucacuggccugcucuucauccaaaucuagggggcuucaagagaggggcaggggagauugaugaucaggugccccuguucucccuucccucccccaguuguggggaauaggaaggaaaggggaagggaaauacugaggaccaaaaaguucucugggagcuaaagauagagccuuuggggcuaucugacuaaugagagggaagugggcagacaagaggcuggccccagucccaaggaacaagagauggucaagucgcuagagacauaucaggggacauuaggauuggggaagacacuugacugcuagaaucagagguuggacacuauacauaaggacaggcucacaugggaggcuggagguggguacccagcugcuguggaacggguauggacaggucauaaaccuagagucaguguccuguugguccuagcccauuucagcacccugccacuuggaguggaccccuccuacucuucuuagcgccuacccucauaccuaucucccuccucccaucuccuaggggacuggcgccaaauggucucucccugccaauuuugguaucuucucuggccucuccaguccugcuuacuccucuauuuuuaaagugccaaacaaauccccuuccucuuucucaaagcacaguaauguggcacugagcccuacccagcaccucagugaagggggccugcuugcucuuuauuuuggucccggauccugggguggggcagaaauauuuucugggcugggguaggaggaagguuguugcagccaucuacugcugcuguacccuaggaauauggggacauggacauggugucccaugcccagaugauaaacacugagcugccaaaacauuuuuuuaaauacacccgaggagcccaagggggaagggcaaugccuacccccagcguuauuuuuggggagggagggcugugcauagggacauauucuuuagaaucuauuuuauuaacugaccuguuuugggaccuguuacccaaauaaaagauguuucuagaca

SEQ ID NO: 21214 - RNA, 4453 nt, Homo sapiens
ugucuagaaacaucuuuuauuuggguaacaggucccaaaacaggucaguuaauaaaauagauucuaaagaauaugucccuaugcacagcccucccuccccaaaaauaacgcuggggguaggcauugcccuucccccuugggcuccucggguguauuuaaaaaaauguuuuggcagcucaguguuuaucaucugggcaugggacaccauguccauguccccauauuccuaggguacagcagcaguagauggcugcaacaaccuuccuccuaccccagcccagaaaauauuucugccccaccccaggauccgggaccaaaauaaagagcaagcaggcccccuucacugaggugcuggguagggcucagugccacauuacugugcuuugagaaagaggaaggggauuuguuuggcacuuuaaaaauagaggaguaagcaggacuggagaggccagagaagauaccaaaauuggcagggagagaccauuuggcgccaguccccuaggagaugggaggagggagauagguaugaggguaggcgcuaagaagaguaggagggguccacuccaaguggcagggugcugaaaugggcuaggaccaacaggacacugacucuagguuuaugaccuguccauacccguuccacagcagcuggguacccaccuccagccucccaugugagccuguccuuauguauaguguccaaccucugauucuagcagucaagugucuuccccaauccuaauguccccugauaugucucuagcgacuugaccaucucuuguuccuugggacuggggccagccucuugucugcccacuucccucucauuagucagauagccccaaaggcucuaucuuuagcucccagagaacuuuuugguccucaguauuucccuuccccuuuccuuccuauuccccacaacugggggagggaagggagaacaggggcaccugaucaucaaucuccccugccccucucuugaagcccccuagauuuggaugaagagcaggccagugagcagggcaaagccugcuaggagcagaaugaccuugaggauccuuugcucagaacuggccagcuccuggggcaggauuuccagaaaggugauauagagaaaggugccagcugccaugcccucuagcacagacugggccagcuggugcagagguccugccgacucugccagagcugcacccagcccgaugccuagaggugucaugcaugagaagaggaucccacagccagccaccaccugugcccuaagguggcucugcaacagccgcagggacaggcugacagccaggaugcccuuguggagcagcaaagccaggcacagcuccauggcccgagcccggucucgcugcagcccuaccgccagccccucgaacacggaguggagggccagggagaacaccaguacacaggcacgcaaggcugaggggguugcuggggcuccacucgccugugggaccccuggcccaucaugccaaugcugcggcccaccauucacuguucccagcagagcccuuguuuccuccagaggugacggcccugacugcuccuuguaagccagugugaucugcuccaucaccaggaccaggaagaagcccauggccaggaugaacucuugcagugggaacuggagcugugggcagaagcagcagcaaaauguucagggaaggaagagugagaugcaaaaucuggugaaagcccaguuacacagaccuagggucugacacagacacagggcuacucucagucacacaaagauagagugaauugguaacacugacacagaaugauacguacacacagauuauggugucacucacaguguuacguguagaccaaaguuucucagcuuuggaacuauuaacauuuuggggccaggggcaguggcucaugccuauaaucccagcacuuuggaagaccaaagugggaagaucacuugaggucaggaguuugagaccagccuggccaacauggugaaacccugucucuacuaaaaauacaaaaauuggcaggguguggugguggaugccuguaaucccagcuacucaggagucugagccaggagaaucacuugaacccaggagccagagauugcagugagucgagauugugccacugcacuccagccugggcaacagagcaagacucuuucucaaaaacaaaacaaaacaaaaacaaacaaacaaaaacauuuugggccagauaauucuuugucaugggagcugucuugugcacuguagauuguuuaacagcauuucugaucucuacuuaccagaugccaauagcaggcacaauguucccuccaucccccuccccauugugacaacuaaaaauauccccagacauuaccaaauguuuccugaggggcaaagccacacuccuaguugagagucacugauguagacauacaugaaaaggucacacauugcccaucuccccaaauacucauacauagagccacauaucacaggacauucaggcuuauacgcagucacacggaaacacaggucacucagucacagacacacaaagggauacauccaguguuacuuccucaguuuuagaggaaaaaaggaaagagcccaggaugacuuuccugccccacuauccaacggccucaguuuuuccuauaauaaaccaaguccuaugccguggacuugaucauuccucacagcccacuuccuugggccaaagccuaaaaagguuagcaacaccaagacccagggaaucgcuuccuauccuucucaggccuacagagaccucuaucuccagcccuuuaggaaaguggugagagagugaagaugauucuuggagcacuugcugguagcuagaacugagaacccauagagcaagucacacaccugagaaaaagugucuuacugucucaacgggaauguaggggucacacagggaauggggaagggggagggaacacauagaaagaauuaugccccauaaccaaaaaucacaauucauaccacaugccaaaagucuuccacacagucauggaguggcacaugaaucaaucuccacaaaccaacacucccagaggugugugauuccccucccgcaagucacaugcccaggccagugcucaccgucacgugcaaggcugccagggccucaucuauggcagccagguagucaggcagcagguccaggagacaaguggccaaaaagacgccccccgcgaaacagcuuacuaggcucagggcuuucuggcgggaagcuggguaggggugaagcacagaggggaauaagcaaacaaacccccuccagggccgaccaccccaacccaaacaauggcuacccuugccuuucccuccuccuuuggucacuccccgccagccccagagcccucccuaagccaagcauucauagcaguguggggaaaaggagaggcuuaccugagccuucaugguuagcuccuggccggcgcagcacacagaugggcaccaggcugcagaggagggugagcaccagcagcagcaccagggcccccaacuucaccuccagccccacaggcacuggaggcucugaagcuaccgccucggggcgccacaccaggagcucuggcucuccccagggccccaugaugcuucugguagcuccagugacucucagaccuaggaagacagaccagagugguugggaaaaaucaugcaaaggaagauggggcaaggaauggggaagcuuggucagcagagugcagcucccuggccccagccacuuugugaccuuccccuacccagggugacucaucuacuccuguaccaggaacauuccucucuucucacacuuucuuucccaagugacuuauucagggagacugcacgggggaaaccgaggcaugagaaaggcuguauggauaucucaucacccuuucaccuggugcccccagaaaacuaggaaacuaggagccgccuccaaauaggaccuggagcuggaguuccccuaaggaauguagaggccggguccccaacucccgaacggagugggugaagccaaaaaggcuagggcugugcagagaugucuuggguagcuucgugggccaccuggacaggguaaguuugggugcuggaucgcuccaucguuccccuuuucccagcgcagagaacaagcgcuucaggccccaggaugggaccuagaggcagauggccaaagagaggggcccuaagagucugcggucccgggacggacugaggcgacacugagggcggugccugaaaguccgggcuccaggaggcggggugcgaggccgccaagcgucgcgggaagcagaugaagaaugcgugagcugggacuccuguucccgggcccggggaggccugggcagccgacauggaccccgcugccagacagcccgcacucaccucgcgagggucucacuacauggucuccgcgcgcuuccggccuagagucgggaauucccgcccccucc

SEQ ID NO: 21215 - RNA, 12345 nt, Homo sapiens
ggggacucaggcgccuggggcgccgacugauuacguagcgggcggggccggaagugccgcuccuuggugggggcuguucauggcgguuccggggucuccaacauuuuucccggcugugguccuaaaucuguccaaagcagaggcaguggagcuugagguaaguuuaucucaugcauaguguucggcuuugggcuguggaauguucaggcguuucacugaugccagaaauggagcagaaucuaucagcuggagacaaaggccuugggcggggguccuuccauuuggugccuacguggggagaucuuuggagacagaagggagaaugggaaggaguugcggccuggaggcuuccugcuagagcugagaagccuucggggaguaauaggaagggggauuuccauugcuuaggcugagggcggggcccaaggacuguugaaaaauagcuaaggauggggguugcuagaaaacuacuccagaagugugaggccgauauuaauccgguguuuuugcguucucuagucacuuuaagaaccaaauggaaggucacacuaggguuuucauuuccauugauuauagaaagcuuuaaaguacuguagauguggcucgccaauuaacccugauuacugguuuccaacagguucuugcuggugugaaaugacugaguacaaacugguggugguuggagcaggugguguugggaaaagcgcacugacaauccagcuaauccagaaccacuuuguagaugaauaugaucccaccauagaggugaggcccagugguagcccgcugaccugauccugucucucacuugucggaucaucuuuacccauauucuguauuaaaggaauaagaggagagaaaguaaaaaguuauuuuggguauacauucaguuaugcaauaagcuuaacguguuuauagagaacaguucauuuuuauuagcugcugaaguuucuaaaaccuguccaguuuuuaacaguucuguaaacuauugcaaacucaguguugaguucauucaugaguuucuucauauauaacagcucuauuacaugagaaacacaggccauaguagcgagacugucugauuguaugggagauaauaggauggagauaaaggauucagagaugaguguucuucaauauuuauuuauuagcuaguugaagcagcugagaccagaugauuggaguagcaagaacuugagauuuuuagucuuuaugccuaggauuuuggucccuguuugcaguuuauuuaguugugugauauugagcaacugaaucucucccaaccucauuuuccucauguuuuaaauuaccauaaacuuguccugccuaccacacagggauguuauggaaaguuaaauaauauauuuaaguuauuuaugaaugguaaagcacuauguaauaguacuuagggauucuauuguuauuaugagaguucaugguacagauugucuucaguaaguggcaccuaaggcucuuuaaauaaaggguuuugccggacacgguggcucacgccuguaaucccagcacuuugggaggcugaggcaggcggaucacaaggucaggaguucaagaccagccugaucaacauggugaaaccccgucucuacuaaaaauacaaaaauuagcugggugugguggcaggcaccuguaaucccagcuacucaggaggcugaggcaggagaaucgcuugaaccagaggcagagggugcagugagccgagaucacaccacagaccuccagccugggcaacagagcgagacuucgucucaaaaaauaaauaaauagauaaauaaauaaaggguuuuguaauuuuguucaguuuagaaaugccuaacuuuagagauuauuuuaaucaacaccuggccucccuaccaucuggcuacucguguuuaauugaugaaaacuaacucuaauguagccacuauaaaaaauugguugcuaacccuuggcaaaaucuuuauuuugagcuuaacagcuuuaauauuuuacaugaaauguuuaauauuuuaauuaaauauuuuuaaauguuugauuuauugagcaauuuacauaaguaaaauacauaaauuuuaugucuacagcccagugcuuuuugcguuucuauauagucauguagcuaccacccagauaacaguauagagcacuuccaguacuccagagaguucuccaagugugaugacauuaaaauacaaguaaaaguccuguugccauaaaaccaaaaugaaaguauuuuuuauaugaucuaugcauguuugucuuccugagaaauuaaacauaacuauaccuuguuuggaaccuuuaagaauuugauucaggaauauuucccaaagguacaucugucaugauaaaaaaaaaaccuucucugaaacaaagguauuuguauauuuagucauaaacacaaaugauguauauagggccagguuauaauugguggagguauguuuagauuucuuuaaguaaaauaaacagcacaaauaaaacaguccaguucauagcuuagugaaauacacuggguacuuaaucuguagccuccuggcugcaguagaguugucauuugaguuacuguguuuucuuaaucuuuuccaggaacacagugaccauauuucuuuucugcaggcauauagaauuugguggguuuucuuuuauguagggugauauuggauacuuuuuguuugugauuauauauuagcaauuugagggacaaaccagauaggcagaaaugggcuugaauaguuagaugcuuauuuaaccuuggcaauagcauugcauucccugugguuuuuaauaaaaauugaacuucccucccucccugcccccuuacccuccacacccccaggauucuuacagaaaacaagugguuauagauggugaaaccuguuuguuggacauacuggauacagcuggacaagaagaguacagugccaugagagaccaauacaugaggacaggcgaaggcuuccucuguguauuugccaucaauaauagcaagucauuugcggauauuaaccucuacagguacuaggagcauuauuuucucugaaaggaugaucuuuguguucugaaucuuuauggggaaaugagguuaccacacuagggaagauagagcuuuuuaauuaugggaagaguugguuuuagguuguuugacauugagaaucuaggguaauuacugaaaguuaauacuggaauuuauuuuacauaauauacuguuacuauaaaguuugauaauacauaagugaagcuugcuacugggaaugacuuggaaccagaguuguuguaauuagagaucacgaaggaauuucagagaggaaaacaucuccaagaaacaucuuucaguauguaauggaaaagauaggccaggcacaguggcucacaccuggaaugucagugcuuugggaggccaaggcgggaggaucacuuucagcccaggaguuggagaccagccugggcaacagagcaagacccugucucuacaaaaauaaaaauaaaaaaauuagucacacaugguggcagcuacucgggaggcagaggugggaggaucacgugagcucaggaggucgaggcaugcucacuccacugcacugcugcacuccagccuaaucaacagagcaagauucugucuccaaaaaaaauaaaaaauaaaaugauaggaguaagcaaauaggaaguccauaaagaugaaaacaaagcaagggaacauaaagauagacuuuguccauagaaccauaaaguuucaaagcuagauuggaccauaaaaauucuaguacaauauucuuauuuugcagaaucagaaacagaguucagaaugucguuuguuagguuuuggagucaggauuguuauuaguagcagagccaggaccaaaaacccaaagcuccuuuuucuuagcacaguguucuuaaacagaauaauauaaugguuaagaaugagaacucugccuggauugaaaccuagcucuguuuauuagcgacgugacucaggggcuauguggcuuuccuaaccuauaauauggaaauaauaauaccuaccucauagaguugugaagauuacaguuuuaauaaauacgcaaaucacucagaauagugccuggcacacaguaaaugcuacuuaaguguucugccuaaaggcuugagucuuggcuuauuuucuauccaugugaagaugucugcucucaaaagcagauugguccaacacugaauucaaguguucuuuuccuaaccuguuguacuucccauuuuuuuuuugucuaaaaguaauagcaguacuuaauaaaaugcccacacuuggcaugcaucuaauaaauguuuuuugaauuucuagaagucauuuuucuucuuucuuacaagaaauuuauucauuuuucuauaugccuuagcucaaaccaaagaguauuuaaaacaucuuaugaaaaugcauauaguagagcaagauaagauuaaugaaaaauaggcuuaagugagaccaaaaaaauaaggguaaaauaaacaaauuuaggagugagcauauucugugauugugcaugaaguuccaguggcuuucuaaagguggacuacaaauuuggucacuguugugaaaaggaaaguagccagcugaaagauucaguaucuguaugcugaaagccguuaaguugcucggacuagaaggaaauuuucccauggauccucaaagaggcuuguuuaauguaaaaaucaguaguaaccugacagugacaugguccagguacuuuaggcugucuuaucccuuaauguaggcuauuaccaucaagcacaguuuugcaaauagccaguggaauguaguucagauacaugacuuuguggguaauccagggguagagacuaaaacaguacugugcaguaugugguuauuuacaguuaauuaagauuaaauaaaauuuaaaaauuaguuccuugacuaccaaaugcucaauagccacuaguagguaccauguugaacaguacagauauagaccauuuccaucaucacauaaaguacuguuggauuguguuggucaagacaaucuaaagcaauuguuucccaggugugcuguguggugugccuuacaugucauugaaaggggugcugucaggaguucuagaugcuucagccucccuuuacuaagagcaguucuuauguuuucuauuuuaucgcuugggcuuccagauacaauguuuuguuuuagguuuguuuuuuuuguuuguuuguuuuuuuuuuuuugagacggaguuuugcucugguugcccaagcuggauggaguacgguggugcgaucgcggcucacugcaaccuccgccucccggguucgagagauucuccugccucagcuucccgaguagcuggaauuacaggcguccaccaccaugccugacuaauuuuuuuuguauuuuuaguagacuugggguuucaccauguuggccgggcugguuucaaacuccugaccucaggugauccacccgccucggccucccagagggcugggauuacaggugugaaccaccgugcccggccuguuuuaguuuuuuagagauggagucucccucuguugcccaagccagagugcgguggcaugacacucucaggguucaaccucucagggaucaagggauccucccaccucagcuuccugaguagcuggaaccacaggcacaugugccaccaugcccagcuaauuuuuguauuuuuuguagaagcaagguuucaccauguugcccaggcuggucucggacuccuaggucaagugauccucccaccucaaucuccuagagugcuaagacuauaggcgggagucaccaugcccagcuucaucuacaauuuauuugaagaaaauguuugagcaccacccaucuugaaaagugauagacugccuuccauuaaauacugucacaccuaguuauuuagcagcagugagcuucacuuuuuauacuuuagaccuuaaucuaaagggugauuucuaguugccaguuaaauccagagccaagcucuuuggagaauccaggagccucacuaggucauguaucaggauaaaauacccauccacucccauuagaaggugagcuuguacuuauggcuuccugauggcugcugcaacaagucuaaagcagucuccuuaguauacaaugucuucucuaagugguagaaaaaagcaaaaauacuacaaguuaauagggcuacauaaaauuugcuaguuucuuuuuugcccuagccauuuauuccuuccugaaaucuugucucucucucgcucucucuuucucucgcucucacuuucuuucucuuuuucuuuucucuuuucuuuucuuucuucccuuucuuuucuuucuuuuuuccuguugcccaggcuggagugcaguggaacaauuauggcucacugcagccuugaccuuucuggacccaggugauccucccaccucagucucccaauuagcugggacuacaggcaugcgccaccacacccagcuauaauauauauuguauauauauuuuuuauuuauaaauauauauaaauauauauuuauauguguaaauuauauauauuuauauauuauaaauuauauauaaauauauauuuauauauaauauauauaauauauauuuauuuuuauauauuuuauauauauuuuuugggggggguugggggggauggagucucacucugucgcccaggcuagaguguaguggcgugaucuuggcucacugcaaucuucgccucccagguucaagcgauucuccugccucagcuucccgaguagcugggacuauaggcgccugccaccacaccuggcuaauuuuuguauuuuuaguagagaugggguuucaccauauuggccaggcuggucuucaacuccugaccuugugaucugcccaccucaaccucccaaagugcugggaauacaggcaugagccacugcacccagccuaaucuuuguauuuuuuuguagagaccggguuuugccauguugcccaggcuaaucucaaacuccuggguucaagcagucugcccuccucagccucccaaagugcugagauugcaggcaugagccacuguacccagccuaaucuuguuuuucuuauguucugauaauauauucccguuuuuagggagcagauuaagcgaguaaaagacucggaugauguaccuauggugcuagugggaaacaagugugauuugccaacaaggacaguugauacaaaacaagcccacgaacuggccaagaguuacgggauuccauucauugaaaccucagccaagaccagacagguaugguacagcuuucagcauuugugcaagaguuugcaucaguugauuaacucugguagagaugugauccauauucauauucuuuguuguuaugcauuuuuuucauuuuuauuuuuuuauuuuuuauuuuuuuuuaggcagagucucacucuaucuucuaagcuggagugcaguggugugaucucagcucacugcagccucugucucuuggguucaagugauucuccugccucagccucccaaguagcugggacuacgggcacaucaucaugcccggcuaauuuuuguacuuuuaguagagacaggguuuuaccauguugcccaggcuggucucgaacuccuggccucaagcaauccucccaccugggccucccagagugcugggauuacaggugugagccaccacgcccagccuguuguuaggcauuuuuaguaguguucuuuuucuuaacgcuuguuuaaacccaaaaugaacuuacuaauauucuguuauggcauguuuacuccugcauuaacauccacaaauauuucuugggaagauccuugacuaaaaauauuuauaaacauuaguuauuucucugucaacaccagcccguuuauggcuuaagccuccugaauggagucuuuaguuuaauguaguuuuguuccguguuucucacauuacccuuuuccuuugcaugaauguuuauuuggcaaaaugugccauuuuuauaucagccuguucuugugauucaauaggaaugugaaauuuaguguucucuuccuuaaaucaccauauuuuauuuuaucagcuauucguuuaguaauuggaaucuuauguccacauaaagagauacaaaugcaagagagcuuauaauuuggauuguguccguugagcuagcucucucauuuuuuuucauuuuuuccuuuuauaggguguugaagaugcuuuuuacacacugguaagagaaauacgccaguaccgaaugaaaaaacucaacagcagugaugaugggacucaggguuguaugggauugccauguguggugauguaacaaggugagcauaugguuucuuggcauaauuacaaaucuuaguauauaguauugggcaauuuggaggagugcugguguuauugucuauauguuuuuugaguuucugccuauccucuucugcacauuuuccauaugacacccuuucugaaaguacugaggucuaaaguguuuaaaacauuugauuauuccacagguaucuuuauauuuuugguaacauuagaaauuauaagacauuauuuaugaaauguaggcauacccuauuccuggcaaugaccaggaauuugaaggaucacuacuuugaaacuaguuaauaaggacaugguuucuguucuuuuuuuacagauacuuuuaaaguuuugucagaaaagagccacuuucaagguaggacaaguuuggaaauguauucucauuccuguuaauuuuguauauuuguuuuucuuauacucugaaugugucacuuauacaaauucuguuucuauuucagcugcacugacacccugguccugacuucccuggaggagaaguauuccuguugcugucuucagucucacagagaagcuccugcuacuuccccagcucucaguaguuuaguacaauaaucucuauuugagaaguucucagaauaacuaccuccucacuuggcugucugaccagagaaugcaccucuuguuacucccuguuauuuuucugcccuggguucuuccacagcacaaacacaccucugccaccccagguuuuucaucugaaaagcaguucaugucugaaacagagaaccaaaccgcaaacgugaaauucuauugaaaacagugucuugagcucuaaaguagcaacugcuggugauuuuuuuuuucuuuuuacuguugaacuuagaacuaugcuaauuuuuggagaaaugucauaaauuacuguuuugccaagaauauaguuauuauugcuguuugguuuguuuauaauguuaucggcucuauucucuaaacuggcaucugcucuagauucauaaauacaaaaaugaauacugaauuuugagucuauccuagucuucacaacuuugacguaauuaaauccaacuuucacagugaagugccuuuuuccuagaagugguuuguagacuuccuuuauaauauuucaguggaauagaugucucaaaaauccuuaugcaugaaaugaaugucugagauacgucugugacuuaucuaccauugaaggaaagcuauaucuauuugagagcagaugccauuuuguacauguaugaaauugguuuuccagaggccuguuuuggggcuuucccaggagaaagaugaaacugaaagcacaugaauaauuucacuuaauaauuuuuaccuaaucuccacuuuuuucauagguuacuaccuauacaauguauguaauuuguuuccccuagcuuacugauaaaccuaauauucaaugaacuuccauuuguauucaaauuugugucauaccagaaagcucuacauuugcagauguucaaauauuguaaaacuuuggugcauuguuauuuaauagcugugaucagugauuuucaaaccucaaauauaguauauuaacaaauuacauuuucacuguauaucaugguaucuuaaugauguauauaauugccuucaauccccuucucaccccacccucuacagcuucccccacagcaauaggggcuugauuauuucaguugaguaaagcauggugcuaauggaccagggucacaguuucaaaacuugaacaauccaguuagcaucacagagaaagaaauucuucugcauuugcucauugcaccaguaacuccagcuaguaauuuugcuagguagcugcaguuagcccugcaaggaaagaagaggucaguuagcacaaacccuuuaccaugacuggaaaacucaguaucacguauuuaaacauuuuuuuuucuuuuagccauguagaaacucuaaauuaagccaauauucucauuugagaaugaggaugucucagcugagaaacguuuuaaauucucuuuauucauaauguucuuugaaggguuuaaaacaagauguugauaaaucuaagcugaugaguuugcucaaaacaggaaguugaaauuguugagacaggaauggaaaauauaauuaauugauaccuaugaggauuuggaggcuuggcauuuuaauuugcagauaauacccugguaauucucaugaaaaauagacuuggauaacuuuugauaaaagacuaauuccaaaauggccacuuuguuccugucuuuaauaucuaaauacuuacugagguccuccaucuucuauauuaugaauuuucauuuauuaagcaaaugucauauuaccuugaaauucagaagagaagaaacauauacuguguccagaguauaaugaaccugcagaguugugcuucuuacugcuaauucugggagcuuucacaguacugucaucauuuguaaauggaaauucugcuuuucuguuucugcuccuucuggagcagugcuacucuguaauuuuccugaggcuuaucaccucagucauuucuuuuuuaaaugucugugacuggcagugauucuuuuucuuaaaaaucuauuaaauuugaugucaaauuagggagaaagauaguuacucaucuugggcucuugugccaauagcccuuguauguauguacuuagaguuuuccaaguauguucuaagcacagaaguuucuaaauggggccaaaauucagacuugaguauguucuuugaauaccuuaagaaguuacaauuagccgggcaugguggcccgugccuguagucccagcuacuugagaggcugaggcaggagaaucacuucaacccaggagguggagguuacagugagcagagaucgugccacugcacuccagccugggugacaagagagacuugucuccaaaaaaaaaguuacaccuaggugugaauuuuggcacaaaggagugacaaacuuauaguuaaaagcugaauaacuucagugugguauaaaacgugguuuuuaggcuauguuugugauugcugaaaagaauucuaguuuaccucaaaauccuucucuuuccccaaauuaagugccuggccagcugucauaaauuacauauuccuuuugguuuuuuuaaagguuacauguucaagagugaaaauaagauguucugucugaaggcuaccaugccggaucuguaaaugaaccuguuaaaugcuguauuugcuccaacggcuuacuauagaauguuacuuaauacaauaucauacuuauuacaauuuuuacuauaggaguguaauagguaaaauuaaucucuauuuuagugggcccauguuuagucuuucaccauccuuuaaacugcugugaauuuuuuugucaugacuugaaagcaaggauagagaaacacuuuagagauaugugggguuuuuuuaccauuccagagcuugugagcauaaucauauuugcuuuauauuuauagucaugaacuccuaaguuggcagcuacaaccaagaaccaaaaaauggugcguucugcuucuuguaauucaucucugcuaauaaauuauaagaagcaaggaaaauuagggaaaauauuuuauuuggaugguuucuauaaacaagggacuauaauucuuguacauuauuuuucaucuuugcuguuucuuugagcagucuaaugugccacacaauuaucuaagguauuuguuuucuauaagaauuguuuuaaaaguauucuuguuaccagaguaguuguauuauauuucaaaacguaagaugauuuuuaaaagccugaguacugaccuaagauggaauuguaugaacucugcucuggagggaggggaggauguccguggaaguuguaagacuuuuauuuuuuugugccaucaaauauagguaaaaauaauugugcaauucugcuguuuaaacaggaacuauuggccuccuuggcccuaaauggaagggccgauauuuuaaguugauuauuuuauuguaaauuaauccaaccuaguucuuuuuaauuugguugaauguuuuuucuuguuaaaugauguuuaaaaaauaaaaacuggaaguucuuggcuuagucaua

SEQ ID NO: 21216 - RNA, 6002 nt, Homo sapiens
cagucugagccuccggcaccggccgcgcagcuggaggcggcggagcggaagguacccugggccggggcugcgggcgguggggcgucuugggaacucguccccaggagagcacuuucccuuccucgcuggcccggagaucggggcccgugcgaggaggggcuucggccugggcguggaccccguucccuccaagcggagucggcauccgggcugggcgguggucggaccgcgucggccccuccccgggcugcagcgagggggcccggaccugccggcaggggcucuggccuccugagguccgagucggagccccuucccuucuccucccagcuucccggaaccugccccgccgggcgaggggcgagggaacuucaacucagacgccccagcccccagggugggcggccgcaggggaccuagagugggauggggugggaauuccuccaggccaggagggagguauggcgggaauaggggcgggaugugaccauuggggccugccacugcucggcagggucuggacgccgcccuggacgguuccuggagcccgcuuguguugaggauaagggagauggggaaggauccaacucugugugugugugugugugugugugugugugugugugugugugugugugugugugugugugugugugugugugugguguguguguguguguguguguguguguguguguagagagagagagagagagagaaaaugagauugagaauccuccuucuucauacucgaaccaagaaagaguauccugggguuugggacugggaucccgaggccgagucccgcccucacucugguuuuaaaguugagaaugcaguaucucuugguaucuccagaacggauuccuucccuagguguagggugggccggcaaagucaaccggccgcucuggaucaucugggaauucaagagagcgauuggagagaggucugauguagccacacugucuugucuuggggaaggccccagaaguuccaggcuccauuccaggcccuguguggggcucaguugccccucuuaaggggucagugggacagucccucuggggcugccucucacagggaguuguccaugccaucuuggccuugggccuaguguccuggccugggcugccugcuguucuggcccaaucauagccuggagggaaagucuucuaauugggcuggaggcuccaggucccuuaacgcaugccucaaccccggguuucuguccucugccucccaccacucuggugccgucugaauuacccugcuggggggacagcaguggcauacucaugccuaagugacuggcuuucaccccaguagugauugcccuccaucaacacugcccaccccagguuggggcuaccccagcccaucuuuacaaaacagggcaaggugaacuaauggaguggguggaggaguuggaagaaaucccagcgucagucaccgggauagaauucccaaggaacccucuuuuuggaggaugguuuccauuucuggaggcgaucugccgacagggugaaugccuucuugcuugucuucuggggaaucagagagaguccguuuuguggugggaagaguguggcuguguacuuugaacuccuguaaauucucugacucauguccacaaaaccaacaguuuugugaaugugucuggaggcaagggaagggccacucaggaucuauguugaagggaagaggccuggggcuggaguauucgcuuccuaaagggcagugugaggugguggugggguguggggaguagaggcguucagucagcccaguuugacaggaugugggacugagagaaaaagcuagguuugaggcugagaucagguuaccgucgcuuucuuaacugcucccugccugguuggugcugggacuggcccucauuugucucuucuuuuggggcuccucccagcccagacucuagcccccucccccuucccaacagccuugacuucaucucagcuccagagcccgcccucucuuccugcagccugggaacuucagccggcuggaggucaguuccccuccccagggaaggaggaagugagggaagcugcgaaggugugaugaacugugcagaugcucgcugugugugcugggggugggggacacauggaagcccgggaagcugacuccuugcccugagucacagggaggggugggcagggcaugcgggugagcuggacugagggaggaaggggcuguuccagaguggguggaggugauucccugguggauucuucucagucacugugcugugguagauguguggcucccuacaguguggucauuguccccugccgggggcugagugacccaguguugcuggcaggccuaggaggaaggggggaggaaggcagccugcccaaacucgagcugugggcauugcugggacugagccuccuuuguauuacuuggggcuuuggggaccgggugggguggaccagggaagcuggcuggcugcuaccccuguccucugucuggguuucccugcuucugcucucccuccugccccugaggugacaugucgaagaggcacgacuuugagucacacaguccugcuuugggugcugucccugccccuuauaagccacagcucugaaucugucuuaaccucacugagccuuaguuuccugguuugucaaaauggaaagugcaccaucuaccuuccaggcaucuggguaccgaaggagauaauuccugccaaaaugcccgacagagugccuggcaccuaggggcucuauaacuauucuuccuuuacccaccuaccaccugguagcugguucugcuacucugguccuagagagggacuccucauuugugacuggacagguaugacuugugcugagggacagucuguucuagauuggaccuuagagauuauuaaacuguaaaugcaucaaaauccugguaaccaaugaagucugacucgaaacccugaugugugaaguagauagaagcuugcucccuggacgucccgcaucccugagcagcucucuagcuaccuggaguccccagguuggcaaguggauuagauugaaacucauguuuuccagcucccaaguggggucaucaucuaccucccaccacuguauucuaacccaucgagggagaccugucccugacccagagauuaggaauuucaagcucuguugucgcacaauugguguuuugccagaacaugccugagcaagcccccugucccuuugcuagaugccucgguuuccagggagguuugggggcccuagagaaguguuuuuggacuuaauggcuuuuccucaaauccccaauacgucuuuccuggcagccccaccauggcugcaauccgaaagaagcuggugaucguuggggauggugccugugggaagaccugccuccucaucgucuucagcaaggaucaguuuccggaggucuacgucccuacugucuuugagaacuauauugcggacauugagguggacggcaagcaggugaaggcagaaaugcccuucccaccccacccugagaccccgccccccagucacugaaugaccuaguauguccuuccccauuccuaccccugucuuugcuucauucucccugcuggaaccaguaaaaguuaggaaguaaaucugcagucuuaaaaaaccuggauauacuuucugguucucccacagacuggcucuguaaccugggccgagucccuuugccucuggguuuaagcucccccaccugcaaaauggggaugaugguaagaccucccucaaaggguuguugugagaauuaaccaaaauaauggugcucacaguggcaacucaagggucaaacacgucuuagauuucuuuaacaaacugaccuaauuuauguugugggacagugauuaauauaaugccuggugcauagcaggugcucaaauaaagaaguucagugagcccgaaggacagugguuucaggggaccuuuggguggcaggguuggggcccucaggccagcuacucacuggcccugugugucagguggagcuggcucugugggacacagcagggcaggaagacuaugaucgacugcggccucucuccuacccggacacugaugucauccucaugugcuucuccaucgacagcccugacagccugggugaggggauuggagggaggggacugagaaccccuuggaaucagccagaggucucgugccuuggccugucuucagucaucuucagagguggggguggggaugcaggggagcacucaggcccuguuggucuccuuuacugugguaacuggcccucugagggcauacuacuguugagguuuugagcugugaaagggaccaucaugcugaauggcuucuaagacugcucugggaagaugagggcccccccaggggagcuuucuagcuuaaguggaggcaccgacaccuguuggugcaugucuacacagaaaacauuccugagaaguggaccccagaggugaagcacuucugccccaacgugcccaucauccugguggggaauaagaaggaccugaggcaagacgagcacaccaggagagagcuggccaagaugaagcagguggguacggcugccaggcuggagccccuggggaagaaugcacccucugagggguugcagacgggcaaagggaacuucucuccagcuacugccguguguuaggggaaacaguaauaucuccuggugagggaggacccauaggguugugucugaugagguaucagaaugaagugacuuguccaaagucacuuggcauuuuuauuuauuccaguuaauuguccauuccguucagaauugggacuauuaagaugauuaagaaaaucugcccucggggagacagcuuauguuucacuugggauacccaggcugugccaucagagugccccugggggagguguagggauguggaugcgggaaugagggcaggcauuguguaaguggcuggaagaagggaugugagagcuggcuuauucagggaccuguaaguggcucucuagccagaggacuagaguuuauuagagaaagcugucaggauaagaaaugcaaagauaauuauggcaaaguuucaaacuggggagauguuaggucuguguguuagaaaaauaauucugacuggaagagagugaggauggaggcagagcagucaggaggugggagacgcucauucaggcaagagaaccaggggcugugugugggaggagguggggcugcaugggaauggagggaguagacuggagggauuuuuggaucccuggccacgaagcugcccaggguagcuggggccugggcgcuuucugggucagggcuggagaaggaggcauuuguuccagcugcuacacuuaugggugaggcaggagagguucauguagucaacagcuuccuuugaccccucaucuuaugucuucucaggagcccguucggucugaggaaggccgggacauggcgaaccggaucagugccuuuggcuaccuugagugcucagccaagaccaaggagggagugcgggagguguuugagauggccacucgggcuggccuccagguccgcaagaacaagcgucggaggggcugucccauucucugagauccccaaggccuuuccuacaugcccccucccuucacagggguacagaaauuaucccccuacaaccccagccuccugagggcuccaugcugaaggcucccauuuucaguucccuccugcccaggacugcauuguuuucuagccccgaggugguggcacgggcccucccucccagcgcucugggagccacgccuaugcccugcccuuccucagggccccuggggaucuugcccccuuugaccuuccccaaaggauggucacacaccagcacuuuauacacuucuggcucacaggaaagugucugcaguaggggacccagagucccaggccccuggaguuguuuucggcaggggccuugucucucacugcauuuggucaggggggcaugaauaaaggcuacaggcuccaacgug

SEQ ID NO: 21217 - RNA, 116023 nt, Homo sapiens
gucugucuguaugcucucucgacgucagugggaauuuccagccaggaagugagagagugagcgagacagaaagagagagaagugcaccagcgagccggggcaggaagaggagguuucgccaccggagcggcccggcgacgcgcugacagcuuccccugcccuucccgucggucgggccgccagccgccgcagcccucggccugcacgcagccaccggccccgcucccggagcccagcgccgccgaggccgcagccgcccggccaguaaggcggcgccgccgcccggccaccgcgcgcccugcgcuucccuccgcccgcgcugcggccauggcgcggcgcugacuggccuggcccggccccgccgcgcucccgcucgccccgacccgcacucgggcccgcccgggcuccggccugccgccgccucuuccuucuccagccggcaggcccgcgccgcuuaggagggagagcccacccgcgccaggaggccgaacgcggacucgccacccggguaagccaaacucgggcgagugggggcccggcaggggacgcguggcccaaguccugccgcccagcccuccgcacccccuccagccccacucggacuuccucauuccugcgcuaaccgcugggcuagaccgugggaggagguugacaguagcugagaggcacaugggauuagcgacagcggggaaagacacauccggaccucgcaggggcuagucggccgaagggccgcggccgcccggcggucauuucucuucacgucccuccgcggggcgggaacgcgaaccggaggggaacucuuacaaacuuuuaaaauccccaaccccagccccaccugggggauggugagaagguuggagugcgcugcggcgcggaggagagagggaaggugguuggugcagugcagaaccagauuucaccuaagggcguuccaugaaaugaaagcagaagugcuugucaguccucuuggcugggaaagcccuccccagcuccccagaauugaauaggagagucuauucaucccucuccuacuucuaaaagaaaccuggcucgcucucugucucucucucucuccccccucccccccuccgugcgcgcgcgcgcgcgcacacacacacacacacacacacacacacacacacacgauauagucaccugcuauaggacuugauucugauccuccggggccuggcauuugagagagaaaauaaauuaccuaccuggauacuuagagcacuuuuuagacuugauuauguaaaacucuuggacagugccaccaugcauuaugcaugaccgcugaaacaaaaauaauguaaaaacaaggccuauccuaaaugcaaguuuuucuaugguccuuaaaaacagacaccagggaauguuugcccugacuugcugguuuauccugaaacucaaaugggacuuaaugauacaggauuuaauuaucaagauugacauguucauggacuuuguuaaguagagguuuucagcauuacaguuuaugaaauaaccauauuuaacucaaagauuuuuuuauaaagcucauaaucugaaaaaaugcuuaugguauuacuaaaacauuuaauagcucuggcaucaaaauauucuacauacuggugaucuuuuaguaaauaguaaagguuagggucaagauauucaauaauuuuuuucuagcagaaucccacaacugaauauugucaagcaguuuaaacugcauucguguuuguuaaaacuuuaaaagggaaacuuaaaacuaaaguauguuguuuuucugauuuuaauauugugcuuucuagagaugaauccuuuuacuguuugaggcacuauaggaauuauguauuuaaauguauguauuuaaauuugaagcaauguacuuuuuugaguuuauaaacuugggaagacaggaaauaaaaagauuuguuuccuguagaauuuuacauucaugauuuaauugaauugcuaaaauggaaagaacauguacgauuaauggagacuuggaaucugagauuauucauccauauugauacaccugcaauuccuaaaugcccuccccugcuuguuuagauaaaaugucuuccugggcugcagccuacuggacaaacuugaacacaaaggaacacacguuauauguacauuuaauacuggaaccgaaaagcugcuugcagugaaaagcaaaccacuucuaaacucuuugagacuuuuuaaagaagguaguauaauccuuuuagggguugguggugaugugaaaaucuauuaucuuuuugcugaaauuucauucuuauguuaggcauuggcacucacuugugcugaguaaaugcccguguuuuucaaacccagauaguaaauacuggggguauacauacaaaaauaguccuuccccuuuguaagcauugcuuugaucuuugcacuuccuuuuuacucuaccucuuaaacaagaucuguguugauugaguugauuaaagcacaauuaaucugaaauaggcagaauuuuagauuuagugauuauauuccuuacauuucuguuguuacuguuccuggaaacaaauugaaguaguuugagaaacuaauauuuaugcagguuguuuuaacuacacuuuuagacuugcagauaauugauuaaguaaguuacuaccuugacuuucagggauugcucauugugguagauacgaggucuagauagggaauuggcagcuacaugaauguuggacuaucauuccaucagcaagaccuuauuuuuaccuaauuuaugagagguauuucucuguucagaagaggugaaaguucuggcuucuggggggaagugguuacuucauaaccuucaauugguuugaacuugggagaaguaagaaaaguagucgauauuuucaaacaguaaaauaauuguaucugaguugcuguauggauuuuugaugaaguacucaaaaugucaucuuuugcaucuucgggucuuaguagaugugcuauucugaguauagaauugacugcaguaggaaguguaucuggaaaugcacaguacuguuguauaaccaauagaguaaauucucagauuaugcucuucugguccacagauugaucagaaaucacauuaacaggaauggaugucuaugcaaaauuucucauuaauuuucuuacuuuuaguaggaaguuuguuuuauucgguuggucuguugguuuucuguuuacaaggugaauugucuacaguagugggauuguuauauuagaagagaaggagaaggaaaaauagaaguuagugcuagaggauauguuaagauguucugcuccuacaucuacauuugugucuaaucagcauuaauugaugacuacgucuugguaaacaguagaccauacuggagcaauuuacucugcuuuuugggaauuaguucucauuugcacucuugcaccucccauaaauacugaacucacuuguaguguucuuagaggucagcaauaaaccaucaagagcauaugaucucucuuugaauuuugucacuacuuuggagacagacaguuuggaagaacugaagguacucagccucagggagaaagguuugaacguuuuggcauaguccugcaagucaguuuggcuccuugacugugaauuuuuuuaaucaaaaaagauuaauauuugaaaccacauaauuuggacaguuaauaguucugguaacauaaccaagccuuuuaucuuuguaguauuucauuaauuaguauccagugccucacuuuuagaagaaaaaaagagaaaaaaguaguaacauucuuuuaaugaugaugaaauugcuucauaccuuuggucucugcuguauuagggguuguuccugggugcaaauuaauauacugucuuuuacauuuccggagguuguugaccuggccuugaagaucagccaacaguuuagaaaauaaguugugcaaauugcauugcuacaccucaaauaauuuaaagccugacaguucuguacagaauaagagucacauaagaugugauuuguuaaagauuauagaaaucucagaagauagauuauggaugaaaauauuuguuuaauuuagaguacuaauaauaaaaauagugcauuuuacauuuuaaaaagaaaacaauuuuuauugugucauauuuucuguaguaacaaacagaauuaauuaucaguaauacaaauuucaucugcuuuaauuuauugccuguuuuugaaauuagaauaaugauauauuugguuuaauuauccauuacaaauugccuuauuauuuuucauucaucuuucaccauuaauccagaaaccuuaaaauagcuuuuauuuugacccaugccuucaguagauaucaacagacuugaguucaucuauggauccuauuaguuuaaacugugacaaauuuugacugcuuaagcuuuagaaaagaauuuauucuuuaaaauagccaaaauuauaaaaaaugaaauaaagaaaaagcuguuugagagaaucaaauacucuaguuuaacuaaaaauaaauaauaucuaaucaauacugacgaaagaaauaucugaugcuuagcauuguacuuguugguacauaguaagcaaucauuaacuguuaaaugaaugaaugauaugaaguuguugcaaaauuuuuuuuuaaauggacagccaucuucuauaaggaacaaaaauuacauuauuuugcuuugccuucuggaaagaaaggagcacaaaauaguccuugugucuuagauauuauggaaaucuuaucuaaagaccacuugaaguuuacuagaacaaauaauuuauuaaaaaguaucuggcgccuuccaaaaggggaacauuucauucugaaagaggcauuuaugaacuagaaaaaaaaugccuuuuaguuucaaaguuuuagaggcaccagagcaagauuauaaaguaauuggaaugauaaaaggugcuuguaaaauugaaaaauguaauuuuuuggugaaguuagaauuucuguacacuccauugaaacuguaauaucaaauacuaauaccuccaaaaaagaaacaaugcuacaagcacugcuugguaaucuaagaauuguuaacacuuaucuaaauuaaucaaccaaaaaguuaaaacaaaauauguuauuuuguuauguuaccucuagaauuaaacaccuaucacccauaaaucugugacuguuaaaaguuacuagauggcaaaccucaggaacaagcaggcaguuagcaggguuuacuguacuuuccacuuucauacuuuaaugauuuuuccaacacuauagaagcuggggccucauccuagcacaguuuguucauuauuuuucaguuguagcauuuuuuaaaaguuggccuugaauuucugaauugaaccauuuauuuuuuuguggacacaguuuuuuaaaugaaauauaccauuuagacuagaaaagagcaaaaugccaauacucccuguccuagugucauugugcccccugggaacccuaaugcaguccugugggaaaacaaccauuuuauugagcgcugcucacuucaguucauucugcuuugcugccacuuaguucugguucugacccugaucuccccucacaucacucacaacaaacauucaaguuuaaaaauuaaguuaaaaguuaguuacauauauauguaacuaauguguauauuaaauauacugauauauauuaguuacauauacagauauggcaacaacaaaaaagguuauauauauacauauuuguaacuaauauguauauuaaauauaaugauauauguauaaauacauauuuguaacuaauauaauuauauuuaauauauauuaguuacaaauauguauauauaauauuuuuuguuguugccagcaaaaugagaaagaaauuaaauguuaacaucuauaacaauugcacuguaaagccgucauuguugaaaaguacuccgaagauuaauagcggcaguguuuguuaaaauaauaaaauaauccaggcacucugccugugacuuccccaugagauggcuuccagaaaaagauaaauuuuuguguguucccuuacgaguucagucugcagcuucugggcaugaagagaagcauaaacaaaacaaacaaggcucuaacuuuguuauaauccuuacgcuacuaguagaaauguauggacaauucaugcauuucauauuggaaaauaaagcuauuagauuuuucuuugagaugaaccuuuuuuuuguaauuuauuuuuuauuuuuuauuuuuuuucaguagagaugggauuuugcucuguuggccaggcuggucucaaacuccugaccucaagugauccacccgccucagccucccaaagugccgggauuacaggcgugagccaccuagcuuggccaaggugaaccuuuuugauaaaugaggcucacuaauauuucuaggauuuacuuuucacuaacuugaacuaaagaaaguauaagaccugcauaaaguugagcauaccucuauaaugucccauuuuaaaaagcaauuuguuuuuaaugacuuuuauuuguuaaaagcaguuauuucaaaaaauuauuuuuauuauuuaucaugucauuuggacugaaaauacuauaccauauuucaguguuagggcacaccuaucccucuuuaucccagacgucaauucuaccauauaacaaguauguaaaaaagaaaacauaaaagugaugacagacucccuaaucaaccuauuuauugguucuaagcccaagccugcaguucauuuaaauagugaaaauagauuacuuaauugucuuagaaaauaugucuuccaugacaagaauuuuaggaaugagaaaauaacuauuuuuggauguuuuaacacaaauucccaaaucauguuuuauugauauuugaagaaccucuuugucuaccaguucuuaaguauaggcuuauuuuguaaggcuuaaacauguauugguguuugacuguuaagacuugaucuauaaccuucagugucuuuuucuuuuaaaugggguauggacuugguaaugaggccagaggagaauaccuuacaauuuauagcaucugcauauaauacaagaaccuucaugauuuauaaaauuaaaaugaugaugauguggaaugauggaagaagcauguguggguggcuauuuauguagaggaaauuagaaguugaaagcaauguuaagaauuaaaauuaaauuacacuuaauuuuuugcucaguuggauagucaggaaaguacuuaaaucagcaauugauuuacguaaaaucaaaacugaaaacugaauauacaaucuaggaaauaggaaaaaaauuuuuaguguguucauacugcuaauuucaaaccaagcaaaaaaccuggggaacuacuuuucagaggagauggcuuaaaaugaaccaaaaauauagccauuucucuacccuauucauuuaaugcauucauuuauuauacugcuaauacaugauaaggugaauagguuaagcaucguuuguauauguguaugugauuuuaaaccugagucuuuugaaagauuggucaaagcaaaggauaaugaaagcauaaagauuuagggggaagaguccucuauaaaacuaagacuuaaacuuuguuaucaacuugaaugugaagauagaauaaucuagaaagugaaugagaauuauaaauaaaaggacaaaucauauaucucaugguugagaaauacaaugagauaaauuguauaucucaucucauggagggucauaaugaaagaaguaagagagauugcccuuggauagaaccuuucggcagacauuucauaauggauuaucauauuuuugcuaaacugguaagaauggacuuuucaccacauuaugaaaaaacacuuuagaagucaguugcgaucaagcaaauauaaguaccugggaaauuaaaaucaaaagcacagcaguccaacaauagucaaaugcauuuacucacucucauaccauaucauagcguuaauuugagauaaugucuuuauggugucucuuuauauauuuacucgauuucccauuuaagacauuuaaccaaauuuaaaaagcaauccuuagaaacuuuaaaaauauuuccuauuuuaaaccauuacauaaucauuuacccugcaguuacaauucuuuuuuugugauggguggggaaguaucccauuucucuuagaaagucuucuguaauagccaaauaggagucaauccaaguugcuuagagagguaguucaauccuguguugaaauagaugacuuuuggaguaauugugcuauauuuacugaguaucuguugaacuguaggaguccagucauucaaggcaagcuacagaaaugauuuuauugcugaggcacuuaaguaucuucacaucuauaugccaauauuaaauuucucaucauccuugauccccaccccuuugcacagauugguauccccagcacauuagggaaugcgguuguuagccuguuaggguccauucaguagauuucucaugccagaaaucuagaagcccuucuuauacauucagcuuucuucuucagucagucaccaaguucuaucaaggcagccuccucaucuccagaauccaucccuuccucguugaauuucuagauuuuauuuuugcauugucuccugcuucuaacccaucguucauuucgcauaauggucagcuuucuaaaguguaaaucggaucaugucucugcagugaaucccaguugucuucacaagcugauucucgcacaccucacccccuuacucccuccgguguuccccaaccauccccuaaucucaaauccuccacaccgacuuucaguuuccuauccacaguuucugacuuugaaugccuuugcuuaugcccucccuguaugagaagugccuuuucuuuccuagccauccugcuaacuucuaaacccuuaggccugguuugagcaucaccauuucucucacuugccuuucuguuuucucccuccccuuuccauaaagaguuaugugcccccauucuguguucuccugaauuccuguggguccuagaaaagaaacaucuugagggcaaggaguucaucuuauuuacuuuuuauuugcacagcaccugguguguuugcugaauaaguaaauaccgaacaagauaucaagagacagugcugccaauuaacuguguggcucugagcaaguuaauuaacuucucugagucuuauuuuuguucuguaaaaaaaaugagguuugacaaaaugagcaucucucucuaaaauuauguguuucuuugauguaauuguauuaauuggaagacuucagauuuucuugccauaucaagauaggucaacuuaagaaaaaugcaugugaguaaguaccaagccaauucuugauuaucaguaugauaauaugaggaacugcccauuuugucgauaauaaguuauaauuuuuggucucaguguagguucuuucucaaauccagauguuucugguguugcauuuuuucauuauuauucagucucucgcauucauauuucuccaaagaaauuuauggaaaacuugagacaaaaauugaauguaaaguuuaauauuuaaaugcuagauugauucaaggucucacuaauuauaacuauauuuggagggagaagaaggggagguggugguaguaugagcugaauccuccucuguuccuuccuagaaggaacacaacguccuacaucaagaaaaaagacagaagcauaucuuggagauaugaaaagaaccaccagguaaacuaaaaagaaaaagaguguuaaaaagucagccuuuaaaaagcaggauuggagaugaggagggguggaguaggggaagcauugcuuguuuauagaagcucuuccaucuucguauagugugauuuuuauuuuuuuauuauuuuuuccuuccuuuuuuuugaccuccagcuuuaguauaguacaguugacagaaauuauauauguuuaugguacacaagaugauguuuugauauacauaugcauugugaaaugauuaaaucaagcugauuaacauaaguaggguuuuauuucuuuaacagugauuuauuugaauauauguugaguccuuucuaugugccagacacaguucuaaggacaaggcacacagugccaaacaagacagaaauccagaaauucauggagcuuaaaucauguagucuuuucaguuuuuaaaauuuucuugcugggcguaguggcucauaucuguaaucccaguacuucaggaggccgagaagggaggauugcuuaaacccaggaauuugagaccagcauggacaaaauagcgagaccccagucucuacaaaaaauuuaaaaauuagcugggcaugguggcacaugccuguggucccagcucuucaggaggccgagguaggagguucacuugagccugggagguugaggcuucagugagcagcgauugugccacugcaguccagucuaggcaacaaagcaagacugucucaaaaaaggaaaaaaaaaauagaaagagaaacuuuauuuuuacauuagccuuuuuuaaguugaagaaucccauagcuaaaaaaguacacaaauauuaaugcugcaacuuuagugauuuaucucaaggugaacacguuuaaccuaguggguggucaagaaauagaacacuggcagcacugcaaaagcauccuaucugcccuuucuuaguuaggaccccuucccuccacugucauuuaaaagauuucacaaacaacuuuuggauuauauguaugucaauucugugacucauauauauccacauagacaauggagcguugacugaaugaauucauuauuccaaggugcuaauaaugagcuucacaccagcgggaacucugcugugucaguugggcucuaagcucaguucauuucagauauuccucacuaaacaaaauacuguuuuuccucaguuguuaguaaaaaauagaaaacagauuacauucucauuuacuuauuacuuaugaauguaaaaguaaauauuuugcuuaauaccaaguagccagggucacugacagagacaugggagaaagaaguauucacaucugauguuaucagacauagaagagagagguauaguucaccuauuucuccccacucaguuuauacauugacaucuguauguguguuguuuuguuuuguuuuguuuguuuguuuugagauguggugucgcucugucacacaggcuggaaugcaguggcgcaaucauggcucacugcagccucgacuuccuggucccaagcuauccucccaccucagccacccaaguaggugggacuacaggcaugcaccaccacaccuggcaaaauuuuaauuuuauuuuacuuuuuaaaauuuuuguagagauggggucucccuauguugccaaggcuuguccccaaauaccuggaccucccaaagugcugggauuauaggugugagccaccacacccagccauguauauguuaaagcguuuaucuguaugaguggucaguguagaaagggcuucauggagccugauuuugauggcuugcaaauuauuauauuuguguauguguaaucggaaggccuucgccgugauuauuucuucaaaggaacccuuugucccuccagggugauuguacccauguucauaggaccaaacauugcugguucacauaaugacucuuuuucuuuuaaaacauaaaggacauauuuuuauggauuuuugaggauuaauagaauaaaaaucuaaagucauauucagauucaagagaacuggaucaguuucucuguauuugaacaaaagaauacuaaucucuaauucauaaugcaugaggucuacuucuuccucagucugaaaauaugaauauuccaaaaugguacucaaggcagaggcuauauaucaaaauuaaaauucugugauacuauguuuuuagggaagaagaaaacuguagcauuagaaauguagacgcaaaaggucagaacaaaguccaguaugucaagucccuuuauaaugccaucugaaugaaagaccucacaccaugaacagagguauugaagcaguuuuuauguggaaaugguaggcagcaauaucucaggagugacuuuaauuauaacauuuaagguuuuaucuaacuuauuauaauccuuagagaacuucucuagcucuacaaguuauucuuggcagaauuuguccuaacauaguauuaauaaaaauaaauuuuacuugaguaugauauaaauuacucuuaauuacaauauaauuuuaaaaugcccaaaacaucuuuugaucuuaugaauuucagucagcuaugauuaagaagacaaccauaggcaaaaauuucuuucuuauggaacacguuggaaugcauucuaaucacuucucuaagaaaaucccugucccccaugauuauagugaauaugauacagcaauaauuuagaugcuucuuucaggggggugagguuauguauucuacagucuauugauucuaagaggcacuuuuuucucccccaauuuaacaguuuuguuuaauuauauacauuucaggauuuuuuggggauauuuuucuaucacugguuucugauuuaauuccacuguauuuagauaacauauuccgcaugcuuucaauucuuugaaauuuauugagacuuacuuuauggcucgggacguggucuaucuucgugaauauuccguguguauuuaaaaauaauguggacucugggccgggcgcgguggcucacggcuguaauccuagcacuuugggaguccgaggcaggcaaaucaugaggucaggagaucgagaccauccuggcucacacggugaaaccccaucucuacuaaaaaaauacaaaaacuuagccaggcguuguggugggcgccuguagucccagcuacucaggaggcugaggcaggagaacagcgugaacccaggaggcagagcuugcagugagccgagauggcgccacugcacuccagccugggugacagagcgagacuccaucucaaaaaaaaaaagaaaauaauaauaauaauaauguggacucuaaaaucauucagugggguguuguagacacacuagguucuuuugauugacaguuuuguuccuaagccuucuauaucuuuccuaccaugguuugaauguguccccaccaaauucagguguugaaacaggaugaccaaugugaugguaggaaaagguagagccuguaagaagugaugggauuaggugcccuuuuaaaagggcuugcuggaggaaauuugucuccucuugccuuuccgcccucugccaguugcggacacagcauuccuccccucuagaggaugcaucccucaccagauaccaaaugcuggugccuugaucuugggcuucccguugccagaacugugagaaauaaaccugggcucuuuauaaauuacccagucucagcuauucuguuauagcagcauugacagacuaagacauuuccugacacucuguugauuugcuuugaucaauuaccgagagaggaauguuaaaaaucuuaacuguaauuguggauuugucauuuuuuccauuaguucugccacguuuuugcuucauguauuuugaagcuuuguuaauaggugcguacacaauaagaucauuguuuuucuuugaugaguuggcccuuugauucuuauaugcaauguuccucuuugucccugguaauguuuauucucuugaagucuacuuuaucugauauuuuagaauguagccugcuuuucuuauauuuagcauuugcaugauauaacuagcccaguguaccaucuucauacauuuaaacugugucuuuaauauuaaaguacaauucuuaugaaaagcguauacuuuaaucuuguuuuuuaaaaauccagucugaucaucucugucuucuagaugaguucaguccaguuccauguaauauuauuauuauuauuauuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccccauguaauauuauuacugguauguuggguuuaagucucucaucuugguaauuaauuaucuauuugugcuaucucuucuuuauucuuuuuuuucuccuuuccugccauccuuugaauaaaucaaguuuaguguuuuaaauuccauuuuaucuccuucauugguuacuuucuaaagugguuacuuuaccacuuuagaaaaguauuuguuuauuacaauaugcaucuuugagucucuaauuaaugugagaacuugacaauguuauacuucuguuuguccuucugugcuguuauuguuauacauuuuacuucuuuauauguuauaaacuccaaaauauauugucuuguuuugcugugaacagucaaucgucuguuuaggaaauuaagaaagaagaaauaaaagucuucugcuuacucacauauuuaucauuauugaugcuuuuuauucuuucauacagguccaagugucuaucauuucccuucagcaugaagaacuucuuuuuagcaugucuuuuagcaggucugcuggugaugaauacucuuagcucuuguuuacuugaaaaugucaauuucaccuuuauuuuuaaaagauuuauuugcugaauauucuggaccaaucuuuuuuuuucuuuuaucacuguaaaggugccuuuacauugccuucuagcuuguacuguaucuaaugaucaucagaaacaucaugcuuaucaugcuuaucaauuguucccccauauauaauauguccuuucuuguccuuugcuauuuugggauuuuuuuuuucucuagcauuaguuuuuaacaguuuggcuguaauaugccuaaccaugguuuuauuugucuuuauccagcagagagaucuuugagauucuuggaucuguggguugauuuuuuaaaaaucaaauuuauaaaaauucucaacuguuauuuuuuugaauauuuuuucugucuuuuuucuguuucugggauucuauguuacaaauacguaagacugcuuaauauuguccuguaggucacugaagcuguguucacuucuuucuaccuuuuuuucucuguaauucaguuuggguaguuuuuauugaccuuucuucuaguuuauugguacuuucuucuauaauguuaaauaugcuaaguccaucuagugaaauuucauuucaguucuaaaauuuccauucuuuuuuuuaaaagaaagguaugcauuucuuugcugauauugccuaucuguucucucauuauguucaucuuuuccuuuacauuauugaccauaugcuauuagcuauuuuugucauuugugucauuuuuuuucucagucuuauuuuccuauuucuuugcaggcuucauuauguuuuauuguacauuguggagaguuuggguuuuuugucuuccuuuaaaacguguugagcuuuguuguaacaggcagugaauuuacugguggaucaccuaguuuuauuaagauagguuuagaguagcccuuauuuuaggauguuucuaacucccaucguguggucuuucugaaaucacaacugaaugcucacaauguucagugaugucuuuccacccuggauuauuacaaauucagugucucucagcacuauaugauguccggaauuuccauuuagcucuuagaugcccagaaacuguuuucuauuagguuuugcagggucuuguccuacacuaucacagcuugguauuuggccagugaccagagaugaccccuauguagauuucugaggcucuugcuuuuuguguaaagccuuucuuugugauauucugcccauugguguucucucuuugggcucucccugugucaugauuuggaaaguguccucagucaaaaagugagggcgaauuuagaauuuaccuaaaucaccuuauaauauauagcccuaugaaguccaaugucuuaaauuacaucuuuagguauuuuguaugguuucacaguugaguauagcaaggagggagguucagauaacuguuaaucugugauaacuaaaaccagaauuugacauucugacaaacuugaaauugcagugcuucuuaaaauuaauacaguauuacuuaaaaaacaaaaacaaaaaaaccaguguuuuccaauuugccaauacaaaaaagcaaaacucccaucucuacuuuuuaggaacuucuauccauuugagaagaugauaaauauauagguaaaguuagauugcaguaaaacuaugcugucuaguguuaaaucaccaguauauauaaguuuuauagauauuaugugacuacagagcuauagguuauaggaaaaauauaggauuucuuggcagaaauuggauuuaacuagagccuugaagaguggaugcuauugagguagaaaagauggcauuucaggaugcagggcauauugugaacaaauguacaagauggaaaugagcaagucauucugaaugauuaaucugucuaucauagaggguuuugauuaggacauaguaguaguugaugcuuauaauaugauuuaauauaauaauguaaugugcugagugguugaagucuuuggacuuuaucuuauaaguaauauggcaauaaugugaaagauucuugaagaggaagaaacccugcagugagggagaacaguacagagccuauuacugucauucagaggugaagcaauaaaggucucuccuaggauguuggaaagaaggggcagauccaagaaacaacaugaagaaaauaaucagcagaaauugguuauugacuagauaugugugaaaaugauauauuggcagaaauugcaaagucaaaaauggggcucauugcagcaggaaugaugaaauugcuuuuagauagagaggugaagggauuuaaaacauuaacuuguuuuaaagguaucacugcuuaaagcuaacagugauuuauuaauauuugcacucugaaaguuuuaacaguuuuaauuuuauguauacaccacaguguuuuggcuacuauacuugccucuuuuguucaguugggaauugaguaaacuaauagaguaaaaaaaugaguacaaagugggcuuugacuagaacucuaacaaagugugaucacugaauuaccaagauaauuaacccauaccccacauauacuccauuucccaugacacauauuauauugcauuguuuuugccuauuugccuuccuacuuccuaaacuguugaauuaguuugcuuuuguugcauuaaaaaaaaggagaaucaccacaaagcaaauuaaaagauacugauuacuucuuccaauucugugggcugccuaguucaucuggccuggccugcuuuggcuaaucucugaggucuuuuggcuacuugacugguacuguuuguagcuacucagcuggugcccuacugcuguuugucugaaguuguuuuggcuacucagcuggugcuagggagccucagcuaggacugccugucugugcuccacauggucuuugauuuuccaguggcuggugcaggcuuguuugcaugguaacaauguuccaagaaagcaagaaugaucauugcaaggccucuuauaagcuggguuuagaacuuguacuucuaccucuuccuauuggucagaguauguccguaggucugccaagacucaaagcacagagaaauagauguuuccucuuguugaguggcauauaaaaaaaaguguggccauugauuucaaucugccacaaccguaagcucugugaguacaggaacugcaucacucuuuugcacuuugguguuguuggcauaguaggcauaaauauuuuuaggugaaugacuaaauuaaugaaggaaggaaaacauucagguaguauuucaauauacuguaguuuuaaauuauauauauuauauacauuugacauaguuuaauauauaaguauauacacauauaguuuucauauauaaguauauuauauauuauauaaaauauuuauauguuauauauaaaguauauauauaaaauauauaguuuuaauauguaaguauauguauauaauuauauauaauauuauaaguauauauacuuuuaucauaccaucagugaguauagacaugguucagggagaaucucuuuauucuccuucuaucuuuugagauagaccaaagaaaauuuuuuuuuaaaaaaagaacuaucacuugaguuaacauuguuugguauuuuuaucuucauaggugauugccuugugaauaacucauuuuguguauugucagaauccuauucugcuuuucaggcugugcuauggguagacuagcucuaaccagaacacuugggagaccugaagcaaagauacuauauuaaaauaaguaauguuauaugccaaagaggaaaaccacuucugccuccuaaacaacugaaagaaccagagacuguggggucagauuagcuagcauuacuauaugaaccugagcaaaugacuuacucucuuucagcuucagugucuuaucuaggacauugguucucaggauuggugugagaauuaagagaaauaugugaaguucuagcuacaguucuuuacccaugagguagucaguaaaguuuacuucuuucuccaugugaaccaaagcacugucaugaugugaugauguucauuaggguuucucaugcucagcguuauugauauuuaggguugcauaaugcuuuauugugaggggccauucugugcaguauaggauguguagcagcaucuguagccucuauacacuagaugccaguaggaccaccuauccagcugugacaggcaaaaaugucuucaaacguugccaaaugaccccugggggcaaaaugcaaacaguuuaucuagcagugacacauagccagccaccuuagaaagggaauugucagcguacccauaaguguagaaugggaaacaaaauacuugagucuucucagaaugucuaaaccuuuugcugucuauauuccucuuuuuauaauuuaccacaaacauauauugcuuauuaugccaucuaauaaaauggcuaacauuugcuguguauuauacucgguguuaauaagcuuuguaugaacucacuagcugaauguuguauauguaucugccauaccuguuggauugacauuccacuguaaacagguaccuuaucuuuaccagcuccaagcacaauguauuugguauaucagguagcuauucuacauguuaauugaucacauugcacccaaaugaaacauggauguggaaguggaaggaggagcuuuaaaacauggaaaauuaguuuauacaaaucuaaauguuguagugcaccaaauugauuccuuuuuaaaaacuuucagaaaucagcuuuuaaaaaaaaaaaguaacuaagccaugaucaacuuuucuuucaucaccacuaagccaauaucagaaaguugucaaucaacagcucuuuuaaaguugaaauuuuucuauuguauuucuuaugaagauuucaguagugcuuagaaguuuuuggcucauuuaucauguuuuauucacuguaugucauuaauuguuaaagaugucagagucaaaccuuaaauucaggagagauuuaaauuuuuccuuuuuccuauuuaaauauauguuucuaauuacauaauucaguuagaaaauuacaauauagaaacauauaacuuaguaaaaguuuccaguuacuguauacagauuauauuguauacuguauuauuuuuaacaguugcauauuuaacuuauaaauguggauaauuauaauuaaacaaucuguuaucaaaggacauacagauuauuuccaguuccuugcugcagugaauauccuuguacuuauuuuuuuacacacuugcucagauaauuuuuaaguacaaauuccugagguagaauugcagaaucaaaagauacucucauuugaguguuucacauuuuaugcaaaguauuuuguuuccuccagaaaauuccucuguggaagaggcuuccucacauucuuuaucaguuuauuagccagcagagaaaugaugaaaagccaccccuuuucuuguaguuucauccucauugcuauccaagaugagguauuaaaaucacaccuaaguggugucuguuguggcugaauauaaucuugaaaguagagacacuucucucugauucccaacuguacucucuggauggcaccuaaaauuuuauuuuuucaaacugaaaaucauuuuaaugaguucgaaaagguuuuauuuuuuaaaaugaaauccuauagaaagaauacauuuucuuacagugggucauggucaaaagugugaauaucucugauccuagaaaguuuccccaguuacaaggacaggcgugcccccaacuccauccuuaauggcucaauucuguggcuuucaaguuaauccacucaguccuacagccuucaccaagaagcucaugugcuacacuuugguguuagugggggcauugucacacagguucagaaaauaacccauuaggcauuuuauagaacucaucacauguucagaacuaagcuaguuguaacauuauguuuuucaugugaaaaaacacaagcaauucacuggcuauuuuauuuguugcuagcuagcuauacuuucuauuucuuuuuccauggugugaaaaucuuccuagaaaccucacuacugggaaaagagaugcagagauuagucccaucuucuccccuggaaauuuacuaucgcccuuuuggcuucaagguccuuccucaaaagcaaagaauugaacaagggaaagugaggggaagggcugggggaacagggagguagaagggguuuucccuggucuuuucuaauccuuuaguuccagacgcuuaguugguauuucaacauuuuagaaauaaaaccugcuuuuauaauuaaugcaaauauuacuuagugauucauccuuuccaaaugauucuugguuucuuuugacauuucauuuuuaaauugugaauuaacauugacaucaccauagcguuacuguuaccucagcucuuuacagugaacuguauugcaaaggcuauaaaaguucaaauuuuaacuaucacccacgugagccuuggacugcuguuaggcuuuugaaacugugauccuuuggcaagaauugguguauaaaucauggggaggauauugaaggggaagaucauguuuaauuuggcaguugggugccugcaauugacagauuuucauuaagguuuuagcuauaguagugaucaugcaucaguucuaauaaaguagguuucguuugaauuuuaaaaauuagagugaggacugcuuuauguuaacuguuuacauucagaagucuggaaaaccauccacagguuuaaauguauauaaucaguauaauuaacacaucaacagccucaccucuguuuuugaggaccauaggcuaauauuauuuaugaagguucaggagaucagucuagaucgacagaaagcuuaagggcaaagaugguuuuaauauuuuucuuggaaguuugagcuucugugguauucuaaggauagggauuuugacauugauuguucuagcugguauucaguacuguauuuaaguguaauguuuuuacuaguauucuucuuauaacugaaaacuaugcuaaugauucuuuacuauagauauauacucauaaauacguguaaaaauccaaguuuaccaaaaaauauuaagacuuaggggauauguucuuugaauaggcauuuauuugcuaauuaacauauucuaaucucaacaagguuauauucuuuucaaaaauccauuccaucaaaaucugucauuuuuacagaugaagaaacaaaggccacagugaguuuaguuaauauccaagaucacacagccagcaugauagaacucuuaaauuucaagcgacuuacccucuuuacucuaucaggucaaauuucccuuuuuuaacugcuugucuuaauugagauuuguuuaauuguggcugucuguauaucuucaaucaauacuuucuuguuuuagacaaauguuucccugcaaaucugcaugaacuucauguucugaaggacucagagcugcccuuuccuuuuuguuaaaguuguacacugcucugcaucccccuagaaugcucaucagcuuucucacucuuccucacucacacagugcuccagcaggagaggauuucuuugaaaaucagauucuuuuuuggagggcuuugugcuuauuggaguguuaugugauauauucauuacggugagggcuaaacucuuugaacaaagagaccugacagugcauuuggguuaaagaacaaaguuuauuucuuucucucaucaccaccagcaugagcagccuggauggucagagcagaucugucucauggcauuguucagggauccucauuccuucccucucauuuaucugccauccccuaggcuauuaaucaucauguuuuugguagaagccaggucuucuccaugucugaguuuuuauggaggaagcaugucaagggccuuaagcccagaccuggaagugguaugcaagaguucugacauugcacuggugagcauuuggucagauggccaucucuaacuccaacgaaguguaggguauacacuagguaagcagucacauuuccagcuacaauacuaauucuauggaaaaggagacaacauauuuugauggguagcugacauucucaucugcaguccuaaguacucaugacugcuagauagacuuuaugaaaaaaaaaaagaaaaauaaccccaggaauuaauauuuacccucagccuuguguuucuuuaauuuucucauuuuucaugucacauaucuaaaauuugaucuaaauaaauuuaaauaaaauuaaccuuuauuugaauaauaauaaggacauuucucaaggaaguaaaucucaaaugauaugugauuuuagauacuaucuuuaucugaccaugugguuccuugcuucuaucagggagggccucuggguaauagaagauugcuagggccugcaguauauuaauguuuagcuggaguugauuaaaucugagaccuauagccuugauaauaaggacuuuuauuuuuguauuuuuauugcacuuuuaauauuacagaguuucuguaccagcuugacaacagcagaaacauggcuugcuucuguggaacacgcuagagcagcaguccccaaccuuuuuggcaucagggaccaguuucguggaagacagcguuuccacagacugggggcugggggugauuuugugaugauucaagcacauuacauauauugugcacuuuauuucuauuauuauuaacauuguaauauguaauuaaauaauuauacaacucaccauaauguagaaucaguaggagaccugagcugcuuuucccacaacuagacagucccaucugggagugacgggagacagugacccaucuggagacagugacagugaucaucaggcguuagauucucauaaggagcgggcaaucuagaucccuugcaugcacaguucacaauaggguuuaugcuccuaugagaaucuaaugccacugcugaucugacaggacacggagcucaggcaguaaugcaagcgauggggagcagcuguauauacagaugaagcuuggcuggcuugccuacugcucaccucuuuuugugcugcguuauccauagcccaggguuuggggacgccugcacuagaggacagagccugguacacuauagcaguccuccccuuguguuaugcagaguacugaucagucccuuuugagcuucucaaccuuguauaaaacuuugagacaguucugggaccaucacaagguuuaugaaggguuagaaaacaauacacuuaaggaacuaagacuguaaaucguugaaguucagagggcgauaaaaagaaauggcuucuaagaaucccaguauguaugauuuuuuauacaaagcauaaagaugauuuguaccaaacucaggacacuguggcgagcuuaacacgaggguauugaaucauacguaagugguaauuccuagauuaugcaaucuccuugcuguuagauuuagauaccaaagaggaacuacaucauguccuccuccuauggucuucaaaaaaggauuauauuuggucuuacugguauaauacaguuuauuccugcaugaauuccauggugauagaauuuuuaaaguucauucuaguguuacaguuuuguuuuguuuuguuuuaauacacagcuucagaauggcagaagaugauccauauuugggaaggccugaacaaguaagugucauaaucucacugauaacuuuauuuaaauauauucauauuucaaaaauaugcaaaggcaacauuaguaaguuagcauuaggaaaauucuaaaauuaguaaauuuuuuuuuaauuucaguuucucuguccuuucaugugaaguuggagaggauaugucaugugaaaugaguaacuuacacccgcuuucacacauauuguugcacaaaaauuguauaugcuacaggauagcuauuguauuagcuuucuagagcuaccauaacagaucaccacaaaccugauggcuuaaaacaacaaaauacauuauuucacaguucugggggcuagaaguaugaaaucaagguguuggcaggguugguuccuucuggaggcucucaggaagaaucuguuccaugccucuccccuagcuucugguugguugcugggaauccuuggcuuguagcuuuaucgcuccaaucucuuccuccauugucacgugcgcuucuucccggcgugucucuacugugucucuaaaccuaaaucuccucuuuuuuucuuccaaaggcaucauuggauuuaggguacacccuuauccaauaugacuucaucuuaauuuguuuauaucugcgaagacccuauuuccaaauaaagucacauucacagguaccggggauuaggaguuaaaggugucuuuuugggagggaacacaguuuaacccacuacagccccuugacauauuuauuuaauguguacacauggauguagagaguggaaugacagaccauggagauucagaaaggugagggaugggagggcagugggauggggguggaugauaagaaguuacuuaauggguacaauguauguuauuugaguguuggauacccuaaaaacccuguuuugacuacuauacaaucuaugcauguaacaaaauugcacuuguaccccaucaauuuauaccaaaaaaaaauuuuauuuaaaacucaucuaguaaggagacagauuguuguagugaaaagaucuuugaacucagaauuugaagaucuuuauauaaguacugacuacuacagaucagcuccucagacuugaagaaucacuuaguccccguaauccucacuuuucucauuuguaaaauagaaaugcuagcaccacacuaacagggaugagucaaaaauauucaaugaaugugcuuuguaagcauaaaacuguuccuaucauuauauuaguaguuaugaaaggauagcaguguccuuuuuucuuuuucuccuauauuuuauuuugaaaaauguuggaaaaaauaaauagaaauguuggaauaaucuaacaaaucuacauugguucuuaaaaccgacauuuucgcuuuucucuuugcucucuuuuucguguguguguguguguguauauauguauauauguauauguauauacauaaucauuuggaagcaauuuucagacucuggagcaauuauaauggcaauauuaaauuauuuauguaaugauuccaagaaguauuuaaaacauggagauuuguucauucaucagcuauuuauugagguauuacuacgugccagaacauuggcuuaguggggaaaaaauaagugauauauacacucuaauuucaggaaccuacuauuuuaauaggaagaacagagacauuguuuucauauggugauauaugcuguaguaguagucugcgcagagcgggauagaaauguuaauaagcagcaucacuaggugcuaccuuggaggaagagcagaguuacggaggacuuuccgaaggaagucuucguaagcuguguuuugaaagauguaguuugcuagacuagaaaaggugaaggaacacuaggugccaggauagccuggucacauuuaaauuuuaguggaaaucauuuaaaauaguggauuucugaaauuacacgugcaaagaaucagccagaaaaauaaaaacagaaguggaauauguuuuaaaggcucugguaucauuucuauaaauaaaauggacauauauagcauuuaucacuucgggugauauucugauugauuuagaaagaaugacugcauugcuuuucacauuaagaugcuccuuucuaauuuuauuuuuaaaauggugauuuaggauaaaucuaggaacauuuucuuuuauugcagcaaagacauuuggcuaauuguauuaucaaaaccguuuguuuuaccuuucgcuuuuauugugcuuucucuaacaauuaagggcgaacuaaccagcaugaggauugugucugcuugauuuuaaaccauccuuuccugucuguacacaggaaaucuuaucaacaagagaugauucuuuaugccacagaagaguaaaaucugcugaaaacauucauuuugaaaguuuuucuuaugugggcaucuuugcgaucaucaguaacagggguggggcauauucugacauuuccauuuuugaggcaagcggucuugaaguuuuuuucuuucuuggcuugagcuuggugguuuauauuuccuaaaguuugcauguccucaguguuuuaguggagucuggaauuugcucuccacccugaccuaauaaacaaugcaagcugcagcacaacacaacuucucucuuagucugaagugaagaguauaucucucuccuaaggugagcccuuuugcccacucgccagucauuuagccaccacaggaaagaguuuuccugcuagguuaucacguuugcucugagacuguuaaaauccuguaugaaaugaggcccauuuuugcagaacaugguuuuucauuccuguauuuccuuuucagcaaacaaugaauagcaucagugagcuuuuaaucuuauaagcauugaagugaagcgcauucuuuguuccucaguugaaaauuugcaucccucaaauggaucugaaguacuguuuauuuaaacgagauuuuucuuacucuuaauuuaacuaggcauacgaagaucuucaguaccccagaacuuucaauaauuuacuacuaagggcaggagacaaacuguaauacuggcuacuaaaagaaacgaaaagcuaguucagcacacuuacuagucucucauaaaaaguaaaauauggcugguuuccaugcuguccacagacauuucaaacauauaacuucuuuaggcuaaaauaaauagcaagcucagaaauacaguuuuaaaguccuaaaugagccagcgguuacaauguuuuuugauaaguaaugaauaguaauuuauuaagauaaaauguacuuucuucaaaauauucugcaugcccacucuguugcugcccuaacacauuaccacauacuuggggcuuaaaacaacacaaauuuauacuucugagucaggagcucagaaaucuagaaucaagguguuggcagggcugcuuuccuucuugcagcucucaucucuuugccuuuugagcuucuaguggcugccugcuuucccugugcacccucucaucacuccagccucuugcuuccuuugucauacuuccuacuauucagugugauuuccugaaccccucucaucaggcccaccuggacaauucaagacacucucuucaucuuauuaucauuaccuuaaugacauacguaaauuuccuuuugucauauaagguagcacucacaguuucugaggauuaggaugcagacauguuuagggggucguuauucagcuuaacacacccacuagauuccagguauuuuguguuaugcuaggaaacugaagguaaaagaaaugagugagcucagugcuuaguugucuacuccuuguacugucaguuauauuuucaguuauucuguaaauagucccagaggugcucucuagcauucuuucaggccuugacauuggauagcuagaugagggguauauuuaccaccauagaggaaauacugauuucuaggauuauauuauuuuguuuauacuucuaagagaguacaagcuucaaaucauucauucaacaacuauuuaaguaucuguucugugauaagcauguacuuggcccugaagauauaccaguaagcaagcuagaccaggucccugccucuggggacuuuauagccaaguuaugcuucucaaaucccuuuguuacguaaacguuguccaacccuauguaaaguuuuguacacaugagaacuaccuaggucucaugaagaucuuuuaaaacccugauuuaaaauauuuucagauuuuuguuuuuggcuuuaguuucauuccuauuauuacauuuuaggugucccaacuucaaauuuuucauauaauauaggaaaaauaaugauugaaacauuuaaauguucuucuuuacagauguuucauuuggauccuucuuugacucauacaauauuuaauccagaaguauuucaaccacagauggcacugccaacagguaagaaaacucaucccuguuacccuguuguucugcuuucagucuuaguaaaaugcaggauuuguuaauagucuguccuagaaacucaguuguguaccuagaaaggaaauggugauuuguuuuaaaaaccaaucuuuuaacauacuuucuugaaauauauuugcacaaaaauauuucaucucaauuaccccuuguaugguuuacugcauuucauaucugcuaggacuacucagaaggaauuucuuuagucaacauaaggauuuucuuuauuaucucuguauuccuuuuaaguccuuucucccagauucacacgaggcagucuccacucuucauuucuguuucaaacauuuaagagggccuguuguguacuaccagugugccagucacuggggaaucaaaguguacagaaaucauaaaaaucaucucauuagaaaaaucaucuuuauaaaagcuuauaacuuugcacucugacaaguuggauaaaacucauaauccuuccuucuaccaugacuguauuaauugugccgauuggcaacuguuuaauuucguaagaguaauaaaaaaaaaacucucuuucuuaaaaaaagugauuuauuuguauguaagcuuggugugauggcucuuuuuauguucuguuucucuccucacuucacccgucaccagugggacuuaacagauguucaaaagcagugugagugaauuauggaaguuauguguaaaacagaguuugguaaucgcugaaggaggcaucagcucuuuuauuuaccagggacuugcuugucuucauugggggacuuuaucccauuuguauuauucucauuuaaaauuaucaugguuacuacaguacuuacuuuucuuuuguuuuagaucagaaaacuuuuucugcauuuauaucuuuaguauuucuaggaguucaugggagggaaaaaaguagaucuacuauacuuucaccuucacuaguaaagguguauuucagagguuuuucugucuuuaccccuacaaaacauuauuuuuaggcugccaugucugagaucuugugaagugcuguccaauuugagcucuaggucagcuuccugugaacaaguaaauguguugguaguguguguguuucuugggaacuuuuuaauucuggaguucaaaguauuuuucuuaguauuaauguauuacugaaaauauaagaacuugguucuguccacaggaaauacacacauuuucacuuaaugucuugugaauacaaaacaguauccugaggcagacguuuucuuaauuuuauuccuucggauuuaugggcaugaaaauaagauuaucaagauaaccaucucaguaaauauucuguggucacagcuuuauguuguagaaauuauuuugccauaauauuagaaaaacuauucaaauuacaccuaaaaaucuaauuuguuaguuguuguuacaccaucauuuuuaccuguauguuuuucccucuucauugcagugucauaguacaauuuuuauaguccaagauauauaggauguuguauucaaauuuuuaaagagguagagagguugauuaucuaaaccaauauuaacuuguaacucuaaaauggauuauuuuagucuucuagauuuuuugaaaucuaaaaccuuuaguagaucuaguacuuguugaagacuaugggaugcgacauaacucuuaggucuaaaguuaaauuucucugcacaguggaauguccuuuucauggcacagaaauguggccaaaagaauguuggccuuaaaacaacaaauacaugcauaucaaaucuaauuuucuaguugauuuaacuuuaauguguugccugaaagaggaaaaauggcucuauuuuacaugaauuuucacauauuuaaaggaaauuaaauccuacaggaaaaauaauagcaaauuugcaguuguuuuuagcagaguuaauaaaaagugagagacuugaaguuuaauguaaacaugcuuccaacuccucuguauuuuucaugacauccaaauauugcucuguuagaggacugucuugauauguucuuucaccauuuuaacagggaauguuuuuauaaguguuacauugucauacaggcuguaucuuagugugaaaauauuucuauuucuaaucaauuuuauuuccauauccaaaauuaaauucuagccauuuggugggggaauuuuuaaauuaugauuauguuucuaaaaguaauuuaaaauguccaggggugaauuucauacagacaaaagaugguaauuuaauacauugaccagugacucccccuuuuuuuucuuguguaugcuucauuucagaugcauucauuuuucaacucgcuuccuuguaaauuucuugaauaauaacaggaaguaauuauacccuuguuuucuccaguucucuagccuuauccugauuuaucauaauauugaaaagauaaaaauaaauucucuggccgggugagguggcucacgccuguaaucccagcacuuugggaggccaaggcagguagaucacgagcucaggaguucaagaccagccuggccaagauggugaaaccccgucucuacuaaaaaaauacaaaaauuagcugggcauggugguaggcgccuguaauuccagcuccucuggaggcugaggcagagaauugcuugaacccaggaagcagagauuguggugagccgagauugugccauggcacuccagccugggugacagagugagacucugucucaaaaaaaaauaaaaaaaauuuugagaaaauucucuuuuguguuauaguuuauuuuuaauuucaaccugaagguuuaucuccuuacaaauuuauuuaaaauaagaggucuugagcuucuuucugagagaaaaugaagauuaaaauggacauacaagcauucuccuaaaauauuuuuagcaccaaacaucuuaauuuacauucaaauaaaugagaaccaccauaugccuuuauuuauugcaaagcuauggauuauuguacuauugacauaaaaaucagcugggaagcuuaaggacuuuuucauauugaacaguuuguacuuauguugucagagauucugauuuuccuuugaauuuucaagucagauaccauuaggguauggauuaagccucuaguuuucuuugcguuuuuacaauaacuaauuugcauguaccuaucuucaauuaaauuauuuucaguauuuuauaaaaugccugagauguuuuagaacacaguuuauaugauagcacaauauucaaaauugcuuauaaacaucaaaaguuauggauuaauaugaaaauuuuaccaugucugauagaccagauuacauugggagugucggggaggaaaggggaaacaaacuaaccaguuaaggaaugaaggcaguacuuucccuucaaguaaagacgggaacagaaaaccuaguguaaggaaaaagagauagccugagaucauuaucugucuaucagacguauacauacagguugcuagaucaguaucuuuuaauuucacauuaagcacacucucuuugaggaaggaaagucagugucuaaugaugugaaggccaaagaaaaugucauagugcccagaagugguugcugcuuuuaauugguauuugucauuuuaaaaugcuuuguuaggagacaagauuaugaaggcuguugacaucaauucuugccggccauaugccuuuuauuggguuaggaaaugugccaucaccuuucaacaaacauuuacuuauugugguucgcuaaacucguaaaacuauuguuaaaauaaggguuaauuuaauauuucagacaaggaagagaaauuauauccuuguggaauuuuaaccaaaaauugauuugaaauuucuacauaaaaacauaauuucaguuuuuuacuugcuuuacguuuuauaccaaauuugagaagccucacaguuucuuuugguuucuguuuguuguuuuuguuuuuagcagauggcccauaccuucaaauauuagagcaaccuaaacagguaagauuaaaggggugggacuuuaaauguuagauuccagugucuaauauugagaucauaagcacugaagaauaguaaaugaguucuaugaaggaaguaguuuaucugaaagaucaacaaccugacaaauuauguaacagcuuuauucauucacuuuacauuucucuuacucauuguucacacuguccugagccucaguauguaguucuguaaaacugcaguuaauuacaguauuagaauuacaguuaauuacaguauucugcugucucuaccagcuuaacuuaccagccacucccaggaaaggcagaggugauuuccauucauuuucauuuauaaggaaauacguaugcauacaguucacaugcacugagcgauauccaucuauuauccuugcacauguaguaccucuuagccuuccuccuuccuuugguagccccagccuuuucugugcugccuuuggaacauguaaccuaacauacugaaaguaccagugggaaguaaaauguuagaaugaacuauugaauucucuucccucuggugucagccucuuuggagucaggagaggaacauuuuuucaggugcuuccccuuaccacuagagucuguagagaauagcucagaacugaaauggccuccucacuguauccaacucuguggauauuuauaggaaauuggaugggaccaaugcugugaaagagaaagaaaggcaaucuuuaaugucugccuauaggagguuucaguuauuagggaauggaaauaaugguguaguuccccacagaaugaggacagucaguaaaucuuuggauggauaaacuaaucacauuugugugugacugaggauauggauaccuguccucuugcagcuguauuacccaauacauuuucuaaguauucuuuucauuagcucaggugagugaaacacuuuugcauuuuguaacauuuaacacaugcuaacuaggucacaagcuuaaauaaagcauccacugcguugugguuuccagaaucgugacauuauauauguguuauauuuggucagcauuugauauaaaugucuuaaugauugcugaacaggcuauccuuauaagguugaaauuagaugaaaguuuuugcugugggggcaagaaugccacaugaaacuuuggggcaugguucuaguucuugcaggugucacauccugacuccucagguugccaguaacacuccauugcucuaccuccauguucaacucuuuuaagcaguuauuucucagagaaggucaucaauucccagugaaauuuuaucccuuaaaguucugugggcucuggcauccuggaaaauuucccagcuuuuaagaucuagguagucuaugaaacagaaaucaacugaaauuugucugcauaugccaaaguauuuuuuccaauaucauuuucauaagcauagcacuacaauaagaauuuuuaaauguaauuccuuauuauggauccaacaguuauaaggaaaaauuggcauuuaugauuuaccugaaggguuaauguaguuccaaaauucaaaauuuaauucauauaaaagcuuaugugaguaaaacaauguguuuaccaaagugaugcuauuuugauaucugaauucagugaaaguaagaagguuguauucaagucagacuuucugacugaauggauguagccuugccuuugagguugaugacucauuuuaagcaaauggaguuacugagaugagugaauguggauuaaaggcaaaauuuugaucucagaaauuuagaaucagaaaugcauccagacaaugcauuugacgacaucuuccugaaaacaguuguaaauuuucauccucagauuaaaaacuucugaggauuuagauacucguauguaaccaugaaaaauaucuauuaaguauugucuauuugacaccacucccaauaagauauaaacacauacgugucuauauuuuuccaacugucccaaaggaauuuugugauuaaagauaaugaauugugugugugugguuuugggguuuuuuuuguuuuuuuuuuuuaaguuagaaaaagauucuuuuuucuuugggaccucuuagccacagauuuuccccagcucugacggagaugagucauagcauagacuacuaauuuuuagaacauccaguucuguugcauauuaaucaguguuaauuaacuaauacuguucaaaaacucaaguuguguuuaaauuagcagucaaguaaaucucuauucuuaugguuagcuaauucugcaggcuauuauacauguguuguuuuuuucaugguuuuagaaauuucauuuaauuauuuaaaaaaccaacaguguuugcuuacaaaaggcauagggcugaaauuguaaauuauuuuuaaauaugaauugugugagaaucaaaacaaaggaauuaccucugaaacuucaucuccaaaggcuucccuuguguuuagaucuggaaucucccaaggaauuguuuuaggucucacugugaugaguugaucauaaacuuuagacauuugugugcauuaaggaaauuucccagaccggggaauuuacuuuaggccuuacuuaucugguaaauguguuugaggacugaucuuuggaaaucaggaaguuuuuggauaauauaggaacaguuccagaugcuucccagagauuuaaaucaguucaaggcaccuggacugcucagagacugcaagacccuacuuggcauaaugaaauguaguauagucuaaguagugcauacguuuuacauuuguucaugagcucaaagcugucaaaaucugcauguuugcugggguuccacaauuuaaugaguaagggagugaacccccaccagcagcuagugggugugaugagcugaugggcagaugaucuagugcuguauaugcagaguuggucccacaauagaaacaaaaggugagaauguuccuuaaaaaaucuuaacguauuuucuuuucaccaaaaagugaaucuguaaaaagaaaaucaucugcuuaagcgacuaugugguuauaaacuacuaacacuaccacaaauugauugacaucauuauaaaguugaaucaggaaauacagcgaaaccucccuuaauaugaugaugaggucauaauuauccuuguuuuauucuuuguauacaaauaugaauaaguuaacuuuauaaaucauaaaaaguuagaacuggaguagaccuuaaagauggucugguauaaucuucccuuuuguacaaaugaaaaaauaugacacuucuuagguguuuaucagcccacaguaguuuauauagugaaggcuuccagcuaacuucauuaauuaacuauaucuauaaaauuucuggguuagauaguauuuaagggaacuaccuaguuuuggaaucauucugguagguuaauauucaaucuugagcuugaccauauuaauaaucauaaaaacaaaaaucuuauccucugaaaugcugagagaagcuuaacagaugcagggucuagcacaggguguguucuacaacgcugaaacaguauaucuaaauaaacaugucuguagucccugcugaaccagcuguaaucagaguagauaaaggaaugucuuuaaguaagagucaaggaagcauaacuuuuauuaauaugguacaguucagagcuuggcagcagcaauuuaagacaaggaagcucugacuagaacaagccguaacauguuaagucuaaagccuaaacucuucagcagauuacucuccacacaugcauagcaugagagguuccaugggcuuagguaccuggcuuuuuagccauaucuuaguguacaaauaucaauuaauaccauuuuucguaguaagauuacgggaaaagugauucuuguuuacggagcccucuuucacaguuucauguuuuucuucucucauuuaguagacauaagauuuaaaaauuuguauguaccuuuguugccguaauuuuuaauaaguauuucucaaacuuaauuggcuuaacguucaccuuugcagagaggauuucguuuccguuauguaugugaaggcccaucccaugguggacuaccuggugccucuagugaaaagaacaagaagucuuacccucaggucaaaguaaguuugugguagcucuccuucuauuugaauucuggaaauuuugauuuccuacgauuuccaaggaauugcuuuaaaugaguacggguugccuucgcuccuaagcugaaguguucacaugauuauuaaaauuuuuaaauagaaauuugucuccuagcaauagaagugacagauacuaaaacuuuguuaacauuucaauuuaguagaaaugucuucagcauuagcuaacaaacuuacuauuucuugaucaucuuaaauauuuuuaaaaauuggauacuuccugaaacuuuaguaagucuuugaaagaaaugguugauuuugacucuuuggagauuuagugaaaaaccaaacaagugacugaguguauggauuauauaguauauuauuuaagauuaugaauuuggauccagacuuuguuauuagcuguguagcuuugaauagguuuaaccaauacuucuaaacuucagucucuuaauguauaaaauacaaaaauauuaauaguauauacuucauaagguccuuuagagauuaaaugagaaaauguguacauguuccauagagagccugaaaguacccuagggccuuggccugagcagauguguggcccucuuggaaugaacugcuacgugacaugcuggugguguauuuggucauaccuuuuaccauguucaggcuguuuguuuauuugagaauauuuuucuuuaaguuaauaugagacuuuuaauuucauaauaugcuauguuucauagacugacugaugauaaacauagacugguaaucauuuugcagauaaacgcagucaacaauuguaauuuaguuuuuuauaaaaguuauuauuuagucaguaauucaaggcuuggacaaaauaguucucacuaugugugugugccccucaggguguaacauacuuuuggacucagucuuuuuauugguuuguuuuuguaaguagaugaagcucaguagagcaggcccucagcaaaguugugauguaaagaaaucuggccgggcucguugacucaugucuguaaucccagcacuuugggaggccgaggcuagcagaucacaaggucaggaguucgagaccagccuggccaauauggugaaaccccaucucuacuaaaaauacaaaaauuagcuggguguggugguguacaccuguagucccagcuagucaggaggcugaggcacaagaaucgcuugaaccugggaagcggagguugcagugagccgagacugugccacuggacuccauccuggacaacagagcgagacucugucucaaaaaaaaaaaaaaaaaaaaagaaagaaaucagucuuugguuuugccagccuugcauuuuguuucuuccuuuuccucuuauccaucuucuaggcccaggccuguuaaauuucuuauccuuauucccaaacaaaagacaaaauguugugacgucguucuuuaccuuucaagugaaacucacccauuauuuaguauggguacuacuagucauaguugcauuuuaagucucuuagcuccaauuguggaaugaaagauguuuuuucuauuaaagguaauuaggcggguaaauaugauggcuuaaguccacagaagcagaccacggucuuauggccucacauccuuuagaaccuugaugaggaaugaggagcagcaauaaagaacuaauuugcacuuauuaaacaccaaagacuugccaagugguuuguauaacauuaucucuuuuaaucucuuagaaaucucaguagguaaaaagugcaaugccugugaacccaaacagacucagagaauggaauuauaauaacuggccuuucucacaagacuaguggcucuauauccugcagcaggcuauugcucaccgaaccucucagauauaaugugugcauuugggguacugggggcagggagauaagggacaaauuaugggcagacaaugguguaaaaaggcauggugaaugauaacucuugaaaacaagggagagagaggcucacuggucaauggguacucagguauuggggaagccaggcccagcacuuaccuuuuuaacacaugugucugugugucacauguauaaauauugugccuuuauguauguguauauuugugagaaggggauugaaagacacauguuaucagcauugacacugacuauaaugacugaagaauuaacuuuaagcgaaaaacugggaguuuuuucugacuggcuuggcacaaaaaauauaaauuaugguauuuuguuuacuucuauugcucuaguauuuugugacuaaguaacaauucuugauacuaacaaacacauggcauuaacuuucuuauaaauuuauuggcuaagaaaaaacuuuauacauccauuuauucccagucuucauacaucuuucucauguagagguuucaucuacucaaaaacauauugcugccucagucacaaaauaauuuacaaaugaaacaacuuagugggcauuagauguucuuguagaaugaaaguuucuauaucaaggaguuuaguacuuacugggaaauauagauauguaaacgacuaauaauaaagcagguucaacuacagucacauuauuucaccaaaucauuuauuuuuuauucacuaauucaguauccauuuauaagcauuuaaucaacuuguaagaggaggaggaacuuagagguuagagaauaugacuauacaagcugucauuguucccuuagcuugucauuguucacugaaaauugaaaugguucugcuguuccuaacaguuauaggaaguaauuuuauuuauccaagaaauucuuaauuggaaggauggguaggagagaaagaaagagacaacggccagguauuuuuuuuuuccagagcucuucuccaaauaucccuuuuaauaguuauuucugcucaggaugaccuuuaaguuuacaaaggaauuuuaaauccccuuucccucuaauguuuaagcagaggaaaaaauuguucuccaugcaucuuucuaaucaggaagaccuuuaaaauugugcaugucuuuucugugguacuuuacuaagcaccugcucggcgagagacuguaagggaaacagugggauagauacaucuaaaguuucucaaacuuggcauuauugacauuuggggcuugaaaauucuguguugugggaggcugucugacacguuauaaaauauuuagcagccucccugaccuugacucacuagaugcuaauaggauuccuauaauugugacauccaaaaagucuccacauugacaaauguccccuggggggcaaaaucaccccucuuugagaaccacugauguggaugcaacaaagaaucaaccuuaaccuuacccauuugcauacuuuucuacuauaaaguugucucgcauagauuacguagaauuguccaaguguauuauuuuauaaacgugccuuucuugguuauuaguagauauuucuuauuuucaagauggugaucauggugucuguauaauuucuguuagaauaucagaguuaguguaccuggauacuaaggagaaagauagaaaagauaaaauauguaucuucaacauuuuguauucugugaugacccuaaaagcuaaugugggaguucuauugacuguuauaaacuauuacagaagaaaaagugaaaguggagaguuagguccacugugugugaacaaugggagggucuauggaaugaugcuuucagguaggcagaggccucguggaggguggccccacacucacccccagaauccagaagccauucccacaggaacuucagagggagagcauuuacauuuacaggaaagaaaugauacuucugagccuacauuugccacauauucauuaagugcauuuguucaggcauuacaguaaaaugccaugggcugugcuuuuccucagcuacagccucucuccuuccaaccucacacccugucuuccugucaugccuuugugagagcgccaccacucugcggugccuggagaggaaccuggaaacgcugauaguucagugcauacucggucauauggagacagcaggaaagagucaggggccaacuugaaagauuuggggccuggcugugguuugcaggcuguagacaccaaacuauacuuuauagaacaugugaaaauauagccuguauggguuacucucuuacugauugucuagauuugaugccuuacauuaaaucauuuuaaaaccaacucuagaagucuacucaaauccugcauuuucuacuggaauagugucccaugcauaaaacccuguuucgcauagguguaggcuagcuuacagacccucuuaccauguugagauuauuucuagaacucaggcuacugaaccaucuggugcucugccugugucuuucacauagcuaagaagaaaauuuccauuuagcuuucugauaucuugcugugcaagucuucaugcucuuuuuuuaaaaaaaauuuuaauuauaaauucuuucaagcauauagaaaguuuaaaaauugacauaacagacacuauguacuacaacacaaauuuaauagguauuagcaucuuaccuuauuugcuuuugauagcucucucucucucucucuguccucucucucucucaaauaaaauaguuacagcuaaaaccccacuuauccaucacuuuguccuccuuccuucucuuagguaagcugcuacucugaacuuucacuccccaagauguuuuuauauuuuuacuacauaagaaugcaucuauaaauacuggcauuuucaagaaaguuaauuuuuacuaacuucaacccaaauuugccauuguauaggauggcuccuuuucagggcaaacauagguucaaacuggacgccauugaagauuaacugguacucacuuugauccuauugauuccucuuugcugucuagauaaaaauguauuugucacaauguaguuuguacuaacucuuauagcaaaaaauaauauucagagaaaaaucuaggggaaguaaguaugcagacuaacucuuauaucuuguccuuucauaagaaaaauuucccaucauuaaacauuuaauaaucuauuauacugccuauaaaauuucccuuuaaaguuuuuuccauucuaauuucaucacggagcuccuaauaggagaggcuggcagaaaagcacaggaaccuuccucuaggccaagcuugucccugccugcuuuugacucagcaaggagugccagggaaggcucacuucccuauuuuucccgaaagccacgcgugaaguuuuaaaaaucaaacuguguucccuuucacagaggugggugacaagagaagcagccccaugggacuucagaaacucucaccaauccuccucuagagugaccagaaaguaccccuuccuauccuaacuaaugugacacguccuucugugugguccacucuaugcaaaaccagaaauugacaagaaugacuuugauuguaaaguacaaauagcuuaccaguuaguauucuuaguuucucuuuaguuauaaauaucaaaugcaagggacuugaaacccagcugauagaaguguaacuauuuuuaaucaaacauuuucugaaagcugguucucacauauguugucuuuccugaguguuuuauguugaguggaagacguguugaaauguuuaggucaacaacagcuuuuuuguuguccccuuccacuacugauuuaaaaaaaaaaaaaaaaggcuccacucuucgugccuuuccuuaaaaauccuaaauguuaaguuucugucgaggucgaauagagacuacccgaucugcuguggcauuugaggauaucacauauccuugcauaaucucccuuuccuuuguauagacuugucugauucacgugguuuggaucuauuuggaguacuaauuuaaaauaauuuaaccugacucaauuacuuaaaacaacaggggagaaaaucaccaauaaucagcuaugugugcguauagaaccuaguucauaucauuuauuaggauuuccauugaaccccuaagcuguucacugcgcaaguauuuaauuagggaaaauaaccauaccccuauguacauuauacuguguguuuuguaaaccaugagaaaagcugcuuauugaacagaagggcuuuguaaccuggggucuauggaucccuguuggugguuucagacgcuuuuuagauuccuaaauuuauaugcagacuuacacauguauguaugugcauuuuuucuugggagaugaguauaacuuuuuaucauauuuucaaagggaaagauuuaacaugguuaagaaucaugcuauagcuuguaucacuuuagcuuuuugauagcagcuaucuuuuuaaaugaucuauguaauauuuuuuaagauuuuuucuuuuuuuauucuugcauuuuuaaucaauuuuaaaugaagugaaaugcuuuauguugcucaacacauagcccagaaagccucccuucaguuuuccaguagguggaaaaaagaugaaacugaauugauggccaaaagaguugaaugggcuucacugcuuuuucuuucuugcucuuccaugcauuugcagauuaagcaugaagcucaccauuagugauugaagccaaaagagagaaggcaauucauugaacaaauauugauugagcacugugugucagguacugcucuagacaagcagacaaaacucccucccauauguaaccacaauugagacuuauagguaauuuuuguugcaaguaguucagaaguuuuguauuuuguccuaaaacaaaauauuacuuuguaaaauauuuuuuuaaauagcccucuaaauccgcuguauauauucaaagucacuauuauaaaguggagaaagcuacucauuagagaaaaccuaucacacagauaauagcugggaagcuuaacccuuagaaauuauuaggagagauauacacuccuugaauuuaagaacugucugaauuuuaaauuuuguuuugucaguucuggcuuggugaccuuccucuauuggccauucccauuuuucugcccuccacucuuccuugacacaugauuauuucugggaccacuguucaauccgaaacaaaucucugguggcuucuuuuaaacccaguggucucagucugaagguauaguggggcaacucucggcauuccauucuggagucuugaccucauaaagucacauauuggcaauucgccuugauaaggucaagugaacacacagaagcacuaagauccccacauguguuccacugccuccuccacagacaaguuguuuuucaacccaucugcagguccagaggugaagcuggaggcuacccugcagucucagucuuuucuccccacccuccagauggauuccaaauaagaagccuccagacuaccuucaccucccuggggucucauggacaugggcuggaaagugcuugcagacuuucacagacaaugcuuuuugccuuuagguccccuucuacccaacagaaugauuauaauaauggcuugaugugcuuacuuacaucaucucauuuaaucaucacaguaauccacugaugcagguucugugauccgcauuuuauaaaugaggaaauugaagccuagagaaauuaagaagcuuaacuugggucucacaggcuuuuagagauggagcccaagauuucaguucaugccauaugguuuaagggccugcacucuuaaccauuguggaauaccauucauuaucauaauguuaaggaucuguuucuacuuugcaggaaucuuuuaaaucuaugguucacaaucaugggugggcuucagaaucguccaaaaauguuucaaccacagagacgccugggaaccacugcacaauugcuaaaucacagugcaucaucuagccaaucuuggauucuacaauaauucuaugacaguuucuaagaauacaugccauuauauaauggcaacauauuacaacagauaauugaauagauauucaauguauaccguggaauagaauauuaugccacuguguuuuaaaaagauaauuaagaggauacggcacaacguggaaaacugcuuauaacauaauauuaaggauaaaccucagcugggcauaguggcucacgccuauaaucccaacacuuuugggaggccaaggcaggaggauugcuugagcccaggauuuugaggccagcaugggcaacauagugagacccugucucuauaaaaaaaauuuuuuaaagaaaaaaaacaggauuucaaauuauugcuaauauuuguagugauuacaaauauuagcuucuuuuuauaaagccuggguggaagcauauagauguaucuuuagcuuuauuuauucauccaugacuuaaagaagauugguuaacaccugacuccaccuugaguagcagaacauuggacugaaggaaaaaaaaaaaugugaagcugucuuacuuagcuacaguuuccagcauguuuucucaggagcucuaugggagacagugcaguguggcucucaaaccuuacuacccauaaaaaucugcuucaaaaccuacuuaaaauaucgauuuuauuccauuuccaaagccugguagaguagguaauucucccacuacaauacacuuaguaacacuagaaaaaaaauauaacauuuucuuuaaugcauagcugaguuuauuagaaaguaugaaaacuacuggggcgccguaagacaaaagaaaacuuugggaaaacacaauaggauauggguggacuuuggggccacagcugcccuggaaauauuugcugaccuagauaaucaagaagcuugguuuuuaacagcuuccuagagacaaaagauaaggccuugggccuuuccaaucugaggaauugaaacugcaaucacccacuuaauucaggacucucucagggcuauaguuucuguugaugggugauccucaggcagagaggugaugaggaaguugccugucucagccuagggggaaucagaagauaaaaugccucucuugagaaucaauaacuacaagcccaauucuuacagauucagaguuaaguguaugcucccugaauagaguaggaaaccccaagucuagaaaugaauaugaaguuguuccacauuggggauacccucagagccuugcagaaaagcauaaaaauguauguggcucaaagaaucaugagcuccugaucaaaaauuagaaaauauguaugcaaauaagccacucuguuuaagaacuggcagaacaaugaaaagcagaauuaaauccucagaaucuucagauaauugaauuaccaauuguuugauauauaaauacaaaauaaguuuggaauagaaaacagaccaggcagaaugaaaauaaaaccaagucgaauuuuuaaaauuaaaugugcgacacugaaaaugauucaacauaguuaacauggauaauuugaaagaaaggaugagcuggcagguacaaaagaaggaguaagaggugucuaguugaaguccuagaaagagguauuacaacugcagauuucuggcucuacauuuacaguuucuaggucuggggugagguuuaggugguuguggaccacacuuuuagguuuuaaagcauuggcucugaagucauuugguucagggcugggcaugauguugguuccuaguuuugcgacuugcaguguuacuuaacuuggcuaagcaucagcuuccuuaucuaugaaacugaaaaaauaauaccuaugucauaggauauauguguaaaucaaguuauucaguacaugccacacaguaagcacuuaaaaaugacaguugcuucuauuuuuauauaaccaaauacacuacuacaaauauugaguggcagcuuugcugguucauuuauggauucauggagcuacacaaaaccuucaccagucuauuaauuuauuuuuaguacagucucucuaaucaguauugcuuccacuguauauugaccccauauccuuucuucugucugggguuaagauaggagacugagaucagcugugucaaaagcuuucuuuuagauguaacacaugauuucuuaugaaaaucucauagguaggauaccagaaaggaauuuauuaaauucuuguuaggcuccuuaguuguauuaguuuuguagggcaguguuuuaauuuaggauacuuaugauagagagcaccccuuccauaaucaggagaaacacaagauggaaauaaagauuuuauuacuuagugguccuggggagcacacagcacuccagggaaggccacacaccaagaucagggagcauguggagaaagagagagaaaggaacucacgggccauugccuuuacuggguccaggacauuauccaaacagguuucccacagggaguuuuaauagguggguuucaagcaagcagguaugaguuccaggaggucacagugugaugaagaagaagucacuguggcauaucugcacaguccaugcgaggugugagcaucagugaagaccagucagguaggcuauauguagcuggcccauggggaggcgaucaccagguggcaauuguauaaugcagauaucuagauuggccacauagaggaaccgggaggagguguaguacuggaaacugcgucgacggucacugagcccugcuuuagguaugagaaaguccagcuuauauucagaauggaugcaaaggcagcauaaaauuaaaagcauucacugccagcugccauaacaaguuaccacaaacuaggugguuuaaagcaaccgaaauuuauucuuucacaguucuggaugcuagaaguccaauaucauggucuucgcagggccgugcccccuuugaaggcucuaggcaauaauccuuccuugccuguuucuagcuucuugugguugcugacaauucauggcaguuugugacuugcagcugcaucauuccaauuucugucuccaucuucacaugaauacugucuucucucugcgucccuguguccaaaucucccucuucuuucucuuagagaccugucauuguguuuacggcauccauaacccuaugugaccucaucuuaacuaaucauaauugcaacgaccccauuuccagauaauacaauauucugaggcucuggguagaugugaauucuggggguacaccauucagcccacuacaaacauauuguggcauugagguuauaagccaguagcccuacgaguauaggaugaugcccauuucagccugauaauacacuccgaaagagaucacaugguaacauuguugccucaguuaaucauagaaauacucaauuaguauagaaauaacaagaaaaaugcuuuguuauucucaugugucauuuaucgaguucuuacuauguaucuguuauuguuauccuuauacacuucugcacaaaagaugguuuuaucccaaguuuuagcuuagaaacugaggcuuaaugaguaacuugaccaagaauggcuucucuuucuccauuuccuuccucucaugguguuguuuuauauacauaaaauaauauauauuauucuauuaauauagauuaauauauguauuuauauauguacauuuuauauauguauaaaacuuauguuguaaguuuuauauacauauaauauauauucuguuuauauauugaauuuauauauauauaaaacuuaacacuauuaagucuuaacacuauuaaguuucaugguguugaguuauauaguucuauuaauuauauauauauggggggagggguguuucuccagccuagacuuccacuuugaaauguagucuccaggcucagccacuuguuugacauugccacuuggaugucugguagacuuaacauauucacaacugaauuucaaaucuuccccaccaaucugcucugccucauagcuuccccuuuccggaaugugguugcuccauccuuccaguuguacaggccccaaaucuuggaguuuuccuugacuccucucuucuucucaaaucccacauguaauccaucagguagucuuauuggcugugccuucacacuuuuuucagaaacuaauuauucuucagcaccuccaaugcugccacccugguauaagcuaccauccucagcaucuuucuuccaguggauuuuagcauccaugaaugauuauuuccuaaaucaauuaucaauaauuguuauaaauuugugauuuuucuauuucuauccuuccugucacuuuuccugguuuuuuuaaaagagcuuucuucauucuucuuuaaaaaaaauuaaaauuagcaucaguaugaacucguggauucuuuuguuauucauuguacuauaagccauuccugucauuauucauuuugauucuuaaauuguccuauucuuggccagugggagucuuucaugcuagcuccuaugucuuuuugauaugucccuaucuuuuuuuuccuaacacuuuccuuauuucugaaauuguaagcuauucuagguucacccuauaccuucacuaccccaguccaggcaucgucugucucucuaagaaguccuaguuccuuuuagcaggagaaguuuuucuagacucuuucauuaggcagagcuacaaaauugauuauuuuaaaaaucucgaguucauacacuaauucauaauucuaauuccaauccaacacugcaggcuucuucccucccuccccucaucccauacuuguauuuggauuugagauaugaaauguguaucucauaucccauauuucuucaguaacugaaaacccucaucaucaaugauagcagcaugcuuacucauuuugcucaguccaauaauucacacacauuuguagaaaaauagaauaguuuuagaauggcuauaccaauaucugcaagcuuacuauauucgguucaaaauuucuuuguaguucuuuugaccaaauguauucaacagagagcauucagucagaguaauguguacaaaaguuacuuggauuagauuuuuuccuucuguguauuuauguuuccauugagcuauagaguuaagcuauuuuuuuauuucuauuccauuuuagggguuuucccaucccuguugauuuaguaauuuuauuuuuugaauaucaacauuugucaguuucacaucuuucauuuauaugagauuaacuagacccuuuagaaaucauuauaaagucagguuguucuauuaauuuuuaaaauagguguauaaaaaccaaagggaucaaucagagccuugauuuaaaguacguucugaauuauuucagacacccgaauccaucuaaacccagaacauuucauuuguagauuucaaagacuucuuggccuuccuaccuuccuuacauuuauguagcauguguuuauccaaggcacaccaccugccaggcacagugcugggcucuguguugacacacaugaaugugaucaucuuucuguagcccccagguuacauggcaccacagccaagauacagacaugugugagagaguaaucaggguauuacucaggauuugcuggaggaaucccucuucaaaggauauucuaaauuggugugugugugugugugugugcgcgcgcgcauguguguguguguguguguugagguggacugggagaaaauauacccuccuugagaucaccuccuggcuagauagucucucccuucucuguuugugauagaaugcaaguggaauuugacagguguacuucucaaacuagaaacuagagagcugcuaucucagucaccguaagaagaacgaaucacaccaaaccuacaucauugucuucuaugacaggauuucuacaagggugagauagugagaugcuggagaucccuguuuugguaguucagggauucacagcaucucccaugcuggugaugucaaccugaagagauauuucuagugauagguuccagggaucuuucaccaaacacuuuaauauauuuuaucauuguccugaauacagcccuauaagguucuuacuaaauuugcaggugacaugaagugauagacaacaaacaauuugaauucaaauuaauuuugaaagcugagacaauggacccaauucuucagcaauuauauuuaaaagauauaaauacaugcagaaaacaaauuacaaguacagaguggaagagagaugauuuagcagcaacgcaugcaaagagaucuaggaguuuuaguuaauaacagacucaacaugaaccagcaaugcaaugugacuacgaaacaaguaauuccucauuaggcugcauuaauggaaacacgauacauaagaccaaggaagugguggucucauuugcacucugugaugaaaggccacaccaggaauacaguguaguacugcugggcaccacauuuguagagaaauagaaaccaacuugagugucuucagagcagaauggugagagaacucaaacuucauucaaaugaggaguaguuacugagccugagaaauuuauagccuggaggauuugguugucuucaaauauaugaauggcugugauggggaaaaaaggauuaaauguguccuguugucacaagaggaugaaauaaggagcggugaauggaagccccaggcgauagagguuucaguugcugcugacagucagggcugucugaggauggaauguauugccucaggacaaagugaguucauugucacugaauugguucaaaaaugaccaggaagacuacagggcagggaagcuaacuuguauuacaauaaguaauuuuuuucuuuuuuauuuguaugcccuuagaaagauguuuacuuaacuugauaaaucuguaacaagggauaaucaagauuugguuauaggacaauuacaauuuucugacagaucccccaaaauaauagaaauuaauagcuuacacacuacuuuauccaagcuguagaauguauaacuuacuucauauacuuuguguuuagucaguuuauacaggcugaacaacauaaaguuaagacauaaaaggguuuuuuuugcagguuuaaaguacuaccauuuuuccaaauuacuggcugauccuagaacuuugagaaacuuugguguuuccccccuuccuacuuuuguuuacaucauaguacguagaugguacaauauuuugguuaaccucagucugacacuuagauuguguucucuuuugcccuauuaaugucuagaguguaaaaagaccaguaaaguagcaccaagaaaucaaagaaaauuucccaguucuacucacuuguaauucucuuaauuuaguaggggcuuuccacaggaaaucacaauagaauaguugaaaugcucuuuaucuuauguacuuuccuucugaagaaagggacaguuaauuggcuuuguucccaacaugguccaaauuuuuauacagggcagcuguauuuacuguaguacaaaggagauucuacaccgaaugaugucucuaaguauuuucaauaauuaagaaccuaauugcuucucuagccaguggguuucagugaaagugauaaaauagauuuucuaagcaagaaaaauacauaaugagggugguuguauaccuuuaagaaaaaagaaaucagugauauucaaucccaaguaaauuuggauaucacagagucagagauauucuuaauuauuuuaaauuaaauuugagucaaaaacaauguguuuaaagacuuuaaaaucauuuuaaaagaauguuagaaauuuacauuaauaauuucuauuuucaaugaauaaaugagaaaccuagaauuuuuguuuuggacacacuuugaucauaucuaauguguucuacuuccucuaauuauuuuuauguuauuaggauuuuuaaaaaaucucuuagauuaaaauuucucaguguaucuuuguuugcgugucuuuuuuucucucuccacuuauguaauugaagcauuucugacauauccucagaacacacagauucuuaucaggacuuaacuacccagggcagggcccuccuuggauuuacugaaaauaaacacuuuggguacucagucucaguuuuaaugacaaaaguugaaaucuuugccuaacaugaagguuuuucuuugucucuaaauuuugauuuuccaugcuaucagaggucccauugcaacagguaauuugaguguugauuguauguuuucucaguuuguaauuguggugaaauguauuuaaaauguucacaauuuuaaaguuaaguuuaccuauaagguucuuuccaacucagaaauucugugaugguaaacuuuuuuuuuguaguuugaaaaugugaucuuuggauguugucuucuguguccuaugcauaugacuaggaaucauagaauuuuagagcuggaaaaugagugagacauuaucuagugauucugcaaaugaagaauuaaaaggcccaaagagguuaggugacucacgcaguaucauagcaguaccuggugacuagaacucuggccaccuacugcagcacuaaaaauuaacccaaauguuuuuaucugaaaauuugcagacuucaggcuaggccuguaaauaaauaaauaagaaguuaaaacauauuugagaaagguaagcuuaauaugccacauuugggaaaagaugugccugacacaaauguauuugguguaauagagaacauucuuccauuauaccgaaaugaaaauuuugaacauucucaaaauucuugaauuuugagacauuuauguuaagcacaguuuauucagacucucuauaaacugugcugucaucccuguuguuuucuccaagcggaaucauacuuaaauuacaacuuuagggaguuuaauguuuccuauuuuugcacuccugggauauuuuucagugacucagaagcauaaacugacacugugaaguuaaggcuguguuccagugggaaugacagcaugucucuaggacgcugauggagaaagcccuccucaugcagcugucuugcggagucucccugcugguggugaaugugagaucacacagggccagcagccagggcaguacaucucugagucucgcuucugguuuuaccuagagccaacccuuggugauuguuugccuccuuggccaagcccccacacaauaggaaaacugugucucaaggucgaauucuauuaauaccugagaggugaauuuauaaacauuuaagauguuuuagcaucucugcagccagugucucuguaaaugaaaauugcuucucgaaguagaaaagcauaagggaguacaagggcuucaaaaaauaauccuuuuaggaauaagaauauugccaggguuagguguuccuaacugguuucaagcagaggaguuaguaaaauuccaaaaguuaaucagcuucauguacucaacuuuugcuaggacuuugcagaaacuccucagggaucccucagaguuagauuagggagaugaacccugccaaaggacaguaaccauucaacagcuggauagccuguugggccccacuguccucagccuuuccuaauguugccugggaacaccacuuuucugcucccuccuuuuucaguguagccuggagacaauuauuuauuuauucacuagcucuuuuaacaaauauugauuaaguagguacugguucuguucuagggguuggaaaaacagagaaaauuaaauagugccuuuguccucaggaaacaauccauuuaauagagagacgaagauaugcccuuaaauaccugaaucaccagcauaaccagcaccugcggcugccaugugggaauuguugaacaagauaauuuuugaaugaaagaguaaaugaccuaauugcucuaauguaaagauaaauuucuaagagucggcuaguugggaugauuauagaaggauucaagggagagauguaugaaagcauagaucuaacgagagaaaacagcacagcagaaaaagcagcaaaggcucaaaaguagaaaucucugagaucgaauggagaauaguaaauaauuugcuggaaugaagagcacguggaaggcaagggugguaagaaggcuggagauaguagauaaggccaaaucaugcaaggauuuaaacuguauguuuuuagaaaauggguaagcuauagaaauuuuauauaggaaugagaaauuaucagcagcauugugcuuuaggacuacaaaucugguagcaaucugcuaacugauauuggaagggaaaggcccagagacacuaguuggaagaauugcagugauucuucaugagcuaaacuaagaguucaagcuaagauagauaaacuaaggaaugagaauggaagaaagggacaaacugagauuuuuggggugguacucagcugaaguuuggcaacugguuaaacauaaaagacaagagacagagaggaauccaagaugaaaagacgauuuugcugcacuuuuuuagaaggcagcauuuguauuuccauuuccaggagguggaguagcuuugagaagaaaggugauuaguucaguuuugggcacauugagcuguaacgguauuauggacaggaagauacccuacaaacagcuggaaauuuugcacaugcuuaaaaagaagaugagaacaugagauuucaauuuagccaucaucugcauggaguagacaauucaauccaggagacuugauaagaaugucaagggagugaucacgauaaaggugagaaauggacugagcaucgaucucugcugaaacaucucuuugagcaggaagaagagugccuuagcaaaagcagccagugaaauggggaguugggggagacuuucaaggagggaaugguaacauaucccauucccaaagaggucaaguaggguugaggaauaauaaauggcuaguggguuuggaaacauggaaucugucaugaccuuuacacacuuuuucauuugauggaucgggggauuacuuacauuugcaaagggccucagauuaagugguaaugguucagcauuaguaauuagagauuuucuuauguacuuuguagggagaaauagaauggcauucaaacagguuuaaguuccucuuaagaaccuuucucauuggauuguagagaagagcaaaugaaagaaucguucaguauuucuugguaucaugcccagcccauagguuucaauuaauguuaaccuuuacaguugucaucaucauuauccagaaggggcuuuuuuuuagaauaaggaagaaaagcagugcucaucuguagacaagggaaaaaauccuuuggaagagagaaagagaaggguaauucaagaagaucaggaauaaacauuaaggguaaaaacagaaugguuagcccuggaaaagggaacaaacauguuucucugaauuaggagaggauaugugaaguaacagggauguuuugagccucagugacaguaaggagaagagagagugaaggaacuugcacgcagugacuucuaccuucucauuaaagucaagagagaaucucaacugcagauaucugcuuaagguaggaagagagaaauaagaauugcugucauuuauuuugugguuuugauauagcaaaaacuguacuagacacuuuaccuccuuuaauccucagaaaacuuagagauuauauauuuguauucacauucuacaaaugagaaagcaaguaaaaaaguuaaguaacucucccagagucccccagauggucaugggagcccagauucagagccagcuaugucuuacuccaaagccugugcucuuuauugaaacauacuccacuaguuugagaucuuggagguguaccccugcacuacuaucaggacuaccccugauaaaguccugugggguaguuguuccuauccaucaccacagugaauaucaaagaagggcccucucauuugaggaauaacagacagugaaauugagauggaccagaaaugcaaauccuggaucccugagggaaacaacaaaaugaagcauagaggaaauaucugagucuggugccaagacucaucaguacaagagagaaugccuaaugggcaauagcaguuagggugggaaaagagaaguacaagggggugucuuggaauuugagggaagaacugcugccuuaguuuucgaaggaugauuauucgagaguugcccucccuucacuuucucacagcuggcagaauuccuaccucuuagugguuagauuccuuuuuaccagauacuguagggccagugcagcaaccagagcccccagccagaaacccugccuccaauuuagaccaguguucugcucugguguguaauaaucauauucuaauuuaaauagccuauugagaugcuacauugauaucuagccuuuuuuuuuuuuuuuuuuacuuuuaaguuuuaugugcaggaugugcagguuuguuacauagguagacgugucauggggguuuguuguacuaauuauuucaucacucagguauuaagccuaauaucuguuaguucuuuuuccugguccugucuguccucccacccuccacccuuugauaggccccaguguguguuguuucccucuauguggcaauguguucucaucauuuagcucccacuuauaagugagaauaugcaguaucuguaauaauggguuuucuguucucguguuaguuugcuaaggauaaugaccuccagcuccauccaugucccugcaaaggacaugaucuuguucuuuuucauuucugcauaguauucaauuggccauuuuuuaaaagacaaaauaacaaaaaaaagaguacaguuaucuccacuccucacccacuaccugccaccuaacccaacccuuuauauuuuaguaauugccuuccauaaauaacauuuuauccugucuuaauuaugcauucauuaguguauuaauuauugaaugcccacaauaugacaagcauuauuucaagcacugaggauacagcagagaauaaaucaauauccucacuguuuuuauuccauuuuuuuaagagacagggucucacccuguugcccaggcuggagugcaguggugcgaucauagcccaaugccaccuugaacuucugggcucaaaggacacuccuaccucagucucccaaguagccggaacuacaggugcacacuaccacacccagcuuccccacucugagccuccauccuaauggagaagagaggcaguaaucaaaauacaugaaauguguaguuauuagaugguuauuaauguauagagaaaaauuaagcagagaaaggagcaagggauuagggggucaaaguuuugguagggguagaguggucagugaaggccaccuugagagauggcaauuauguaaagccugaaagcagguaagaaauauacagguauacagaugucccuggaaagaguguucuaggcagaagaaauagaaagugccaaagcuaagauugcucaccuggcaaguucaagaacagugagaaacugauguggcugcauaggaguaagaagaaaaaggacggagaggacaugagauggucagauagccuagggccuuguaagccauuauaacgauuuugucuuuuaauauagagaaauauuaaagguuuuuguuuuaacuuuuuaacauagaaaaauguaaucauauacaaacacagaauaguauaaugagcccccuugcacuaaucacucagcuuuaacagcuuucacuuugggaggauuuugagugaaggagugauaagacauggcauggcaugacauggcuugaacaggaucacucaggaaaauaagccauggggagacaggacaagcagaggaaacacaggagcaaaagcuuaggagacagaugaugguggcuggaaaccaagggaguagcagugaagguggugagaagugaucagauagaggauauuuuuuugaagauuugaauuaauauuauauauauuauacuuuaaagaagaauuugaaaaugcauguaguguaguaaagaugguaagaaauacagaaaagaggccaggcacaguggcucaugccaguaauccuagcacuuuaggaggcuuaggugggaagcucccuugaggccaugaguucaaggccagcccgggcaacauagugagacucugucuauauggaaaaaaaaauuaaccaggugugguggcaugcaccuguaguccuagcuaccuaggaggcugaggcaggaagauugccugagccaggagguugagucuucagugagccaugaucauaccacuguacuccagccugaauggcagagcaagacccugucccuuuaaaaaaaaaaaaaaagaaagaaagaaaaagaaauauaagaaauggcacuagaauaucaguauuauauacauuauuuucuguuuaaaaauccacacaacuggcaaaaaaaagugacauacaugaacauuuauaagacagugcauuuauaaauuacaaacucucugcuccucccauauuauuuugcagugaugaaugauuaggccauccaaacguaaagauuuauuuguaauuugcuaaugauggaaugacaccuguugagguacaaguucccagcaauucuuggaauuagcaauaguguguuacuucuuucucgaaagaagcaugauuuguaagcagcuauaucugauguaguaaaacugaaaguuaaaauaaaaaaggaaaccgugggucaaaguaugagggaaaagauaaaacuuucagagcaaaguuauacauagagauuuuauucaucgucucuguguaauucacgagaacuucuuagcuuauuuauuaugucaaauggcaguuugcucuucuaaucccagccugauaucaugagccauauaugcuguuggucauucaaaaagggcacuaaacaaggugaaagaaugucagugaaucaaugcaacuccaugaguacuaccaggaaaagaaaaacaaaaaaacaugccauuaauagugggucaaagaggauuuuuuucaugccauccccuaccuuacugagaauaccacauuuauauucagaagacucauaaugaauuccagaguccucugugucuuggcuguaugacuuuggguuaugucacuuuguuaaucuguuugaacuucuguuuucuuaucuacaaaauagggguaauagagucaacucugccucccucacagggacuuucggaggcccaagggucuuuacaaauaauagagaaggaaagaaacuggcacuuuaauaguaccuaccauguaccagggacugcguaguccccacggcagcccucugaagucaugugauuggcccauuguguagauguagagcuuaagacucagagagguuauuuaaucuguguaaggccacagagcuaggagggggaaaagcugggauuggaucacugacuagaucaacuugaaaucuccugccugacagagaaagaagagacuaacuuuacuaagcaucuuuuuaugccagaaacuguguuggacauaauucuguacuaucuuauuugguaaaggucauucuguccuuccugguugcccugguugcucaacaaguaauaaacaauaaagccugacuguuuuucaucccugagagaagaaauauuauuaaaauagcguuauucucuuucuuucuuuccuuuuuuuuuuuuuuuuugugugugugugugugccugauaaucugacuugcaaccucacagaaaagaaugaaugcaugguuucaugucuguggcaugacucugugaaggagccuugcaaggggacagauacaccucuaccacuucuuauagccauuccugagaccucucuucucacaacacauaccagcaaagccaaacaaacaagguguuuaggaauaacugucaucuaucaacacucucuaggcaaaguagaacuaugaaacacugaggagacugcacacacacagaagaaaaaaugaucaugucacaugguagcacagagcaaugggaaaugugaauaguuuguugagguggacagacccaagcucaaggauugccugaucgcuccauuuauaggaaccauggcaaccuaccuuaucuuacugagccucaguuccuccagcugugaaaugggguacaaccucugaccccacagggcuguuguggggauuaucugaguuagcauguuccauaaaacacaguaaguuagaaaguauagcuguauaggcucugggaguuuaacaagcaagagaaauuugacaguaaucauuuaguuacugaacccugucuucauauugcgcuagguugcauaugguuuuccugccugucccuuccaaucacauuucagaaaaaggaggcaguaguggagccuugugggcuaaaguggugaggagggugucauggaagauucagguucaggucuuccucuugaagaaugggugcuucucaauagggaaguggaggaacaaccugggaguugucagcuugaagaaaauccugagacgugauaauggguagguccaaggagguccugaguaggacucugagcacagagccuuucuuugcaugugcuguuuuuccugccagcaagacccucuaaacccuuuggccucacccacccccuugccugguuauacuccuagccuucuuucagaucuccacccucaguacucccucaggaagcuuucccugaccuccugacccagucaagugcuucuuauauaucuccuuuguaagcucuucucaguuacacuuuuacauuuauuugugagauuauuugauuagugucagucccacucuuuaauucuccacaagaacagagauugugucuguucugcauucaccaugcaucgcuucauccccuaguuuacugcaguguguggaacauaggacgggcuuuaaauacucgcugaauaaauagagaaauguugguuauuagugagguauuaccuaggugggagagaggauuuauauuugggauugcuaaucccauuaagugccaagcacugcauuaacucauuuaauccuaaaaaaaaguccuaugaaaucaaguguauuauuccuuuuaacuuuaaagacagagaaacugaaauccagagauguuaaccaucuuuccccguugacacagcuaagugguaacagucggucuugagccgggcagccuggcuucagacuuccuagacuuuaccacauuguucugcugcuuagugcaguagaggacaaagugaggugcacacgugaagucaggacagauuuccguuugaaaauuguguauuuuccccuccucuucuucauuaccauugucaucaucaucaucaucaaucacuucacaagcaaagcuaagcagaaaagaacuacuucauguaucaccucuuacauucauguuaacucuacauucugccaaagugauuuggcugaauuuacccaaagagcaaaguggacauuucaaauccugauuccuagaaaauuauagacuacauccuguaaccaccuuugaagaaccagcauguacuuuaccccaacgugacaaaauuguuuuaaauaaaaagagguaauuugacuaagauugguaugaucugagacccaugguuucuacaucuuauucaaaaagcagauccagcauguggucaucaguagguauugagucauaaagcuccuggaagaaaaucuuaaguuucaucaagaaugccaagaaguccugggugucuccaagaaugauagcuguuacuauaauaacauaauuacuacuggaaaauuagcaaagcccaauaaaauauggcaugcaaaaaaauauuuacccuggaaauagaagugaccuaaaucagucguuuauuccagccaccugcuuuuagauaguacuuaaaaaaaaaacuuucaggauggucauauuguuuaaaguucucuagguggaagaguacuuuacaguaauaaauuaauaaauaagacaaguuaaugcuuuuaaacuacuauuauuuguugagcauuguuguaaaggcuuuacaugcauuaauguauuuaguccucacaacaacccuuugagauacuauuaucaucaucucccuuuuacagauggggaaacugagcagugcccaaagucacacaaccaggaaauggggaacuaucuucaagcccagcugguuugcgccuaaaguccaugcucuuacagugucccuggguagcugaguacucaguuuugucaccuuugucuccuugacuuuaacugaaagcuuaacucuuuuuuuuuuuuuuuuuuuuaaacggagucuugcucugucacccaggcuggaggggcagugucuugaucuuggcucacugcaaccuccaccuccuggguucaagugauucuccugccgccugccgaauagcugggauuacaggugcacaccaccaugcccggcuaauauuuuguauuuuuaguaaagacagggcuucaccauguuggccaggcuggucucaaacuccugaccucaggugaucuacccgucucggccucccaaagugcugggauuacaggcaugagccaccacgcccggcccgaaagcuuaacucuuaauaagagccugcaauguucagacgcuuugaaaaaaaccuaacagacacaguugcucucuauaaacuuaauuuucaaaggaaccacuauucaaagaaguaaaagggagacugaauaaaaagaacuaaguucuccguagagcaaaugaauuucugaaucgauugcaaacaguucuccgucaucaugacauccuaugaaguauggucucccccauguuagagugccagugucuucauguaccauauaacuugcaaauaguaucacugucuucucacacuucagcuuucuucuuucaucaguauuuuggaaaguccacaaaacccagggggcucccugucuguugcccuguggucucugugaaaaccagaugaugcgaugcugacuuggacucuuucaaauggauccaacagcacaugagucacuggcagcauguucagcuccuuuaccucaggaauuacccaguuccucauucuugccacccuucagccaugaaguaguaauaugaaaaauacaugaguacuuuuugaggauaccucggaccucuuuccuucaguaccagagacuaauugccucauaaugguaacauugaagagcccaguuaucugacgugauugggcuuuaauuauggauuccuucugguguccuauuaaauuggaaagccuagcugauuucacccaaaugaagcauuaccucaugccuugcucucuugcauuccugugcuggugucacuuaaaaguguaauuacaugguuuauuucguguucuuucacucuugauuuauugcugaagaagccccugugggauauaucaucauaacaaagacugauuucagaugucaacaccaagaaacacaacuggcaucagcaaucuauagagaguaucuagggacagcagucagcuuuggagaaaacccagaacuucucauaccccaucccacauuuaagggcaaagacuuucuccuuguuaaagggaaagcacugaguucauaauuagcuuuauacccagaguuuuuuuuuuuuuaaauguuauaccuguuuaagaaauuuuuugugcuuugagguggucaagaucaaauuuaauuagcaacccucuucgugauuggcuugcucuggggacccugcucuuugagaaggagguuagaagguuuagaagcaaaccuuugcagcaguucuagccaagugcaugcauacaggccuugagguggagcugcacaguugacuguaggggagucuguccuuuguugacgagugaaacuucucucccugcaaacccucuggggaauaaugccaacucugaucagcuuuucgacucuuggaugaaauauuggguugggaaaaagucccuacuaagaaaauuguaccaaaacccugcuucaauaaaauaugaauccauuuaaugaaguuuauaguagaaguaggcuagucgaaaaggauucugucucuuuccaaguauuauuggcagguuuagggucuuccucaaguuuauaucauuaggacuuccaucaaagaguuaucuuuaggugugauucccauccucccucccucucucccucccucccuccgucccaucguuccuuccucccuuuccuccuuccuuuucuaccuuucuuuuucucucugucucucuuucuuucaagcugugggcugcuuguacagauuuaugcauuuugaauuacugcguaguugagagauuuggggcuuagguuauucaguucuucaaaaaguacaguaugagcuaaggagauagggugaccaacuaaucuagguuuuggcuccaaaaacccugugucccagaaaaccccucaguccuaggcaaaccaggauaguaguucaucuugugaggagauuauagugcauuuccaaguauuuagcugaauuuaucacagggcucugacuugauaggauuuaagaggguuaaaauaaggucuuuucuguuauguuagugugacuuuagucuuggcacuuucucaaggaaggaauccagucuacuacaggggcuaggugacuaagaagaagaaagaggauaucuaaguguuuuuugcuaaaaaugucauuaucuccaugcuauuuccuuuuuauugcuauugucaucauuuuaaagacauaccaauaagaaauaaauuacuuuaaauagaaaacucuaauuuuaucaagcaacagcaaacaggggugaaaucuaaggauuuguacuuaaggaguacacuuuuuugaauugaagaaacuuacuaugaccugagcauauguaacucaauuaucagaagucagagagggcuacugaaggcucagguuuucuaagagaugacuggaggccaaguccucaggcuugaguguuuauagccaaacuucagaaccaggucccuggcaagauucuccugucuaaucacauggcacagaguuaggauggacuguuucugcuuaccugccuucuuccuuugauuuccaucaaccaccaguuucuuucucaucaaucauuuacccagcuuuugugaccaagaauuuugaugaggaugcagaggaaggcauguucuugguuaauaggaaaggaggcuucaugacaacacagcauccucuaagauguguugcuccaacuuucacaauacauauuguguuuuaaguggccugcuucuuggaguguaucuucccacuacacaaaacaaccaccauuaacauuuucauuuacuuccacccugucauuuguucaucacauacuuuuaaaaacagggcuguaaucauguauauacauauaugaauaacuuuauauuguacuuuuuauacuuacuggcuuaucauaaacauguuuccauguugcuggagagucagauaugcuaacuuuuggaaugugcuucuuauauagaucugcaacuaugugggaccagcaaagguuauuguucaguuggucacaaauggaaaaaauauccaccugcaugcccacagccuggugggaaaacacugugaggaugggaucugcacuguaacugcuggacccaaggacaugguggucggguaaguagggguauaugaugcuguggaagguaggaacagauagaauaugggaugcaggaacuuagaaugaacaggccccuuucauuagggaccuuucugagacccucagaugaccucaaaaaacuguguaaacuugugcuuucauuuggacuccaggaaguaaggugaccacaugucuggauuugcuugagacagcccgguuugccccugaccuaauuguuuauagcacccucuucuacucuuaaagguggcccaauuuggaugaucacuuauauguggucacuugaccuacaagguauuugugccacuauuaauuuuuuuucuccuagaaauaaaaauaaggacaaauuuaaagaaacauaacuauagcagaaaucaucacuuuauguauauuuuuacauucuugaugauuucuucaguggauuuauggugugaauauguagggcuuuaagugaaugcauaaauaucauuucagcucucugcugcuuagaaaguaaugcacagauaagaagccaaggaaugcaaauuuauuuuggcauucauuaggcuugaaauguaaauaaaaaaugacguauucauuuaaggguugaucaaauaaaacaagcaauuuuuaaugaaugaaguuuuauagaaguaauuucaauccaaaagaauuaagcuuuuaaauaagacauauuuauugugcuaaaaaacuuguauuuucaucuuccuaauacacuaaaauggcacacagaauaauaguguagcacacaauacaaacugauaugugcaaucaauaauucuaaaaauuguuguuuuaagucuuucuuuggaaguccuuaaaugcaaaagaagaaauuuuuaauuuuguuuaauuuuuaaaaacauuuuucaggguuuucuaauccugguuuaaauaguuuaugcugaaaucccaguuaaucuggcuuauucacucaaaagaaaggaauuguuuaaaucaacuauaauuaagcugaugguugcauuucaggcuuugaauuccgaucaaguuucaaauugguuauuauuuuggagguugugcuuucauguuccuagguauuucuuuguuugacugugaaaauauuuaagugugaaaaaccuagagagagagcuuucuuuuaagucacuaaaaucggauucuuuugauguuagaaaaaaaaaagacucuagauugaaggaagaagcuuaaauugauuugaaaaauuaaagugugcuuuauaugaacuuguuucaacauccucuugaaagacuggcgugucuccuguuguaugucacaguuuguucaucauguguuguggaauacccuuccaauuccugauugaccuaggagagcuuugaaaugcaggcuaauuaucacaguuuuagacugauugaucacuuaguguuucugcagauuuauuccaguaggguucugucaguuugaaguguuuauuuucuuuggucuuguuuaaucccuauuauaaucauauccuuuagaggaaauuuuagaugaaguuuucuacuaguauuuauuauuauaaaaccuccaguauggugucuauaauuugguguuucugugguuugcuuuaguaaucuuucaggauuuuagaaagaacuaaugguuauuuaaauuugagaccuuaaagcgggaauagaaguaaauuguuucuaaggaaagugagggauucuuucacucuuguagugcaguggguugugggcucaguaguugggagaacucaucagucauucacucauucaacaaacauuuugagcaucucagcuccugaauuugaucauuaugaugucugguuguagagcagugagauuuucuaacccuauauaauuucagugagaaauuuaaucaagaugccacuugagaguuacaauagacucaguagucuuaacguuuuuaguguuuccuaugaaaagucaguacucacuuucuaauuugauuuuuagcugagaaauuuuugcuuacaauguuucccaaaauacacuauuucuuucauaauucauuuguuucuaucucucucuauauauacauuuuuaagauuuucaaugucaaaacuuauugcauuuauguagaaagaacaucgugcuagcauucuggaaaccaguauuuuauucccaguacuguugcucucaacagaggacugggggcaaguuacaugacuucuuggggaccuuaaugucuucccucauaaaaugagagaguuucacuacagaaucuuaucuucaggcuguuuacaucuccagaauucuggacugaacuaacauuacguaauauuaugaaauaacaugagcaaacuugccacacacauauuuaugguaugacauugauuauuaguauuuaguucugacuuguagauaagaguaucacauagagaaacuuaggaagauagccaaaauuaugucuuagacuugucaauacuagaaaugaagcuaagauaacuuguuuucaauaauacagauuaggcaaagaguauagauucacaagcaagacacuaauccaacauaccaaaaaagauauccaaaaaauggcaaugagaagacaaauaacuuuuaaauugucaaaaccaaaagaauuacuuucuuuggaguguuuaucuucaucuuucccucaguaugaauucuuaauaaacuuaguuucuacuuucaaaaggauuuuaucuauguuauaaauauucauguuuuaaauagccaagucuugauucugguuugauugcuguaauguaggggauuugucauuuuaauauuuuuuaaguuagcuuuaauuuugucuuuuuuaaaauucauuuauauaauuagccuuuacugccuuucuugguaaaaaauaauaauaauaaucuuaguuugguguuuuauuuuaaacccugaauaucaacaauuuguuucaacauauuuuaguucguugacauuuuuauuccauggaaaauaucuguguuccuugacuuugcuuuaggccaguucacuuaccaguaaucaccacacucucucugcuuucuggcaguuuagagacauggaauuuuuuuccaauuaauacauauagcauauaccaacugguaagcacuaggaguagauauauaaauaucaaaauacagaggagaaacaaggccuucuucagugucuguuguuccccuuuuuguccaugaguucucaucauuuagcucccacuuacaagugagaacaugcaguauuuguuuuucuguuccugcauuaguuugcuaaggacaguggccucuagcuccauccauguuccugcaaaacauaugaucuuauucuuuuuuauggcugcauaguauuccaugguauauauguaccacauuuucuuuauuuauuuauguuauugauagggaauuuagguugauuccaugucuuugcuauuguggauacugccgcagugaacauuaacaugcaugugucuuuaugguagaaugauuuauauuccuuugauuguguacccaacagugggauugcugggucaaaugguaguucuauuuuuagcucuuugaaaaaucaccacacugcuacaaaaucaaugugcaaaaaucacaagcauuccuauacaccaauaacagacaaacagagagcaaaaucaugagugaacucccauucacaauugcuucaaagagaauaaaauaccuaggaauccaacuuacaggggaugugaaggaccucuucaaggagaacuacaaaccccugcuuaaugaaauaaaagaggacacaaacuaauggaagaacauuccaugcucauggauaggaagaaucaauaucgugaaaauggccauacugcccaagguaauuuauagauucaaugccauccccaucaagcuaccaaugacuuucuucacagaauuggaaaaaacuacuuucaaguucauauggaaccaaaaaagagccugcauugccaagacaauccuaagccaaaagaacaaagcuggaggcgucacacuaccugacuucaaacuauacuacaaggcuacaguaaccaaaacagcaugguacugguaccaaaacagagauauagaccaauggaacagaacagagcccucagaaauaauaccguacaucuacaacuaucugaucuuugacaaaccugacaaaaacaagaaauggggaaaggauuccuauuuaauaaauggugcugggaaaacuggcuagccauauguagaaagcugaaacuggaucccuuccuuacaccuuauacaaaaauuaauucaagauggauuaaagacuuaaauguuauaucuaaaaccauaaaaacccuagaagaagaccuaggcaauaccauucagcacaugggcaugggcaaagacuucaugacuaaaacaccaaaagcaauggcaaccaaagccaaaauugacaaaugggaucuaauuaaacuaaagagcuucuccgcagcaaaagaaacuaccaucagagugaacaggcaaccuacagaaugggagaaaauuuuuacaauguauccaucugacaaagggcuaauauccagaaucuauaaagaacuuaaauaaauuuacaagaaaaaaucaaacaaccccaucaaaaagugggcaaaggauaugaacagacacuucucaaaagaagacauuuaugcagccaaaagacacaugaaaaaaugcucucauuaucacuggccaucagagaaaugccaaucaaaaccacaaugagauaccaucucacaccaguuagaauggcaaucauuaaaaagucgaaacaacaggugcuggagagguuguggagaaauaggaacacuuuuacacuguuggugggacuguaaacuaguucagccauuguggaagacaguguggcgauuccucaaggaucuagaacuagaaaugccauuugacccagccaucccauuacuggguauauacccaaagguuuauaaaucaugcugcuauaaagacacaugcacacuuauguuuauugcagcauuauucacaauagcaaagacuuggaaccaacccaaauguccaucagugauaaacuggauuaagaaaauguggcauauauacaucauggaauacuaugcagccauaagaaaggaugagcucauguccuuuguagggacgugggugaagcuggaaaccaucauucugagcaaacuaucgcaaggacagaaaaccaaacacugcauguucucacucauagguggaaauugaacaaugagaacacuuggacacaggguggggaauaucacaccccugggccuguggugggguggggggagggauagcauuaggagauauaccuaauguaaaugcugaguuacugggugcagcacaccaacauggcacguguauacauauguaacaaaccugcacauugugcacauguacccuagaacuuaaaguauaauaaaaaauaagcaaguuuacaagggcaaaaauaaaacaaaaaagaaaaagcaccacacugcuuccacaguggcugaacuaauuugcacucccaccagcaguauauaaguguacccucuucuccacagccgugccagcaucuguuaucuuuugacuuuuuaauaaaagccauucugacaggugugagaucauaucucauuguguuuuaauuugcguuucucuagugagcuuuuuccauauguuuguugguggcaugugugucuucucuugaaaaguaucuaaaacagucacuuaucuuuuaaagaaacuuuuuaaaucagaaaaaagguguuuauauuuaaccacguauuuaucauuugcagugcuguucauucuguuucuuaggucaaaauuucuaucugguaucauuuucuucugccucaggcacuuccuuuuauuauacugcugaucugaugcugauuaauucuuucaguagguguauguuuucauagcuuuuuauuuuaucuuuguuuuucaaagauauuuugaagaguauagaauuuuagguagacaggccgggcgcaguggcucacgccugaaaucccagcacuuuggaaggccgaggcgggcaggucaccugaggucaggaguucaagaccaaccugaccaacauggagaaaccccgucucuacuaaaaauacaaaauuagccaggcaugguggugcaugccuguaaucccagcuacucgagaggccgaggcaggagaaucacuugaaccugggaggcagagguugcggugagccgagaucgcacaauugcacuccggccugcgcaacaagaaagaaacuccgucucaaaaaaaaagaauuauagguugacaguauuauucuuucacauccuuaaacuauguuguuccacugucuucugauuugccuuguuuccaagaagucaccugucaaucuaaucuuuguuccucuguauauaauuuuuuuuucucucuagcagcuuuucagauuuucucuuccucacucguuuuaagcaauuugauuauauggauauuagcauaguuuccuucauguugcuugugcuugggguucaucgagauccuuagaucucuggguuuauauauuuaguacguuuuaaaacuuuuuggccauuauuuuuucaaauauauuuucuguccacuccucuucaucuucuucuggaaccccaguugcacauauauuuggcuaugugaaauuuccuacagcucacugaugaccuguuuuuuaaaaaaucuuuuuuuucucuuucauuuuggaaaguuuuauuacugugucugcacguucaccaauauuuuugucuguagugucuaauauguucuuaauuccaucuaguguauuuuuuccucuuagacauuguaauuugcaauuucuauagauuuguuuggggucuuuuuuuuucauaucugccauguuacuccuuaacauaccaaugcuuucuucuuuuucugaucauauggaauauauaauagcuauucaauguacuuguguacaaauucugucuucuggaucuauuuuuguuuaguuuuuguccuaauuaugaauuauauuuuucuauuucuuuccaugccuguuaguuuuuuauuggaugacagguauuuugaauuuuguaucguuaagucuuggauuccuuuuuuuuuuuuuuuuuuugaugugcuuuuaaauacguuugaggauugggaugaaguuaaauuugggaacaguuugauuuuuuugauucuuucuaaacuuacuuuuaagcuuuaucagagagaccagagaaaccuuuacucuaggguuaauuugacaucauugcuaaggcaguaccuuucugaauuuucaaccugaugcuccauguauuacaagauuucuugaacuauuccagccccauauguguuacaguaauuuuucugccuccaccucuguggugguucuuuucccagcuuugacauauuuccucacacacagcacucagcugaagacuccagugaucucugaguguaucucuguuugcgguuucuuccuuuccgguacucugcuugugaguuuuagccuccuuggcuuccuccaauauuuaacugugucuccucaaccucagagauugccaggcucuguugggguuccuccuuccugugcugcagccugggacucuuuaggcauuaagccagaguaauuacaggguucaccuuauuuauuucccuuuucuuaaagauuacuguucugugcugccuguuuucuagugucuaaaaaccauuucuucauguauuuuagauauuuaagguucaaaccagucuguuuuacucuaucguuaccugaagcagaagacugacuucuguacuguuucauuuguuaaccagaguaaauccuucauuauucacauaauaaauuaauaaggaugauguuuuucucacagggacuagauuaggcaauauacaugaaaagcauauuauugacaguaaaguguaagaugcuacacagauguuuaucauugcuauuacaaaggagauaaccccguuuuccugcaguuagggaaguucuauaugggaguaaggcugaaagggccaaaagauauagguauuguuucugaaaaacugccuaugcuucuaugcauauaaguaugucauguugcauauuuuucugugcuguauuaauucaugcauuccuuuaucaacagauacuuauuaaacacucauaugucaggcauuguucuagggacuagagaucucugccuucaaggagcuuauuuucuagugguauauuuucuguucugugucuuagcuauccacuuuuuucaucugccuggacacgugacuuauucugucucugggccucugguaugagugcucauuucauucugccuuauaacuccuauuuucuucccuacuuuaucugaccuuccuaccuuagcuuguucauucuuuccuucaauccaguugucaugaaaucucuuucuuuccucuacuaauuuuuuuuuucuuucuuucuuucugaguaaaagccagagaucuggcccccugcuuaccucucugaauucuucacuuacuucugacaacuugcucauuucacuccagcuacauugaccuccuugccuuuguuguguuuugaaaacaccggcgugguccuaccgcaggaauuuuguacuuacuguuccuuuugccacauucaucauucauauguucaugucuuccccaucgcuuccuucaaguuuuugcucaguugucaucuuuuuacugaguguccuuccugaccucucccuacuuuaaaauguuaugcuuuuuucuacuaccucuccuguuccucauuccuaccuuauuuuucuggauaacacuuauugccuucuaaauuguaucguauaauuuacuucuuuguuucuucuccguugucacacuagcauauaaauucagugaagguagagauucuuuuacugcugacaaaagcaucuaggacauuuccuggcacugauaaggaucugcauaaauauuuguugagugaaugaaucuccuugguaaaguccuuuuuuguuugccuguuauauuuauugaauagacuucuuuguuucauguacuuuaauuucaaaagugaauggcuggaacauuuuauauauuuucuuauaaaucauuuucauugcuuuuuaagcuuaucacauauuuuguuuuauaaauauguagccuucgugagauaaaagauucuccaucccuguuuacguguauacuuagaugacaacucuaauggucauaaauaauuccaaccuuauagauaacucaggagaagaugagauuauaaguagacuuuaaaucccauucagaaacccaaggacaauucaaaaggaaaauaaucauuccaaauauaauauucuucuuauucuuaagaaguuguuaguauuuugaauuuugaauuuuuaauacagcucccauagaaaauacuuuaaaaugaacccgguaagacuuccucauuaagacauauagacacauaugcucccacucccguaaucaaauuuggaagucaaauaagcucugaaaaccaaaacauucuuccaaguuuauugcagacucauuugguaguaaaaaccaaucugaccugauguguagcuguuuauagucuuuauuuuuccauuuggugaguccaauuauauauuucgcugaggaaauacuaacguguuugacuacauugugugccccagaccugcuuagaguauuauguaauaugcaguauaggccauauauugccuuuuuaacaucaaaaauacccuaaauucugaaaugcauguagccccaagagauuuguauaaagcauugagggccuguguauuuuuuuuuaauuuacaagugaagccagauucccuagacauuaagugccuaacuuuugguuguuguugcugcugcuguuacuguuuuuucuccagcuucgcaaaccuggguauacuucaugugacaaagaaaaaaguauuugaaacacuggaagcacgaaugacagaggcguguauaaggggcuauaauccuggacucuuggugcacccugaccuugccuauuugcaagcagaagguggaggggaccggcagcugggagguaagcaucauuuuccuggccuugauccuccaagggguccaggcuuugguuuucaucuguaugaauuauauguucaucugcaucccuuccagucucuaccccacacugcugucaccuuuuccuugcucagaaaccuuugauggcauccugcuacuucuaggauaaaaacuauagcuccauagccugucauacaaagcccugcuucucuggccccagcaacuuucagccucaucuccagcccaccuugcauccuccucuugccaucucugcucucugaauaacugaggcauauuuauaccuuuguaugugucuuccuuuaccaaaaacaccccaccguuuccauuucacccucucgaaaaccaaugcagaaaucaagacuuugucuaaagaacaccucuguuuuaccuuccccaacucaccuuauuauaaggcauuuuucuuucuuugggcucugcagacacauuauaaacuauuaucuuuaucauaaaaauuguaugauuuuccauuuucuugccuuuucucaaauuuuuuuuucaaccccauucccugucccaccacaugccccauuucuacuuuuguauuuuguccuuuacucuggccguccagucgucaucugauacucaugugauucaaaaccgauuaucaguuuuccacuaaauauacuccaucuucugauacccagacucaaaaccuucccauccucacugacucccccuccucgccugugcugcgaggcugugguccagccauuccgugcucucuggcauuccacacuacauuccauuuucauuguuccacuuauaguagucuucucccuggucucugucccuccccacuucuaaucaaguuuacaucuuguagccagauagauauuacugaaguucuguaucuuguugcugcuccgugucuccguuuugccuacaaaauccaaauucuguaaguuggcuuuuuggaucucccaagagcuggccucaggcugcauuuccaaucuauuucccguuuugccccuucaggucaaagucuacuacuugguaggagcaccaugauuucucacuuuccugccuuggcacauucuuucuauuuuugcucucuccucuuccuggaaugccuuuauccacucucuuauaugaauguguucaaauucugccaccuuuucaauauucagagcaaauaccucuucugcuccaaagcccucugaacucucuccuucuuugaaaucccacaucacuucauuuguagcucucuuguaguacuugucucuugaaucacuaccuuuuaugauauuauagcuuaauuaugacuauauccaucagcgugaaaacuccagcaggagggaaggaaacagaugucccugagucauucaguuccuucagaaguuguuuuugaguaccuacuaugugccaggcugucugcuuggcacuguggaaugagcucacucccugugcccaagcagcucuuggaauaauuugcacacuucucaauacagcuggugccuaguaggguuauucaauuccauuccaucacauccugugugccuuuaacucuuacuguagagaggaaagggaaaggugggggaaggacaggagaggagggaggcgaucugauacacggaagagaguuuuuacuguaauccggagaaaaugcaggucuucuuugaugccuuucauauuggaugacauaaaugagacuguuuuuaacacuuuauuagcaauaugaagaguuucaaaagaggaaaaauggguuuuuauuguaaguuuacauuauuugggcuuuauaaaagcauggucuuuuaaauguucacacuucccugggcaugaauggacugugcuguauggcccuagaucgggaaaaagagcuaauccgccaagcagcucugcagcagaccaaggagauggaccucagcguggugcggcucauguuuacagcuuuucuuccggauagcacuggcagcuucacaaggcgccuggaacccgugguaucagacgccaucuaugacaguagugaguacuucacuuccaacagggggcacaccaagaauagacuuccagcccugcccugccauuuacuugcuagcugaguccuggggaagguaacuuaaucacuuuaagccucagcuuuaucaucuguaaaaugugaauaggaaaaucuagcuugaaagguugauguccagguuaaaugagguauuuuaagaggggcucaauacauguaauucuuuuuccuuugauguacauuuuuuagucuuuuacaugaaaugucacaucucaucuuauuuaugaaugucuugcuauaaagauauaugguugauacuuuuagaagggagaauaaucccaauuuucuuuggugguggggggacucuggaaaggaguuuauaaaagacaacuauuauucuuacccauuuucuuucccauauguuacuagcuuuaucaagagagaaacuugaaguuaaaugaaugaguagcauagacagcaugugacuucaaaauccuauuucaagccggguuuggcgucaugcccuguagucucaccuacuugggaggcugaggugggaggauauggaguuucagcccagcaugagcaacauaaugagaccccaucucaaaaaaaaaaauauauauauauauauauguauauauauauuaauuuauaguuccuaggacuuuuuaagaguuuuacaguaaucuucagcauuuaccaugcaacuuucuuguuugauuaugcauaggauugauuagacagguauuuucaaaaagccugcaagcauaguacucagacucauugaaaguuuauagaauuuggccuguguggaaaacucugugcuccaaguacaacaacuaacugaauucucuaauuuaaacaacuuugaagggaagugaaagguuauaaaaugauacagacucauaccgcagaaucaccuuaaaaugcagcuguuggagaaaaaaaaaaaggaagcuuuaugcuauuaccacaagaaaguuuugccucuucaccacacagaauccuaauuuaguuugggaaaaagaaacauaacauccccauuuuccuuaccuguaaaauaaaagguaguaaguaguuuaagaaaacuguacuuuuccuaaaguuuuuaggacucuuguaaauagaauaauagcagaaucauggaaacaaauuuggaauugaagucuugaccucauugaaagcccagaaaucaauuagcuugguacuucccaauacaucagaaaagcucuuucucuuuuugugucagucucucuguguuagagggagaaacaaauaccuguuccuuucuaccucauuuguuuuggugaucauaaaugacccaugcccaagaaguguuccgagaauuucagaagccauucuuguuuuauuuacuuuguuagugaaagcauguauuuaagcuuuguuuuggucaugugugcuaaggggaggguccuaccuaaaggacuggcuuguugagcugaggauuaaucauguuauuuguuguuuuuccccugugaacagaagcccccaaugcauccaacuugaaaauuguaagaauggacaggacagcuggaugugugacuggaggggaggaaauuuaucuucuuugugacaaaguucagaaagguaaauacauucugugaucucugaucucaagaggugugaucuugacacacuacaguucugagugugucugugagucacauuucagcaguggacaagaaacaucccucugcugccacagaaagucuuaaaaagcauuuacguuuuaccucuuccaaauguaaauugucuguguuauuuuuuccuaagucaacuaaaucacuuuuagauuucccauggaaguaaaaagaaauaagaaaaccgugauaauuauaaucagugacuuucaguaucuuuauacauuaaaauuaauaucuguacuuuguuaaacaaaaauaaauaauagcccauucuugacacacauacaaacacacacacagaauaauguuuuacauaguauuaaauuguuuuuauuucuuuugcaaugcuuugauauaacacugagagaacuucucugaacacuuccacagaugugauguuuaagaaaaggaaagaaaacagggaauacagggaaauucucagagcacauuucucucacaauuuucccuuugaggaaagguucuuggcguuuaucuuucauuagauauauuacaacauugauagauuaguaaaagcugaggaaaauguguuauuuucucaaacugcauucuuuuuuuaaauaaaaugauaguuggaaaguguaguauaauaucuauuuacuacagggugagcauuuucaaaguaagcagauaccuaacugaaaauauaaauaaguaaaauaaaucaauaaaagacauguggcuuuuaaaaaaauuaucauaugagauuaaauucucugagguauauagucagaaaaaaaugggaucagauuuuaaaguaaacacauauauacuuuauccaaaaaaauuuacaggccaggcaugguaacucaugccuguaaucccagcacuuugggaggcugaggugggaggauugcuugaacccaggaguuugaggcuguagugagcuauuaucaugcugcuguacuccagccuagaugacagagcgagacccugucucaaaaaaaagaaguuuacacuuucucugccuacacuagugucagccuucuuccaauccacucuguccaaguaauacucauuuccagauuccuggguguacauacugugaguaaacacaaucugaguaccuuuauuuguaaaugagauccuuagucauuaucauuacauuggaauggcuuaguaagaaaugucuuguacuuggcuuaaagaaucucaauaacuagguccaguguaguccuaccugaaggcaaaggagauuguaagauguuuuauccauuccuaguauuucuaaaauucuacuuacauagagauaaaaacuuugaacaaagucaauaguguggcccuuucuaugaaacggaaagugaagccaggaagaugccaaccuaaguuacauugucacauuucuguagaagugaauagaguauuuauaaacaugcugaacauggaguauuuauaaacacacuccaugacuagagugugcaauuuaagcauugcauuuuaauuagaagggaccugauuauuauaguauuuugaccaauuacucaauaugaacuaagagacuauuauagugagacaguuuaauaguguguuaagagccuggacucugaaauuauacugucuauguuaaaauccugguuccuccaaguacuagcuguucagccuuggauaaguacuuaaccucuuuggaccccaguuucucuuuugcaaagugaggauaauaauaguacccaucuacaucacaagguuguggugaggaugaaaucaguuaauauguguauauaugaagcacuuagaauagcaucugccauacauuaauaguaaaacuuauauaaguuaauuauuuuuauguacaucuauauauugaauugcacugccucguuggauucuaauauucuuccaccaucguucguguuucucaggauuggcuuaaggauggagaagcaguaaggucaaagauuaaaagaaaauucaaguuaacuagguaaaucuaguauucugucauugugaaugaaaguuggggcgcauuacugugguaaauaaugaaaaaagucagugauuugugaagauuuuaaaagacugaaccuuuugaucuuguuuuuuaaaaguguaaauagauaguagguagaauauuaaaccaguuuuauuuuucagcauguuuauaaauacuauuuacacuaugugaaauuacacacuucaaugugauuguuugcagaugacauccagauucgauuuuaugaagaggaagaaaaugguggagucugggaaggauuuggagauuuuucccccacagauguucauagacaaguaagugauuuauuauuauuauuaauccuuauuauuuuuagagaugggaucucacucugacacccaggcugcagugcagugguacaaucacagcucacuguaucccccaacuguugggcuugagggauccuccugucucaaccuaccaaauaucugggacuacaggcaugcuaccaugcccagcuaguuucuucaguuuuauuuuuuuuguagagaugaugucuugccaucuugcucaggcucgucuugaacuccuggacuuaagcgauuaucccacauuggccucccaaaaugcugggauuauaggcaugauccauauuacuaucaucauuuuauacuuucugccuuauugaaauuuaguacuuagcuuccaucuauaaaaaagaaaaaucauaaauauuuaacuuccauaaaacaguacuauuuuuaagacucaugcaggucauccaaaaaaguuaccuacuguagaguuaugggcaagguucuguuagaucguuugcucugagauguuggcaagauauuuaauugcugccuaauccccuaacccauaagacagugccccacagguccuuuaaugaaaauguuuuuaaguguucuaccaaaguaauuaugaugagaccuauuuuaugauagcaccuaauuaugauaacaccuuaaaaggguguucuaggagucaucuucuaauugaagcugaugucauccuguuaaaugaagauuucccaauggcaacugauuaaaugaucaguuuaaucauuuaauaacaugauaaugcugagcccccaccuuaauuauuauucuccuauuuacaaguaauugaagaguauucuccuauuuacaaguaauuaucuggauuggaaacaauccagauauucaucaguaaguggccaguuaaauuauggucuguccuuuugaugaaauaucauguaguuauucaaaagaaugaguacucugcgaacuaauauagaaagaucucaguuauacaguguuaaaauauuuuaaaagauggguguagaacaaaguguguguagaaaugauucuauguucaugcauaaagaaauucuggaaggauaccuaagaaauuaauaacaguauuuaccacuggcugguacacuguaggaacugcauggauggggaacaagaaugucaaagagaauaccacuguaugcuuuuuuauauuuuauaagaucuuuaucccugugaauauauuacauagucaaaaaaucaaacugaaaaaugcuuaaaucccuaacauaccaccaagaacuaauguguuaugaugccaauguaagcaauguuuaguuucuucucuucaucacuggccuguagccaucucucucuuuccauacccagucuuucugauguugcucuaaauaaucuuggaggcuuuuaaggcugcuuuggaagagaagaaaguauaugcagugaauuuuauaagcaugauauuuacaacuagaagacauuugaaauagacaaaugaaauaauaaagcuucguaguacauuagcauagcauuguauuuugauuuuacaguagcaauuucauaaaaauguaucgguauagaauucugaguuuggaacuuucuccaggacacgguguuuuuuaguacacugugucuaaacauuggguauaaagaaaagcauaaggaauguguuuaaugaguagcauuacugcaaaaaaaaaaaaaauguaguccuacaccaacaugugguucuucguauccugcaguuugccauugucuucaaaacuccaaaguauaaagauauuaauauuacaaaaccagccucuguguuuguccagcuucggaggaaaucugacuuggaaacuagugaaccaaaaccuuuccucuacuauccugaaaucaaagguaagucaguuguuuaaaaucuuaugcucauauuuuauuuuauuuuauuuuugguuuuuguuuuguuuuguuuuguuuugagacagagucugacucuguugcccaggcuggagugcaauggugcaaucauagcucacugcaacuucgaacuccuggccucaaacaguucuccugccccagcaucucaaauagcugggacuacaggugugcgccaccaugccgggcuaauuuuuuuuuuuuuuuacuuuuaauagaaaugaggacuuccuacauuguccaggcuggccuuaaacuccuggccuuaagcaguccuccggccuuggccucccaaagugcugggauuacaggcuugagcugccaugucuugccauugugcuuguucugagaagaggacaagcuaauuagaaaagaucaguuagucaccuccuuugaacagcuuucuaguaacaggucccuggauccauggugcuuauuuuuagaagagacaguaguauauuauuuugaggucauggaauuagucuagcuuuuuaaaauaauguuauuuccaccaagcuuauaugagauuuagacauugagaauuugucuuugaauuugagaaucuaacauuuauugacuaacucagaguucaagcagcugagaugaaaaaaucaggcuugcuguuuaggagaaucagccaguuagucaaccagccucaggcgguggaacagaaaacuuggccaacaugcacugugaaacuaugaaaaugaguaaggcaucauucuuucucucacaaaagaugcuuuaagaaagggcacucauagguuucuuaaauaguuauaauguaaauuaugauuuuaauaaguaccgaaagugaagcauccauaaaaauauaagagaauguugaagagagagcccuuggucccuuuauucuaaagcagccuccaaaaagaaggcuucgucaaggagauaucauuuggcccucagcauuugggguauauuucagcaguuggguguuaaacagagaaggagaggguucucuagguuuaaguuacuugaggagcuuaaagagagagguaaacacagcguuuaugcagagggaaaaaaguguucugagcgcucggauggacaugaaggccaauguggguaaggaaggccagggccaggcuaaagagggcugugaauggcagcuuaagaauuuugcauuaauucuggagagggauagccgggccugccuagguuuggaaugauggcucugacuucuuuaugucaccacugaggguaccauuuaggaggcagaugaugagucagaagaguaaugcaagaauccaagugagaaacagugcaguuaguaaagguccuagugccaggaaugaaaggagaugguggacuuaagagagagugcagugauacugugauacagugauacugucaagagggccuagaggucggagguguaggagagacggggagucauagaugggucuaagacucccugaccaggaagcuugugaugugguugacuugaugaaaggaacaagggagcaaaaguagauuugggugggaaaagaaggagcucagaguaaaacauguuauauuuuaggucccugugggaaaaucaaguguaaguucuuaguaggcagaucaaaaggcagaacuggaacucaagagaggacagggugagaaauuuagcauuagaaucaucucaaaacgagauauaacaggcaccaacugagucaucauucaaagguauuucuuaaccuagaguccacugacccccaaagagucuguggauagaaauguacuuugauaucaucagcuucuuuuauaauccuguuuuguauuuuacauacugaaaaccaugauucugagaagagauccauagaguucaccagacugcagaaggggcuguggcacaaacaaaauuagaaaccccucaguuggagggaagugagacugggaagggaggucaguaaaaugauugccacggggcacccagauccuugcugagguuggaaaccgcaaaggugcagcagcaacaagccacauggguggguguugucuccugugagagcaagaugugauagguaaucuuugaagagggcuuuccuuuccuagaauucgugcugccacaggaguguuuagaaaacgguucuacaaguucuuguuucuuuucugagguuguggccucuccauuguuuggucagauuuguagugcacucuauauccuggugguuugaaaacauugucagcacaauaacuuuucuuucuucacaugagauuucauacaaaaucccaguguauggacaugguaggcuuugauuaaaauaggggugaagggcccugccagcucggccuuccgagaggcugucccaccucuccuuacuucccuaucaggagcugcuggaggucuuuugaaugcuucugccuacacaaaaugaugugaaaaucacugcuuuaauuuaaacacccuucuuuaaaaguagacacagaagaaaaauauggauaauuuuuuuagacuuucugaggaaaaaaauagauuucuucuccagaaauaugucuucaaauaaugccaguuuuugcuaacacagagaaucaugaagaaagaaaacccagguuaccuguauguguaugaaccuagaaacauucaaagcucagcuugguaucuaggcugccugucucccuuucccagugguaucuaugccucagaaaaguauguuauaguggggguauauucaggugauuacuuuaaugccucguuaucauaguaggaacuauccaaugcagggauuagagaauggggucaccugaaaguucaaaauugcaccuguaugcuucaugcaccuaccuuccaggcugucauugaugaaaagcuucauacaauacaaaguuuaagaacugucuggagaaauacuuacccauugagcucugaaggaaagaauggacaacauauauauauaugaggacaacaaauuacuugauucuauagaaaccuucuggauuauaaaaacucaagauaauaggaccaaggagaaauaaucugaccaggcaauauaacuggucagaaaaguaguaggccauuuagcauuagaguaaguagauagaaauggauccaaacuguacaacccagggaaacauugcauacauuucucagaagucauugaacacacuuuuccuuacccccagucucuguagucauucccuaucucauugccuaauuuuauguucuucauuauuuuuaucaauauguaaaccugucuuaucuauuuauuuaugggucuauugucuuccuaccaccccgaguacaaagaaucuucuuuaggucauagacuaucuagaacaguauaaguugcauagaaaaugcucauuaaauaucuguggacugacuuauugauugaccagccaagcugccauccauccucaucuauaaggcuaguaauauguuggguaucaucagguaagacauuauacauaaauauaaagcaucauacagaaccagcccggagcuuugcauccucuauggucaucaacauuguacuucacaaaaaauuauuggagaugguuggguccaggggagacgaucgaaauaaucaagagaaggaugauuggcagaggaggaagauaguugaggaacugcuguacaaaagcaaaaaaaaauaaaaaaaaaauaaaagagaccauaaugauuuuucagucugaaagauggagauuagggauaaauaaucuuuaaauuaugaaagguauggccaagauaaaugcagucaccuuuacugguaaacuaaaaccugaaaagugagaaugagguacuuuuaaggcacaugcacagaaauagguagcaaacacuaggagauuauccauauuugugaauugaacuauuaucuaaagucaucaacuguuauguaaagucauugauuauuaaagucacugguuauuauuauacaaagcuauuuuggaguguuuucaaaagaaugacagccuaacauaaugaaaacaucagugcacuuugagacugaucuugacuccauugugaccucagauaagucaccuaaccccuccuagcuucaguuuccucuccugcaaaaggagaacuuguaguaaguggcugcuuugguuccuucuaaaauagguugauguuucauaguacaucccauggugccauugucaaaagcagaccgcaaggauaaaugaucccuugaauauggagugugaaagucuccauauucaauucuguggagauucaaacagcagguucuuuuauaaagcuuauguggaauguucuguaucaguuucuugucauuggaaucuuacuagcuguguuauaauuaauauuuugcccuuaaaauucccauuuuacagugaaauacagccaauaaauaucucucugcuuuaaaagguaaaaugaauacauagaaaauacuaacuagucucuuugcuggaauccaugucaauagauaacauuuauuucugaagauaaauaaguugccugcuucccucuuguguuucauaugucugcagugaacaguaaugaguauagcuguaaauuaguuaagauagaaccgauggggaaauuauaaaucugaaucuaaaacauauuugauaaguaagucaaaguuucuccacuuaaaggucauccccuucuaguggaagcauauuuuucucaaaauuuggcaaccuugguuuuuuuuuuuuccugggaagucuggagaugcucagcuuuuaaacaacuauuaaaguguacuuuguuacccugcuuuccccugcuucaucuuucaacugcaguuagaugaucaugagauaaucaguaaacagagaccuucuaucuagcccuaagaugacugaaacaaccacagaauuagaaauaaucgaaguucuuucugaacauaagcaugacaaaacugacauugaagaaucagaaauagaauaauuguuaaggguucagcacuaaucaaaaaaaagaauaccucauugacuguauuuaauuugaaaaaacgaaauaaaaccuccuuaacugcuccagcccaaaaaaagagaagaaagguauaugauagaaaaagaagagaaagaaaaggaaacagaaaggagaaacaagaacacaguaacaccacauaggcaguaacggaacucaaaagggcauuggggcuggugagaagcacagauagcgagaaacagaaagaugaaaacaaaacaaaaagaaaagcaaucagaagucucagagggcaucacuguauuguagucaaauaguggucuuagacuuuuagccccaguaucucaucagucaccagagguuacagaucccuugguuacuguuuuucuggcauccaccccauuuuuauuauccuggugaccacuaaggaaugggccuccaucacuuauguccgcauugucucugccucucacuuuaacucuuuaguaugucccacacacacguaaaagaugaacuuccuaaaauaccauccccuacacauuauuucccuguucaaaaacauucagcagcuuucuugccuguaaguucauucuccgggugcuccgcaguguugucccaaacaguuccauuucucaggaauuccuuauacagucauagcuuguuucuuuauauuuugcaaauacugugauuuuuacaaauugaagguuuguggcaauagugucaagaaagucuauuggugccauuuuucccacagcauguacucacuuuaugucucugugucacauuuugguaauucucucaauacucgaaacuuuuccaugauuauuauauccauuauggugaucugugaacagugaucuuugauguuuuggggguaccacaagaaguguccauguaagaugacaaacuuaaucgauaaauguucuguguguucugacugcucuacugacuggcaauuccuccaucucucucccucuccucaggcuucccuauucccuaucacacaaccauauggaaauuaggccaauuaauaaccuuacaguggccuccaaguguucaagugaaaggaaaagucacaccucucacuugaaaucaaaagccaaaaaugauuaagcuuagugaggaaggcaugucaaaagcugagauaagcccaaagcuaggccucuugugccaguuagccaagguuuuaguggucugaguagaagauuaaaccagccacaacauucccuuuuaccaaagccuaauccagagaaaggccuuaacucucuucaauucuaugauggcuuagagaggugaggaggcugcagaaaaaaaguuggaagcuagcagagguugguucaugagguuuaaaaaagaagccaucucgauaacguaaaagugcaaggugaagcaacaaaugcuaacagagaagcugcagcaaguuauccaggagaucuaguucagaaaauugaugaagguggccacaccaaacagauuuucaguguacaagaaacaaccuuccauuggaagaagaugccaucuaggacuuucauaacuagagagaagauguagaaaugccuggcuucaaagcuuuuaaaaacaggcugacucucaggagguugaggugggaggaucacuugaacacagaaggucgaggcugcagugagcuauaauugcaccacugcacuccagccugggcaacagagugagacccuggcucaaaaaaaaaaaaaaaaaaggcagacuuucucauuaggaguuaaugcagcuggugacuuuaaauugaagccagugcucauuuaucauucugaaaauccuagagcucuuaagaauuaugccaaaucuucucugccuuugcucuguaaauggaacaagaaaaccuggaugacagcacaucugucuacagcaugguuuacugaauauuuuuaaacccacuguugagaccuacugcucugagaaaaaagaaaaaaaaaggauuccuuucaaaaugguagugcucauugacaauacaccuagucacccaagagcucugaaggagaucuuuucauggcuacuaacagccauucugcagcccauggaucaaaaaguaauuuugacuuucagucuuauuguuuaagaaauacauucuguaaggcuguagcugccguagauagugauuacucugaugaaucugggcaaaguaaauugaaaacccuguggaaaggauuuaccauuaaccacauuugugauucauggaaggaggucaaaauaucuacauuaauaagaauuuggaagaaauugauuccagcccucgugggugacauugagggguucaaggcuucagugaaggaaguaacagcagaugugguggaaauagcaagagaaugagagugagaaguagagccugaagaugagacugaacugcugcucaugauuuaacuuucaugguugaggaauugcuucuuauggaugagcaaagaaaguaguuucuugagauagaaucuacuccuggagaagaugcugugaacauucuugaaaugacaauaauuuagaauauuccauaaacuuaguaaagcagcagcaguguuugagagaauugacccuaguguggaaagaaguuaaaacuguggauaaaauguuaucaaaacagcauuguauacuauagagaaaucuuuugugaaaggaagagugaauugacaaauuucauuuuugucuuauuuuuaaaaauugccacaaccacccagccuucaguagccaccacccuuaucagucagcagccaucaacauugaggcaagaccuuccaccaguacaaagauuacaaccugcuguaggcuuaggugaucauuagccuguuuuagcaauaaaguguuuuuaauuaagauauguacauugcuuuuuaagacauucuguugcacacuuaauagccuauaguauaguguaaacauaauuuuuuuguguacugggaaaccaaaaacaucaugugacuugguuuguugcaguaauguggaauugaaccuuucaauaucucagaggcaugccuguacuaaacuuucacuucagccaaacuuaucuacuccuguucucaaaagcacccuguguacaucuucuuuuuccucuucuuauauaaaacugauucugagaagccuuuccugaauuucccaucccucagugaacuccuaaaagguuuuccccaaacuccuagaacacugaucugcaccaugaauuuaauguauguccuguuauagugcugucucacuaagucuuucccccacuaucuuaaaauuauguuggaggguucuuggcagcaaagacauuaugucaugcuuuuuuuuauuuccagcauuuagcucauuguagaugcauaauaaauguuaacuuuuuaacaugaguuauuuugugugaccaagcaaaagggucaauaauuuuuuaauucagcaucuucaggaucuuuuugauggauaaucaaauauuucacuaguuuuaacaacacuggggacuuaagaaacuguuguagaguggauuuggguguguacugcucuguggucucucuggagcuaacuuucagccuucauacccauuggaauaaauauaacgcuucuugaaauuuaccaucucuuccucuuugagugcuuucuauuucccuuuaagauguuuaaaaauaccauuagaaucaguggucuuucuguggcuaguggugggaccaaaucaaucuuuucuccucugguuucucuuccuuuaaauacagauaaagaagaagugcagaggaaacgucagaagcucaugcccaauuuuucggauaguuucggcggugguaguggugcuggagcuggaggcggaggcauguuugguaguggcgguggaggagggggcacuggaaguacagguccagguacaaaaauacuuauucuuccuaaaacuuuuucauauuggagaggguagaauuuucuuuucuuugguuucugagcaugucugugaguugaguggcuaugauauuauugaguauauuaauuaaaauuuccugacaaauguaaauuuauuuuucaaagaaauccauguucauuuuacaauauguagguaaucucaaaagucauuaagaagaaaaaaaaguaccccaaagccaguuauuuaaugaauaccuuccuaaagauuuugguauauuucucuuuuacauuuuuugacauaguugucuuguuuuuguuuggaaacauugaaaagauuguauauuaucauacuacaauauagcuauauauuaaacaucucuauauacuacauuguagaaacuuugaaaauacauaaaaucugccaucaaagguuaacuacuacuauuuuuauguauauguuauaguauauauuuguaaauuuuacccugaauacagcugugaucaucauuaugcauuuuauuuuaauccauuuauuugcaauacuauuuuacuaucauuugcaccaugacuguguguauagagucauaggugcaacguuuaccugagauguuaacauaaacauuuccuccaguaauaugaacuuuaagcauaaauuuuaagcaucauuuuaaugacucauuuccucaagugaacaaaccauaguauaacuuacuuacauguaguuuccuguuuucuauauaaaaugcuauacugaaccucuguccaccuaacuuuucacuuauuccagauuacuuuuguaaauuagagucuuuguaguaaaauuacuacgucagagggcaugacaucuaaugccaucuguuuucccaaagaguuguaccaguuuaugcuuccaccaaaaaugccuaagaaugaacagugguggccauuuuuccauugaggagucaguauguuuuucugugcuuuguuugauuaaguuuuuuuccucaagggguuauuuuaaugucuucuacauaggcaagucugaguuugguuggugacccucacuauuagccucuccccuucacauaggagugaaggcuuucuccauuacaaccccuccccaaaucuggggugcugucagaguugccaacauguaaacuuuaccaaaguggaauucugauagucccaugacccccaccaugugucuuagucccaacagaaaaaccaugugugggcacaauacuguccugucacaccaaaggcugugcucaccugagagacagacacuaaguugugcugagucuuuguaaaauaucuucaugauguuucauuuguuuuacuugccguuucaggguauagcuucccacacuauggauuuccuacuuauggugggauuacuuuccauccuggaacuacuaaaucuaaugcugggaugaagcaugguaaguaaugcuuuguucuuaauaccaagaaaggaaaaaaauaauuaaugcuaaaaaggguuuuuaaaaucauuacuuaucacaacaguauuaucaucuugacaaauaauugaugaaugcaaauaaacuaagaagauacuuuucccaaaagauauuauuuccuguggcuaguauaaacucuauuacuuuuauauauuuuauauauuuacuuuguaaguggcaugaacagaggaaagaaaagagcauugaaaagagacaacagagaccugacuauucaaauauuuuaaacaucaucaaacuuaauguauucugucucuuuuuuucucaaauaguacacuucugaaaucauuuugaguuuuauaggaucggucuuuucccaucaagucauccccugagaagcugcaguuaaaccacauguugauaguuuauauuacagguccauucuaguguacccauggaagaaauaauacuauaaagaagucuucccauuuauugaauaccuauuuuugugccaagugcuuuuacauguuuuaacuguuaucuucaugacugcucuauauggaaaauaguaacuccauuuugcacacaaaaggcaucaaaguucagaaauguucguacucacugaaggcacacagaaguuaguggcagaacaagaauuugaagcaggucuccugcagaaaagcuagaugcucucauaguaucugucagauaacauaguugaaccugaaagagggugaucaggaaugguacacuggauaacucccacacuaaagaaugugagucgacaacacgucuuuaugauuugcuuuguucauuagcauuaggaaaaaacugcucuguuuucaagaacuuuaaaaauucagcuuuccugcaauucauagaagagcuuuauuucauuuuucuccuuuacaaauaagcaaaaugagauuuaagauuuuagaaguauacuaaaaaugauuuuuagaaaugaguuuagaauaucuccaaaacaugguauuuaugauaugaccauuuuuaaaagaauuuuaaauuauuauuuuucuuuuccuuuugcagcaaacuugucucuuaccuuuaucugaccuacauuggaauagcgaauuaucacuaaauacauuuuacugagaaaaaucugauguuuuugcauuuaucuuaggaaccauggacacugaaucuaaaaaggacccugaagguugugacaaaagugaugacaaaaacacuguaaaccucuuugggaaaguuauugaaaccacagagcaagaucaggagcccagcgaggccaccguugggaauggugaggucacucuaacguaugcaacaggaacaaaagaagagagugcuggaguucaggguaagugagcacacaaauuacguucuguugguuggcuggggaggggucaguccuaggugcagaaagauaucugcuaaucuaaagaugauauaucaauaucuaguuuaguguacucuucaaaguucuguaugccuuuggaaaagcauaugucagaucauuuuauucacacugggauuuccauuuuugcucuguuaucuuugaauguaaaggacagaaauuuauauguacauucuccagucauaaucaugcaguuuuaggguauugugagagauaaucaacuucuuuucuggcacagauaaauagagaaguauuuccacaagcuuaauagucacccugucuagauucuggcuuaaccgucauacugaaauagaacuuugccuuaaaauaggaacuuuucuuuuuaucuugugcccucuuugaagaaguaggauuaggagaaaauguacuuuugcguuuacugugaaccaauacuuauuagcauaugugucaugauucuaggucauccuagaucguacuaagaagacgucuauaaaagcaaagguaguaaauauuuagaguugguggccacauguggugucuaucacauaugcuuuuuuuuuacaccccuuuaaaaauguauaagccaugauuagcuagggagcuauaugaaaagcaggccauaaacagguuuuggcccaaaggucacaaaugccauucccugaccuuaauggaacaaacuuuacaaaaacgugaguggcucauugaacgucucuguuuauggcagagauguguguuuuuucacacauugccuaacaagcuaauuguuagagauuccaaugaaggauuauuucaccaagauauuggugauuuaaaaucaugguaaaaucuaacauuguuuggagauuguuuuccuuaaaauaacagauaauggucguucccuuaaaauaauacauuucuaaacuuuuuuccucuaacaaaucauacacagauucuuuaagaucaaucucuaacuauauuugucagugacccaguguccaauucugcuuuuucuaguccacacaauccaaaagcauugaaagaacauuuucaacuaaaaugauaugucaaggugucagaacacugaugcuggucaguuuguccuuaagcaugccauacccauaaaacaaaaguaggaacacucaacuaugauuguggucauugccuuacagauaaccucuuucuagagaaggcuaugcagcuugcaaagaggcaugccaaugcccuuuucgacuacgcggugacaggagacgugaagaugcugcuggccguccagcgccaucucacugcugugcaggaugagaauggggacagguaagucagaacuuuugcaugauagguuguccuggguggggaagaagaagagcaucguauaaugcauacugacuagagauaaaaauaauuguucaaauauauugaguccucuaacuggaaugaugaagaaaaauaaugugugaauaagguuaaguagcacaauuugcugcuccauccugcugcugucaucuguuggaaucuguaguagcuggaggacucaucuaagagugaaucucucugggcaagaaaacuaagauguguguagguaaugguacuuuuugaaaagccuugcuuuguuuauugaaguaauauuuggagaauuguuaagaguccuaccaaaucccugaagcauuguuaucccagcugcauauuuaugacaguguacucaagaaaaagcccaauaaaggcagcaacaacaacagaaagauuaagagggacuggucauuauuucccaguuacugguuucuucucugcucccucuucugauggucaucagucuaugacuguuucagacuuuugugacugcuccagcccauaugugggaguggaacauuccaaacaccaugccuuccauucuugcuauuacugagauuguauuugcaaagccaccuggcuucuuucuaaaacaguucucuuaguccuuucauugagacuucuaaaaugaucucaaaagccuauaaaaauaacaagagacagcagccuucacauucaagucaagugccuuaucuaaaaccuuccuaaaauagcaucaacauagagaaauccuuuucuguggaagagcucuugagugcuguguuuuagacuucaguuuaaaaauuaaaccaagcacuuuaggaaaguaacaaccucaggguuucaagcagagacaccuuuguucucauuccuugcaacguaaccaaggaugugguauaaccacuggccuuguuauacaguaugagaggaaccaguacaaccuucuugguauaaagccaugaacagcagaauucuuuuucaggguuaaauaauccaguuagcauucaguagcauacaaccacaagaaaaagcaguuaaccaagacaguacagcaguguuucaaguggcauuuccagggaccuguuaaauugauaagucuaagaagaugagcacauacagguuagaaaggaagugcugauaucugaagggaggauuguuggaagggauacaaggcgaggcacaugcaaguucccuccuaagacccaagcacacucacacaagccggcucucagagaggccacagauuugggacuuggagagaccagaggauccucauaagagcauagguauagggcagcuuuuggccaucacagcccaagucucuuguuuuaauucagcucgucauauuuggcuaauaguuuaaauccuguggccauuagucaucauagaaaauauaauaaagaaaaauauauaaaacuucugcuauuggggaaauucccauaagggugugaggauuugagggggagggggaauguacuucugcuaugaaaugcugagcggcacauggaaauuuucgagcaguuuuagaaguaugaccuuuuucuugguguaugugcaucaugucuaugucagaguuuaggcccuuuucagaagucuucuuccaguaucacauuucaagaagcaauagugaaacccugagaucauccguuuuaaaauauuucucaaguagcaaaaucacaauuuaguuuuuuaggcucuucugugccggaguuaaucccaaguacgauauacuugcuauugcuaaggaagaggcuugaguaaaguggcaccugauagcuuauuuuagagaagauccagccuguaccucgugucccagauguagugcugcugcgagaugcuuuagugugcucugcaccucaaucuguccaugcucuggaguggucaucuucuuagacauucaucugaaugucuuuagaacagugcacauguauccccuaugcaggauugcuuaagggauuaagagauggcuuuggaguaagacaggccugggcuugaaucccagcuucaccacguauuggccuugacugaguuauaugacgccugcaagucucaguuucauuagcugaaaagugaagauaauauuaccuaacucauaggauuauuguuauaguaaaaagacaauauauaucaaaugcuuagcauagucugguaaaucaaagcucccaacaaauaguagccacugguaaaaugauuguuauuguuauuguuuugaauuuuaauaguauguuuuuuaauaauuaaaagaauuacgcuccugugagugacuuugacaccaccaguauguucagccucauuagcguaagcucuuaaguuccuucuaucauucuuauuuuugugccucuacugcaugcuaggguuguaaggcugacucagacagaaccugccccagagaugacaggacagagaacgagaaaaauguguagaaaacugcaguugcauaaccaagcaguaaauuugagagggacaacuugcuccaccuaggagguuaggaaaguauucucugaggaugucagguuugaacuggaauauaaaggauggaguaggcauuguucaggcagaagaaaggagcaaaaacauuccaggcagagggaauauuugcuggaauguuugcaggaguggugggaaauacaaucacuuuguuucuucacaaguuuacugcaagaauuuucuuccaguaguuaaaagcuucacuccauucuccacucuugggaucuggaaagaucuuuaaaaaaccaccacacuguauuuuggaggagggcagcagggcuaagugagguaacuaaguuuuucugaacaauuccuagugccaggcauucauuuuacauagaaucugugugucaggaaaagucagggggaaagguagagaagaaaaccgcccaaagccaugguauagaggcaggauugggauuuaagcuuaggucuuucugggcuggaagccucaguguguuuauacaucaaggggucaagaccugaaugcucccagaggccaggaagguaccacaaauaacguagcagccuuggguaggcaguugggagggaccaguccucuggagacagcaucccaccucagauucaaugcauuuuauagauucaaaacauuuuagggccaaauaaaacuagguaugagagcagauuccauucuugagucuaaucacaucuugggaaucuuuucuuuuucauuaacauuuuaguuaauuauugccacuguguuuucauuccagugucuuacacuuagcaaucauccaccuucauucucaacuugugagggaucuacuagaagucacaucugguuugauuucugaugacauuaucaacaugagaaaugaucuguaccagguaagcagaaaucucaagaaaacaacugaagaaaaaucuguaguuuacuuuuucuucuguuauguuugggugcauguuauuuuuaguaauguuaacaguagcaaaaacaaaaacaaaccuuuguagguaauaucuaaaaucccauuaguugagaauguuacuuuaugauguaggauccuuugaucuguggguauaacagccaucaagccacaaugaaauucagcaucccgcugggggaaggcaaacuuuaaacuuuagaaaucaaacaguuuuuucauuuaagagggagaaacuaaaguaaaaaugucacaucugucaagaaaaauaaaguuaaaaaaaguuugaaaagccaguaauuuauaauaauuuugaagucuacugaaacauaccuugacaacauccagauuaaauguauaucaaaugaagcauucugaaaucaccacacagaaagguuaaaaguuugcuugaggaggaaaaggugucuuucaaaagcagaaagacagcuccaagugaggaaaagugggaacaccagaguuuugcccaaaucagguuuucuuaggaauuaauuaggugggcugaaaauacaaguugaggaacuguuuuuuccagaggucuuccaacacugcaaagggagaguuagcuggagacacagcgaggcccuuugaugggcauaugcagaauucagggagaggcaaggagccugggagccacuucggcagaagcagagcuuggacguuggugaugggagcccagugaccccagccagccuuucuggcugagcgacugcacuggcaugaaaccaagaugggguucggcuccugagguuuccuccuuccugccccugauugcuuuucccaccucacugucuuuccccuacucccaccagucugcuguauggggcuccugcccuugcccacuucuuaccuuuccauuugucuccuucccuucaucgacccgaagcaucuuccucauccuccuuggagagaugguuugcugguucacguguaucucucacuccaaaacuauggccaaaauccuguguaauuauuuacuuaguaaagauauuuguuccugcucucucaguuuuuauagcagugaugugaaucauuucuauuuccucacuuuaaaggaaaaugcuuuuauuauuuuaaagaaaauuaauuaaaacuucauuuucuuuaaaggaaauuaaaauaucuauuuucuuauuuuuauuuccauucuuuaaaaugugcuuuaggcugggugcgguggcucacaccuauaaucccagcacuuugggaggccgaggcaggcggaucaugagaucaggagaucgagaucauccuggcuaacauggugaaaccccgucucuacuagaaauacaaaaaaaaaaaaaaaauuagccaggcaugguggcaggcgccuguagucccagcuacucgggaggcugaggcaggagaauggugugaaccuggaggcugagcuugcaaugaggcgagaucgcgccacugcacuccagccugggugacagagugacgcucugucucaaaaaaaaaaaaaaaagugugcuuuaaagugcauuuaaagcaaaacuacuaaaacguuuacauguggcucuuaauaguuuuuaccugugacuagguaaaaauuaauagguuuccugauaggggaaaaugaccauuuuucauucaauauaagucaccauuaggcuucuucacuggcucuugugcuucuugucaaaggaaaaguaaaguuagugacucuucacugccuguuaauauaaaauaacuaguaugaagugugauuguagauuuacauuuaaaggaugucuucuugaaacuuucauaccguuuuggggucauugguauccguaaggucauuuugccuguaaagcuugauucucgcagacuuuuggcugauuguuccuuguagucaucacaaaucuaugaauaaaaccaggaaugggacauuguagcuugucaguccucuuuucaaacccugcuuaacagucauauucaaggaauuacuuauuuuauguuuauaaauaggaucugcaaaggacacagcacaacaggauuaguagcugugauuuuuuuuuggagacagagucucacucugucacccagacuggaaugcaguggcgcgaucucggcucacugcaaccuccaccucccagguucaagcgauucuucugccucagccuccugaguagcugggauuacaggcgugcaccaccacacccagcuaauuuuuguauuuuuaguagagaugggguuucaccauguuggucuggcuggucuugaacuccugaucucguaaucugccagccucggccucccaaagugcugggauuacaggcaugagccacugcgucuggccaguagcuaugauuuuuuuuuuauauccuaaacucuuuacuguaucauuugguuacauauguugagacucuccaguguguuagagacaaaaacccugaaaccgccaccauugauacuucuaucccuucugauuuggggacucucagaagacuauacguccauuuuuccccuaccuuaccaccagucugauuaaugggcagugauucuggcuucccuaguaugccuucuaggugucaaacacacacccaauggcaacuuugauuugagaauuagaaacugcuaagauuugaacucuugauuaucuguuguaaagguucucuaguaacuauucuuaauggaaaaugauacaguucucuaaauaauuuggauuauuugacaguuaagcauucuucccaaauaccuuucacuaaucuaaguacauuucugugaccaucugucaugaucaaauuccucuccccacccacccucuagaaacacacucaaaauaguccaagugcaccgaguuaggauuuuuuaugaaaauauucucuuuaagccuuuuucuccuuucauucuccuucccccaacauagacaaccacucuaucguguuugguauggauuguuuuauuuguguauguucccauaaaacauuauuggaggguuuuauguauuuuuauguuuuuaauuauuauacauaucauguauauucauaguuuuaaaaaugguacagaagaaucuacauuggaaagucaaaguugcccacccugacaaugcccaggucugcuagcacaaaugucacuauuguguuuauagguaguuuuucaaguacuggauacaaauguacguauacuugaaauacauagauauuuucauauacucucacauacaauccacauuauauuaaauguacuucucuugccuugcauuaaccuuuaaaauuuuuuuaauuuaauuuaauuauagauucaaaggagguuacaaaaacguacuaggaaguccuaguauuuacugcaaggaaaccagaggucucuucacccaguuucccccaaugguaacauccugcauaaccucagaacagugucaaaaccuggaaauagacguugauacaauccacagaucuuaaucagauuucaccaguuuuacacacacuuguguguaucuguauaguucuuugugcauauauuuuuuaaaugccuaaguggcauugugcuacauguuacuguauuucugccuucacugcuuauccacacaguucuacauauagcuaguuuguuguuucagcuccugaagagaaucuaguaugggucuuucaccuauaacauccuuguuuccuaguaguagacauuuaaccaacuucuaacuuccuaccucaguagauaauacugcagugacuguccucacuuauguccucuuguggauuugugucagaauuucacccagauacaucugcaagaguuggguugcugggacauuuguauauuuggcuuuccagaaugucuguguaaguccccaugcccacagccauagcaugaagguauaauuguuuaagauauaauccuuggauuuaagaacuagaagguuuauaucauggaaaaccauugauuggacuguggaagaaaauauuaaaaaaaaaaaaccucuccgacucauaagauauuuuuuaauuaaauucaagcuacagauaauuuauaauuccugaaugguauacuaucuuauaauuucagauccuuuuuucacaaucucauucucuuuccuuuucccaucuccccaaguagcauuucagaaaacacagauuaguaaacacaguuuccauugacuuauuuuugagaagaaggcucuuggcaacaauaucuaaaguuuugaggacaucacuucauuucaggccagguugauaguccuagaaaaugaaagaaauaagggcaaguaauaauuuggcaaaaaaaaagggucuuguauaguaaauaaucacuguaguugagauuuagacuacccucccaucauucauccugccaguuaucaugugcuguggucaccuacacagcuaggagguugguggcucaccugcugcuguagccaguaacugcucaaugaaaagggaauuuuaggcaaauugucacaagacuggcuggaugucauaguuaggcuccugugaaauaaacugauuuguauaaagauacauugcuguucucugucagugaacucaguuauuugaaagauacguuugugauuguauuugucuuacucauuuuugaaaacacacaguuugcaaaacaucuuauuugcauucaccgaaguaauaccuugugggcaggauagucaaauggacuauuuaaguaccuauuagguaucagcagcucaccuuuuuuauucagcugagcccccuuggugagauacuuguauuauccugguuauguuauuuagaaucuuauaauaccuuuuaugaaauggguguaggaaagcuauauugacuggucucaggagccaguccaugggacaguauuuuuuaauuuaguaaauuuaguuuccaugucagcauagaaucauggcacuuuuguuaauugguuucuauugaguacuuuauuuaaauuucuucagugaaaacauagccuuaauuugauuuguuaauauaaaauuaucagcuggagguaacuccuaccagauauuuaagaaaacuaaauuuacuacuaggugugcucaaaaucaacaaucaguggguuguagugagaaacaagaagcuauuaagacuuguaaauaugaaaauaacccaccacagaaaaaauuguaaguauaugaagugauggauuuguaacuuagccugauuuaaucauuuuauguuguaaacuuagauuaaaacaucacauuguaccucauaaauauauacaauuacuauuugucaauuaaauuuaagauaaauaagaauuuuaaaacaugaauuauugaauggcuaaguguuaguacaguauauguacuucauuagcauauaguauggaacaggauaacuugggugccaaggucagaaguuaaucugggaaugagaaauauuccugcaguauggccccaccuauugcaguaacagcuaccaagcugugaguuguaaguaaguauucacugcugaccagugaaucuccugcccuuucacuuuccagacgcccuugcacuuggcagugaucacuaagcaggaagaugugguggaggauuugcugagggcuggggccgaccugagccuucuggaccgcuuggguaacucuguuuugcaccuagcugccaaagaaggacaugauaaaguucucaguaucuuacucaagcacaaaaaggcagcacuacuucuugaccaccccaacggggacgguaagagacaaucacacaucauugguguaacuuucuccaccuucuaaauaucuacuagguauuugauaaacguguguuauuugauuugcacccaaaagugcuuuccuuagucaccuggaguucaucaucucuuuugggcauuucuguugcucaccaaagcuaauuuuuuuaaagaugauuuggaauaguuaguaggaggagaaagcagaggccugaguaaagauucaucuugaaguacacaaagcgucguuuauucagagaauguuuauuuauguucaugucuccugagaacauaauaggagacugugggucuucaaagcagaacaauagacuuauaguaucuuuacugucccuccccaugauucaguuuuugccauuuccuucagcuucacaagggccaucuugugaguuagccaucccauccugugacugucccuuugcuuggacucuaggucugaaugccauucaucuagccaugaugagcaauagccugccauguuugcugcugcugguggccgcuggggcugacgucaaugcucaggagcagaaguccgggcgcacagcacugcaccuggcuguggagcacgacaacaucucauuggcaggcugccugcuccuggaggugaagggcacacuuauuugcuuuugcauuaaauuucugagggagauuuaaggaaaucuuuucaaagaaggaagucaguagcugcuguucucccuuacaaucagcucuauuuguuuaacauuuauggagggcuucagaguaccaccuuuagacauucccccaacccccuugcuuggcaucucuaacuggggauuucuucaaugacagagccagcccaaaguagcaauugggcuaguaauaggacccaaggagccaugcacacugggagguggggacaaaagggcaaaagaaccuuccacuaacgcuuucuugugugggcuggauuguagggugaugcccauguggacaguacuaccuacgauggaaccacaccccugcauauagcagcugggagaggguccaccaggcuggcagcucuucucaaagcagcagguaagauggugaucuggcggucauuaaugaaaaauguuaccaggaaugcaaacccaacuucaauagagcagucauguugccuucuuuaagccacagaccuacugcugaaaaacaaggguaaauaaaaauuauauggcaaaucacauuuuaucugccauaaggcacuguuuggacuaguaaucuugggcuuuacccugauagucauuuuaguuuuuacuuucugauucaucuguuuguuugggguuugauuguuuagauugacucccaugacaaagggucuuuucaaaguagaguuugauuccuuauagaauucugagugguauuagucucagaucauaucagaaggccccagaagaaaaagauuauugguauaagaaaucauuuaaagacuucauuuugaaagaaauaucucuuagaaauugaaguguaggaaaaagaaaaugggccauguauuaagacccauuauguggaaggcacuaaaaauggcuagcacuuauugaccuuucuguguaccaggcacugugauaugcacuuuaugugcacagucucauuuaaugcccaaucaccccuugugacaaauaccauuauuccccaucuuagagucaaggaaacagacuagagagacuaccagaucccacuucaggguuccaguaagugacagagcuaugaaucacacuucggcagugugaacuucaagacuuuauucucuguacuauguuucucucuccuauuuugcucauagguuugcagauguuauuccauuuaauucucuaguccugugaaguauagaaaauuauccaugcugaucuuugaaucuccagugccuugcauauuuagaaccucaaaauauguguaaugaaauuggcaucugaagccugcccugacauaucugauauacuuuagaggcuuuuuuuuuuuuuaacuuaaaagguaaaugcuucauaaauucaagaaaacaaagcaaaagacauaggaacuuuuucuuugggacaccauauuuuucuuuucucuuuuguuaaauagaacuuuuucuugaacaagaaacucugauugcaguggguauuaauaguuuuagaagacacugauuaauuaaaugccuuccaacaagaagcuauaaccagccagacgugauggcucacaccuguaaacucagcacuuugagaggcugaggugggagggucacuugcacuaggagugugagaccaaccagguuaacauuguaagaccucaucuccauuaaaaaauuuaaaaaguagccaggcaugguggcaugcgccuauagucgcagcuaguuuggaggccgagguagaaguaucacuugagccugugaguucaagggugcagugagcuacaguuucaccacugcacuccagccugagcuauagaauaagaauaagacccugucucaaaaaaaaaaaagaaaaagaaagaaacuauaacccuuuuaaaaaugcuuuauauugaauucucagaaucccaugaaaggaaaagcaaguaacaguuucucugauauauaaaugaagaaacucagaugaaaaaccaaguccuaaucuuaaugucguggaaaaggucaguuaaguccgagugugguggcucacaccuguaaucccagcacuuugggaggccaggguggguggaucaccugagacuggcaguucgagacucaccuggccaacaugacgaaaccccaucucuacuaaaaauacaaaacuuagcugggcgugguggcaugcaucuguaaucccagcuacucagaaggcuaaggaaggagaauaacuugagcccuggaggcugagguugcagugagcugagacugcgccauugcacuccagccugggcaacagagcaagacuccaucucaaaaaaaaaaaaaaaaaaaaaaagcgucaguuaagagauagcucaucccuccacacuuugguccuguaaauuguucaucuuaauuucuccauggauuacauuuauugccucauagaucaggccagaacugggagaauaaaaucaagaaacagcaugaagauccuucuuuguuucccauuaaguacuccucuauuauugauauugacccaucugauguucucccagcaagauaaaaacaaguuccucccucaaaaauggcaucauuagacaucaagcuaaacacucauaaaaaucaucuaagccucugagaaguaacucuagcucuagucuuugaguuacuuugauguuuuguuuauuuguuuguuguuuuuguuuuugcuggaugcuaaagagcagacuacauuucccaaaauauuucaauaauuauacauccuaguagguuuguuuauuuaaagaucagaacccuggcauugcuguacccagcaaugaaacuggccaugcugucacuagacaucaagcaucuuugcucuuuugaguguccaagaaaaggggcugagaaauacacauugucaugcauaaauuugaacaguuaggacccuaauccugagggugcacccuaguggcuguaaucaugcuguccaucagcccuaagauuaaagaugcacuauucaguugagaaauauccuguagaguuaaaugugaaagaguauuugaagucuuuuuuucuucaauaguaucuuuggcuauuucaggugucauaagacacuuuaacaaucaaaguaaauuacaauuuuaaaauaauuucucuggauauuccaguagaaauguuuuaugauuuaaaaauuauccaggagauugccucaagcugcuacauugcuuugccuuugggaaucugaccuuugcaggcaguuggaaguugacaagaucuggguuuaccuaaugcuguguaaucuaacuucgcaggagcagauccccugguggagaacuuugagccucucuaugaccuggaugacucuugggaaaaugcaggagaggaugaaggaguugugccuggaaccacgccucuagauauggccaccagcuggcaggugagugccgcuccaucugucugauggcugccccugagggagucagagguucaggaauguaagaacagauggucuuccuggugcuuuauuccccaaagaacaugccuuuuauuuuuaagaaagucuguuugucagagaccauuuuuaucuugaaaaacccuauccaugaaagaucuaggucagcugaguucugaguacgaaaguguaugccuaaucagaucagaguugagaugugagaaaagguuagaagaaaaacacaaaauucacauaaaaguuacccauuccaaauucacaccauaauugugaccaucucaauuucugaagcuaggauaaauguuacuguuugcuuaggacuuagguaagugauuucaggauguaaaaauaaacuaagaauucuucuuagaauuucaauaaauauaaacagaguaaauagauuuaaagccuuccucaaaacuccacagggcugagaucugaagguauaaagcaguuacuaggucauuuggccccaggaagaaaagccagagggaggaggugggcagcaugcaagaucuccaacaugacaagaucaguucuucuagagacgagagcugcuccacuucuaaaacugcucaugugccucccacagccuguauguguccagcucacugacguuagcaugguucucccuuuauguuagcaccucauuuccccagaaggccuugccacagaacacaaaaagaugaugcacucagugaccccacgcucuccuuacccaggucagccagcaacagagugacugcagagaacaccacaaaugccucggcagcuacagaauaauuuuucuuuuagccuaagacaauucuggacccucaguuaaaaugucaguauugccagaggguuaacaccaagccuugugaacaucuagacaucucaauuugagcaaguuuauacaauucauucucauaagcuuguuccuauggaagaagggagacagcuucacagcucugaguaagcucuucacuagccuuaggucucugagcaggagaugauugacaugguggccuggacugccuguuccuuccaaaaggcuauagcucugacucucugcaguuugguuggguauucugacccagcucagaguuugugcaaagcacuauuucccaguaccagagccccuacagcuguucuucccccaaaggguaccauauucuuggagggugguccugauuccucuugccauuccuccaucauuaggguaccaggcccuccuaaggaggacaugcugaguuguuuauuauaaagaaacagacugcccuaguggucccuucgauguauaacgauuucugguguuuuucuuuccaacagguauuugacauauuaaaugggaaaccauaugagccagaguuuacaucugaugauuuacuagcacaagguggguugugauaaaaccagauucucuuaaccauuauuaucuccacacugucauuuaaagggaggaaccagcauuauccagggucuacuguuaaaaguucuuauuucagaaccaaaagaugcuggagguagauaaggagaauauccaguuuuaaucuacuguaaauguauacugccuucuacucagcugggcuuugaccuucaaguagaguagcuugguugguuccacugggaguuggacagcaagccaggcagcaaugaucagucccuccagagugucuauggcauguuagaacaaguguguuccuucuucauuuccuucaggagacaugaaacagcuggcugaagaugugaagcugcagcuguauaaguuacuagaaauuccugauccagacaaaaacugggcuacucuggcgcagaaauuaggucuggggauacuuaauaaugccuuccggcugaguccugcuccuuccaaaacacuuauggacaacuaugagguaacaccuuaccuuacagauuuagcaauuuucauuugacuuuacucuguuaacaucucuggccagggcauaaucuccuucccuuuuccuuaacucugaagaagaaaaccagucauugcccaaggccugggagggugacccaggccaaguuggcagcccaucuuccugagaaugcuguuuucagauaccuucagauuuuccccguuuucaaauaccuggagacuuccugugaaaaugcuacguagagggucaggauuuucacagaacuuuaacggcccugagcaaacaaucgacuguaaucaacguguagcuuccuguccccaagaacacaccuuaccccauggcagggcauugagucauguucugugaggugacuccuaguggagccauuacccggggauuuuuuuuuuucauuucuaaaaauaaaauguagaaaagcauggggugaaguuuucuguugaaaauuucaugguuagcuuuuguuucugcauggauuucagagcuucagcuuacagagggagacuguguagacgucacuguaggcagaguuucacugccucagcgcuucucucgcugucucucucucugcuuacuacaaaccacuucucugugauuuccugaguggucuuugagccgaaacaggaaacuugauucgaagacuguauuuucuuagucgcucuucucugcccuuuccauuuccuccuggcuccugaguggaggaggcagcauggaagagggaagggugggcugucagugcuuacagccugcacugggacucgaacacaagaacaugcuccuccuuccuuucuuucucacaggucucuggggguacagucagagagcugguggaggcccugagacaaaugggcuacaccgaagcaauugaagugauccaggcagccuccagcccagugaagaccaccucucaggcccacucgcugccucucucgccugccuccacaaggcagcaaauagguaaaaaaaaagacaaaagacaguggagauauuuuccagcucccccaggcuggugucuucagcucuuuuuggauaugguguggcaguuuucuuucucguuuucuggauacacuucccugugugucucucuacccccugggcucacccucugccucucuugauaguaccauucagaugagggggucguacccuuggaaaaucacauugacacaugaacuacuuaguaaacacuaaauaauacaauaaauacuaaaaacaacaugaugugggugauuaaauuuaacacaugagagaaauaauauuuaccuuaaagagagaaccaucuccuucuuccuuugccuccucucucaagcuuaugacacugaccuugucccccaccauauaugggacuacgugucaugccaccaaaagucucgcaaccauaugaaauggacucucaacccagcccaguaauccuauauuuccuacaauuuuauucucccacucuguaaaugaugauuccaugcuuucuauuucuaaacccccaacacuccuucccuccccuuacucaugcaacacccuugcuucacacucuguugaaaacagaagaaaccagaacccucucaccuuugcaccaagugccagcccaccugugccugugcccacauuggcagccuuccauccggacuugguggguuaaauuucuuugcccagcugaggagccaccucuccccugagucuaacccccucaccuuuacuagguuguuguuccuguuaauucuuaccucucucuccuguacuagccguuccuccuccccacucuccgacuaggucaccuagcaagcauuucaugauuuccucaucuuuaaaaacaaaacacaccgaaacaaucacccucuugaucccacaucccauuuagcuacaguccaauugcucuauucccauacauagcagagcuccuucaaagaauuuuuuagaguuauucuuuccagcuugccaccuuccacccucugcuuggccuccugcaguugggaucgcauccccaccgcuccaccaggccugcuguccucacagugaccggucaccuccacauugccagaucuggucaccuccuuuucaccuugaccacuugcagagugugucaugguugacgccuaccuucaacuucagaccgucuccauuccuggcuccuccacagcacacuccccuggcuggcucuucuacacucaccuuuuaaagucacagcccuccagggucaguccuaaacccucccugcuugguaccucacccaagcccaauacuggcuacaucugucagaagcgcugccaucuuccaggagauuaagacaaaacccaagaauuccucaggaguccuuucugccacuaaucacuucguaugcgacgcaucgagugucauccugucugcaaccaccgccccaggccagccugccgucauuuccugcccaaauucuugcacggcuccuacucaguccccuuguuuccuuccuguccaccucccuucaguccauucucugcccaacagacgguaugauucuucuaaaaaaucagugacauuguauuaauucuggguuaugcccuucaguucauucagucauucauucagcaaauccugauccagcauacacugugugccuagcaguguucgagguuuuaaagauaaaacugugucccugcuuuacucguuugcuuucuuaaacauugcuguggaagcucuuccuccacacugcgccuccauucccaaguguuuucucugcuccccuggcucacuagucugaccaaccuuuugacuguuucuucccauucccuggaaagcucuuaauuggcuggcucuuucuugccacucaguuucagcacccaucucacccugccagggggccuucccaggggagcaagggcagacgucauuguccgcacuugagaaaggaauaauguauccgccggaaaacaacccagaucuccugagucacagcccagugcuccuucugcacagauauuaaaaaagaaaaaaagcaaauacuuaacauuuuuuuaaaaaguaaauaccuaagcauuaagcccuuaauuuguaguuauuuuuaggauaucgcauaguuuguaacccauaauagacaccaaauaaagauugguugauuaaacaaaucagucaauaccaaaaugauagucgugccacuggcauuaaagucuuaauauucuaauauuggaauuugguacauaagaagauagcauuuugauuaguguauguuagacuucuguuuccuuccucacuguauaggaaauaauuugucuuggucauaucccuaaggacacuuauaaacaaagggaauucaaccugauuuuccaguauagacucauuuucaccaaaaucauuuuacuuuuauugcuaccaaaaauguuuucaaggcaauguaugcuguaauagcauaugaggcccagagagagaucucauuuuuaguucuugcuucugucaccaauuuauuuugcugagguucagcaguuuccccagcuaugaaauagauaauacagugguuggaaaacuacacuugauuucuaagggaaaaaaagguccacugugagucaagagaauucagaaaggauucucauaaacacaagacuagauugcaggaagaugugaaagcauuuggcuaauucugacauuuggcuaauaacauccucacaguaugucccaaguaucuucugcccuucccaccacggugagcagucaugacagugaggguggcauaggugggauguguggcuggcagaagccagugggcaagaguuguccacagaauaguccaugagcuuuuuagagcccggccauucccccagugaauuugugcuuucuccccucagacgagcuccgagacagugacagugucugcgacagcggcguggagacauccuuccgcaaacucagcuuuaccgagucucugaccaguggugccucacugcuaacucucaacaaaaugccccaugauuaugggcaggaaggaccucuagaaggcaaaauuuagccugcugacaauuucccacaccguguaaaccaaagcccuaaaauuccacugcguuguccacaagacagaagcugaagugcauccaaaggugcucagagagccggcccgccugaaucauucucgauuuaacucgagaccuuuucaacuuggcuuccuuucuugguucauaaaugaauuuuaguuugguucacuuacagauaguaucuagcaaucacaacacuggcugagcggaugcaucuggggaugagguugcuuacuaagcuuugccagcugcugcuggaucacagcugcuuucuguugucauugcuguugucccucugcuacguuccuauugucauuaaagguaucacggucgccaccuggcauuccuucugaccacagcaucauuuugcauucaaauuaaggguuaagaaaagagauauuuuaaaaugagagucacuugaugugccauuuuaaaaaaaaaggcauauugcuuuuucuaaugugguuauuucucugauuugcaaaaaaaaaaaaaaaaaaaauacuugucaauauuuaaacaugguuacaaucauugcugaaaaugguauuuucccccuuuucugcauuuugcuauuguaaauauguuuuuuagaucaaauacuuuaaaggaaaaaauguuggauuuauaaaugcuauuuuuuauuuuacuuuuauaauaaaaggaaaagcaaauugaugaccucac

SEQ ID NO: 21218 - RNA, 46295 nt, Homo sapiens
gggcugcaggggcagcgcauacacuacaauggcugcuggaaagaggcguaaggaaacaauuuccaggcccgccgcguccagcccgaaauaugagaaaaaaauuauuagaaauuccgcgggcgguguagaggcggcggacgggccggagggaggauguuaaagccccgcggugaguucuccggggguccggggcggcggcgaggcguuuagcgggagaaauaucaggguuauuuaaauuaugggacuagccgagggggcagaggagcagcggcggcggcaggaggaggaaaaguuugugcuacucucagccccugcucaggaccccagagagaaaaauaauaauaaaaaauaaaauaaaauaauuacgcggggcugcgaggacucccgaagucgcuucugacagggcagggggcgaugcggcuggggacccgaaggugaggucggugggaaaaaaaaaaaaaccuuuauucagggucuggaaaguuugaaaaguuuuccuccuccuccuccuccuccuccucucuggugcugugaauauugugacagcggcagcggcagcagcgagagcggaagacauuagagacccgaaaaauaagggaaaaauuaauauaaauucaguuuugagaguaaacucuccgcauuuuccaccaaaacaucccgggggaaggucgcuucccaaagggccuggcggaaacccgcagucggcaauauuuggggggcacuuugagugacuugggguaacuuugccccuuuuucaaaagagguuuuucuuuucuggagaaaugaauuuguuuuugcccuuuccucaggugggcaagccggggucggggugcggggucugcagggaggugugagcccgggguguguggcugcgaggggggguagggggagggggugcuaaaugaaagcaggagaucggcacagagcagggacagcuuguugucaguaucauaaacaaccaaaauggagggagaacucaggcauauaaccaaauaaaaauuuuuaaaaaaucgcaaaaaaucccuaaaaauccgggaugcucccccuuuucucgcuaaagguaaaaguauguaccgccuuuccccugaaguccauuuugacuuugcagggaccaaggaguuaauauuuauuuauuuuuuaaaacuuucgaagggcaaaagccuuuuauaacucaaccgacaaugagaaaacgugaaaauccgaugcaagagaagcagggggagcgaggggggaggugguagugcagaaacugcuaaacuuauugguaauguggacugaucucagauaagauaaacacuauauuugcuauuuuauaacucucuuuuaaugaucuuugcgggguuuuuuuggguggaaaaaaaagugaugccauuuucuuaauagaguuaauaugugugauuggaagaaugaaccuuuccggcuuuagauugcauuuucgucgcauuuaugcuucagguuuuguuaguggcucccuccuuucuuuaaacugggcucugcagaggagggauagagaggugauggugcucagagaggcuggagugcaaggcuggaguaccuuuuggggagggauguggaguugcuugguuucccccuuccugacauguuugcuucaccuguucauccuuccuaaagaauguuaagcugagguuuucugguuuuauguguauaaaaggaugaugucucuugcaucacauugauguuaaugggaaagugcugcugauguugguuccacgugggauaugggacagagcagggcauuuuaaagggacagcuucucuuuucuuaugguuuucaucaccuacacagaaucacugucugaggaccaaaagcagaggugcugggaggguguggugauggaagagccuucccuuucuguuacuccagugcacccacccauaggagugauggagggacaggagggauaaacagccucaaccgaagauggauauguguauaguuuguauccaaacuguuccuuuguguaacaagcccucccaggaacuuuucauguuacauugcuuugcuuuggaagcugauuuuggaaggaauuguggaaaaauggaaauaguuuaaggugugugguguaaugguauagcauuauugaacaguuaugaauucugugcagugagaucaaagagcuguguaugcccauaaugugauuuuacagccauuuuguaaaaacuguaaaauaccuuaauauucaauuuggcuuaagguacauugaggacuucugguugaaaauuacagaguggugaagauucuuuaaaauuguaagcaguaggcauuucuuuagggggaaggaaagcacacacaccaacaccauggaaaaguuuacacauccauuuuuaaaguccauccuaugcauggguuguaacuuugcgccuuugaaaugaaaagauuuuuaaaauccugagcccugugaguuuucauuuucuaaguugaauuuauuuguguuauuuaacagaaaguguuuacugaccauaaacuacuaucggcucuuauguuuuagauuuccacgauauuuucaaaauuuaaaauguguaaauuguuagcuguacuauaauggggauuaagguuaaucuucaguagaaauuacuuguguuccauuuuccacagguauauggaguuucugaaauaaauccuuauuuccucuuguuuuuauuauuuauagacauggauuaaaauuagagcugaauuuuuagacuucuuauauagaauguuuuuucuugcccuacuguauaaacaaguuauuauuuuuguagucuauuguauguuaacuuguguuuacaacugaguucuuccaacuuucuguaaauaccucuauacaacaucacaucaguaacguguuugaguacaucaucuugugguuucugauuuuggaagcaauuacaacuuucuaagaacucauuaaaagauuaaucucaucacccacaguuaaaucaaaauugauuggaaaaggauuaagcuaucaauagagaagggaaacuccuccaugcccaaugaucuucuguccagagguuucagaaugccauuaagacuuacaaagccuuuucauuuuaucuuacguuuucauuguauuuuggcucaagacaguuacauugacuauaaguagucagaauuaugcugugcauuuaaaauaaaugagacuuagaucuugaauaauugccacuuugacaaaccagauacuaauaucaauaaauucaaucucuauaaaaaaaugaaggaauucaaguuauauuagauuaucguguuauucagguuguuuggacacuaugacugguuuauugucaaucuaaauaaaagugcugguauugugauuuuuuuucuuccucucauauagggugguguaaaacuuucuucauguuuguauuuuaugcaacuagcuacuugucuguucagaaaacgcacucagagugcaccaaucuaaaaucuguaaucgcuuagagagucuuauuuagauggggcacagcacaauauuuaauuugaagugauuguacugagcuuuugugaugccuuagaaauacuaccuguugaacauccuuuucugaagcuauuaaauuauaccaguauacagaaauaaugucaugauauuguguagucaaaaucuuuauuucaguuggaaucggagaaaccucauauauugauagucuuauuugaaauuuauaugccuacuuuugcuacuugaaauucuauaaagaauuuaucugcuguggaagauuuauaagugugggcuaauauugacacauucuauaucuguauauuauuaccaaaauauuuuaguaaauaguaaauagauauuuauagcaaaauaaauuagugaauuugcuuuaucaguauaguuuuaaaauuugaagggugcuguuuguguuuuaauaacaugcacagguggggguuauuccuucauuuuuaauguaauccugauugucacuauguacauuuugguuugauauucugcaaauuuuccuuucuaaggauuaaauuuguuguuuccuaaauuaaaugugaugcuccugucuuaagugagauuuggaaagccagauaacuaaaacauauaucuauagcuaucuuugaaguuuuguuucaguaaucauuugccucuugagcuguguagucaaaauaauuuuaucuaagaauguuuuaauauuuuuucuuuagaauccuguucuuuggaaaauuaagauauauaaaaaauuaccaguuacacacauccccaaggaaaaaaaaguuuuacugaagaaacuuacuuacauugcuuggaauacauauucuuuuugguguguuugcaaguguauaagaaauaaauauuaauuuuuucucuuuauauugauaacaucuuagauucuuuaauuauuugaguaagggaagaguuucaaaaggaggaaacugaaucuguucaacaaaauccaagguagugaauaugaucaagguaaaagggcuauaaaucaucccuugagccauuuuuaaaugucuuaagaaccugauaaacaccuuuucugaaacauugaauacuuugaaacuauaucagucacuucugaaaaacaaagguagaccuuuaguuucuuuaguucuaccaggaauuaauauagguagcauauuuaaccaauuaguaaguguuuagguagucauggaaaaguauuuacaaguaaguaaaauaugaaugcaggguaaaucagauugauuagcuguaaaguuaaccugauuuuagaauucaugcaugggaauucuuuucuauuuuaccguaagacuacuuuggagguaacuaauuuuugcuuuuuguauuuuauugccuaaauuuuuugaaaugcucaaaccuaaaauccacuguuacuacuuuucauuuauguuagauuaacuuuuauaucuuauuugcaaauuucauuguaaaauuugagaaauuaaauuaagauuuuuagauuauaacauuuuauaaaaguauugagcuauuaacauuugaaguuguaagaaauguauguguaugaaagccuaguagaaauuauuacagggacauaauuugauuuuuacuuuuaaaucgauuagucugcuguccagagguuugcauuauacucacuguuuauagcuaucccugccuccucuuuacagggugguacugacaaggauauggugguguggaaccuccaagggcacuuggguauuuuuguuuucugauuuuguguauguauugguguuuguuguuaagaauuuugcucuuaaaaaaaaaugcuuaucagaacauuuaaaaauuuuauaaaacagaaauaucuuauuuuuuuaaaaagguaguguuaugcugcauuaaaauuguuaguauuuaaaagucccuggaugucuuauaaacagaguuacuacaggaucaugguauuaaaacuaaccacagugugugcugggaauuugagaugacuaccuaaaaaaugugugugcauguguagaaugaaugaacuuaugcaguauguccuagguuaauaggacaagaaauuugcuuaaaauauuuccuuacauuuaaaaguggaaucuucuuaaucuaaaaacauagaaaaccuagcaaugugaagguguuaggaagcaaaaauuuuuuuuggugccuuuuaaaaauaagaauuuuaaacaaugaaaguauguaacaauaaguauggacuaaaauguccaaaauucaugguaaagaauuugguagauaagaauuucagaguaaaauaacaauugugguaaauuaaaaauucaucuuaugugaauaaauaauaaccaacuacaaggcaaaaguuguaauuuugccuuaaaaauuagauaauuggggagaucuaccaaagaauauuuuuaauaccaauugcugguuucauaaugaccuuuuuaaaauagauccccaaagccugccuuccuucucuucuuagauuugaauuaaacuaaauuaaauucuaagaauaauuuguaaugguuauucagaauuuuuuuuaaauaagaaaaauuacuuuuugcuauuuuuauaaaauauuuugaagauuguuuugaaugugugucuucgugaaguguccugagaaaguuagaaauuauugaaaaucauuuucuucauuguucaucagaaaguuuaaaacuuuaaguuaaugaaauaaauuuuaaaaccucagucuaagaauaguuugcuucauggacuuuuuuagagcaauuuaaauaauuuguuacagacuuagucacauuuaaaaagccuuucacaagauaaugauaacauuucaccaacaaagcuccuaauuucugguauguuuuuaggucuaugcugccgauuaaaggaauuuuuucuuucccguuuauuaauuagcaagugcuuuucugaaagaguaucuaaacuuuugguauaaucuucugggauagaaguugccuuuacuauuagaaaauauuuugagagaggagggggcaucuuuucuuaaaaggcaacagaauccuuuacagauugugaaggaugugccauuagagagucuugaacucuucuuuuuugagaaugagagcccccuuuuagccuuucacucauuaaauauuugaauuauuauugcagaccaauauuggaauugcacauauauauauugauugugauuuccuaucuuuuuguuucugaaugugauaauauucucagaauaagugcuauauguuaaaggcugccauaucaguuuuuaaaaaauuaucucucuuuaaccagugguuagacauuagagcccuuuaacuuuaaaauacauuuuuggagacuguuaaacuagaaaucaauuagcaaauaaggaauuuagccccuuuggcucaaaggcaaaauuggaaggugucauaaucaauuuuauuccuuugaagauacauuaguaaauauuuauugaauuguucuugaucaugagaauuuuaagaaauuaaaccuggaaacuuaagauaguucaaguguacaguuucaaaauaacaccgguuggauuuuagucuaccagauuuucucgguaacuugauuuuuucuuguauugucuuaaugcuggaguuacauagagcucacgucacuuuucuucauacccugagagaguuacaauaaguagguuuuauuuuuaucaacuuuggacaaugaagggaaaaugcuguuuuauuauauaugagcacuuuccuuuucuuaagcuaucuucuguauuuccuaaacauaauucauuuaagcacugcauuccauugaagagaaauuagcuccauuauucuguguuacacaacugcaacuuauggaacaguugucacuuuauauauuuggauuguuaugaccuuauaaccuauuauaagccuaaaaacaaauauuaauauaaccagcauauccuauuauaaauaagcuacaccucaaacaugaauuuguuuuccuugcaccuuuaaaauuguuucuaaauaaaucugagaaaauguucuucauauguuuugcuaauuugucauagacugagguaauuuaauuguauaaauuucaaucuagauuuuucucuucuaauguugguagcauuuuacuugauguuuacuauucaauuucauaggauuuuagcauuagaauagaaauagauguauaauaaaauagguuaauuacaccaagagugguggaagcagcccuacuaguuauuuggaagauuuuuaaaauguuuccaagaaggaaaguuucugugaugaucaggcacaccaaacaggaguuagugacauuuuauguuuuucuuuaucuugcuucauaaaacgugagcauucucagggcuacugucauacaaacaaauaacugauuuaacuaugcuguauguuaagcacaucuaucaggucuagcuuuuaauguaauuugcucaguuuauuuuuaagaaaaagguguaagacauuuuuucagcaauaauuuggcauauauuacguuuugaaagaugcuguauuaaaauauauugucauauuugcuuacccaaaucaaaaugaaaguaaacuaucaaguaacaggcuuaauuagacauagaaugaaagcuuuaaauauuaaacugaauaacuugauuuacugcugaaauauacauaauuuuaauucagauaguuguuuuuguaucugaaucuacuuuuuaugccuagaaauuuguaaacaaaguacaaaauacacauauaaaauucuguagacguuccuaagcagcuagccuuuaacaguuaauaaauuuauuaguuuuuuuucaaauauguggucaaaauuacuuaaagaucgugauauauucaauuauuuucauuauucuucaaagaaaaguagugacaaauaggucaguacuugguugaaugucuguuguauuuaaauucuuaauuaucaagcauuuaauacuuuuaaugguauuucaauuuuuuaaguacaguuacagauguuuuucuuaaaagcccuucuuuugggaaaguauaaacuaaugucuguacuuccuaucucacaauauugcugcugagagauuggugacagacaguuauuuuaaaacuuuacuucuguaacugcuuuuauuuaauauguucucaagaucauguuauucuuaaauuccuaucuaggagcacuuuuaaucauagccuggguuaucuuuucagcuguauaccagagauacaguugcucuacuuaaacauuagaucucauguggugcuugaauuuaauuauucuuaguucaccuuuuaucccucagugcagggaaaaguagagaaagcaguuuguugugggagaagugcaauugaucacauucagaggcugacucauaauagcuuuuguacaaugcaugauacucuuccagaauuaaaagaaauuuuuuaauugaagccaaaauacccgcaugucuaaguuuguccuaaucagauuucaggcacacuugugugcuuccauuggcccuuccaaguguucuugcuguuugcauguguuugguucucagugcugccacccuguguauggcagugccuuacguagacuaguuuucugugcuuuuuaaaaucaagcaauaacauccaaaaucacuucuggaaaaugagcauauguauuaaaauuaauauaaaagucauugugguauacucugguucuguguuuaaugcuguacuaaaaucuagaucuuuuucaaguugcacaguucagaaguguggucuucaacugcuaaguauaaaauucagaaaauuuuaaagauaaguaacuuuaucucauccaucauuucacugaaauaaaguagaauuagacuaguauuuuaaaucuagcuugaaauugaucaaauaagaaagcagagguucugauccuuuaaagaugagauguuacaaaauuuuuuauuucagccaaguuuuaguuaaagguuuuuccuaguaaaaacaaaaaaaaaaaaaaagagcccaaaaagaaacuguuuauguuuaaaagaaaaagaaacucaacuugauugguugaauuauucccugaaucguuagcaacaugacuuuuauaacucucaaaauauuuugaguauuaaugcuaugcuucagccauaaaauacuuuggcuaccuaucagucuuugcuuuuaccuauauuaucucauuuaguuuucacagcaaucucaugagauaggaauugcagggauaauguguaugcaagaagcaauaaugauuucagaaggaauucuguuacuuuuuguaaguaaaucuuuagaauggacagaccuauagcagcuaauuauuauauguuauuuggguaguauaaaccuaaauuauguccauauugaaguucauauauuuaagaaaauuguacauucuuacaaaaugaagauuucaggcauagaguugacagaguaauucgaguuagaaagugcuaaaugucaacuuaucuuuaagcuguacauaaggaauuggggaaauuuaucaacuuauuaagcuaaaggagauuuuucuaaagauauaaguauaaacuuugucucauaauaaggaucuuaaauagguaauuuuauuaauuuuggccuuaaauuuguugcaaagcugucugauuucagaauaaugaauaaacauuuuuccccaaauuuuugaauggucuuauuucauuaaacaauguaauucuacaugaugacaauugaaaauauugcuuagcuugguuaauuuuagauguuaggcuuccaagcuaaaaaugccacugaugaucuucccacccaggagaguuaaaagaauuuaauacaguauaugguauugucccaauuacuaaagaauuccaaguuucacaucuccauuuuguuauucauguaaucuccauggguuugggggauuuggggauuucucucuuccuuugugucuccccuauaauaaacacauaaauauuccuuaaauuuauuuuaaaauaaaaaugugauugucacgggaaauguggcuaaauguugaauugggcgaaaaagaaaaauuuuuuaaacuucucugcuuuuaugccuuuggaugaugaguuaauguauaaagagaucccagagcauuguuuuuuaaaaugcuaaaugaaugguaaagacaguaaaaacuauaggugcucaagggagggagagguggaacuugagaugggcuuugaaaaaggcaugaguuaggaauuggcaagaagaagcagggcuguucaggugagaggaaugguuuuggcagagguuaggagacagagaagaccagucugacuggagaggaugguuugcaaggguacaguucaggagccgcuagaaaggugugcugagaucugauugugaaaagccuuuauuaccagccugaggaaugugcacuaugugcugcggaaggcauuguagcuuuuugagcagaggaggaugaauuaggaaaguuaaguugauccagaguccagaauaaacugaccccauggauguaagacuagcguuacagaaaugugaauauguuccacauuggaagcggggcccgcugcacgcagaggucuccggucuuuaccacuagguccauucugcuagcaauucagacuucagcuauucugugaauggcucuaccauuuuuuaguuccuuagucauggaaccaccuuuuucuauauucaguuggaacuuccgucauggguuuaauacuuguguuauagagacauuaacgaaauggacacauagaagaaguuaauaccacuugggggaauuagacucacagaggagguagcuguagagccaagaauggcgggggaaggccggggaauccagggaaggaugcuugggcccgcauaugcagcacgugccccauucuucugcaguugagugucagggugucaggggugagcagaaugaugguggagaaagcuagaaagggagacaggccaggaggcaucaggucccgaaggccacacagaagggguuuuauuccguugagaggguacccacugagguucagagcugggucuuucaugguauaaacccacucuuuuaccugcauccccauucucucuccuuuugcucauuccucucaccagugauucucaacaucuaauguucuccuauaacccucucaccagaugucuagcuuagcucccagagaagacugggacugucagugcccucuuuaccucuggauuccucuguaaugaugcccagcccuccuguaggggaggaucggggggggugguggagacguacugccuagugccaggaaggguuggucuagcuggggaggcugggccccagggcuguauaccggggcuucuggagccagccgguuacuccagccccucguagguccuuguauugucacucaccccucccaucuuggaauuucccaucucuuccucuccacuugcaaaauaugcucagaucuucccaaaucaaaaaaauaaaauacaccuuuggcuucaucaucccccuucccuaaguaccuuuccccucaucagugccagacuuucuggaagagugguccaugugcuguuucuuucaucuccccuuacucuuuagcuauccugccccuucauuuugagucugcauuugaaggcaacauccaucaacagccucccaggcaccaaagcugguggcaucauuuccauuuuauccccacuugccuuucugcaggauuccacauguuuggcaaacuccugcaucucugacuuuucuggcuuugcuguuccuucucuggcaccuccuuugcacuuuguuuggguggcaccuuuuuuccaccuguccccccaaccaccagcauuuuggcauuccccaggguucgcagcauuccccaguccacuucucaguguacacuuuuccugagcacccguucccacuccugcgguaccuuuagcuugcagcuucuugcuaaugaagccuuagucucuaccucucucuagggccuccaugucucuuuucuguuuacacuaacaucuccacaucuaugugcaagacaccuuuccuuuuauaucuuauucauuccacaaauuuuacaaagugccugccacacaggucaaguaccaugcuggguacuaagccaggccccacccacaaugagcaaaggacacaguaguuaguagagcucccucggggugcaguaggcagcaugaaggaauuaagaaggaguucagaggugaggaguccugggggccagggaagagggacccuaagagacagugaucaggggagaccucuugauaaaaggcccuuuguauagaggccugaaugaugagaaggggugggccaggagugaccugaagggacgcuccagacagaggcccugaggucuggaggaggagcucuacgugcuggaggcagagggagcgagauaggggaccgggcagaaagccaucuugcuggacugucuuguaacgucuaugaggaccgcuggcccugagugcaguagaacuccggagcagagcggggguuguccuuugcaggguggcugucacuuccagccucauccucaucugugcugcccucugcacauggcuauaggaccugggugcucccgucaccuccuuccuccccugccccuuugagaggcguguugcuggggcacccacagccugccugccucagcuguggugaccccucugugccugcacagccacguccuucucaccggcccuggagcacugcuccauaccaugcguggguaugcagcuuccucucggggcugagccuuggagggcaaggaccacgugcuguccuccaccccacuuucucugucucagaaccggcacaggguaaauuccuggagaggaguacucuguuuucaggggcaguccagagguuugauuguggugaagggaagcuagaggaagcccugagcagcgguuagaggcugugugaugcgggccauccauuccagagggugucugggacgacaugaguuccagggagaagucaguaggaggaggccugggaucacuucuuuggagucacccagccccuuguuaauugugaaguguggaacagcaagguugggagagagaaggugguuaaguuugucucugcugcucccuacccacccuguucccugcucccuccauagcuaagcccugcgcaacaaguacagacagaccuccugaccgccacaaggccagcccucaccugcagcaagcccuguuaccauggggguggcagagacaacuacacaugcuccaaagaaagacagacacagaugcaugagggaaaaggaugcacaccccccagaauacccagagcaggggagacccacaaucccagacagagaaacacguagaccuaagcacagugggcgugggaggcuguaucugucugugcagguauguguaaauuauguuuauauuuauauuucaggagaaagccagugggagaaagacaaacacagagaaagaagagagaaauacacccaguucacacccacagaggggaaagagaugcaccagcaacucugacucugucuuuucccugcuugaggggagaccccaaaguggggaaagacacugcacguucaccaggauaggcugggaaaagacacugaggacaccuggacugggggagagagugacacauccagaagguggaggugggagagacagauuccaggaugggcaggagaaagaguuacacucacgccaggaugugagcggagacgcacucacucccacggcagagggagacacacagccccggaugugagggcaggacaccagucccaccaggauuuggggagagaggcacacaugcucagauggggguacacacacagaagcaugcagaggugggagagagacacagacaccuggucugcagcagggagagaaagacccccagcgaggaagagagagacagacccccagaguuggggggagagacagaaauacacgccagagugggagggccccagagauccacaaacauacacagcccuggaggggagagaggagcacacacacacacacacacacacacacacacacacacgcacacuagggagggagagggugccugcaccccaugugggaacacaagacagagcaacuccaaagggaggcggcacaugugugcacacacaugcacacccccacgcaucuggauggggugaggggagagagagagacacaugcauagaggaggacacacacacauguauuaugcacggcaggaggcaggagggaggcccacacccuugcagaggaguuaagacaggccaggugaaggacagcacaccaagggcagugacaggagacacgcggggucaagagaugugcacacgcugcucgucuaugcgugugguacuugcaccauccccgagacuuggggcaggaaacgcucgcggugccacccaguucugacugacguguccucacaccccacugggugugcccauagagccaggucugaauggcagucagcgcuuggccccugaaaguaccugaacucuuccuauccuccucaggucacccauauccagacagaaggucacaccaaguuccuuuacccuaauuaaaaugcuggaaguauacagcggaggcaucacacacucauauauccgguucuauccucugagcgugauguacacacuugagaguacaacaguagagugaagaaccccuugguuaaaccaauacaguaaaugcugguguaucaccagguucaacaguuagugccuccacagccaggcuuguuucuucuaucccuuacccaugcccauccccauucccucgggcuuguuuauuuuccugcgggugugaaguuauuucaugccauuuauauauuuaugaucaugugccuuuggcuccccagcucguucuacuagggguucucuuuuccucugcucccuagacagcaccuuucuggccaacucugguuccauggcacuucugugcuccccaaauuccccuguggugcccauguuauagcagugagcacgcagcuggcuugccuugcaguuugguguguccucccacacccgcgagacuaggucugucaucuugauaucacugcucaccugcacacagcaggcacuugggagguuuugugagacaagugccccgagcuguaacagcucaaaggagagacuuguguugcccaucuugggcucugucuucucaccaacccaggguucccugggcgcuggcccccucccggcuugcaccgucaccuguucucccacacgaagccaggcgccuugagcuucaggaccuccugucuccuuagauuugggcugagguggccucaggcaagggaaccugcucggugaucucuccagcugcuggcuaugaacuuugggccuccucacaucugucucacccccugcagucuucaccagcccuggacgcuggcuuucugggucguggcuccaccaccacccuaccccagccucucuggcaccugcccucugcauguucuccccugcuggcccaagaaggcugguuagcuuccaugaagagugcagguggugggccagcuagcucuguaacagaccccgugaacugggaagugacucccuuaucuggaauaauagugcugucugacugcagugcuugcccugugcugacuguucagggcaccuacacauagugaugccauuuauccugguaauggcucccuaacauggguauugucuugauucccaguuauagaggaagaaaaugagcagagagaauuuaagucacuaaguauuaaaugagauaaugcaugaaaaaaauucucagcaaaacaccugguuccauucaaguggucaaaugguuuuugguugguuguucuaaacaagcuuauucacucuauuucaugaaauuuuggcuaauaauuaugauaauaauagucucuaauagaacuagaaaucucugauagucauuagguaacuuuaccccccaaguucacuaagaaaauugagucugucagauaugcacccucagcagcuucuucgcucaccacccaccuuauuugcuuucuaaccccuccuuuucuuggcugcagaggagcucugcucuucugcccaaggcucauccacucuuucacugucccauugaauaugggauuguguuuggucccacugacuucuucccuucagccagaggagguguucaagauucuccagaccaaaacgguucagagucuucacuugucucugccaucuccauucucuuucuccuacaggccuucacgucuuucucaaaccacacccggcagacuccugccucaccacucccccgaagcaacuuuggcaaagguuucaugauggccuccugccccacacgcaugcugcacccacauacacacaugccacacacacacaaacacacacacgccacacacacacaaacacacauacauucacacacacacacacacacccagugcugaguccagcagaugcucuuccgguuccuccaccugccugcuccaugaccgaagucucucccacuguagugcacccacugcaugcaugagccaccauuuucugccaccucagccugacacagcuccuugaucuugcuacgcucauuuauucuccaccuuuauuaguuaaaaaauaacuagucaucauaugcugaauaguuacuugauagccuaacugcaauauuucuuuuuccuuuuuuuuuuuuuuuuuuuugagacagaguugugcccucucacccaggcugcagugcaguugcaugaucucagcuuacugcaaccuccgcauccuggguucaagugauucucuugccucagccuccugaguagcugagacuacaggcaugugccaccauacccagcacauuuuuuguauuuuuuuaguagagaugggguuucgcuauguuggccaggcuggucucaaacugcuagccuaaagugauccaacagucuuagcuuaucaaagugcugagauuacaggaauauuucuuucuaaaaaauaguuuaccuaaugaaggccgggcgugguggcucacgccuguaaucccagcacuuuggaaggccgaggcgaguggaucacggggucgagagaucgagaccauccuggcuaacauggugaaaccccaucucuacuaaaaauacaaaaaauuacccaggugugguagcaggugccuguaguaccugcuaccgaauagcaggugccagcuauuugggaggcugaggcaggagaauggcgugaacccgggaggcggagcuugcagugagccgggaucgugccacugcacuccagccugggcgacagagugagacuccgucucaaaaaaaaaaaaaaaaaaaaguuuaccuaaugaaagaucugacuguuaaacauuuguuacugugucacuuguacaucagucucgaaugcuuagaaauaaccguuuagccucaguagaguagaauuaucaguugauuggucuguggccuuuguagcagggucaaggguacaaaaaugaucaugugcauuccuuagguuggagaagauguaaacaucauaaacuguauaaauaauuucugacuuugucauugucaaccagcuuuuuuuauguacccagagcuugugguacauguacauguagguuuacuguguagggugaaguguagugcugccuuuagguguuuucaaaaaacuuuuuauuguagaauauuuuaaagauauacagaaguacagagaacaauagaaugaauccucacacccaucgccaguuucaagucaccacaccucagcagccagucuuguuuccuucguccccuacccauacccauugccucuccugcagacucuuuugaugcaguuauuucauaucauuuguauauuucuugguguuuccaaaaaguacagacucuuuuuaaagguauaauuacaauacaauuaucacacaccaaaagaacaauaauuccuuaauaucuagugaguuuucaaaucugccuacuuaucuuuuguuuuuaaagauuuccaugauccaaauccaguaagguccauaccugcuguuagcuguuauauuucuuaaagucuuuuuugacccacaguuacucauuuuuuuuucuuccuuaaaacgcauuuguuaaagaaacggguuuuuugucuuuuguguuugugucugucugucuguccuguaguguuucccccaagucugaguucugcggauugcaucccuguuguauucuuuacacgcucuguaagguucagguucugcuuuuugccuccaaacacguuauagucucuuaaaaaggaaagcuggaaagauugaauguggaagaaauacauauugaauuaagugccauaagcaaucaugauaacauugcuaccaauauagugaauauagcuauuuaucauagcuguaguguuaugguguagaauuaguguucccaucauuuuaaaaaaugcauuaaaaacuaacagauauuuccuucuggaauguucuucuauaaaacuauguaacacuuuaaaaaauugaauugggaucuuuguuuuguaucuugcuuuuuaaaaauguaacauuguauaaagauuguuucccauguacuuguauguuacuucuuuguauuccucaaaagcuauaccacuugagaaugaaugaccacaguuuauuuagccuucccuaguuguuggcgaguagguaguuuccaguccagucuuuaaauaaugcaguaaugaaugaccucaugcaugaaucuuuaugggugucucagguuauuucuuaaguuaaaugcuuagguguaaaaugagugggcgaaaagauaagugcccacuuuucuuuggcuuggcaauugcauggcagcuuugaccuccagggaagacuuacagucgcugucgcugguaguacacaggagugcccauuuccuucacuuuccccaccaugggccacagccacuuacagcaaccuucccucucucuacacuuguugauuucuuuuguuuuaauuuguccuucguguuuuccauucuuagccaucaccaccugccgucauugcauuucccuuugauaccuggggcugcuaaucuucccuguaccaaaaaucccaguuaaccccaacuuguuaucguuuugccuaaaagauugacacugagugagggugcauaguacauuccucaauaugaaaugcuugauauguguagauuuguagugucuacuuuggcaguucagaaccuguguuccuccuuucuggguuuuuuuuuuuuuuuuccuguguuuuagauuauugauguugccagauaaaugaaagaucacccuauguuaauaccacagguucuguuaagguggggagaaaaacacaccugccaaacucugaauuaaauggaauuuguaaagcagauaaauuaagggaguaauuauucacauuacccaacaauuugccuuuaaaaaaaaaaggauugaaauuggcaccucuuuugguaccuuuaguuauuaucuaucugagcaaugucaauugagaaucuaaaguauuagaacuccaaaagucaucaucgaagugcucugaaauuacagugcauacuaaaaauaccucacauuugcauaaugcuuguaaagucgcaucauugucuggaacaccccaccccugugaauuugaacccuaaaauggccauugcugaccacaggcucgcguccucugccuccacuuccuuccuugcuccugcugacuuugucucugcugcuacaguuuaugcuucugggccuccuucucucuagcucaggucucacauacucccugcugccaccgcuggcuccugcuagugcucuagaauguucugcuucuccacugcucucuacuucaucuuccugcucccagcccugggagaauccucuccuccugccuuuuccagaugacucaggacagugacauuacugggugaucuaaaagcagcgcguguaaagcaggccugcagugauggcaugaguccagggccuguggucguuuggcccuccuuggucacucuccagcccugucaugggaacauacccccauucccuuuaaauuccguagcgccgggcucccacguuccuccagcacgucaagccacauuucccaugccugcccuugcacgugcuauuuccucugcuggaauguucuuaccccuuuaguucacuggaccaauaccuacucauccuugaaaacugcucaugugucaccuacucuaugaagcaaaauuaauuacuguguccucccccugugccuugauggucuuugguuuggcaucugcacacacccuguccuccucuaucucuucuuaugcccuggguacugcccccucuaauucauuauccuuucucucccuuucccucuccaccugauccuuccugucagcauuauaaacaugacaaaucucugccaucuuuuaaaaaauaaaacagugacagcucacuguccucucuguaccuuccccuucagcugauagcauuucuccaaagaggaauguggacuuagugcccccaguuccucaugcagcacuccuuccucaccccaggccuccauucugguuccccaaaguauaauaguucuuuucaauuuuacuaaaaaccugcaugucacacaaccaggaggaaguaggguuuaguccuuaccuuggcucuaccucccugaaacauucucuucccuuggcuucugugaccuuagagcauccuggcuuucccugcuacucaguggcauaccuucgaccuguugcuggcuuccccacucuguccauucuccagauagucccuccuuuccccucuccgugccccuuuccacaccuugcagugccauggucucugcuguaugccaucuucccccuaguccuuacccugcucuucaaauccuuugccacucacuguguuaugugccuuacaugcaguaucauuuauuccucacaacaacucuguagggcuucauuaucucacuucauagcugaggaaacugaaacugaagaaagauaagucauuuacccaaggccgagagcuaguccacuugacuugcugucaccaggugagauugcuuccacaccacuggcugagugaccuguccugcagcccuuccaucuccaguuacacuuguuaaagcaguggcucucagccuucagucgacuccagccuugccuuucugcagccucccuucccaccacuuuccuuaagacaccaucagcuccagucacaggaggaauaagcauuucuacccuagucugcccuuuucuucuucucccccgacugggacgcacuccccaccucuccagccucaccugugcaggcccacaucuuaccucaccccaaucucaguucaguuggcucuuuugucccaaauucccaucuccaaagcuuggaaagaucuuuucuuucugugaauucccacuguaccuaaucuauacuuaccuuguggcaucuucuaccuucuguuuugcauuaucaauaauuauaaauuaugaguauccuuuugggauaccuccuuacuagaccccaagcuccuugaugguagaacuggugacugauuaaucuuuguguucaccaugauaccuugauaguuaaauuaaaugauaaggauuuguuuaucuguaaguuuguucuuauaucccuuacccggagcucugugcagauagggggucuauacuggucuguuggggaagacgaacuuucuggacaugaccacaagauggcaacagugacugcagcguccugauaucuguagagggugggccaagucaagaaagagaacaaugucuucuugauugcaggagacucaagggaaauccaagagaauuuucaaauuuaaagcauugugucaaugcccaguuauucacagaggugagcaaauagauuggacaacuguuuucuuccguggguucauuuggccaacagcauggaaagcucuccuccugcccuuccucucaucuuccuuuuauucauucagcacauacuugaguuuccccugugugcauccacuguucuagguacuagacauacagaacuggucaguaaaaggcaggauccuguucugauagagcuuacauuuuguggccuucacugggacccaguggaagauauugcagacagaaccaagaguuuccuugcuguuuuuuguuacuucuggagucaucuuuuccccuuugccccagcauggauugauccauaguuuuauauuauccccacacguuucauuucaacaagcaaaggcaccacuggucagcgaaucacagugacuaauuuuguuuuagccaugauuauugguggccuucuccccugcuucccaguuacccaguuaaucaagaaucgacuguguucuucuuacaguugaagauauggaaguuaaagaaagguaaaaaaucaugucuaauguugcacagguggauacaugagaaaguacauacucaggucuugguaucauucauuccuuucugaucauugucaguaaaguuuuuuaaagcaaaagaaagcaaacaaguccagcauugugauaggugccuauagacaaauuugacauacacugugucugugcuaaaggugacuuauaagguggaccuaauguaaguuuacuuaaaguugcauguaguguuuagaaacauuucuucaagggguaaacaagaguguaagaaaaauauacacguaauaauuuagaagcaucagcuaucacacauugcuuguuuuaagacuaagaaguuacuaucuguuagagcagccuccuuugcgguaugaaucuuaguugaguauucauuuuuuuucccguaucagaucccuguccccucccugcaucuuccccgcauaccaaauggcucugcaagaugggauucaguuccaugcaaccucuugccaaacuugccuucauuucaggaggacgagagaagggguuuaauuugaaaggcuaugugaaagaggcauccuguguuguagaacucacaguguggaaucuuggcuccuaugugcuucagucgaguagauuuuuuucugacauguagcuauuuucucugauuuuuagcuauuauaauauuuucauaggugcauuaucaucuuuuaccaaccaaaguuaagccauaaacaggggucaguccauugcuggauagucaauaauuacauauuacccaaguuacuuuucaauuuaacaugcaaacugacugcuggcuuccgguggaucaguuuuacuuuagcugugauuuggguuuauguaugaccauggccaccauaaaauuuaagguacacccugccuaugccacagagaugaguaagaucagaaguaugcuacuucaccaaauaucacuuuuaauacaaaucucauuauauaugagccuuguucucaggaacuauucccauuguuuguccuucaaagauuccauugacugugauuccguauaagagccugugcccaaaaaaaacaaacccuuauuuuuuaaauccauaucaggccagggcagcacuuacuucugaguaacacucugaauauaacagcuuugcauuuugagcccucagaacuaugcuagagacuuuacauacaucacuuuaauucacacacuacugcaagguagauguuuuucccauccuacagaggaaaaugcugaagagagacuaaauacaucauugaaaguaguuacacagauagugaaggucagacaggauucaagccuaguucugauucuugccuuugucucucugcugcuauuccccugcacugcuuuagguucugaaucagggcaaggauucauguuuucgggcccucuccaagucagaguuuuaaaguagcauugcaaaggugauuuccagaacuauacugccugagaugauggaaagaccuucucucuguaacacaucuguguaucgcaguagggaaggagaccaggggaaugggggcaaacugaggaguguaucaucaugcaguguaggggccaccccagauccuggugcugaagcuucaagaaggaggaggcugggacuuugcauugauggguuuuaaccccauuuuguuaauuaacugucagcaaacacugcaaaggcuuaagugaguuuauaguuuaggaaggucaggccaggcacaguggcuuaugccuguaaucccaacacuuugggaggcugaggcagguggauuaccugaggucaggaguucgagaccagccugaccaacauggugaaaccccaucucuauuaaaaauacaaaauuagccaggcgugguagagcaugccuguaaucccagcuacucaggaggcugaggcaggagaaucacuugaauacgggaggcggagguugcaaugagcuaagaucgcgccauugcacuccagccugagcaacaagagcgaaacucggucucaaaauaauguaauaauaguaauuuaagaaggucacuuuuuuuuuuuuuuuuaaugcuaaccagcuggacaugguggcucacgccuauaaucccaacacuuuaagaggccaaggcuggcagaucaguuguggucaggaguucaagaccagccugggcaacauggcaaaaccccgucucuaccaaaaauacaaaaaauuaguugggcguggugacaugcaccugugguccuaccuacucaggaggcugagguaggaggaucacuugagcccaggaggcggagguugcagugagccaagauugcaccacugcacuccagccuggaugacagagugagaucccaucucaaaaaaaauaaaaauaaauaaaaaugaauaaaauaaccuaauuagaaacugaaaggagaaugaccacuuaauuguuucggagaccaacaaaggcacacaaagauugguugcuuucugaagaaucuaaaaauggcauuggguauaggaguuggggaagcaaguuguauaggcaccuacacuuaagauaauuugucaauuauacaaauaauuuuuaaaguuuaagccccuucugacaugacacguccauggcuccuucacccuucuugucuccugcagagcuccagucugccucucuugcucuuagcuccaaaaacagugaauccccugaaguuaccuagacccaccauacaguuugugacucccucuaccuggaguaccugcccaugccuggcuaauacuuguucuuuuguuaccuuggcuucuguguuacuucauuuguuuuauugaauuaaucaaaggcaagccuaucaauuagcauggcacuucuuucuuuuaaagcaacugcuaaugaacauuuuuuaaaaggcuaugcagaggcugaauugaaacacuucaggggguacuuccuuugguauuugauaaauggaacguaucccagaacuauuuaucauccguaggucucaguuccaguuagauguauucuuggagacuuuaaaucauguagugugauaugccagcccauaaagcaacaggugaaccgaacuggcuuccuccaaguuugacagcugagaauguggcucuaaaaccugccuagauauauauccuuuucuaguaaggucugagugcaacucacauuuaagccaauauuccuuuccucuuuuuucccucccucugaaugggaaggagagauuuuagucauuuugagucauugcacuuaaaggauuuuaguuuaucaguuugcagaaaguuuuauuuucguacuucuguaaauuuaugugaugaugaguuucucaucauuuuguuuuuuauaauacaaaaacucugccauuuuauuguuuuuuaacaguuuugggggguauaauugauauuguauaaacugcccauaugugaagggugcuugcaguuuucacauauauaugcauacgucccugaaaccaucaccauugucaacauagugagcauauccgucauuucuaaaaguuugcucauggccuuuugugauggaucccucccuauccuaccuucugucccuagacaaccucugaucugcuuccuguccucuauggauaagcuugcauuuccuagacauuuguauagauggaaucgugcaguauguacucuuuguuuugcccaacuucuuucauucagccugcuuauuuugagguucauccauguuacuguauguaucaauagcuuauuccuuuuugcugcugauuaguagcccauuauaggaauauacuacaacuuguucauuuguuuugggguuuuuguuuuuguuuuucugagacacagucauacucugucacccagacuggagugcaguggcaugaucuuggcucacugcaaccuccgacucucagguucaagcaucccagguucaagccucccaaguucaagugauucucuugccucagccucuggaguagcugagauuacaggcgccugccaccacaaccggcuaauuuuuguauuuucaguagggaugggguuucaccauguugcccaggcuggacucgaacuccugaccucaaaugauccauucaccuuggccacucacucaccuuggccucccagagugcugggauuacagacaugagcuaccgugcccggcuaaaaccugauuuuauccauucacacaaggauagaccuucggguugcaucuaguuuugacuauuauaaacaaagcuacuaugaauagucaugaacaagucuuugugaagaccuauguuuucagaucucuugguaaauagcuagaugugaaaugcugugucauaugguagacacauguucaacuuuuaaauaaauugccaaacuguuuuucaaaacaauuguaccauuuuuaccuuccuguccaugguagauaggaauucuauuuguuucacauucucagcagcucuugauacuguccaguguuuuuaauuuuggucauucuaauggguagauagcauuaucucacugugguauuaauuugcauuucccuaaugaucagugaucuuuucgugugcuccuuuaccauucauauauuuucauuggugaaaugucugaucagaucuuuugcucauuuguuaauugaguuguuuuuuauuguugaguuuuagaaguucuuuauauauucugggugcaaguaguuuaucaacuuacaguugaucucugcuuugcagagauguuguucuaaucuucuaauggcuuguccuuuuuauucucuuaacauugucuuuugaggggaaguuuuacauuuugaugaaauccgacuuaucaguguguuuauuuuauggguugugcuuuugguguugugaccaaggacuuuuugacuaaaugaaugccacagaaauuuuucugcuuucuuccagaaguuuuauaguuuuagguuuuauauuuagguucaugauccauuuagaguuaaguuuucuauauggugugagaugugauuccaauuucauuuucuugauguguagauaucaaacuuuuccagcagcauuuguuaaaaaaacauuauuuuuggugaaauaauuuuuucugauuauaaagacauuuguaaagauuguaaagacauuguaaagauuauaaagacauuuguauaauguagaaaaguauaaagcuuauaucuuccuaaucuucuguuuguaauuuaccuagguacauuuaacaguauugggagaaggagagcuaguuuuaagugcauacuuuuaaaaaauuggaauaauaguguaaaugcuuacuguauguccugcuuuuuacaauuuuaacauuguaacuuuccccacauaacuuaguauucuuuaacugcucuuucccauaggauuuaauauucuuuaacugcaugguuuuuaauggcugcauagcuguucugucacaugcauaucacacuucaccucuucugacauuaucaauuuuuaaucuuaaaauauacuuugaacaucuuuauacuuaaauauuuuuuauuuuugcuuaaauuuuucuaaaugaauuaucaggucaacauauauuaacuuuuauauggcuuugauuacauaguugcacaauacauuccagaaagguuucaacaauuuacacucccaucagcaguaacuaagcaauuuaauccuuuauugcaaguuuuguuuguuuguuuuuguaaaacccucaaggauacccuggacacuccugugcuucucuuaaaggcaaauauuuuuccccuagccaagugccauucuccuuucucauucuucccagacauaggacccuucuacucagcacuggccaaggugagcaaacuccaugcauuucuugccuuugcuaccaaaaaacuuagcaggaugaacauaccucccuccuaagucuaguuugauaaagaagccccuuuucuuauccagggcaaaagccucuccaucuucucuagaucccauucuacccugauucuuccaagaaugccccacuuucuuccccgccucuuuguccucagcauggaagcauucucuagucucucccccugggaucuugaguuucccccuaccuuguuuuucucuucucuuuaggugcgaagcuccuagaaagaaaacauccucuuguugaauaucauuugcuuaucacccaaugagcuauccuuauuuacacauucucauucucccuccucccauucucucacucccucccgccccacccaauaacuucucuugcugaaguuugguguccucaugccuaaguggugaaccuaugggccaguucuguagcucuuagcauuuuuaucuuugugguuuccgccacauuuuucuuccuucuccuugaaguucuaucucuggucuuucuccccuuaaauuagcugauuuugccucauagaggugaucuuuaggcucuaucagcaauuaaccaguaacuuggcuugaaucugucucuguaagaguuggcuguacaacuaucauugucuuucuuccucauaucucuuuuuguuaauacuauuaggcacauaaguggacuuucuucuaguaaaucuuauuuuugcugguuuucaucuccgcuuuggauaacuccaacacauaucuucugugucucauucaaacaagcacuuccuuuccucccucucccguccuaccuccccaagcauuugcuguucucagugcuuucaauccaucucauaaugaguacaagagugugaacaguccagcccauugggcacuuuucucaucugaauccguacagcauguauaaauuacacuucacgguagccagaaggucaucuuagaaucuaaucaucugugguucuaaucucugacuucuuuuuuggcagucaugcccuccccuacaaccacacacacacuuuuuucuuugucuuucuuaauuguacauuuuuuaaggcaaaaaucaccaaauauccauaguacucuuuuccuuuucugaccuucugugguacuuuuuuauaccauauaauauuguuuuuaaauguugauuugucacucugauaccacguuauggcagaucuuauuuaacauuuauauuucuuaacuugacaaaagguauauauucuuuuuuuauauacauacuuuaaguucugggauacaugugcagaacgugcagguuuguuacauagguauacacgugcuauggugguuuguugcacccaucaacccgucaucuauauuagguauuucuccuaaugcuaucccucccccacccccacccccugccaaugacaggccccggugugugauguuccccucccuguguccauguguucuuauuguucaacucccacuuaugagugagaacauguaguauuugguuuuccguucuugugguaguuugcugagaaugaugguuuccggcuucauccaugucucugcaaaggacaugaacucauccuuuuuuauggcggcauaguauuccaugguguauaugugccacauuuucuuaauccagucuaucauugauggacauuugggcugguuccaagucuuugcuauugugaacagugccacaauaaacauacaugugcaugugucuuuauaguagaaugauuuauaauccuuuggguauauacccaguaaugggauugcugggucaaaugguauuucuaguucaagauccuugaggaaucaccaaacugucuuccacaaugguugaacuaaguuacacucccaccaacaguguaaaagcauuccuauuucuccacauccucuccagcaucuguuguuuccugacuauuuaaugauugccauucuaacuggcgugagaugguaucuuauuguaguuuugauuugcauuucucuaaugaccagugaugaugagcuuuuuuucauauguuuguuugaaacauuucauauguuucaaaugucuucuuuugagaagugucuguucauauccuucgcccacuuuuugacuggguuuuuucuuguaaauuuguuuaaguuccuuguagauucuggauauuaucccuuugucagauggauagauugcagaaauuuucugccguucuauagguugccuguucacucuuugauaaaccugacaaaaauaagcaauggggaaaggauucccuauuuaauaaaugguguugggaaaacugucuagccauaugcagaauacugaaacuggacaccuuccuuacaccuuauacaaaaauuaacucaagauggauuuaagacuuaaacguaagaccuaaaaccauaaaaacccuagaagaaaaccuaggcaauaccauucaggacacaggcaugggcaaagacuugaugacugaaacaccaaaagcaauggcaacaaaagccaaaauugacaaaugggaucuaauuaaacuaaagagcuucuccacgacaaaagguauauauucugcagccacaacuaaccugugugcuccuacggaacagggaucaugucagucuauacccacaguaacucagacuggaaccauacauaauagguguugguaauguuuauuccaucagugucagauauucgucuuaggagagugguaaccauguauaauugagccuugacccucuguuguagggaaaugaagcaggugauuuucugcauagaacuuguggcuucuuuuucucucuuaguuaauaucccuagagaucagucuucauaaccugcaccaacagacggaugcaaacauugaauacuucagaauacauuuugcauuuucuuuguaugucguugaggauggacaugaccugggaauuuaauugaaaacaagcaauaaucgcaucauaaagacuaauucaagagcucagaaauugucccuggcuccuuauucugccucugcuugagggugcucaguggcuugcacccuucucuguggacagguggccuggucucugacugaggaaagcacucauggggcaagauuucucccauagcaauuguuaaggacaagauagacaccacaaaagguuuuucugaaaacuguguugcagagaagauaauggguguguuuagaacauaaauaaaauaagcagcaguuuugagaaaugacaguaaacuugaaauaauuuaucaaaaaugugaauaaucuagauaacugugauucgggaggaaauauauaaaucuagggauauuaauuuguguacuuuucauuuuuccauguacuauacauuuuuaacaggauuuaagauacauuuuucaauaaagugcaaagaaugugaauaaaugauaaugaauuaaaagcaguuugguucauaugccauuaaccagauuggccugacuuuuggaauuuaaaacuaacucuucuuuucuuuuuagguugccucuuggugcugccuuggccguauuuggcacccagaaugcuucauucugugacggucuauuaauaagguugccuugcuagaguuuggagcagggccucagguagguggcuuuuaucauuauauggcaugacuuucaaagugauuaauuauuccaguuccuaaauacuauaagauauaauauuaaaagcuuugaaaagcaugccacauaauaagcaugccacuuacaaucuuagggucuaucaguauguacugugauggggacuucaguaauaauuauggucgaaugggaggcuugaaauacuagcaaggagcagucuuccucacucuuugcacaaaacacauagcugcuguaaaaacuuaauuuguuccuguuccccagauagcccacagauguacucuuaagcucuucuuucucuaaaucuugcacagugauacaguaucccauguugcccuuauaucuuuuuuuuuuuuuuuuuuuuuuuuuugucuccugggcgggauccuauuaccuaugggcagguggagagggggauuagacuugcucacagggauggggcagaugcuagaauaaggaacccaaugcaacaauagcaauuugccagcauuguugggaagaggacacacacaagcuaucuagauuucccagccuguaggcgcagcucagugucacagaaucaagguguagcaauacuuggaaauccaggcacacguggauuugguaccagguaagucugucaguacgaccuucaagauaggguagagguugagaggccaggacccccagcccuaggacggggagacuggaaaaaaaaacaaugguggcugugacagauaccaggggaugggcuccugaacucuucacugauggcagaugggggaaaggaggccuugggcaggguuucacaagauacaucaacagagcuugaucaaaucaaagguacacgaauuaaucgggcuaaaauuuucuauaagaacaacauucuauggguuuaagcaucaacaccguuagcauuaaaauuuuagcuaucaguauacuguaaauauuuuagcuaucuguauacuauaaaaauuuuagcuaucuauaugcuauaaaaaucuuuaguguuagggguuauggauuuuuuuuuucuuuuucuacuuuacuguaguuuuuaaacuuguuuucaaugaaguuguuuuuuaguagcuagaaaaaggaaaaaugacuaguuuuacuuagccaaacuaaauuuaugcagguuuucuccuuuuuuauucuccuauaucuguaaucaguugaaaauuuccucugauauuuuaaacaugauccucacauuuuauuuucacaugaaggauacccucuuuuaaagauuuugaauuuuacuuuguuccuuuuuccuucccauagaacuucacuggcuauuucuaaaugauaaaucaugaucaaccuguaguuccaugugcuuaaggagcuauggaacaggacauuuaaagcagaaguguucuaaacguccaggcuggcugagugcuacccagguuuguauccgugcuuggcgggcucuggguagcacgugccugagacucccuggcuuuugaggucugccgaagcaggugacgccucuccuggggacacagaagcaguacggacucccagguggcgguggugcuuucccuaaguuccuaccucucugccaaaacaaacuaaccauguauuucucuggggcuugucuucugagcuugcuuuauaaccaauuugaaauuucaggagaccugaaacauaguuaccugcuagcuuugauuccugaaauuuccuuaaagggaccacaguucuguucagcaaaugucuaucaaaugucugcuacaugcuagggugcugaccaggugcuagggauacgaggaugaauaauaguaucccugcagaugaauuuacugucgcugggggagagacaggucagacaggucauuucaagaagagcuuuccaguccauauuaagggugaaagguucagagagguaagguuuucaaggucauucuugaucaaauagaauuggucaaggaauauagauaacaaaccucuucuaauuguuccagccaggagaguacaugggguccucuggaggcagaggagagagcggcuacccuugacaugaugguuuugccuagaacugauccuguuuacccuuaacugugugggaauaaauagaaauaguuguuucuagaagugauuuuauccuggacaugcacaugagcauaacuuagggaggacagauggaugguaugugcagaccugaaccaggccaugaauucuguuuucauuacauuuuuuaguacuacuaaagcaucagcacauacacaacauuuaugccauagcacaagccugucuuuaaaguacacuuuacuuugagauggcuuaaaacuaauuucugcuugagcuuuuauagauaaguacaacuuauauuuauagcuaaguaaaacuuucuuuagcacuuuucuuauaaagugucugaugucugccuuuuuguuugaauuuauaggcagauucaguaugggugcuugacaguucagacaugaaaucuggauuauucuguauuugcgauuuuaauagcauuaggcaauuuacuauacaugaauggaggcauguucucuagauauuuagguuccuucauugugaacauuuuuauaguuggugucaaacauuuuuguuguacccccagaaacuuaaucaguuacugguaauaagaucaauaacuuaccacaauuugggauacauacaguuuucagauugagcugaccugugggcuaccuacuuuguaaucagaccaagaucaccaauauuuugggacuguuuuauagaaaaaaaaaaaagcacaggaaauuaucuaaaaauagaguauugauuaagcagucuuacuuugcauucagauauaauuguccuucuuugcucucugaggcaucauugcuucccuuuugcacaauuucuuuuucauuuccucuuugaaaauacuaauggccccaugugaaaaaaaugaaaauaucucaguguuguaccacccauuguauuuuuaagucuuuuuauuuugauaaaaauacacaaucauagggaaccccccacccccaccccaaauagcaguugaaaugaagugcuucuaaguuguggaucauuagaagggagcuuucaguugggcaugguggcucacgccuguaaucccagcacuuugagaggccaagacggguggaucacuugaggccagcaguucgagaccagccuggccaacauagcaaaacccccaucucuacuaaagauaacaaaaaauuagccggguaugaugguacaugccuguaaucccagcugcugcggaggcugaggcaugagaaucgcuuacaccugggaguuggagguuucagugagccgagauugcaccacuguacuccauccagccuaggugacagagugaaacccugucucaaaaaaaaaaaaaaaaagaaaaggaaaagggaguuuucaaaagagaaaaaaaacuuuuaacuuaacguggcauuuuugcucuauaaaauaaacaaccaaggaaaauaugucugaauugggagauaaaauuuacuugauacuccuucuucauuggguuaucuguucauucucucuggcuacucuagaaaaugaguggccugaaaaggaacauccugcuuguacagauaagagaacugauauugggguuuucugauuccacuuuggaauucauugacuuuuuccuguugguucuuacagacaaaaaguuaugccauuuuuccccucacuucucacuucucaauuaguuuuuauuaucuguauacuaaauauaagacauuucuaaacaucaguaaggcuaauuuuuaugguaaauuucaaaaagauguccuagaacuauauuuuaaugaauugcucaaaaugaguuaaaaauauaaaacgcaguaauucaaaaagggcauccuuauuuuugauuaacuuuaguuaacuaugacaucuaauuuaggaaaguaaauaguguaguuuuccacaauccaguuauaaaaugcauuuuuggggaccugcuguaaacucaggcgaguuaggugcaugucuuggcuaugucuccugcuucacaguaguugcuccagcuccuuucuguuccccucuguagggaccagcagccccaacugagagucucguccuuccugccccauaccaaggacuaaugcaggcaucaggcguguuuucacuuuggaaauuuuuauuacgaaugggagccagacugauguuaucuacuuguauuaguugauuucuuaguauuaagauuagagaaugcuuguuuucugaggcaaaauaaguauuuuuagauaaccuuuuauuacaauugcuauuguuuuaaucuaagacuuuucaaauagcugcuuaguuucaaaaaaaauacuguucuauuagcuuauucaauuuguuggaccaaauuguguucauacuacauuaucuuugacuugaauauagauacacaguugucccuugcuauccaugagggauuaguuucaggacuucccugggauaccaaaauucacagaugcucaaguaccugauauaaaauggcauaguauuugcauguaaccuaugcacauccugccaugaacucuucacaucaucucuaaauuacuuauaauacuuaacacaauguaaauacuauguaaauaguuguuauacuguacugcauaugaaauaaugaccaaaaaagucugugcauguucaauacaaaugcaguuuuuaaaaaauauuuucaauccaugguuggcugaguccauggaugcaaaacccacaaauacagagggucaacuguaaauucuaucuuaugucuauuaugaugacuaagcaagccuguaggucauugugaugcugguaagcacuuggcccuguuuuaauuuuuuucauucauucaacaguuacuuuaacugccuuuuaugggaaacaacagugaauaaaacuggcacaaccucucugccccuguaccgucugcaguugauuuuucauucuuagguuuuuauaagauaguuuuuuuccuguuauuuuucacuaauaagugauuuuacagacuauggaaagugaaugcuguaaaaauuuacaaauuaugcagaaacaccgaaguuauuucuuaaaaauguucuaaguauacuguugcccuuacuucaaaacugacugccuucaguuggguuaucuuaguaauagauucuuucauauuauucagaacucucuuguguuucauacauguaaauuacaauauuaagaacugguaaguuucuuuuugcaaccuacuuuauuuacucuauauggaaaaaccuguuuuaaggaaauuuuuugacaucuucugaauuacuuacuaaaggcaucuuguaagcauacaggagaauaaagcuuugaugcuugaugguauuugcccuuaauuagcaaaaucuguuugacuuuuaaauaugaaauaauuauugaugcagguaagugaaaaaauucacagcucuuagcaaaaugauuaucagaacuauggaauuuaaaauaagcaguuuuaauacaggccuguucuuuugcuggcaucucauaggaacugauuuuaguagacccucugauguaugacucauuuuggcuuguuaguuuuuuauaugagucacuguuuuagaauaauguaaaacaucggaagauaaaucugggugugugugcacaaacacgccauacucucucuauuguuucuguaugcaaaguugcccuggaaaaaauugcuucuucugguaccaacaaaaacuagaaggguauucugaacugcuguucaucuuagagugauuugaaauggguguauguauuuucuacuuugguucacaguucaucagaccaaggcaaaggagaauuuucgucacuugaaaagcacaauaaccaaucuuugugaguuuuuuuuuuuuaaguagaaaagaaaaacaugaguaccaaaccaaguuuuguugcacuuuucagaauaguacuccuggugcuuuuuaaguuuuucuuaauccuauacaagagaauauacagauaauuuuaucuaacuuuucaguuaggauuacauaaauacaaacuguauauuuuuuauuauaucaauccaaagaauaauuucuaaccaguccugcuuucuuuuuuggggggagauauuuaguagaacuuugaaauuauuuggcaacucauaagaacucaaaauagguucaauuuagggaaauuaagaaauucaagauuauguuuugggauaaaauaaaaugauuggcuguguuauuuuagacuguaaaauacauagaaugggugauuucuagacuauuggaauaugucacaauauacauaauuuuaaacuguguugaaauacuuagaugcuaaagguuuuuauuguaaaaugucauugaacaauaagcauaaauaaagauuuuaugaauguauuugagaaugcaauaaaauuuauauggauuggagaauaaaggaaaaaauacauaaacuuauuguuuacuaguuaacuuggguuuucaauuuguuucuacccaaaucguuuuccacucagacagauguauuagcuauuacuuuacauuaacaguuguuuaaauuauuuaaaacugccuuuauaaacugucuuuuaaacuuuuuaagucuuaaauuuauuuccuuuuggauauuuggcagcucuaaaagagaaaauaggcacuauccccucuuuugaucuuuuaaggauagugacaggauuuauccacuugcaaauugguuugcuaaccugccuugucauagaaaacaguagaauaaaagugaagucacaguuuuagggcauucaucccuucuuuaucacacauaugcugucaaguuguucaucuucugugggccucucaccuuaaaauggcaaugaugguaaacacauccaccucucagauucauugaauuccagggagauaauagagaugaaaacacuccacacgugucagguauuuauauucuuaaaauaacauaauacacaaaauggucuuucauauucguaauuacccuacaaaaaacucaguaugugcccugggcaaguaaguauuugcaaaguuaauguuauuauuuuguaauuuugaugugcagaauuccguucuuccauuuaugcauguccugugcuuuacaaaagaauggagcuuuugcuuuaauguuuaaaauaccuuuauaggucuaaauuuuugcuuuucuugucuuuuaaacuauaaaaaaaugcugcuuucagauauacccuuggcauuuuuauaaugaugcuugaaugccuucuauuaaauacuuuauuuagacaucaucaaauucuucaaguaugaaaguuuuauuacaggggauauuuuuagauuuguguuaagaaucugaaaguuauuuuuauuuaaccugucauuaacauaucuguuauuuuaacuguuugauuuaauuaucccuuuauaaucaugauuucugaauguucaucuuuaaaauacucugaguuuacugaucucucaugccuugugcucucuacaauaggugauucuauucugccuuuugaccguuauucuuuucauguuuacuuguacgaucaagaauuaacagauuguuuucugugugugaucucagucuacuaaugaucauacuacugauaaacauuauaagcuacuuuaagaguuuucaacaaugaccucuuaaaccaaaugaugcucucuuccuaacaccccuuucuucuguagcaaaucuauauuuaacuucucuugcaugcuuuugaaaucuaaagagugcagaguuguugcuacauuucaaccauccuugcagcauccugaaaaauaaauuggcagguguugcagauagcaaaaguguagcucugagaggcccccguugugcuagugugcacaguaugggcugagugcuuucaccgggagccuguuguucuuuggguggcuccagauguacccuccgaaaggggccuaaaauugucacuuccauaauauuaauaaacuuaauaaaauuuugaucauuugguuuauaaacaguagcccuaauauccauuucaguagguaagucagauuuuagaaauaaauaaauuugggaaagaaguggggagucauucagcaucacaaauugcuauuuaucuagguaauacuuuuuauuuaugcauuuauuuggucacguaaaugugcuuagaccuaauaaacauauguaguuggugaaaauuaaugcaugacucguaagcagaguauggaauguaagcaugugccaugaaacugcaauucuuuuauccuguauuuuccaucauuuacauaccgguuccauuuagaggauaguccauuuucacuuuuuuuucauagauuggccaaaaugggaaggauuggauuccacucucuuccacgaagagucaaugggacuggcuaagaucaaagucugaggcuuuuuccaucaguaaucagguaugcauugaacuaaaaaucacuauaauucuaugcaugcaccuuuaaaguauuugacugauaugcauauuaugaauguggucuuuuauuagauuuugagcucacaaccuuauccuauaguuugaaaugcaccuaugauaauuaauuugaguuuuguaauauacuaaaauaaaaagguauuaucagccaugaaaaaauuucagcuggucuuagaaaaguguaauauuugaaaucagugcaaucuucauugcucaguauguacauccaaagauaacagaauucauuuguuacuccauauugauuaucaccaauuuuaguaacaaucaaauguuuguauauugcauauuggugcacuucuaauaauuuuuuuuaauaacuuagaaguuguuuuucuuaacuggaauucuuugcccauuaugguuggauuuuauaacacaauggcaaauaugaccagucuuugaaguauuuucagauauuaguuauauacagggauuuagauacuugcauuccauguagauucugcaauugggaaauguucaauuuguuucccacgauguucuaaauaggugcauaaaaguaucagguuaggaaaucaaauaaugaaaauuaagguuuguuuccugccuugguagaaugcuuuauaccaguuuauagugucauuacuggucacagcagaguagcuguuuagauauuuccaagggaagcagaggagcuagcuuuugaaugagaauauaacagaaauagagcaagaagcccuugagauccagaaaaucuaaaacaaaaagaacauauguuaccauugguaaugucaguugcauuguguuaaugucacuuuuaaacagcaaggcggauuuuuagaccguuugaauagcacaaaggccuugccuguaucuaccuaauaaagaaagacaccugaagcaaguacugaugaacuuacccauaugccuuacuauguuaauaaagugaguggauaauugcuguauuuugccuguuuagaaacagccuuuacauuaaaauaaaguuagaccuauuguaacauagaguuaauuuuacaaaaauguagguauuuagagcuccugcgaaaguauaacuggaauccgugaaagucagucuaauaguaacuugguaguagcuugggacagcaagugucagugucagucuggugccaaaacacaggugauauaaggaaguugguuuuaaaagagguugcagguauuauuucuauggucucuuaaaaguacaucacaggccagguguggcggcucacgccuauaaucccagcauguugagaggcugagacuggaggacugcuugagcccuggaguucaagaccagccugggcaacauauugagacccugugucuacaaaagauaaaaaauaauuagccaggcauaauggcauguaccugcagucccagcuacucgggaggcugaggcacuugaagauagcuugagcccagggaagucaaggcugcagugagccaugauugccccacugcacuccagccugggugacagagugagacucugucucaaaagaaaauaaguacaucacucaacuagccuuuauaaacguugaggaauuggaacuuugaggaguugguuuucuuacccuagaaacagagucgauaauauuuacuauguuuugucgaugaauuuuuaaagguuuuaauucauuuuuaaauuuuuuguuuaaaaagauauacuccuugcuguacaauauguacauuucauucuuuuuugcagcaccaauaacacauugaaacucugacacaccuuuuuaccaaccuuaaacaccucuuugaugauguguugugugccaugucagaaguccacacaggucugcugcacacagguugcagguguguccaaaggccaaugcccucagcucuuggggaugccugcugacucguuuaccuacuaaccucagugugccuaaaauuuuugugaugugaaaaacgaugaggaaaauuacauuaaccaugucuuucucccaaaaugacaaagagccaugcucuucaccuaauaaaacaucaaaagguuuuacuauuugaagaauuuguauuuguuaggaagaugaaucauuucuacucuugacucaggaaucccucagaguaugaugacacugguauaaugcaucacuucggguggugcauucaacucuuucaggccucuagugucucuccgugaaguaccucuuccacagacucaaugguucacaaggugccuaaaagaguuuucaguugcuuaucucuguuuuccuauagugcagucugacuagagcugacaugcacaaaucaaacugauuuuuagagacugaaauauuugcugaaacguuuuuagucagauuuuauguucucugaucuuuuguaaaaauugaagcuuaauaaugccacuuuuuagagucauguuuugauucuucaugagaguuccugaaaucacuacugcuaugccuaaguaaaacaugugucaaguggaauuucaggguauguaugaacuguucauucugagcaaugcauuucuauguauuuugacaaauauaaagaaaccuaugggguuucuaauguaaugugaugauauuacauuagaccagcugaauccauuuuauugguuucuuuuuuaauucaaaagcaucacauagcaaauaaaauuuuuaaaaauugaguuuaguuacaaacuaguuguuucuuauuuuuuuuuccagucccuuuuugcuuucuuuuacgaccacaugaaacuugagaagccaccuaaagcuauaucauuuaguggaguugggcaguucccaaguguccaacaagaaggccugguuuaggcugcgauggccacugucauuccuggugauuugucagaaguaagagauacccagaaagucccuucagggaaacguaagcguggugaaaccaaaccaagaaaaaacuuuccuugccaacugugugacaaggccuuuaacaguguugagaaauuaaagguucacuccuacucucacacaggagagaggcccuacaagugcauacaacaagacugcaccaaggccuuuguuucuaaguacaaauuacaaagguauuaaacucuauuugucuuucagauuauauuuucucuuauguuggcuguuugaagccauuguaaacguauguauuuguauacacauuuuucagcuaauuugcaaagaggaaauguuaaguagauuagacauugguuuaguuuuuaguauucuaaaucacauacuuuuauguguuagugucuuuggacuuuuuaaaauaaaaugcuuaaugaguagaauuuccauuuguagaaagaaauuacaacaagaaaaggguaaggacguuuacgugaguauauucagucuugcucauuugcuuuuguaaugauagcuggaaaccagcaaaaacuaaaguggcaacuuaaauggcucaaguuuugcaguaauuagguauauuaacuauccucgugguauauauuaaguuaaacaguuuccauuacuaagggaauucuguguuagcauaguaguuuagcuuccauuugaaaagugaauacaugccauuuuugucauaauaacuacuuauagauuauaucuguguuuaaaggcacauggcuacucauucuccugagaaaacccacaaguguaauuauugugagaaaauguuucaccggaaagaucaucugaagaaucaccuccauacacacgacccuaacaaagagacguuuaagugcgaagaauguggcaagaacuacaauaccaagcuuggauuuaaacgucacuuggccuugcaugccgcaacaaguggugaccucaccuguaagguauguuugcaaacuuuugaaagcacgggagugcuucuggagcaccuuaaaucucaugcaggcaagucgucuggugggguuaaagaaaaaaagcaccagugcgaacauugugaucgccgguucuacacccgaaaggauguccggagacacaugguggugcacacuggaagaaaggacuuccucugucaguauugugcacagagauuugggcgaaaggaucaccugacucgacauaugaagaagagucacaaucaagagcuucugaaggucaaaacagaaccaguggauuuccuugacccauuuaccugcaaugugucugugccuauaaaagacgagcuccuuccggugauguccuuaccuuccagugaacuguuaucaaagccauucacaaacacuuugcaguuaaaccucuacaacacuccauuucaguccaugcagagcucgggaucugcccaccaaaugaucacaacuuuaccuuugggaaugacaugcccaauagauauggacacuguucaucccucucaccaccuuucuuucaaauauccguucaguucuaccucauaugcaauuucuauuccugaaaaagaacagccauuaaagggggaaauugagaguuaccugauggaguuacaagguggcgugcccucuucaucccaagauucucaagcaucgucaucaucuaagcuaggguuggauccucagauugggucccuagaugauggugcaggagaccucucccuauccaaaagcucuaucuccaucagugacccccuaaacacaccagcauuggauuuuucucaguuguuuaauuucauaccuuuaaaugguccucccuauaauccucuaucaguggggagccuuggaaugagcuauucccaggaagaagcacauucuucuguuucccagcuccccccacaaacacaggaucuucaggauccugcaaacacuauagggcuugggucucugcacucacugucagcagcuuucaccagcaguuuaagcacaaguaccacccucccacguuuccaucaagcuuuucaguaggauucugggacauggauucauuacagaaauguauguguagcugugcccuagaugaccauuuuuauuuuagugccuacuuuaaaacaguauaaaaauuucugcuuuuguauaauacaaauuuucauuaagccaguauaaaauagaaacuagcuuuuaaacugagcuuuggaaccauuuguguucaguuaaguuuaccuggguauuuuguccugauucacugccaauugucacauuuuaagacuuuuuuuuuuccauauaggaaagccauuauuaguaguaaacuuuuacaaaucccauuuucaaauuacuuuuagaucuuaaaauuuucauuuuugucuaauaacaguggcucuaccuuuugacaucuggcucauuaaaaaauuuagcaauagaauguaaauuguauaaaaaguuugugaauaacucaaggguuuaaauuuucuuacuagcuucuaaauggauuaauaaucaagugcuucaaaugaauuaagaguccaguuucggaagauaauaaauguuuguuagauacaccauaauuucagaucaguauauucugaagacucccuguugucuggcuaaaauauuugccaucuuuauuaugagccuuuaaggaaaacaaacccuaaacacaaagcaucaguauuuauagcaaaaagagacucuguuaggugacauggcauuucgugucacuuaauaguuggcccuaaauuaguacacaggauauuuugucguguuucauccuucuuaacaugcuaucuuuucauuuaauaauaguaauaguguauggcauuggggucuucagagucgauauauagguagaucucuuuagucuuuuccaccuuucacauccaaggggugggucaagugcagccagcaauuuauuuucauuguuggcccacgguuaguccauaaucuagagccauuguggaacugcagccaugagguguguuuaucccacaguggauugacucagccucugugggugacagacuucuaagcaggaagauagacgugaagcacaugguuacauuugggaacuuguguagggaucauggccccuguagccaggguuaaaaacuggacuuuuuagaaguaaaguaaaagcauaucgcuuauaucauuucuugcugaauuugauauguuuuucuuucccuuaagaaucaaaagcagaaaacaaaaacaacaguccuacuccgauguuaucuuucugauucaaugugaauccaucuuuccuugcaauauuuugga

SEQ ID NO: 21219 - RNA, 70625 nt, Homo sapiens
gaaaauaauucuuucaagaagaucagggacaacugauuugaagucuacucugugcuucuaaauccccaauucugcugaaagugagauacccuagagcccuagagccccagcagcacccagccaaacccaccuccaccaugggggccaugacucagcuguuggcaggugucuuucuugcuuuccuugcccucgcuaccgaaggugggguccucaagaaagucauccggcacaagcgacagaguggggugaacgccacccugccagaagagaaccagccagugguguuuaaccacguuuacaacaucaagcugccagugggaucccaguguucgguggaucuggagucagccaguggggagaaagaccuggcaccgccuucagagcccagcgaaagcuuucaggagcacacaguggauggggaaaaccagauugucuucacacaucgcaucaacaucccccgccgggccuguggcugugccgcagccccugauguuaaggagcugcugagcagacuggaggagcuggagaaccuggugucuucccugagggagcaauguacugcaggagcaggcugcugucuccagccugccacagguaugagcugguggcccgcccagucccacacugugcaaacauggagaaaugaagagcauagcagcauccaucacuugcuuccaaagugggcucacuagaaaacuagcuucccagaguguucauuacaaagagauuuuauguucaaauaaguguggagacugcagccaucucucuccugcuuggaggagucacggcgacaacugcuucucagaggaauuuucaggcuucugauaaguccugcuuugaaaaacccuauuuuaccuuaauuauaaguuucuaaaacguauuugaccaugaaaucuacccacuuucuaccccaaaaccuaugaguacgccaugaaauuucuaccccagagagcacucucugauagguacugcuguggccccaucaccucauuuuacaaauagagaaacugaggccuggaaagaggaugggauuccugaagguccuccaauaaggaguagaguuccucacauuucaguauucuuacaaaugcacagugcugccugugauagugcugaguuauaagaauuagaaaaaaguuccaauuuaauagcaauuacaaugauuacaaucauauaagcucccucuguguaacaggcacuguuguauuaucucauuuaauccucccaacagcccuuuaagguaaagauuagaugaggggaagauaaguccucuucuacagaucaaagaaaugaaucucaaggggauuaacccacuggcacaagauggcacaaagagcaauaagagauagggucuuuggcuaggcgcagugguucacgccuguaaucccagcacuuugggaggcuaaggcgggcggaucaccugaaguuaggaguucaagaccagccuggccaacauggugaaaccccaucucuacuaaaaauacaaaauuagcagggugugguggugcaugccuguaaucccagcuacucaggaggcugaggcaggagaaucacuugaaaccgaggggcagagguugcagugagcugagaucaugccauugcacuccagccugagugacaagagcaaaacaccauccgaaaaaaaaagagauagagagagagagagagagagagagauagggauuuugcaugugccugugugucuccagagcucauacucucccauggaugcccuguuuccacaugcauccuauuucaaggaauuuugcugcuuuggaauuaugucuuuaucuccaauaacuaaaguugauaaagcuacaugaguuucaacaacuucaaaucagagcugaaaaucuguuucugccacucagaaaaaaauuaccaaaauguucuucaacaauuauuucaagaguaaaccuaaccacccuaagugaaauagucuuacggcucugcaggacaggcucuagguuucuaaggcaauuuuuaaaaacauuuucuuuaggcauaaguuaguuuaucuuccacuucugucaacucccuggaaaaaugcagaugagaauacacaguaggaguaaugcuaaguagucaguuaaaaugauuguuuagagcagugcugucuaaugaaaauaugacucacacauguaaucuuaaauuuucuaguagucauguuaaagaaaggagaaagaaacaaguaaacauaauuuuagucaucucuuauuuaauucaacagagccaaaauauugguuuuucagccugaaaucaauaucaaaauuauuaauggauacuucucagucuauuauuuuauacuauuuggaaucugauguguauuuuacacuuacagaacaucucaauuuagacuagccacguuucaaugccuaauaaccacauguggccaagggccaccauacuagauaguacauacuuagacucucacuuuacaaaucagcuuuuuuuaaaaaauucuuucuuccugcugucaagaaugagauaaaauauauuaauacaagcuguuucuacguacagagacuacagagugaauauacucuagugcagagaauauagaacuggguuuuguuucuucuccuuaagcuccauggagaucagaccaaugacuucugcaaacugagcuaaggcaauauuuaggccucaaggggcucgaguaaugucaaccuugaccccacauucuuuaaguugaccuccacuuagccuucaggauagaaagaaauaaaagauaaaggcacuauacuuuucuggggacagagccaaacugaaagguguccuuauagaauuagaaagccauuagcuaccucauuuuaguugcggaaaauuagaauguuuugguuauauaaacccacauaccaacuugagccaaccuuccacaaaaaacuuuggaaaauaaaacagaaaaaaauaacaaggacacaagagugagcucuuaagggguuuacuuaacucggauauaccccagggaagugggcuauuggcccaacuucacguauaagaaaacuaagcuccagauagucuaaaucccuugccaaauguggcauagauauugaaucaaaaagucagaauuacauucaguucaacaacuauuucuugggcaucuuuuaugugccuggccuugaugaggcacuaaagaaauaauaacauaguggccagucgugguggcucacaccuguaaucccagcacuuugggaggccaaggcaggcagaucacgaggucaggauauugagaccauccuggcuaacauggugaaaccccaucucuacaaaaaaugcaaaaaaaauuagccgggcaugguggcgggcgccuggagucccagcuacucaggaggcugaggcaggagaauggcaugaacccaggaggcggagcuugcagugagccaagauggcgccgcugcacuccagccugggcgacagagcaagacucugucucaaaaaaaaaaaaaaaaaaaaagaaaagaaagaaauaguaacauagccccagccuaaugcauuucacaaggcagugacucauaaucaucauaggaauaguaagacuucuugaaaaugugacaaaaacuaugaauccgcuccccagggguggaaauacacacacacacacacacacacacacacacacacacaccccuaugcauaaucacacacuguuuuggcauacaagccuauaauuucagggaauucagguuaugaauuccuaccugguauaacaggaugugagucucaucugauuucacacacuacaacaaaugguucucaagccagauggagccugagggugcaaccguccuucagcugaauuugaaucugggugcccuggguagauacagaaaaauguggcugcuuaagccuggcugagaacuucuguuucuuuuguugcaggccgcuuggacaccaggcccuucuguagcggucggggcaacuucagcacugaaggauguggcugugucugcgaaccuggcuggaaaggccccaacugcucugagcccgaauguccaggcaacugucaccuucgaggccggugcauugaugggcagugcaucugugacgacggcuucacgggcgaggacugcagccagcuggcuugccccagcgacugcaaugaccagggcaagugcguaaauggagucugcaucuguuucgaaggcuacgccggggcugacugcagccgugaaaucugcccagugcccugcagugaggagcacggcacauguguagauggcuugugugugugccacgauggcuuugcaggcgaugacugcaacaagccucugugucucaacaauugcuacaaccguggacgaugcguggagaaugagugcgugugugaugaggguuucacgggcgaagacugcagugagcucaucugccccaaugacugcuucgaccggggccgcugcaucaauggcaccugcuacugcgaagaaggcuucacaggugaagacugcgggaaacccaccugcccacaugccugccacacccagggccggugugaggaggggcaguguguaugugaugagggcuuugccgguguggacugcagcgagaagagguguccugcugacugucacaaucguggccgcuguguagacgggcggugugagugugaugaugguuucacuggagcugacuguggggagcucaagugucccaauggcugcaguggccauggccgcugugucaaugggcagugugugugugaugagggcuauacuggggaggacugcagccagcuacggugccccaaugacugucacagucggggccgcugugucgagggcaaauguguaugugagcaaggcuucaagggcuaugacugcagugacaugagcugcccuaaugacugucaccagcacggccgcugugugaauggcauguguguuugugaugacggcuacacaggggaagacugccgggaucgccaaugccccagggacugcagcaacaggggccucuguguggacggacagugcgucugugaggacggcuucaccggcccugacugugcagaacucuccuguccaaaugacugccauggccagggucgcugugugaaugggcagugcgugugccaugaaggauuuaugggcaaagacugcaaggagcaaagaugucccagugacugucauggccagggccgcugcguggacggccagugcaucugccacgagggcuucacaggccuggacuguggccagcacuccugccccagugacugcaacaacuuaggacaaugcgucucgggccgcugcaucugcaacgagggcuacagcggagaagacugcucagagggugagugccagggcgcagaccagcauauaauggccaugauggaguggacuccuaguauggguuggaaaacuacguuuauauauauaaacauucaugcacacugauucuuuguacguauuaauauauccauuuaaacacacacccauaaugacuuuuuaagggggcccugucauuccguuguuacaaggugaccuauuuaagggcugaagggcucagagagguuauauaauugucccagggacacacagcugacacaucacagagcugguauucaagucugccuaacucaucuacauagaguuuaaaauaaaguuggagaggccagaacacaucuaguguucaagaugagguagauaaagggauacucucucuuuugcuaaauaucaacuuuauuuccuacucuccacugacaucaaaccaacaguaaacaaaaucucuguauuuggauggauguaaaaauucagcuaaauugaauacgcagugagauuacauaaaaacaacuguuucaaaugcauacuuggcuaaagacgaaaugccuauuaucuacaagauugaccugucuuuucauugucuuuuguaacugguuuuguuuuuuugauuguuuuguuuuuuuaauccuaaagacugcaagcuccuauccuuaaaagggcacuauuucuagcaguuaguaugggaccugguacauauuaagugcuuaguaaacccugguuaagugaaaacacaggagagaaaauuaaugcucauauuuaaugagugucuucuuuguacuccucucaucuacccauauuaucauugucauaauggagaauuuuuuccuuuacuaaaguuauugguaucuaaacauaaauaaauggcuuuguguucaauguggcgcaagcagggaagccugguuggaaagaacaccaggcuggcagggaggagauacaaguucuaaacuugaugaggugagcaagcuuggucaaggcguucugucuuacucaccucuauaauauaagaaaguuggaccagauaugcccaaaauacccucccagugcuagggacacguaacucaaaguucagagcagggagugaggcucagacugcacuuucccaugccaacagccugcaucugagcuaagacccaggaagcacagaaaguuggagaggccagaaacacccaagggcacacugcugaccugggacuccagccugaaggaaauggacuaaggaacagccaccacaggucuuaagauggaucacagcagggggucccugaugccaucugcauuuuagaggcaacagaagaucuucagaccucuguggcugacaguggaaaagacaggucaaacaaaccuagagagauuuuagaggacacacuguugacaccagauguccuuucuuauuccugccagugucuccucccaaagaccucguugugacagaagugacggaagagacggucaaccuggccugggacaaugagaugcgggucacagaguaccuugucguguacacgcccacccacgaggguggucuggaaaugcaguuccgugugccuggggaccagacguccaccaucauccaggagcuggagccugguguggaguacuuuauccguguauuugccauccuggagaacaagaagagcauuccugucagcgccaggguggccacgugugagugagcagaacucuuuugggcagccucaccugaugucagcccacccaguguauaacccucccucgccacggccccuacaauccuauaguuguucuuuacaguuauaccaaauaagagccuagaauuaaguccauagaaucacuuauuaaagaaaucccucauuuuccaucaaaucuuucuccuugcucuccuauauacuuccugccagagaaaaucauuacaaguaacauuuagcaaguguuuacuguguaucagacuuuguuguaagcagucuacauauuaguauaagaguccucauuuggccgggcaugguggcucaugcccguaauccuagcacuuugggaggccaaaguagguggaucaccuggggucacgaguucaagaccagccuggccagcauggcgaaacccugucucuacuaaaaauacaaaaauuagucgggccugguggugcaugccuguaaucccggcuacucaggaggcugaggcagagaauagcuugaaaccaggaggcagaguuuguagugagcugagaucaugccacuguacuccagccugggugacagauugagacucugucucaagaaaaaaaaaaaaaaaaaagaguccucauuauaugaguuaguauauguaugaaauaggagcuauuguuaaccccauuuuacagaugaggaaacugagacugcaugguuaagcaucuuaucccaagucaugcagcuaacaaggaguagaggcaaaacuuuaacccuggcaguccuggcagguuuauguucuaaaccacucuauuacuuuucaguggagaucacugacuauuuuucuuuaaguggaaacauucugguuuaugaguuuagcaucaguauaauuaccuucauaucuaaaaagcaagcucuggcuagaaauugacccuuuuuuccuuaauaauaacauuggcugccauuuauucaacuuguucugcaugccacgaaccaggcccagcagucuacacacuggaguggaguauaucacucacuccucaaugcauucccaagaaguagacauauuuaccuucuuuuuccaagugaagaaacucaggcuuagagcacugugugcaauugcucaaguucacauugauaguagagcuuagauucuaaccccaagucugucugauuccaaagccugcguucauuuuagauuuaaacauaugaaauugccaaaauuaaucauaccauuuuuccuaauauuaauuuuuauacagccucauagagaccucaucccagaagaagcuuuaaaaggacaccugcucugguugucagccccugacuguugcagacauccagucugguuuaguggaaucguggccgcguugcccaaucacacaccugcccuauccuuacguucuauuuauguuguuacuuacagacuuaccugcaccugaaggccugaaauucaaguccaucaaggagacaucuguggaaguggagugggauccucuagacauugcuuuugaaaccugggagaucaucuuccggaauaugguaaggaguacaaaagagcagauccauuugaucucaaggauuugaaagaugaccaaaggguucugaagacuucuguaucaacuaauuuuccuuaguuuuugguggaggacaaggcucucauuagcaucauuuguguuugcaucuauauuuuaagggauguugguuuuucccugauuuuaauaaguaaguguagcacuuacggcugacacccuagacaaauagaaguugucaccucaagguuccaauuguccaucaucaccuuagaaaucucuacucagaggcaaagaagagaagaaacagucucucccucaaaauaaagguacaucucagauuugagcaacccuucucuccaggcccaaaaguacaugugaagcagggaacuuguucucugaauuuaagcccaggcucugccaccaaccagcugugugacuauccaacaaucacccuacuccucugaugcuggccucagucuacccaaggagggauugagcuugugccuucagaauuccuuuggcucucacauucugucauuugacuugcaugacaaagggguaaaaguuuacgaaugggagaaacaaacuagagaaaugucuuuaucaucucuguauccucaguagcuuacauacugaucugaugcauaguaagugccuaaugaaucgaugaaagaauaacagaggaaugaaugaaugcagagugaaugaaucacauaaauuaagagacuggcaccuccccuaacucuuaccaagcugccucuaucucucagaauaaagaagaugagggagagaucaccaaaagccugaggaggccagagaccucuuaccggcaaacuggucuagcuccugggcaagaguaugagauaucucugcacauagugaaaaacaauacccggggcccuggccugaagagggugaccaccacacgugaguaucaccuuuaauacuuauagaaugauaaggcugauuguaccucauagcaccuccugguugagaaagugccuucucauauagcaucuacaucauuuaacuuuugcugcauuuuuaaaaauccagauacagugguuuaaaauaacaauucuuugcauguuggugauuuggguuugggcucagcugagcagcuuaucuguucuugacugcacuccucauguaucugugugcuuaagggguggauuggccuaggauggccucagccaggauggugucuuucuguuucgcagagccucucauucuccaggaugcugguccuguucacacagcuauugaacagguucaaaauuggcauuagaucacuucuaucaaagcacaucccacggccaguuuauauuuaaggaauagagaaacagauccaucucuugaugaaaggaguuucaaaaucuccuuucaaaggggugugacuaccugaagauaauuaagcccauugcuaacaaucuaauuagcaucaugucacuaguuuaauauuagcacccaguuguaggacagaggaagggaaaauauuaauguuaaggcuuaaagaagcuaaaucacuuuaacaucccauaguuaacaccaucaggggcauaacuuuaagccaggguaaguuuuauaacuuuaaccccauuuccacuaacauugacuaggcucugguuuauguagaauguugauuccaucucuucaaugggaaccuaaauaaaauuucauucaauacuaaugaugucagaaguucuugggaguagaauaggauuuagcaguacuagaucauuuggugagaaaaagaccugaauuuggaguugcuccaccaggaaacauuuuuuuuuuuuuuuucugucacccaggcuggagugcaguggaacgaucucaguucacugcaaucucugccucccagguucaagugauucuccugccuuagucucccaaguagcugggauuacaggcucccaccaccacaucuggcuaauuuuuuuguauuuuaguagagaugggguuucagcauguuggccaggcugguuuccaacuccugaccucaagugauccacccgccucggccuccuaaagugcuaggauuacaggcgugagccaccgugcacagcugcaauuuuuuaaaaagaaaaaaaugcauaauuuugcacuuccauauaggaaaaccucuuuauuuucuucaagauaacauaugcgccaacucuuuaaguaaucgacucuucuuggcaggggguuguuggaaaaauuaaaucaguugcuaaugacaagaaagaacaucuugcauuuaaauauuugcacauuuugccuagcucagagccaauucaaaggauuuucucuuucauaagcaaguguuuuccaucauccugacaccaccucucugugguagguagaaaagcagguaccaacaggaaaaaaaaaucauuagaucaccagaaagacaaagaaaagacaaagcaaaugcuuaguugcuauggaggaggugcacugaacuuuuuuuuucacugcucuuuuguuuaucuaaauuugggaauugucugcuuuauuucuucuuauuuuagaacaaacauuccaacauuugaaguugcauaaucauaaauuucaacauagggggacaaauauuuaccuguucauuuuguauuuuuaguagagacaggauuucaccauguuggccaggcugguuuugaacuccugaucucaagugauccacccgccucggccuccuaaggugcuggcauuacaggcaugagccgccacggccggccacaauuuaccacauauaccugaaaccuuuaaaccuuuaaccuuuuuuccagauguaaagggccuuaaacuucuaguucagaacacauuuggcuccuucugucuggcaucuauauaaaggugguauuauacuuacuuuugaggucaauauguuugagagguguugucauguaaagggggaaaaggaugggcuuuggauucaaucaguucugaguuugaauuccaucuuuaccauucaccaucaccuuggaaaaaucuauuucuuuaagcuccagauccaacagcugaaaaauggguuuauaguauucuccuuguggggucgucauaagacucaagacauaaauaacaaagcaccaucuuugcaccugauaaauacagagcauuguuaguuucugcuauucaagggucccaaaucuagggggauaucaguguccuugacggaaacccaacuucuuuaaugcaagggguacuaaggaagguaguagguacgguuugggugcuugcuagcaccuauaagaacacagagcaggcagcuucuguccauuuuugcgacaucauuuucauugugcauuuuacaucaucugugagcugggacugaugugucaacaccuagacuucaaaaacagacucugcaguuuucucacaaucugcuguaaauuauuguuccuuuucauucccuguauaaagcccacuuccugucacuuguuauuguuuacugaaccaaugcugaaaacacauuuaaaaaaaaaaaaaggagaagaagaagaaagaaagauucaaagauucacugaauacccagaauaugccugucucugcugggaauuuaaaagacucacucucucaaucaaugaauaacccuaccuaaauugacucaaacuguacagaaaucuguuaugaaacaaugagacacguaugauauuagaaugcucuucaaggacaguggcagccacagggagggaauauguguuuaccugacugaagccggguuaaaaaaaggcuucucauuaggagacaacauuuaagugggauuuugaaggaugcauaggagauuuuuagagggaaguaugaucuuagaaagaagaaaugagagaacagcauguacagagaccaggcggugcccaacagcauaaugugcuuccagagcucugagcaucuaucagaguacaacaccagaguagguggggcagaaaaagucaagaugagccugcaaaaacaggcaaggcuugaaauagcaaugacuuucuugcgugaauucuuucuaucaaaaauaaguuuccauacacugucaagacagucuauugccucacuuuucugcuugguaauucugauggaaaaguuuucaggaaacauccaggaaguuuugccuaauuaaaaauuuaaagagacuaaguucaucuuuucaaauaaaguauccccaaagcauguuuccucaacuuaugagaacaguaauaauaauaauaauaacaaaagaacaaccuuuuuuuuuuucaugugacauccaugggccagucucugugcuagaugcuuugcaagcuuuaucucucuuaagauuugaaaaaaacaaaaacaaaaaacacuagagguagcugcuguuaucccuacuuauagcuuaucaaaccaaaaacuaagguucagaaaggcaaaguaaagucaagcaguuaguauaaguauucacccacaggucuggagaguuacaaaguccucucucugcuaagccucaggcaauggcccuaaccucugaagccucucuguccucugcccaucauaggcuuggaugcccccagccagaucgaggugaaagaugucacagacaccacugccuugaucaccugguucaagccccuggcugagaucgauggcauugagcugaccuacggcaucaaagacgugccaggagaccguaccaccaucgaucucacagaggacgagaaccaguacuccaucgggaaccugaagccugacacugaguacgaggugucccucaucucccgcagaggugacaugucaagcaacccagccaaagagaccuucacaacagguaaaaggccucccccuguuaacagauauaguaaaggaaagauugaaagauuuccaucccacuccauguugggguaucuuccaggcucauuuuacaguacgaaaaaugaaagggguauuucuacuccuguaaauuuuaaaauauuguagcaauuuauuaauuaauuuuucaaaaaaaauuccaaauaaccuuccaaagcacuuuugggggugggggacauauguagaagaugcuggucugauauucucagacaaaaguucugguuaaaauaaaguucaaauaaauauuuuuaaaguaaaauaugguauauggaaaacauauaugacaaaugagccuccuaacacuuuagccuacggcauuauuuuaaaaguucaaaagugucaauuuuucauucaguaaauauuuuucagagcucaguaaguacuuugugaguuauuagaaauaugaugaggaggccgggcgugguggcucacgccuguaaucccagcacuuggcaggcugaugcaggcagaucaugaggucaagagauggagaccauccuggccaacauggcaaaacccugucucuacuaaaaguacaaaaauuggggucaggcgcaguggcucacgccuguaaucccagcacuuugggaggccaaggcgggcgaaucacgaggucaggagauugagaccauucuggcuaacacagugaaaccccgucucuacuaaaaauacaaaaaaaauuagccaggcgugguggcgggugccuguagucccagcuacaggcugaggcaggagaauggcaugaacccaggagguggagcuugcagugagccgagaucgcaccacugcauuccaaccugggugaagagcgagacuccgucucaaaaaaauaaauaaauaacugggcgugguggugugcuccugcaaucccagguacucgggaggcugaggcaggagaaucacuugaaccugggaagcagggguugcagugagccgagaucgcaccaacacacuccagccuggugacagagcgagacucuugucucaaaaaaauaaaauaaagaaugaaauaugaugagaaaaugcaaaagaccaguuuuuacacucaugagcuuauuuuuaagucuuugcauuguuucuuuaaccacaaagucugagaaaaacacaaaugacuaaagugucgcacucauccauaauagggaaaggugccaaaucuguagcacuuguuuagauuugcacauccacuauggggacagaugagugugcugagaauuuuguaauuucucuccaguuccaggcacguuucauaugucagcuugagcugucaaagacuccugcucucuugugacugauauguucaauacaaauguuccuucucucaaacaggccucgaugcucccaggaaucuucgacguguuucccagacagauaacagcaucacccuggaauggaggaauggcaaggcagcuauugacaguuacagaauuaaguaugcccccaucucuggaggggaccacgcugagguugauguuccaaagagccaacaagccacaaccaaaaccacacucacaggugagcucugcaucucugcaagccugagccagccagcccuagagggcccuuaaaggaugggcaccugcucccacauguccccauuugcaacccucagaaauaaguccaauuuccugaaauacugcuuauuggauugcagugaguucuuuuguaaaacauuccgaaaauuuguuguagccuccagagaccaacucaaagccauuuuuaucauccucugaaagucucucugauuucaggaugaaucucaacuugcacauucucuccuuaggucugaggccgggaacugaauaugggauuggaguuucugcugugaaggaagacaaggagagcaauccagcgaccaucaacgcagccacagguggggcacaccuggaauucccaucccacugagcuggugcugggcagaugagacagagucaauguggccaaaaccuauuuaaagagaaaaaguagaagccuggaggaaaaagggcccuguaguaccaucuagccccaauguugaaauucaaaaggaacauaaguacgguccaucuguaugaugccaacaucauccccuguauggaaaaggggacuggggauuuuguguuuguuguuguuguuguuguugagauggaguaucgcucugccaccaggcuggaguguaguggcaugaucucagcucacugcaaccuccgccuccaggguucaagagauucuccugccucagccucccgaguagcugggacuacaggugcauaccaccacgcccagcuaauuuuuguauuuuuaguagaaaugggguuucaccauguuggccaggauggucucaaucucuugaccucaugauccgcccaccucggccucccaaagugcugggauuacaggugugagucacuauguccagccgggauuuuuuaaagaaaaauuggaaccaggcuuuguaagaaauucaugaacauguguaaguugguaaucaguugcaucuuuuaaauaaaccauuaucuaguccaaacacaacugugggguuuucucugagaaaacaccuaacuuuuauaccccugucaagcagauuauaaguaacaggauuguaguuuaaguccaggcccugcacuuaccuguuguauccuguagccgcagcuuguaggugaggaugcugaggggcuaccugauuugaggucauugauucuuuccucaagauuuuuuuuuccauuuuucugggaaguuugcacugcaaaaagaaaacuccuccucugccucucccccagcccccagcuuaccuccccacaggcacuaugaggaagaaggaggcuaguguguaaagaggagauggaucaucauugagcuuccacauuaugcgggaugcaaggccggacauuuacaugccaauucuuuuuuuuuaaucuuuugauuuugagauaauuguagauucacaugcaauugugagaaagcauacagacagauccccugugcccaucacccagguucccccaaggguagcgucuugcauaaauguagacuaauauaacaacugagaaauugacauuggcguaaucuguccacucuauuuauauuucaccaguuuugcauacacucauucguauguguguguauauacuuaguucuaugcaauuuuaucacacauguagauuugugaaugcaccacuagagucaagauacagaacagucuuacuacaagaaucccacaugcuacccuuugcagccacagccaccucccucccuuugccccucugccuaacccugggcauucauuuaucuguucuucaucucuaugauuuugccauuucaaggaaugcugcauaaaugggauccuacacauauuaguccauuugaguuacuguaacaagaauaagaauaccuuagaccaaguaacuuauaaacagaagaaauuuauuucucacaguucugaaggcugcgaaguccaagaucaagaugccagcagauuuggugucugaugaaggccugcuuucuggcugacagcaggccaucuuuuuacuguguccucacaggacagaaggggcaaggucucuuuuauaagggcaccacucccauucaugaggccucccaaaggucccuagauccaaaugucuucacauuggggauuagguuucaacauaagaacuuuagagaggcacagacauucagugcauagcaauacagcauguaacauuuugaaacuggcuuuuuuuccuucagcauaauucucucgagauucaucuaaauugcuucuuuuaucaauaguugguuccuuuuaacugcuuuaaaucugagcagcauuuuauggaauggauauuccaugacauuauuuucaaucuucucagacuccgauggggucaugugggugauguauaauuagaccuauuuuacaaaaguaaaaagagagacccagagaugugacucuccuguggucccucagcuccucuguggcagaccuaggauuccagcccagaugcaguugacuuucagccccagaagcagcccugucuugcagccugaagagcauucaucucucuguucuccucccagaguuggacacgcccaaggaccuucagguuucugaaacugcagagaccagccugacccugcucuggaagacaccguuggccaaauuugaccgcuaccgccucaauuacagucuccccacaggccagugggugggagugcagcuuccaagaaacaccacuuccuauguccugagaggccuggaaccaggacaggaguacaauguccuccugacagccgagaaaggcagacacaagagcaagcccgcacgugugaaggcauccacuggugagucugcccugagcuuccuccaaacucuagguugauucugagguuagcagaucuccucagccaggguguccucacaugagaaagccaaaugcaaaagcaagccacuuucuccaucucugaagccccugaacaccacuuugaaagggcugcuuacucgucuuuucuaccuccugucaacugauacagcaaauuucccccacugggaaauagggguuuuaaaauauuucuuccuaggagaacuuuaaacaucaggguuuguguuugcauuuaccuaugauuuuuguuuucuuuucuuaacugugcaucacagcaucuuuucaauuguuucuuguuuauuuccuucuuuuagccuaauaauuaauuuacuuuucauuuuacuucauuuaaagaugaccaagauguugguaauaauauuuuuuuuguuguuguuauuuucuacaaacuguuuuuauuccaggucuuuugcuuucugccaagguuaccccugaagaguggcacacggcccuuugagacuuccauggugcccucucauuuucucuuuucucuuagucauuaagacauuaaccuaguuugucuaugacgacagcuuaauccugacauuguggcccaugcaacuuguguccauucuggcccaugcaaccuguucacugaaccugaggccaugguuacucgguggcuaaacugaagagacaaccagguuuuuaaaauauuucuuccuuuaugaaaaauaagccuauucaauuuuggccaccaaauauucgaaauguauagguggaaaauguuacuuuuccaggguuuggcaaguaauagucuuuacuuccaauuuaauuaguaagcauguauugaguaccuacugcauacauuguaccguacugauauuugaggaaaaguaguucccaaagucagcauuguuauguggacucauuugugccugcucauagugcuugcggaagacuagauacucagaaugcuagacagaacucgagaaaaagagugauccaaggaaaucaggagagcuggcaaagguguuauggcaagggauguuauuccaguugaagcuugauaugcaagaaaaggguuagaaguguggacauauuuggaaauggcuugaagagucuuucucacaauaucuucagucucaaaucacagucacuuacuuaagauagaaguugguuuucuuucuuauaaaaugaaucuggagcugggagguacagggauaacuuaguaguuucaaauugucaggcacccaggcugcuucuuucuuuuccaccauuuuuaguccuuggcuuccauucucaaagucaucucagugucacaacauggcugcuguaauacagccauuccaucuguguucuaggcagcauaagggaggaagaaccaaaacucccaaagaggagcaccuucugggugagucuuucuggaaaccccaccaaucacuucuccccauaguucauuggccacuccuagcuguaagggaggcagggaaagguagucuucugucugaacauguuacuuccacauaaaauugaggucauuuguaagagagaaauuuggcagacaaugagcagucccugccagagucugaaaugaguuuacguggucaauucuguugacucugcauugacugcuucccacccaacuauaagauguuuauaaaggaugcucugaaagaauaguuuaauuaaaaaauaagguggggggcggggauagaaccaagaagaaauaaaucuauaguagagauuuaaauuucagcuuuauaaacaugagcuuguuauaaagugucaaggggcaacaaaugaaucagaaaugcccaaaagaugaaaucccucucuuuucuuucucuuucucucucuuucuucccucuucccucacuccugcucuucuuccuccuccuccuuccucugccccucucccuuagcuuucccuugaguuugauaaaugcuguaucuaagagagauuccuauugccccucaaucauuccaccuucuggugauggccacauugccuccuuccuccagugagaaaaccucacaccugcgcagucacugaagaaguuuuaucucccuaagauccugagguguggggcuucuccacuagagaaaggagguaauguggcuauaaccaggagauuuacuagcuagaauuauucuguuucugaaugagagccccauauuggcauuccaaagccucagcaguugcauuuccccaccacgccuccuuaaugccauuucaaagauaucauguuucguauuuaaagacauucuucagugugggaaaaaugugcaaaguucuuuuuauugguucuucuccacuguccacagacuauuucccccaucccuuucuccacaggaaaaaauauauauguuucauuuaaggugaagcagacgcuucuuucccuccuugaauucuaacuuuuaaagccuucugcauucacucagucaauaaaauacuaucaccaugcucugugcuaaguucugggguuacuagagcaaagaagacggguauuuaauuccaaggaacucacuguguagcgaacaaacagacacugagauaacauucugcucacuacgaucgaggguacagagggugcagccagugcucaggagacacuggaucuaacuucagagaaucaggaaaggcuuacaaugggaagacgcuuuuggacagagacauaagaggcaaacauagauguguuaaauggaauagcuaaagaaguagaagcccaggcaccugaccuugguaagcauagaggaagaaagaaaacaggaaaagcgagagcucuugggugaaggagccauguggcuauaaguccugaaauguugcagaguuuuagguucaaccaucagaagcaagaaccuuccagcucuguaucacuggauucuuaauagcagaagccugccaggcgccacucaaugucuguggggcuuacagagaaaaaugaagaaucaguggcccugaagaauuuuuccuggggaauuccaggguuuuacugauggauugggccauaauguaagucuuuuucuugauguggcaccauacuaaaaauaugcauaaccuggccaccuaucacaccucucgcccaaagacccagccauggguuacagggcccuacagaaucuggcacggccagcccauccucugaccucaguccugccacucauucccuugcucacuucaccauggccucuugggccuucacacuguuccuuaagcuuucugagccugcucccacccucgggcuuuggagugugcugcucccacucccuggauaccacucuuuucccagcacuucacagagcgugcucccucauuucacucagcagcucagauaugacccagaacagagggcuucucugacuaccagccuaaaaaggcacccccauccugaucuaccccuucaagcugcucuagguuuccuugugaaacuuaucugccuugauauuaugcaaguauugguuuacuauaauaucuauggccugccuccccaucagugagcagaauauaaggacugauuccaucauccacugcugaaucccagugcccugaaggcagacaaguaugugguaugagcuucaugaguguuuagggacccuggcuacuucagagucagcauuuccauagaaucuucugauucuucccuuccaccucugcauuaacaccccaauucuuuccuuaaggcauaagggaaaucauucccuuggaaagucuucaauuccgcuuaaucuggauagaaaaggaaggaaggaaggaaagaaggaaggaagggaggaaggaagggagggagggagggaggaagggaggaaggaaggaaggaaggaaggaagggagggagggagggagggagggagggagggagggagggaggaagggaggaaggaaggaaggaaggaagggagggagggagggagggagggagggagggagggaggaagggagggagggagggagggagggaggaagggagggagggagggagggagagagggagggagggagggaggaagggaaggaaagaagggaggagggaagaacgaaagguaccgugucuguuggcauuuaaaaaaauuaguguguaccaggcaucauucccucuccuccucucccauucccucccuucucuuucccucuccuccacucuauucuccuccccucuccuuccucucuucuccccucuucucucuccucuccucucucucccuuuucucucugcuuuuguacucuuauaaacccaacuaaacccugcuuaaggucaaagccaugaauuugcugcaugccauaagagacaggaggcaggggugauaggcagaaacauaaagccagcaaagcauauuuucauagcaacauaagccuugacagugacaacccaguagcucucaggaauuuuggaagaagaaagguggaauuuuguuuuuagccacagcuaccaguaauacagaacauucugcucuuauuugcuauuuugauuuucucacagaccaaacugaaauuuauucaaauauuuauucauccagcaaauauuuauuucauaccuacugugggucaggcgaugccgguguauagaagagaaagaaacagcuucucuucucaagaaauggugcacguugcuauaagagagagaaccaaaacccaaauuauaacacuguagcuuaucuguuuuagagggauuugugggaggcugcaggagcauacagacagguacccaucacagaccuaagcaaagggaaugaaaagcacuggagaaggcuuuuuggaagaagugauguuugguugaguucugaaaaagaaaaggggcugggcaaguggagaaagaguaaugacauuuccagcaaagggaauagcaucugaaaagcugaaaagcaugagaaacuuuaccuuagugaacugcaagcuauacaguccugcuauaugauagagugggaaaacaguaggguaggaggcuagagacaucaucaggggcaucugcaaaggggcuugguucuuggcaguuacaaagaaaucaccgaauguuuuaaggcagccaaggcuucucauuucaauugucuuaucucugagagaugagaguaaagcgacugaagauacccuuugggguugucaggcuuggaugugaccaugccccugcugugggagaaucacucuuucuccccuaaguggacgcugaagugaguuccucaucaagccagcacuugguaaucacuaucuagaagaugguaacaaucuacagauuuuuaaguuggcacugucagaaauuccuccagaccagcugcucaacccaccaggagcacagcaauggguuucaaaauucugauuucccaggcccacugacauuguucaaggguagauuccagugcacagcuguaagaagaagacaacagccuuuugauaaagaaaugccaagaaauucaguguggaaucuauaauggaaacacuuggcuucuagggcaguaaguccacaguaugucauuugcaguugaaauguggagccagcauuuaugugaagccucuugguccucaucucaacuauuguccacuguauuuuuuauucauaauauucccccuucuuucauaauucugacccccucucucuuuaauuuagcuacugauuuuauuuguggaaguuguaccuuuuacucacuuggcuagcauuuauuuaauaaagggaucuggauggggcacacguagcauccacuacugacauggccacaguacugccucucugaguuauaaaccaaugcucuuucuugauuugccuaccaaaaaaaaaaaauaguagagaaauagccaaaaguguuagcagaaguaccaacaccaucacuauuacuauuuacugaacaacaugacauuauguaaaaaaaaaaucacucuaucaacuauaugaacagaugaaacaggauguggggacaauuagaugaaaguaucaguggcauacuaaauauccgauucaaagagauaagaugauucucauuaggaagagacauuuuccaacgugcaucuuuucucuccauccaucuuuugccacagcuuaaugggcaauccacaaucucauucccccaccccccguaagguaacuuucccaauaucucuuucaagggggcauuuaaaauuuauuuuauagaaaaaaauguuuuauguaacaauuagacauaaggauuaaaagauagacacccguagaaaaaagacaguaacuuaauucacacgaagggguacguugucaaugacagauuaguuccugacagguggacagcagagaaacaaaaacaggaaagugggauaagaaggagagcuaagaagacauaggguugauuuaauuuucacuuagcucuguuuuuguccuauaucucuuucuguaucaggacugcugaaauauuugagaaggacaugcucuugaguuuaguugugcuuaaaucccaaugucaaggguauaaucacuauauccagggaacuguuucuggccucacaaggcccagcaggauuaaagguaguugacaccuccuuucuuuuccuaaaucuagauacaucacuugcaguuugggguccucccuuucucauaaagaccauguuuaggugguuaagaacugcuuuggagccucugguguaagcuuuaggauaugagucgggguuaaagaggagucuguauucaagaucaaguauugcaaacauuuucuguaaagggccagaugguaaauauuuuagacuuuauaggccagagaguuuccauuacaauuauucaacugcacauuuuguaacacaaaagcagccaucaacaauauauaagugaacaagcauggcuaugcuccaauaaaacuuuaucuguggcaccagaauuggaauuuuauaugacuugcaugcaccaugaaauaauauucuucuuuggauuuauuucccgaccauguaaaaaaguaagaaaaacuguuguuagcuugcugacuaccaaaauaagcagcuggccagaugugggccucggguaacaguuugcggaccucuguucucgaucaaacaaaauuugaaggaguguaugcucugacaauaugaaacaagcaggaagaauguuccccagaacuuagaaaugucugaguuaaaucaauuccagaaaagaaauguuuucuccucugaaaggauauccucaaucaaauuccaagcuaagauuuucaacuuaguagccugcucuaauggacacauaaggcucauuugaaauuagcagcaaugugaaguauaaauagaaaaaaacaguuuguucuuuuaaaugauuuaaagucaguuucuacucucuaguuuacaggauccauuuccagagaaauacuuuccuuccuaaacuaugcaaaguccacuuaagcucagcccugggcaaauuaucucccuuaagucagguugagaccagugaguuuuuacggaauuucgugcauucgcgagaugaaugaacagggugcauucaguuuuacuugagcuucauaagaucugcuucucccaggaccucuuucuuuuuucuauuaaggaacaguuuuucaaagccuuaucaccuuccuuagcucagccuuaauaauacugugucaaugugucucugaucuuuacuaauaugaucuauguaaaugauuugaacgcuagaaacugaugaaaucccaauauaaacuauacaacagaccucccauaggauauugaggcagcacaaaaaagaagaggcuuuuuuuuuuuuuuuuuuuuuuugagauggagucucguucugucacccaggcuagagugcaaugacucaaucuuggcucacugcaaccucaaccuccagggcucaagcgauucuccuaacucagccucccaaguagcugggauuacaggcucacgccaccacacccagcuaauuucuguauuuuuuguagacacgggguuucgccauguuguccaggcuggucuugaacugcugaccucauaugaucugcccaccuuggccucucaaaaaagaaggguaucuaagaagagccaauugucucaaaauacagaaggucggacagcucaaaccaagacccccagaauaacugagggccaccccauuaugaugcaagacauguuccaaaaugaaaacugaagcucagagcaucgcuaacauagacauauaguuuucuaaaucugcaggacacugaucaauaggaaaauaccauuuccaagagaaaaacccaaauaugcaugaaggcaaaagaaauuuuuuguuuguuuguuuugagacagagucucacucuaucccccagacuggagugcaauggcgccaucucagcucacugcaaccuccaccuucuguguucaagcgauucuccugccucagccuccugaguagcugggauuacaggugcccaccaacacgccuggcuaauuuuuguauuuuuaguagagacaggguuucaccauguuggccaggcuggucucgaaccccugaccucaaaugauccacccaccuuggccucccaaagcgcugggauuacaggcucgagccaccaugcccggccacaaaagaaauaugacauuguuguccugcugguguuuuaauagggacagcaccaguaggggaugcagugaacaaagccuggcacuuggacugcaauggccuauagauguggcauuggguuugccauucccagguucucagaagcaaaacuuucugaggaauaguuuaacugaccccaucucugucauuauucagaacaagccccugagcuggaaaaccucaccgugacugagguuggcugggauggccucagacucaacuggaccgcagcugaccaggccuaugagcacuuuaucauucaggugcaggaggccaacaagguggaggcagcucggaaccucaccgugccuggcagccuucgggcuguggacauaccgggccucaaggcugcuacgccuuauacagucuccaucuauggggugauccagggcuauagaacaccagugcucucugcugaggccuccacagguaucucuuuccuuucuauuuauagcuucuguuuuucccagcaggaaacugcccaugaauaaucagacacgacuagcuuuggaauggacuuguucugccacuacuuaugucuauggggucuaauugugacacgaggccaucacgcuacagaaccccaaggcaacuuuuaauacuucacuccacaugaaugacacccuugggaguuguacagagcucaaccugcaggacuaaacacacagcucccaugcagagggccuuuagcuccauaaacagccucccuccuguuaaaggacguuaaggcacuauauaugaaagggaaagaaaaucacaaaauucucucaucuacugaggguuaaggcaauucuuuaagauuuaaaaaacaaacaaaaacaaauauuuuccugcacuuuccucucuuugcuccauuucuaaaauuuaaagaguugcaugaugcauguuuaucuaaagaaagucacauuuuuucaguaauauuauuauucagcuuauucuuguguuaaagauucccuggaucuuguugugugauuugaucacuaaacuaguucuuuguccuucuccaggggaaacucccaauuugggagaggucgugguggccgaggugggcugggaugcccucaaacucaacuggacugcuccagaaggggccuaugaguacuuuuucauucaggugcaggaggcugacacaguagaggcagcccagaaccucaccgucccaggaggacugagguccacagaccugccugggcucaaagcagccacucauuauaccaucaccauccgcggggucacucaggacuucagcacaaccccucucucuguugaagucuugacagguauucuagacgaauucacuaauucacuuccuccccuuugucucugcucgggaggaaucaaagcacuuucuugcuuuaaacugggaucagcuccuaccacauuggggaaauaccagugaaucaucucugcuucuuccuaaaugucacaucccuuauuuggcuaaguccuaguuguagcccaguuccauggaaaauuccaccuacuccuccuuuaaaaaagugagagguggcuuuucuuucaaaguaaguuucagucacaauaucuaaaaaguuggaaagcccaaccuguaaaugaagaaaaaauagcucugagcucaugagcucauuuuaagaacaccaaaggacuccccauagcccuauuuguaugucaagaauagaaauugugaacaauuccuaaaacuacuuuucauucccaaaagcugaauagaaaaacccuggcuuuagugccaacaguuugagugugcucaacaccugcuguaaaucaugcaucuauaaucaacacuaaccagacaacucaucccaaccuuagccaaaaugccaucucaccugaaucccagcgugcaauugccuuuuuaaguaacucagcaacucuguguccuuaugcagaggagguuccagauaugggaaaccucacagugaccgagguuagcugggaugcucucagacugaacuggaccacgccagauggaaccuaugaccaguuuacuauucagguccaggaggcugaccagguggaagaggcucacaaucucacgguuccuggcagccugcguuccauggaaaucccaggccucagggcuggcacuccuuacacagucacccugcacggcgaggucaggggccacagcacucgaccccuugcuguagaggucgucacagguauaugacccuccucccagacuggagacaugauaggagccagcaugucauugaaauagagaaaauucacccguguggcagaauccuaccccaauguuguugacagacagcgugaaucucuaacucaggaaggucuguguuggaauuccaccucacuagcuaaauauucuugggacuauauguguauguauauauauagauacacauauauacacacacacaaauauauacuuauauauauaguguguguguguauauauauauauguguguguguauauauagauauauacuuuuuuuuuuuuuuuugagucagggucucauucuuuugcccaggcuagaaugcaauggugugaccauggcucacugcagccucgaacuccuagacucaagugauucuccugccucagccucuacaguagcuggaaccacaggugugagccaccacacucagcuaaguuuuuuguauuuuuuguagagauggaguuucaccauuuugcccagccuggucucaaacucccgggcucaagccaucuucucaccuuggccucccaaagugcugggauuacaggcaugagccagcgugcccuaccucuauucuuggguauauuucuuuacaucccugagccuccuuuuuguaucuuuaaaucagcaaugaacccuacuucaggaaacugucgugagcaauaaauaaguuaaugaaugucagugcuuaguaaagcgcccaucacguaguaaauacugaauagcaaauagcuaaauuuaucauacagcaacagagucaugauuuuuaaaauagcacaaacguuagggcuguggcacaaaaauaagaucagaacuuucuagaaaaaccuuauuacuagccucagagccaccaacuaacacccaccugauaggcagaucucuacauaauaaccuuuagaaaugaugcaguuagcuucugcugaaacuaucuaggacucucuccucaacagauacaaaaagcagggacauuuccaagaaaggacagccaccuuugacuucaaugcuuuucauucaauuugggaaggaaaaacaauuccucucaauuuuccaccaaaaaugagcugcuccaucuguuauaaaaaacugugcuguacaugagauuucuagaaauagcuucaaaaagggcuaugggaaaaagggccaacuuuuuggugauaggguuucugugcugagcccuaagcccaugccccacucuacauaugcugccuuuugauaaugcaauccaaaucacucaauucaaaacaauuguuuuccuugcucuuauauaacagauaaacuuggugguugcuagaaacuacauaaaauuccaaaaauaagggggccagguuuuauuccuguguugccuggaauaucuucagaucaaacaagagcaaaaagggccuuugagacagguguggucugugugcaagaugcucauaucuuccucuguaguccgcaaacuuuuguuuuuagcaguacaacuccuuuugcaaaugaaaucuuccaaggaacccuacuauuugacagauaagugaacagcuguucuuggugugccuggaaguaagagggggauaccuccacccauguucucaacacaguucuucuagaaaagccccagaucuauguggaacacaguuugaaaauaaccccucuuaaaagcaagagguugcucagagguugcucagacucucacagggcauugaauccuuggauacccaagagcaaguaucuauaucuuucaacuauuuuugguugaaaucccugcagauauucuccucccuaacuucuaacccauggccacuucagccuucaaaacaguggcugagagacugcauuuaacccucagaagcaucccacaaaacaauggguuuuuccauauccuaaauccaaacuuucuaaaucaccaauaacaacuacguuaaauuuccuuucuacauuguagaagcaguaauaguggguucuguucugcaccauuuacugagaaaaaucuccuuucuuuuaauuaaaaguaggcacacucauuucacacaaacagcuuugcucugugauacagccauucuuccuuuagacauaaaguacgagcagaaaaagguggaagaagaaacaagcugagaacccaguacacaacuuuugaucccugaaagcugauagaagaccaaagaaaaaacaucauacuuguucacaccugagacagcauacacuuuaucaacccaggcagguagccaguggcuagugaugagauaaucuuucuaauuauaaauaaugaaauaaagcagggauuucucccugacaugaguaagaaauuccaagggaaaacacuugaacaaugauuucuuuauuaagcugacacuuauugggcacucgccauguaucagguaugauacuaagaaguugauaaauauuaccauuuaaucaucacgcaaucccaugaaacaguaccaucaacuccauuuaaagguaaagagaggguggcucagagagaagcugagugacaugcccaagauuaugcagcuagcaaaugcuaguauugggauucuaaucaaggacuacuugccuccaaauucugcacuuguaaccauugcuguaucucuuacccuaacccacaauccuacuuuuccaugugaauuucaccugcuagcaaugcaugcucccgguggguugugcauuggugcagaugucuuugccaucucaaggauaaaccauguagauauuucccuuucuggccauuuucaacuccugaagacaacuguggccagggaaccacaguucaaauugcaaaugcucagagaccaagaauuaaaaaaaaaaauuaucuuuccccuuucucucuuuccuagaguugggcugugggauguuugguuuccucauuuuugguuuauagaacugacaaauacuuuucuguccuucuucagaggaucucccacagcugggagauuuagccgugucugagguuggcugggauggccucagacucaacuggaccgcagcugacaaugccuaugagcacuuugucauucaggugcaggaggucaacaaaguggaggcagcccagaaccucacguugccuggcagccucagggcuguggacaucccgggccucgaggcugccacgccuuauagagucuccaucuauggggugauccggggcuauagaacaccaguacucucugcugaggccuccacagguacuuccucucccugucaaugcuuucuccccaagguucuuugcuuccuuuucaagagaucaugcgcggagucagcaucucgccauaacugaauccuuuucaugugccuuucaguggccggcugugcaugcucagagaccucccugugggcuaugacuuuguccucaugccuuugccauguggauggugaaugaugcagguguugcccuuucugaucuccagccccccagccuuucauacuuuaccuggcugauucuacaucuuuuuugaaugaugaauuuuuguuucaggaaucagccugaugguuuuaauucacuucuccagugcuuggagauaacuaaaagcuucccucccuauauaugaguucugguggaacacagauuauuuacuucugagagucuuuugcuaguuggaaauggugcuuuucuaucucuaaaucccucaaggauauggguagugugguucuugcauguaagaaauguuucuuuaaaaugcacccaguauaauaagagaacugaauuacccuccuccgggcaguucucucagauacugagucauuguuagaacaucaaauuagcaaauagcuagaccagaaggaaaaaaaaagaaauuacacaauuaugacuggagacuguaccaaagagaaagccauucauuagcacaaguacacacagcagcuuuuggaacaaggaauguccugggcuaugaaugucaaagaacugauacccuuuuugcucuuuuaaucaagaguuucucucuggaguguuggccuuuggauggcaaacucccagccccagacccaggagggugcauuauaguuuacucgucacucuaccccuguuacaagacuucaguguuucccgggggccugccaaagucagcagccuuccucugacacaguuuuccguugcucaucuuuauuaugugccuccauggguuugaagcucgguagagacuaucgcuucauuuugcauaugacugcuccccuuuuuaaauaauuauugcaacuaaacuuuaaugcauaccuguacaucccaguugaaucuagcaagagcauagcucugcauuuuaaccucagucauuucacuaauuuucacugagauaaagaaacauaaagcacaggcaaccacugccaggacggugacccugaaaugccuagaauuugcagccgaggcuacucugaaggcacccggaccuccuuuuucugagacccauaaaccaucccuucccagaaggcaaaguaaucacccaccacuucugaucuuuucugcagaucuuguggcuuggguguccucaguauuuuuauguguguguguuuuucuucuuaacaauagcaacauucuugccacugaugaauuggccuaugggcaggaaguuccauaaucccaucugaucuguaucucaacaaaucuauuagaaggaucucagagaccaggagccuucuuucuugcuaaagagacaguacuagcuuuucaaacccugcuccuaccugcccucugcauguuuuauucuuaugguuggggaaagcacuggcaggaccaucuucaagacaaaauguuauuucuucgcugaaagggauggccuaaacugccuugccuuggcuuagcccucuugguuggcaaugcaauacuagccuuuuuggcccacauagcagcaguuaagagaggacaagcuauuuuaacagaauaugagaauggcuggcugguccuucucuaaaguaugaaaaaaauaccaagaauuacacugagaaauugguaauuaccauuaagucacaaaaucagaagccucaaguuaccaccuugggaagguaauggcaucagaauuauuuagcccucauuugaauagaugggagcuccuucaaaguaaagaaugucuguggaaggcauccaaguaaucuugguuuccuuaaugcaauucaagagacuggaaguugccaggacucauaucuuuugaccaguggccagcaacccugagguagggcucccagaggcaagugugguuaagaugcaacaguuccugauaagaucauucagcacaucuucuuggccagggccugauuauauguggcaacugcauguagagaaaucuaauugccauaccuuccuuuuucuaauuucuuuuaacaaaacugcuuuuucucucccuuuggcacuaauugguaacauugcuuccuuccaucauagcccugaauuaucagaucucucuacccagcaaugguucuauuaacaaccucaaucuuaaaacacagccaaauaauuaacucaaauuuauuuuuuucuucuccccuaccccuuccuuuuacagccaaagaaccugaaauuggaaacuuaaauguuucugacauaacucccgagagcuucaaucucuccuggauggcuaccgaugggaucuucgagaccuuuaccauugaaauuauugauuccaauagguugcuggagacuguggaauauaauaucucuggugcugaacgaacugcccauaucucagggcuacccccuaguacugauuuuauugucuaccucucuggacuugcucccagcauccggaccaaaaccaucagugccacagccacgacagguacaugugcauucucccauuucuaacgcacucucuccacagucuucuuugcagggugaagccucuccuucuccucucccauugauguacaagccacagggcacuaacucuuccauggugcuaggcuggggugcuguuuaacauaacucuuuuccaacagcagcccaaauaaugcauugccauaaagacaugugccugauuuaucacugaccaggauguuuacagcauaaaauguaguucagucuaauuugccauauggaaucuagagaaaagaauucuaaccucucauaacuaaaaagcuauauaacuagaccuguucuugacuuugaaagaugucugccucagucaaagaggucuuguaaauuuuauuuuguauuaucuuagugucuuugucuuccuagucucuuggaccucgcaauacccaaauaucccagugauuuaauaaucauguugaugguguuggguauuuuuuuccaacugggaaaguaaagggaaacagcaaagauuacuuaucagaugagugcaggaggcagccaugccauucagaccaccccaguuccaacaccaccucuagaagaucagaacaugcugucuugcccucagaauagugaaugauaaauggcaaaaauaaaaguagaauaguuguguucaaacaagggacuuaguuuaaaaaacaaaagaauaaacugcucucacuuuaaauuuguggugucugugagaugugcacuaagucagaugcucuuugccaugcaguaaaagacaacccuaugugaauuuagaaaggggagccccccuuucuaaugcuacauucaaaguagcauucuuagcacaauuuagacagugccuucucuggagagguaaaugaagaaaucacaaacuagaaaaaaagaaacaauaucuacagaacaaacacaggagaaaugaagaaaucacaaacuagaaaaaaaaauauugucuacagaacaaacacaggauaauuuuuccuuauaguuuacaaaaaggggacucauggucugggaaauccaagaaaaggguugacaucguagcaucaaaauugccugucauuuaggucacccaugguugagagagggucuguccucauucuacaugaggcuacaaauugucgucagggugauccauggauaaggcagagagagccaacauuauccaguugcuaucucagccagguucaaguauaaaaaaacuuagaggagaaaauuaggcaaacauauauguuuguuucucauggcucaaaccgauuuucaacaagggacaaauuauuuuaccauuaacaaaggguaaagucuaaaacuuuauggauuuagucuuauguguuuugauuuugacucuacaaugguguuuuaaauugacacacuuucuuuuuucuuuuuuuucuugcuuuaguagccaaaccucuucuuagccaccucacugucucaaacaugaccuggggcaguguguccaucucgugggaagcucaggagucugccuuugauagcuuucuuauagaaguuaguaauuccgaucacccccaugagaccauggugcugucugugccuggggugucucgcagcucugucaucaccaaccucaaagcuucuucuaauuacacugcccaccuucaugggcugauuggcgggcagcgugcucagacccugaugguccaagcaaccacagguauuuccuauuauggcuucuucacucuucauugaauuuccucugaauagcuuuccaaaaaucacccgcuacccacuuuucacccuccuaguugcucccaauccuucucaaauuugauagagccauccaaaucaaagcuuuaaagcuuuaaaauaacucucaccccaaauuaaagaauuucagugucaaaccucuuuuuccuaaauauccauucacaucuggaguuguucuguuuguuuguauaaaguuaaccugacuugcuuugguugaauuucuaaaucaucuuuucaucugaucuugaauaaucuuuuucaaucccacccauuaucaucugccuguggucguucuaaucaaaguuugccuaugucauguucaaagagguaugugcaugccauuucuggugacuuggucagaaagaucuacacucuuuuucucucuagcaggauuuuaaaaaauaaaggugcccugagcaugcugagaauagacucugaaucacaacccaagaauugcaugagaggacccaguagucuuaucuuguucucgugauuuuugucugaagacuacucuuuuuugacauguacuuugucaagcacauuuugucacccacugauagcugucacaaagucucaggcucuucuuucaagccaucaucuuguccaaaucuuggugcauguggugaauauucagagcauuaaauuuugaaaauguuucuuuuuccuggaagcagcuagcauguccaugagucauuucagaagguuuaaaguggugggagaaaaaugccccucauuuugcauggaacauugaccauacccuaacuaccacuaucuuucucuguuuuuucuugcaucucauuucucagcuugguugcacccuuugagaggcagcuggagguaaagcugaccucaagaaccugagucuuauucugcauggugaaucuguuggcauugauagucugucugguagcaugagaagaaucccagcaugcauccuuaauuugggagauuguuucuacagcaaaauauagggaaauaacagaguuccacuuggaacauuuuaaucuuuugugugguugagggaauuugucaaagcuauagcugcaaaugauugcauuguuaccuucugaaacuaauugauaaggaggauaucccaugucaaugcuaauggcuauauucugcuucugaaccaaauccuuuuuguucuuagagauuuuaugacaucgaauuaugcuguauaauugugccauuaaaguuuauccaaaugagccccuucuuuccuccaaacuuuggagcugaagcaaaauaacucccaaguccuuggaagaaauauugugccucuucccaacccuaaauccugaucuuaauaucugaauccuccaguacuguugccucucucuaaaauacagucugggccgcacuuacuuuaaaauuaguuuuauuugauaaaugagcauuuaggaggccagccccauaaacaucuagccauauagaccccuuaacauuaaaugaguugcucucaaaacugaaugucuagacuuuaacagaaaagagauacuuaaccucagggaaaccaucuaucuguccaaauuauccaauaauugaguuuccuaagcagaaaauucaaugccuaacuucaaguuuuucuuucaccuuugcauucacugggaauuuugaauggaagccaucuucaccuuuacgguauuaaaugguaaaauauagauuuuccuacaaugcauauuaaguacuguaaaaauuucucuuguauggguauuagccuuuaauuugugcaaacaguagauacuaaaaaagaauacuaaaugaggaaacuccaaagaagcauuuucuaaaacauguucaauggaacaccagcuccuugagauguucaaaggauauuccucagauaggguauacauugaucaauaaguuuaugaaauuugggccaaacaaaauuaaacagguuuacugacagaaccagccugucagagccuuuaaaaugcaaacccaccuugugaaucucuaugguaagacauaauauucgguguuuaccaugcauacuuaaucauaaagcugucuuuucuuggaacaucuuacagggcuuguguccccaguacaaacuuuagaaaauguagccuuaauacccuucacguuacuccaaucuaccacucuaauggcuugucuacucuucuucauacaugacuagcaaauggugguguuuaugcuuuaaaagaacacagaucuaaaaaauaaaauaaaaauaaagaacacaaauauacaccugcagagaaagcaauauauuuucuaucaucauauucaaugcagguguagacacagccuaacauacugucucuucuguauguauuuggagauauugaugcuuucauguucuauggcuacauucuggaaaaauccacugcuuccucuaauaaugucucucucuuucucucugcccauauuccuucuuuagaaccaaagccacaguugggcacgcuaaucuuuagcaauauuacuccaaaaagcuucaacaugucauggaccacucaagcugggcuuuuugcaaagauuguuaucaaugugagugacgcucacucacugcaugagucccagcaauucacagucucaggagaugcaaagcaagcucacaucacaggcuugguggagaacacuggcuaugacgucaguguggcaggaaccaccuuggcuggggaucccaccagaccccucacugccuuugucauuacagguacucaaucagagguucucacuugucuaacacagagagaaaaggagauaagucaucuuaaaggaaaauucaacaaaaauacaaucuucacugcaaauguguacucucuuauuuuuaauugacaaauaguaauuguauauauuuauggagaauaguguguuguuuugauauacauauacauuguggauugauugaaucaaccuaauuaacauaucaaucaccucaccuuauuuauuuauuuauuuauuuauuuauuuauuuauugugcugugagaacauuuaaaaucuacucuuuuaggaauuuugaaguauucaauauguuauuauuaacuauggccagucaccaugcugugcaguagaucacuaaaacuuauuccuucugucuaacugaacuuuguacuccuugaccaacaucuccccuuucuucaucuccccaaccccagucaccgguaaccaccagucuucucugugcuucuauguguucagcuuucuuagauuacacaaaugagaucacgcaguauuugucuuucugugccucgauuauuucacucuguacaaugucuucuggguucauccguguuguugaaaaugacagaauuuuccucuuuuuuaaggcuauaaaguauuccauuauauauauauguguauauauauauauauguauauauacacacauauggaauguauauauuuauauauaaauaugaucuaucuauacaccacauuuucuuuauccauucauccauugacagacacagguuacaauacauuacucaugauagccaagauaauauauguaaacuucuaaguaaagagaaagcagauacuauuauaaaggagaggacuuucacagcugcucuuaggaaguggagagaacguucucaagaguuguauaaagcuuuuaggguuuuuugugcccaguuuuauuggcuguuuuaucccuaguuuagagauucugccuaaaaagugacuccuaaguuaguaaaggccuaagaucgaaauccuguucauaaaucaugcuagguaacgcaguucauauaugugacaaaaguauaaccaucuuuuucuuuaaaaaauaauuauucuuaaaacugacaacacagaugcagcuagaugcagcuaauuugaaauuccugucuccuuuuuuucuuuugauuaaaaaaaaaaugcauuuaccaguacugucagaaaaaaaaaaaaaagaaaaaaaagaaaaaagaaaaaucaccuagaaaagagacgcugaaccuucuccacuaauccuccuuaucccucaggauugccaucacugauugggguuggcuuuggguauggaaagaacguagaacuuggagucggaagaccugguuguauaucucagcuuaggcaccuagcagauguaugaccuaggauaagucauuaacuucucugguuuuuuuagaugugaucgggguuggaagauugaugaagguucaaccucagauggcagauaaauuucaaguuuaauuaagcccuacccauucacucaacuugacuucuugaacauuugccaauguucaauuuggcaaaugcugccaaaugguggcagcaaaaacuucaauggcaaaggcugcacauggugucaguuuacuaaauucuagcccaaaaagccucagaaaauauuuagaagucucuuccuuuucauuagugauaauuuucagaagacggacuuugccaucugauuuucacauuaaaccaggucucucccagggucuaaauugccaucacuaagacaugucaauuaguacaauuaaauauuuaauuauaggcagcaugguguccuggaagagugaggauuuugagaucaagcuuuugugguuucuaaaccucucccacagcuuuuuagcuacauaauuuuagcaaguucuuaacuuguuugaacccuaauuuccuuaugcauggagagaggauaccacaggcacuucugggagccuugucucauagauuaaauagaguuggugaaauuuaacugccuagcauccaguaggaauuuuauacaugcuagguucuuucugcugucucccaacauuauuaggaaaguggcuuucuuaaaaauaaccaauaaggcuagauagaacaauagaccuaugcaaucaugaacucccucucguuuuuaagagaacuuuggauguguuuuaauguaagauuaaaaaaugaguauuuuuuccuauccaguuaccuaaugugaauuaaaucauucagaugagucuucaaaugcagaacaugguaauuucuuaagggacugagacaaggaggaacgagaugagauucucacuccucaggaggggagaaauggccacagaucccaucaggccauugcuuguagcggcuugcaggaccucccacauaacagaagaaaaggaagcugagagacccagucuugggaauccuagauccaguuacagcauugucucagcuaauccaugaugugaaaagauugcguuuuaaaagaagcauauuaaaaaagaaaaaaacaaaacaggagggacucuuaaauaacaagcccuugauugccuaauuagccugaaugcccucacuuucauuggaauucacugcuuugaugguguggaggugcaaagaggccagcuaucaaagagagaugccacuuaucuaaacaaaauccaggaacagaauucgagacccuugucucucagaugaagauuguuugcccaguauaagagauuucauccucgcuuuugauagaauuaugauucuugggaaaucuuuacguggaaaaaacugccucagaauaaacaccaaguguuucaaaauaacuacaggaaguccaagccacagcaaaauuuaaaucucuauuuacaaaaugaagguauucauucccuuauucauucagucaccaaacacuucuuuuuaaaacauuuuucuuuaugucucauggauuagacccuaggcauuagugaauuaaugcaagagcauuuaucucuuuguaaguuuccauuuagcuguaauggaaaagaagugucuaaacuagaugcagcuaauuugaaauuccugucuccuuuuuuucuucugauuaaaaaaaaaaaugcauuuaccaguacugucagaaaaaaaaaaagaaaaaagaaaaaacaccuagaaaagagacgcugaaccuucuccacuaauccuccuuaucccucaggauugccaucacugauugggguuggcuuuggguauggaaagaacauagaacuuggagucggaagaccugauuguaucucagcuuaggcaccuagcagauguaugaccuaggauaagucauuaaccucucugguuuuuuuagaugugaucgggguuggaaggcagguagcaauaucuaccuuacuguaucauuuugaagacuaacuaggauaacaaugugaagccuugucaguuggcaaguaucaauggaaacuuagccaacauaagcucacuccuuuuggauaucccaaugugugaaaaggcccuuuagcaccugagaaaucagaaugccugggacauacauguuuggugaacgaaugaaggagagauggugacagaauuuacuaagacccagauguguucuuguuuucuaacuuuauccaggaaaauaaacagcaaaagauuuagcaaaucuuaucauuucuuaguggguuauaaccaugagcuauuaauuuugacacaaaaaaaacuuaccuccucccuuuauuucagcuugugaggauaucucacuaauugacuucauuaauuugauucaaacugugcacuagaagugggauagaaacacaugaaguauaccggaaagaaauuauacucgaaaaaaaaaaaaagagcugaaggcagugggaaguagacaacgggauccaaacucaacaaaaugcaaccuauuuguauaaagaacuacauggccuuuggagucaaaccugacuaaaaucuucgcucuaucucuucuuacaagcuuguaacuuuagcuaagucaaucaacuucuuugaaacucaguuugcucacgugugaaauuagaauaauaccuaccucaugggcuauuaagagaauugcacaagauaacacuaucuggcacccaauaaguucuuacugaauuuucauuuucuaagcauauaacacaaauugaaugauggacuuggguaucuauugguguucuuggaaacgugugcuauccugacagagucagugcugcuaaccugaguuauuuucacuccucccuucuuucagaggcccugccccuucuggaaaaccuaaccauuuccgacauuaaucccuacggguucacaguuuccuggauggcaucggagaaugccuuugacagcuuucuaguaacggugguggauucugggaagcugcuggacccccaggaauucacacuuucaggaacccagaggaagcuggagcuuagaggccucauaacuggcauuggcuaugagguuauggucucuggcuucacccaagggcaucaaaccaagcccuugagggcugagauuguuacagguauuucaaaucaagugagccauuuguuccucuuccugguccccuucuguguaaucugucuaccggaucgccaugacuuuaacaucuuuguucacauucccuacuuaauccauaaauguagucuacuguuucaccuucuccccacacucccucuugucauauguacuuaaugaacacuccccacucccaccccagaaaugagaaggucgaaauauuucugcuuuguauucaaaauccuuuagaccuugucuuguccauagcucuugugugcuuaccucauaucaucgucccuugugaucaaccuggcugguccccagcuacauuucagccuucucaaaagaaauauaccaaugaguauauuuccaaaacguauuuaaaacuuuugccaucucaaaaucucaaccaugaucuuaacaaacuuacccagugggcucgucauuggaaaaccaaaugugaacuuauuuuaucgguaaucacuaauaucagagagacucugcaacacggacuaaauccauaauuuucucaagacuaaugauuccuacagaaauuaacaacggaauagucaaacaucuguguuucccaaagucuuucuagagauuacuagcuccacagaauguucaaagguccuacucggugaggaaauuccacguucaaauaaguuuggaaagacugaguuaaacaaaguuaaagaggaucuuuaacugcacggcuuuucagaacacccuaacgugcaucaucuccaagaaguacuuauccaggcaguauuuuccaaacuuauuugacaaaggauacuuuuuaaggaagaggaucaaacaggaauaguucacugugagcacacuuugggaaacucagcucuaaaucuacauugacauugaguuuugucuaguuaaggcaaugcaagaugaaacccuggguccacaguauguagcacaaaagguuccaaccucaguucuaccaucugaacauuuaucuaauaguuaauaaaauaacaagaaagaaugcaaaaaaaaaaaaaaaaagucaaggguaggagccuucuuuagugaaacagcacuaagaacaaagcaaaaagaccauaacauuuuaaaagccauuuugggcaggcucaaggagaauguaaucagcaguaucaucaugagcagcucuacagaucauuaaugcugguuuauuugucuuuucaaaaagaaaagaaaaaggucuugcaggggaugggcacucagccacuggaagacagagagcaaauguaaacaauuuacuggcuuugaacuuauuuaauaauaugugggacgggccaaugcugaguccagauguggauuuacugaauugcuuuuagacaaaacucacauaugcaaacauaugcuugacuuguauugaaugugucuacuccaucuuuccccucuccugacucuacuggacuuguuaauguugaaugauuuuauuuuugguaucucaggacacuucuaucucugaaagccggggcaucacuacauauugauaccccuacuggagagaagauugcacggacugguaaaugauguugucuuuccuccuucucccaccauuuucucucccucuagaagccgaaccggaaguugacaaccuucugguuucagaugccaccccagacgguuuccgucuguccuggacagcugaugaaggggucuucgacaauuuuguucucaaaaucagagauaccaaaaagcagucugagccacuggaaauaacccuacuugcccccgaacguaccagggacauaacaggucucagagaggcuacugaauacgaaauugaacucuauggaauaagcaaaggaaggcgaucccagacagucagugcuauagcaacaacagguacuguaaauaaacaggagagaacagagaaaagucaugacucaggggucuucuucucacagggcugaguaaucacaggagcuuuggaugcaggcaggcuggcgcucugauccugacucuuucaauuacagacuguguuaccuuggacaauuuggcuaaguccuuaugcaaaaaaaguaugaugccauuuacuuaauaggguugugaggauuaaaugagauaauucauauaaagcccauagcggaaggccuggcagguagcaagggcccagcaaaugagagcuauucacguugccauuaaugcaucaucaucguuacaauuaucaucuuuuuuuuuuuacguuccaaagauucuuccuucuaucuauuaucucaucauaucucaucucaucauaucauaucucaucauuuuauccagagauacacuuccuuguucuuuggccaaauguucgagcuauaccaaguagggagauaauggagaagcagcacgucuaucuauacacauuaauauuuauaaaaugcuacaugugaauaaucaguacggugaucagcaaggauaaaggagagagcuggcaagauuaacaugcuacuguuuaugaagcucucuaacuuugauacucauaacaacucugaaaggcaccuagaguguccuuggaguuuaauuaccuuuuuccauaggagcuguuucaaggagaaaaaaaaaaaagaugguuaauaauaugacucuuaggcccagagugauggcucacaccuguaaucccagcauuucaggaggcugagacaggaggaucacuugaguccaggaguuugagaccagccuaggcaacauaguaagacccuaccugugcaaaaaaaaaaaaaaaaaaaaaucaaaaacuuagccagguguggugccucaugcccguaguaccagcuacucugcaggcugaggcaggaagaucucuugagcccaggagguuaaggcuguggugagcuguguucgugccacugcauucccaccuggacgacagagcaagacucugucucaaauaaugauaauaauaacaguaguaauaauaugacucuuuguaauaauaauaauacuaagaugaacaugacuuuuuaaagagaaaaggaaaaaccuccaacaagucaaguaaauuauuucaugaaacugagggagaugcagagacauagcauucgcuggagauggcugcuucaaagggaaccaggggacagaaccacaaaaucaccaggagagauaaaagggaccugagagaugauguagcucaaccucuucuguuugugcaugaagacucugaggaccagaauggugaaaugauuuuucuaugaucauagagcuagauuuggaguaaagcccaaugaccagcuuauucuaauacuauuuaaaaugagcagucuggaugagagaaaaccaaugcauauagcuacuugccaucucugacaggcauaggcaugacauuugccaaaaccucuccuuuuugucuaaagauagauauuuuauauuguuaaguuuucaggaccuaauaaguggcaagaaaucacccauguaaaaauaauaaucaguauuuguaggcuuggagaaaaugcuagaauccaggcagcaaccuaguaagagggaaaaacccuguuucuuauuaacagggacacccuauccugggaugcaggucucagucuccuccucccuguggcugcccauaaaacgacuccagaucagaggcagagccuugauuuugaucuugguuuauaaacaguguucuucgaaguuuacuucuucugaucauugauuuguuuugcugaucuuuuuuuucuagaagcccugcaguucuaaagcaaaaaagagaaugaauaaucaugaauugaauuuuuuuuaagaacaacaaaaaaaaaaggcaaggcagacccugcucuuuuggaaagcccucucuuugauuuucuucucuagagccuaguagcuuauagccaaagagaggugcccaugcgcgugcgugcuugugugugugugugugugugugugugugugugucuacaugccugugcuccaggaccaggagaagacaggaaagggggcucuugagcacagaagaugccuaauuucuaucuucaccucaucaaguuuauaaauuuccccuuuuguuuuuuuuuuuuaauccuuucuccucuccucucuuccucccucauaccauuguaaacucuucucuguaauguccuaucccucuuccuccugagaaggcccugcuguagcuccuccucucacucacaagguaccucuccauagcacaagcugccagcccugggugcccagggcaguagaaagggcagugggagacaguguugccuggugguuaagccaacaaccaugggacaguguccuuggaguuucaucauggcucuaccucaauuccuucaucuggaaaauagaauuuaacucaaaggucagccacgagguuuacauaagaucaugaaugucaaguauuuagcagaauuucuuuacccacaguaaccauauuagcuauuaauguguuuggccauaagauacaccuacuaaaauguaccuacaccaaugagguuuucagucaaagcaauagugcgaguacaccagguuggcagagggaaguccucagugccugaguuuauacaccucacuguuuuuuguuuguuuguuuguuuguuuuuucccaguuagacucaucucgaucuuuccuaggggacaccuuaaagucuaguauggcccauggaggaaagagggacauuggaaagaaaauaaagagagggcaaucauauuuacugaauucucacugcaugccagaugcugugcugggaguuucacauuuguuaucucugcuaauccucaaaacaucccuguggguggguaccacuuuucccucuggacagauggagaaacugagguucacagaagugaagggaccugcccaaggucacccagccucucagugguauuuggacaaugaagcucuuucaggcuccagagacccaugugguuucugaaacuuuccaugggcagggcaaaaacccaggcagccacagagucuggggguggcuaccaggccacagaagaaagcuguaggaggagaugucuuagaugagagaaaaaugcagaaagaggaagaaaaaaaaacccuugcugaauuucuguggguuucagcauguaauaaucccuguggguuggagaggggaaaagaugaggaagugaguucccuagagccugaaaauuguuuccugaauucucuggguaggcaugguuagcugaagagggcaaaaaucgcagccaaaaaauacacagagaaaagccaaaggaaacuggguuuugaggggagguauuuugggaggcagaaacucccccugggcauggcuuuucucacagguagacccagcguccacuggguguuugcuuuggugaugagccugagguuguucucuuggcuuuggaccuccuuccaguucuaggaauggguuugcccaggucaguguuugugugaacguuauuuccaggauuccaggcugugcuuggcucugcugccuacuccugggacccagaaagaucacaucacaagaauguucauggaagccuugguuugguucucuguaaaauggcuauaaucacaucuuuuugggggcuucuacaggaggauuaagccuuauaaauugcaaagaacuguacaguugucaagucuuaguauuauuuaauaaaaggaacuagaaagcaaagauuuaagaaaauguuaaaaaucaaaaaugaacgggggucacauuccaaucugggaaaccauucucccacgauuccuuggaagucagcuaugguccuaucacuccccuugaauuagaccaaaugacuuuucuacaacccugggcccuguaccugaaaugaaacaauugguccuagcaagucacaacuuaaccacagaucaccacauucuccauccuaaaggcuuggcucagacacaaauucuaggcacugaguuuuccuaaauaaggaauucaggaagaaccauugaugaacaagacaguuaacuguuucugggcuucucuugugcuuucuucuugacagccaugggcuccccaaaggaagucauuuucucagacaucacugaaaauucggcuacugucagcuggagggcacccacagcccaaguggagagcuuccggauuaccuaugugcccauuacaggagguaggagacucggaaaggggagagagaggaggaguguuguggguuuggauggauucaugaaaaagacccugauaauuuucauccucuaacaucaugaucaaagaaaaugaauucuuuauuugugagaccaucuggagagaagagaacucauuuguaaagugcuaugagguucuuagaagaaacuuucuugugaagggucacuugaacaagaccuuuuuuaaccuugaaauuauaaaauucuaugagaaauagaucucuaguauuguuugcacacaauggcaaaagauucuaaauauauuggcauuucucucccugcgcacacucaucugaaaagcuagucuuggauauaugugaaguuuuaccuuuggguaccaaaucugucugucucagcaaaugauggcaagcugugccuuagaaaauuugugaguucuaacucaaagcgcaugggcuauaauagagaccacaaggaggaagcccagucaaaucugccuaaagacacucuggcagguaguaagcuaccuguugcugaaaguguauaaagagaggaugguuaauaaccucuucacaggaaugcuguuuugucucuauaggaagucugaccagcugaugugcaaguucuucacuagcccccaaauucuaagaaauacaauuucuguguuuauuaauaaacacugcagcacaaacuugacuauaaucaacuuucuuuucuuaaguagaauuuccucuaguaagggagucuauaauccuaagccaagacaaugggugcaauagaucugacauacauuacauaguaagcuucccauauuguuuguggggaaaaauaauaagauaaaauuugcacaacgugccagcucucuacugaacggaaacuugccauuuuuaguacguugugacuucauguuuucccccgccccuccuggcuuuguuuuuggcaucugcaccaauagaaaaagcauacaaaaaguaagccuucuucccuuaugccagaggguaggagcaaaugagaagucaagaaagugguguuugaugaagauauaguuucauuucuaaaucagauacacucuuuuugggggcaacagugaauaagugucagugagguucauuauuccucaucuugcuuuuacuguguuccagguacacccuccaugguaacuguggacggaaccaagacucagaccaggcuggugaaacucauaccuggcguggaguaccuugucagcaucaucgccaugaagggcuuugaggaaagugaaccugucucagggucauucaccacaggugaguuggugggguuguguguguguguguguguuacuauuuuucagaggucacuugugcauccuaugccauuucucaccuucagccuuguagcucaugacucagcagcuggaaaaaaagggggguuuuauuuaugagauccuaguggaaagugaacuggauuuagagugccagaggccucucuucuggcccaucccagccucuggugagcugggugaccuuaaccuuguugggccuccauuuccuggacuauugugaaagaaaaaguccaaguuugggagucauacuuaccugaauuuaaauccaaauucuaccaacuacaugagcuaucaguccauuuuacuaggguccacuuuccuucucuguaaaacagacacaauucugcuucccucacaggguaugguaaggaucacaugaagcuguguuuguaaagcauccugaaauacaauuguucauguuagcccaccaucaccuucaccuccccgccuauugccuggaacccuugugagugucccucaaagcagguguuucacaugagcaugugauggugacagcuacaaaacagcuccucucuauuugguggcucuugcauuccaggcacuguuacuaaacccuucacauuuaauccccacagcuauuaucauccccauuuuacagaggagacaacugagacaaaugaaauaccuuggccaagcccacauaauuaguaaaugcuggaaccaaauuugaacauaggucggucugacuccaaacucucuauccuucuaaaauaaagaguuccuuuccuaguguaaccugauuuguacaguacacuguaaagaggggaaaauaaugaauugcauugaaggagaaugaaguggaaaauuucucuucagacagccaugucucaaaacaauuuauccuuugauaugugagcaauuauccaguccaacucauuaagggauacaaagaauagaccucauaggaaauuuuaaaaauauccucauagccugaaagaguugacaacacacaauuaaaauaucccaucugaacccagagucccguccacccugccucacaggcccuuauuuccccaaagaaaucuuucaucaguggauucuccacggcaacagauggcaaaagcugaacguaguuccucccaaugccccauugucaucaccaguuaaaggagauucuguccaugcacagugaagcaggaaggaacucagaguggacaaugugggcuccccaguugcccugccacauccuggcucucagaccagucauuucaucccucaaggcucaggugccucucugugaaaugagcugaggauagcuucccuccacccucgccagggcugcuggcaugggcacaauugaguaguaagugcaaaagcaagaggaaauggucagauucaugcuggcuucugagaaagugauguuggguaguaggagaggucaguuaaaagaggccagggauaaauauccuuugaauauccauccuuucucagaacaagucauuugaaaaccauacuuaagacuucaaauaccuuuaauagagaucuuaauaacaacugcaaguauugagagcuuucccuaguacaucuuacacaucacacauugcuuagcuagucuuuauuaacuaaacagucacccuuuggcagcugaagaaagugaaguuuggagaagggaaaugaauuuucccagggcacagaggcaccaggcagagaagccaugguagaacccgggaccaccggccuccagagccuggcuuuauguucucugcaagccaucuaaggagaaauaccacucaaagcucagaaaaggcucggggccaggugcggugacucacgccuguaaucccagcacuuugggaggccaaggaagguggaucaccugaggucagguguucaagaccagccuagccaacauggugaaaaaacccaucucuacugaaaauacaaaaguuagcugggcuugguggugcacaccugcaaucccagcuacuugggaggcugaggcaggaucauugcuugaacccgggaggcagagguugcagugagccgagaucgugccacugcacuccagcaugggcgacagagugacagucugucucaaaaaaaagaaaagaaaaaagcaaagaaaagaaaagagaaaagaaaagaaaaggcucgggcagucuuaacuaugcaaguccccucuguguaaguucuuucucuggggaaaguaauauaaacaauaauaauucuugucauguguucagccuuguucaguuuacacagcuccuuuccacccauaauauaauggaaaaaucaaaauaacacugaagaugaaaccagccagaauuacuaucccuauuuuacacaugaggauauagaggcccaaaguaacugagccagcaagggagggagucauuacucaaagccaggucaggcuggcuccaggcuuaggucucugaaccauuccaugcagcugacacuguccuaacaucaggacuccauaagcaguguggacagcagagcagcuagagucugaugucccacccaaugacuucccuccuguccaccaucuuucuuugcagcucuggauggcccaucuggccuggugacagccaacaucacugacucagaagccuuggccagguggcagccagccauugccacuguggacaguuaugucaucuccuacacaggcgagaaagguaagguuuuguccaagucucuccucacucuaaggagugucuuuccugcuguaaacucuucccauucgcucuucucccugccacauuugguacaggaugauaaaaaugcauggguagguugaaaaggccaguaauguucauguggcucccaacugaaaccucaagggagucugguaggucauuuaaaauaaaaauaaaaauacaucuccagccucuacauguuuuccuggcccauuccuccucuccuguuaguaucucugccuaccagugugagacaccccguuuaggaaacaguugucaucuuuuacaaagaagaaaaccagaaucuaaaaucuuaaccagaccgcuucaggccauacugagcagucucaacuuuucagagaccacaaaagaagcuaguuuuagcagauuuaauuaaaaagucugaaauuuuaagccagguacaguggcuuacaucuguaauccagcacuuugggaggccagggcagguggaucacuugagaccaggaguuugagaccagccuggccaacauggugaaaccucgucucuucuaaaaauacaaaaauuagcugggcauaguggugcaugccuguagucccagcuacucggcaggcugaggcaggagagcugcuugaaccugggaggcggaggcugcagugagccgagaucgcaccacugcacuccagccugggugagagagggaggcucugucucaaaaaaauaaaaauaaaaaauaaauaaauaaauaaaacagaaauguuuucuuguuuggcaaccaucagugcuaauguacccaguugacagauuaaacacuuguuuagagcaccagcaaacuacagcugccagaaaguaaaaucaaauauaaguaagagacuggagaaagagagagugcuuuucaaugaaccccuccauuuuguaaugagcuacucuagaaauaauuguguaauuucaauuuccagguauagguaaguuucauauuuuaugguuugguauuguuuugcucucagugacaauaugagcaggcaccagcgucugugccuggagccucugaaaauuuucauucaguuaugguaaccaacuaagagaggucuuuuugaggacagagcacagguagggguggggaacugauggggaggagggauguuggguuuauucuuuuuacucuuuaauucuuaaauagucccugugagcaaacucuucugagucaggaaagaugguguugcaccuaaaaugaaucagguauaguucaugggaaccauggagauuguagauucagggcaaacaaggggcuugguucagaagaggggguggugcucacaaaugaugagguaaguugaccaacuuguccccgcuugccugguacugucucaguuuuagcaccagaaguuccacaccuaggaaaucccgcagucccuggcaaaccaggaugguuggucaccugugaauaggaaauaaacacaugcccccaagcaaugugaucaguauugcuuuccaccacuggacaugacccagcaggccugagagauaguggccaggcucuggugcagcuacugcuguccaguuuuugugaccccucagccuaaugacuugaugacacuuaguaaauuauaaaagggcaugugaaaaagugacaaagagaggagagcaugcaucaggacaaauuaagcaugggcagcaggcuuggggauguccccuccgaccguccucuaccucggucucaguggcaaagcgauuccagccaguaccaugugggaaaaaaaucuccugacccccaguuccccuuccuucugauuuggggccuggaaaaauuaagucuccauaugagaaauccuuuacguaugaggugagugcucaagagagagaaagagagcgugagucauuucagaaaucagaccugcuuuuccgcagggucacugaaaguuucgauguucgaaggagguguguaugugguuugccaagcccacucauggcucagacagugagaggugacugccuugguauguguauuucauguuuagugccagaaauuacacgcacgguguccgggaacacaguggaguaugcucugaccgaccucgagccugccacggaauacacacugagaaucuuugcagagaaagggccccagaagagcucaaccaucacugccaaguucacaacagguacaaagacacugagagcuggaagcucucccuucuggggugcccacccacagccugcaucuuaaacaggaaccgcuagccaguucuucuuucuuaagucagggccuugcaaugugauuacaucagcaucacuuaaauucaccagugcccacucagucaaggccugaagaaacacacuauuuccuuuugaacugaaaugaccuuggucuccccacggggaaggaaaagauuuuaagaggagggcuuuguaaguggaaaaacaguucccacuggcccuaaaccuaguauuuaaugauccacguuccaggcaggaaaauauuuuugaagaggcauauuuuuuaggcaauuuuuccuagauguuuguuagguuucuauacauugagagcuuuuuacaaacuauagcaagcagggaaacagaggaaccauccucucugucagggugaguauugauauuagcauucauccauccucuuacuuagaaacaaggggcuugauaaugauguucacagcuguauacuucucucuaaauccaaccaaggccaguuagaaacauccagcccuuaggaugagauaaaccauagagaauuugucuuuggagaucaucuggcucaaccaccuuauuuauacagaggaaguucuugccaaaggucacguaguucagugguagggaaaggacuugaacccagucuucuugauacccagcccgaauuucugcccuacauuugcugaucuuauccgauauuaaucauccugucuucuccagaccucgauucuccaagagacuugacugcuacugagguucagucggaaacugcccuccuuaccuggcgacccccccgggcaucagucaccgguuaccugcuggucuaugaaucaguggauggcacagucaagguauuuuaaguauauaacaacuccucaaugcuaguugaagcauuugcaugaucuucaaaguauggaagaauuaccugaugcuguuuuucuaccccagugcaucuggggagcugaaaaaaaaaauuaguagagacuggauggcaugccagaccuucugaaucauacucuccagccucuuucauuuuaaccagacuccaguucugauaggcagccaagaucaagaaccacugcuuacaagacuugaggacauuuuaggagcuggaaucuugauccuuuaauauuuuguugaacaaaggccaaaagguuucucugcauguuugccauauguauuaucucacagaugguaucuuuauauuauauauuguaauauguuucaccguguucuuaugauaucaacuguuaauaccauuuuuauccaguguuuauauuauuuauauucgcuacccaagaauuuucuuucuuuuaccuuuuaauuugaaauaacuuuagaucuucaaacaagcgaaggagauuuccuaaacuuuaccuuccaaacuuguuauugaauuuuucauuuugguuaucucacuuuauauuuccaagaucuuuugcuuguucuccacacauugaucuuuuucuggcauuuuguuugugcuuccuauaucaucaucucuuuaucucuaagaauauguugcugguauuuuauucuauauccugcacaguguuuguuacaaguuucuuuguuuugcugcuguuguugaguuugguuugguuuggguuucugucuuucauguuggagacauccacccaaugucuguugaucauggucugucuuuuuguauuugaacuaggaaugaaagagcuaauagggaguuagcucaggcagggcuugucaacuuuguggcucccugcagaaugauugggcaaguacccacaguuuucuugggggacccccaaauaacagugccauaaaaccuggccucucacuguguacaaacuuucaucuuauuauguuuccaguguagcaccucggccuccuugaaggcugagccugguggauuugaauccggacuuccucucuggcucaaccuuuccagagaguaaaccucagccuaccaucugaaugggaaagggcagucauuuagacuguuggagggaaugaggagaucuuagagucuguuucuuacaaaaaagcuucuaaacaaaccaaaccuuuguucaaccacacuccacauuggccuuuaaagacaucucugcuuuuguacacauuccuuuacugaacuugcuggacucugugacuugcaccaagcagccucugacuagcucugcccaugcuccuuaguuaaccucagccuucuucauucauuccccuccauggucucucuaccacucacuuucuaucuaccaaguuucuggcacaccuguugcugucuccucucccauuccccucaucuucauggauuuauaccuuacauucucuugcucucuuuuuaguggguuuuagaagcaaguagagaugaguggcuguauccaaucugucauauuuaaccagaacuggacacauugcuaauaacuaucaugccccuuccuggaauugauauaacaaugaacuaucucacugugugagcugaagcaaauccuuuaucuucucugggugucaguguucccaucuguaaaaugaaugccuuggacuuauccaucuuuaaggucuucuccuugucaggcauucuaggauucuguguuuaccugaaucaugagucucauuuugaucuagaguacccuaauugccuagaaaauggcuuugcacagaagccuagagaacugacagguaauuguauuccuaaguaauucaaugaacccagcuuuaucccugacaguugaucuuucccccagggacuagaacuggggggcugcaaaaaggccucuggguauuaaaugagcacucaucccaguuuacuuuucugcauguccauucaccagcuuuacaugucuuagaaaaaaaaucaaccugguauaggagaaaagaguccuggacaggguguugggaaacccgcaugcaagaucauccucugccuccaacaauuuauggaaugagagcaagucuuuuagcuucucugaaacucaauucucccauugaagaaaacaggauaagguaccuucccaguucccaggaugcaggagaaccuuccaggggcuucugcacugaugcaugacugcccaaacuaagcuggcuguuugcagguuguagagaagaucguugugcuugguuuacuaggaguguagguugaauuccaaucccagacacuaaggucauuugcugaaaagaauuggaagcuagcaagaggguguggaaagaggauuuccugcaaacugaaaccaaugaccuccucuguacagcagcacagagaccagccacagacuacaaguguaguuagaguuggucaacaucugucugucauggauaucucuguucuagaagagagacaugugaggucagcuuaaguuuuaauccuaccaugccuauggggcuauuauaaucaucuccuaacucaagagauccccaaacugacugcacauucaaaucacuugggaaguuucuuaaauauagccaggcccaacuucuggcucugaugauuccaucagucugagaugaggcccaggcaucauauuguuuuaaagcuucugagagugauaaagagcuauauuuagggaccacugaccuaacugaccucaaagucccuuacccugugugauucaucuugcuaccagauuaagcuucuuaaagcacagcuugguuuaugucauuggcauguccaaacaucuuucaaggcuccccauuucuugugaugauaaacuucaaguuccaaagcuuagcauuuauaccuuacagggcuccucacuccguuuaaugauaaacuuuaaguuucaaagcuugucauuuaaaggcccuucauaaucuaguaacauuuuccacuguucuaacaccugaagcuaaguaugguugaggucgcuuauugccuccuuauauuauuucauuuuauguuuuaaaucugcuuuauucaaaguuuacugauuuaaauauuaaucucauccaaaaaaaaacccccuucacagaaacauagaauaauauuugaccaaauaucugggccccauggcucagccaauuuaacacauaaaauuaaccauuacaaucccauucucccaauauaguuuggcagggccuugggcaggugguagccuuagcccuggagucuacagcagugcucucauccuuaccagaugcggucucucccuccuuauauuauuuuaacuugcucugcaccuucuggcccaaggaccuuugcuugugcuguacucuccccaucucugauaucucagcagugcacauggagccugguagagaguggguacucaaugaauucuuguccaguaaguaagugaauggauggguaaaugaacuuauaaauagaaugacuucuuaucuauacccugagaauuucugugaccaaaagccauuauacuuuuucuucugcucuuaggaagucauuguggguccagauaccaccuccuacagccuggcagaccugagcccauccacccacuacacagccaagauccaggcacucaaugggccccugaggagcaauaugauccagaccaucuucaccacaaguaaggaggcccagggugccauccagccuugagaucuaacuuugacugaaucaacccuugacuuccccuuugacuucuacuuuaaaauuuucaaacaaaccucugaaaagaaucgauucacugcuacuacuuggaagccugaggaaagcaaaugugggagauuaugagcaucccggugaaaggaaaggaggaagcccaucuggauucaguccccauuucuaucaccugcuaggugugccuuaagaaugcuacuuccauccuauaaucuuuagcuucuucgucuauacagggagauuaauaauaaauccucugucaccaggaccuugcaaguguucaugagguauugcauuugaacuccuagcccaguauguggcccauauaauugugugguccuuuuauugucagaguucaacaugagcugaaagucucuuucuuucuccuucaucaugccaguguuuacaaaaccuguccacauucaaaaucacaaaugaucuucccaccaagcugguauggugagcccuaugcccaaaguucuaguggggaagcagacacuuucagagacuaaaugaccuguucaagacuaucuugugaguuacagucagaguugggcucagauauuccaugcccagggagccucccccugcaccugucacaaaguaucuucugcagauagcaaaccugcaaguuguuccauugauaaguaagaguggcauccauuccugaggaccagaggagcuggccuuuggagagcccugccuuugaaaauucacgggacagucauucugcacacaucugcugaagaaagugcuuccccuuugccagaucuuaugccagaugcuaacuaugaauguauccuaaagaugcucuuauacuagggcugugaaauaaauaagaaaacagcucaugauacaaccucagaugaauguccucagaucagaaaaaagaacugcuaugaucaucagcucuaagacccaucuacuaggcauaguuccaagauugcccauuucuaugaguuuuuaauuguuugcaucacauuauugcaccuggaaauuccccaggcauucuaguccauagaguuaagcuaagaauuaagcuccagcucaguccuccugcacugagagcaucaccauuucuccuuauuccacaguuggacuccuguaccccuuccccaaggacugcucccaagcaaugcugaauggagacacgaccucuggccucuacaccauuuaucugaauggugauaaggcugaggcgcuggaagucuucugugacaugaccucugauggggguggauggauugugaguaccaccagggacugcagagcccucaggccuaggggaagagggagagggcaaagcaggggaggagaagagggugaucuccuccugaugcacucugacacccccaugugugaggccuugcaagauagugccugucacacagaggcacucaggaauucucucuuaaacaaaagaaugggaaacacgcuggcuacuuuuugaaacggggagauaaguuucuuguaguuuaucucauccaauccucaucaaacaacucugugauguauaaaugacaguugaucauugaacccauugcuuacauuaauuagcacugacuaagcauuuauuaucuaccaggcacugugcuaagaguuuaagaugaauuauuccgaccccauuaccauaggagcuggguaguguauuuuugaauuaauaaacucuauuuuuuuagaacaguuuuagguucauggcacaauuaagugaacagaaguuuucauauacaccccacacccacccacacaaccuccccauuaucaauauccugcaccagaauggugcauuuguuacaaucaaugaaccuacauugacacaucauuaucacccaaaacugggugguauuuuuaaucccuguuuuucaggugagaacaccaagacuuaaggaggggcaggugaccacccaaaguuacauagcaaauuagggauggacagaauggagccugaugcucucuccacagugccacacuccuuccucucacaacgaugcccucuuuccugcaauagcuuaaguacacccagauucaucgauauguuuauagguguuccugagacgcaaaaacggacgcgagaacuucuaccaaaacuggaaggcauaugcugcuggauuuggggaccgcagagaagaauucuggcuugguaaugcagcccugcauguuuauaucuaaaaugccugauucugcccuccuugucacuuuuccuaacccacagggaccuaugggagagaaagagaugaggaagaagaacuacuucugguggcagacacagaaugucaaauucuuaaugaaaaagacuaucauuuaaaugcucugaaucaucaaaauguaaaccaaaaaguaucugagacagaucucaaucaauuuagagguuuacuuagccaacguuaaggacacgcccagaaaaaaagaacacaaagccacaggaacagccugugguccaugccuuuuuuuuuuuuuuuuuuuuccagagauaauauuaagaguuuuaguguuuaaagggggaaagccacaggaacaaccugugguccaugacuuucuuuuuuuuuuuuuuuuuuuuuuuuuuuuuuuuuuuuuucagagauaauguugagagcuuuaguauuuaaaggggaaaagugggcuggagggauauggucacauuacugaauccacauguugcaagauaaaaaaaagaaaaaagcagaaugacaaaaaagagaauggucaauuuuguauucaucucacacucaguaaaucggcacuuuacauaagauaaagugaagauagaauaacuaucuguggagauaucuggccuuuuaucuguagcaucugcuuagggacaaaaggagaggcaguuucucccaugacucggcuuucaguuuauuuuuuuuccuauuggcagaguuaaauuggggucccaagauuuuauuuuccuuucacaaaaaguaaaaucugauuaaggaagaaccaaaacucagcccuuauguguuaaccuagccuuaagucauucucuggaccagucauagaauccuccucacugauaucauugauaucuucccuccugugccccagguugugcuccaggugcuaagauggguuucuuagagccauaauauuuaacccccauagcaccccuacaaaguacucaauugccaccgggugggcaaggugucaggugucagaagugguugacuaguggguugguaagacgaauuuacuaacaacaguauagguuugaaaaaggaacguuuauuagaaagaaagaaugcugcaaaaggacuuacagccccugcaguggauuuuuccuuagggguauuuauggaccuuaaggcaggagcuuaaggauaauuuggacccuauuagccauguagaacaugauacaugauuacauuuguagacauuuuggugccuuaaugucagcaaggguugcaaaaugaguuuugauaugcauguauuccagagauguauagaaguuccaguuaccuauaaauuuuugggaaauaaaccuggaaccagaugcuugcuugagauauacggaagccuaauuaccuuuaaaucccucaguuaagggguuuuugucuccgaguccuacuugauggucaccaggugauuuuugcucuccucaccaccucgcauggauaaaaucacagccucaaaaagacugagugguuugcccauaggagucuaaccaaugaacaguugagcugaaauuuggaaucuccuaagucaacacuacaauccuaucacccauccauucauccaugcaauccacacuuuccaaccaccuaacugcagagaacauuguucuaugcaccacugccuaccccagaaaauguuuaucauauuauaauaaacauuuaucuauauuauucauugcccuucauuuguaaggcacuuuacaaaauuuuauuuguuuguuuguuuguuuguuuagacagaguuucacucugucgccgaggcuggaaugcaguggugugaucucagcucacugcaaccucugccuccuggguucaagcaauucgccugccucagccccccagguagcugagauuacaggcacccuccaccaugcccuccuaauuuuuguauauucaguagagacaggguuucaccauguuggccaggcuggucucgaacuccugaccucagaugauccgcccaccuuggccucccaaaguguggggauuaugggcgugagccaccgugccuggccuguaaggcacuuuagaguuuaaaaaguacuuucaccaccuuaucuccuuggaucuucacuaaugcacugggagguuggaaguggggcaaaaaugucaacccgauuuuaccugagccuaguauuacuccagcaagcacaagacugagcuucaagcacaggccugugugauauggcccuuuuuuuuuuuuuuuugcuuucugagauggagucuugcucugucacccaggcuggaaugcaguggcacaaucucagcucucugcaacuucugccucucggguucaagcgauucuccugccucagccucccaaguagcugggacuacaggcacccaccaccacacccagcuaauuuuuguauuuuuaguagagacaggguuucgccauguuggccaggcugauaacgaacuccugaccucaagugauucccaccacccccacccccacccccucccaccccaucucugccucccaaagugcugagauuacaggcaugagccacugggcccaguuggcccugucuuaaguguacccaguugccgcuuuuacagagugaaauagaaaugagggccucagucaccugugcuucuuagcaacccuugccugucauccacagggcuggacaaccugaacaaaaucacagcccaggggcaguacgagcuccggguggaccugcgggaccauggggagacagccuuugcugucuaugacaaguucagcgugggagaugccaagacucgcuacaagcugaagguggagggguacagugggacagcagguacaguaguggcugcacguagagccuacaaagccauggagaccuucuugacauuuacaguuuauuucucuaacuuucauuccuuccucauuaauccagcaauuuauuaaaucaacaaauauuuaaguaccuacugagugccaauccagaaaaacuacaauucaaaaguguuggguagauauuuggguccugaaacauugaguauguugggaaucagggcaaucaggauugauuucuaaugaccaucuuucaaaaaaagugugucuuucuuacccaguuuuagauaucaguuguagacugauuaaaaaaaaaauuccccaaaggccuuaauauucauccaauccagcacuucucaauuuacucuggguguauggacccacuggcgaucuugugaaucuccagaugcugacacagguugucugggauggggcugagauucugcaucuucuccaaguucccuggugaugccaauauagcugguguugcuggucuguggaccacagcuugaguagcaaaccauccacuccaucaccuagcugcuugaaucucuuccaagacaucccugccauguggucaucuagucucagccugcauccucauaaauagaaggucucaccucucaaguggccccugcauuccuugucuggcucauaaccuucauuccagucuugaagauuucuuggacuugaagugguuuugugugguuuccuggcuccacauaagaggagaaauaaauaaggaaacaacauguauuaaggcccuacuagguaccauccucuuuuguagauauuccaccugcauucaucuuauuuauuccucauaaaaccauuuuaugaagacguuguuuuuauacagaggaggaaagaaguucagaagagcucagugauuuguccaagguaaaacagcuuguagaagguggaugcaauccuggcugcagaaaacugcauccgacaauguucucagugacaaagaagggucaggacugagaguguggaccacccccaugcaacccaugcccacuuuggguggcuuucuguuauguuugugagagcagaagagauagaagcuuggcacguuuccagccucccugagcccugaaagaaaacauccauaaggugaaaagucuccagauaaaagguugccaaagccaggcugagccuaaggaggcacaaagcucuuuugagauggcaguuuagugauaauaaagagagacacccaggggcaaacauugcuuuaguucuugaaucccucaaagaauguuggcauuuuauuaccuggaaaugaauaccucuuugguugagauggcuucaggcaagaagaagaauguuacagggcaagcaaauucauuaagcagcaggaauguggccucuguuccucucucuuugugcuuccauugaggaaugagccauaauauuucccuuuacugagauaacguuuguaaggcugcauuuucuugugugauuuggcugcacccaggccuucugcaggagagcauccuguuucauuaauaucuacgugccguccucaugcucuggguagcaucaucaguuaaaaagguaucuggguuccuuugacaacuugcuccaaauuaugacgguagaaugccucagagucuugaaauguuugugcacagcacuugucuggauugggagugaggagacccacaaagcaaugguacugaaaugcuucaaaaauucaauauauuaaauuacaaauuagauuuccaaauaguaguacauguuaaugggcuucuugucuaagaaucacggaacauggucugaugaauacuuuaaaaaguaacuaugugauacagagacuauuuagggacaucuaaugucugaagggcuuaauuaugacuaauaaauauuuguaugugggagaaaagcaugccauuauuaaaugcauacuucucaccuuacucucugaggucuuuauagaaagggaaugcagaaaagucauaaaaauaacaaucauaguaaguauuuguaugccaugccaccuguuuagcauacaccuuuauugucacaauggcacuacucaguauauagaaucaaagugcugguuccauuguauagaugagaaaacugagguucaacaagaugcuugacuugugcaaggucacagcuaaaaagugaaaagaugggauucgaagcuagacucuccaaagccagccacagcccucuucccaccacauuaugcugcuucugucggaaauaaguacuggggugacacucaugucccauucaguuccgcauucaaugcugacucugggaucaauguucaaggccagucccacacccagaaccuuucaauugucaccucugguucugcccuuuacuguccaggagggaaauuucagcugagauuucucagguccauauuuucugucucucccaggugacuccauggccuaccacaauggcagauccuucuccaccuuugacaaggacacagauucagccaucaccaacugugcucuguccuacaaaggggcuuucugguacaggaacugucaccgugucaaccugauggggagauauggggacaauaaccacagucaggugaguggaccgugagggcccagagcaggccaagcuugggaagcuggagggggcuaauggaaguacaauuuaacucccuauccuagcagagacuaggaggcaggaaccuuacuuguaugacaacauguuuuucccaaggcagugagcaaucucaaggacacugcaggccagguaaaauagaaacagcacagguuaacccuugacagucccaaggacaaacacuggucaaauggauuccaaaaacagaacgcuuuacucagacaaaaucucugucugaaccccaaaaguaaagcagauaaaaguggaggccauuuaggugaagcaggguugaugacacagaaccccuggccuggggcaucuuuggaaucccaagaacaccuuaaaaugaaguccacagacuuuaaaucuccuccuuuugugaagaaaccaaggcccagaaaaagcugacuuuccugaggucacagagugaaguuggcagcagagccagcucuccccacuuccagccccuggcauuuucccugcaccacacacaccucuagcacuucuacaaucacagaaacagauuuuuuucgaucccuuuuagaaauaggcgaacggaucaaauucaguaaucucccuuacucugagccuugccuacacuggcacauuccugaaaaguguaaagcugugugggacuagccacuuaaucauaaccaaaccccugcccaggucccuccacagaaguuagucaccaucccugggaggagggcuggaucuucccuuggggccacaccacgcugaucccuggaccacaaggaugcuuaugaggucugcucacuggaaucccaaggacuuuauaaaaaugcaaagggccaaauuccacuuuaugauaaccccagggauucugauucaaugaucucaggcaagacacagcaucucauuuuuuuuuuuuuuuugcauauuugcauuuuuguuguuguggggucaggggggaggcaguugauagacuccacaagcgauuccugacaugcagcagguguugggaccuguugcuuuucaauauuagucacuuugauacacauguuuaugcccuaauuaacugcuagcaaaugacaccugcgaccuuaaguguagaccuuaccuuacauaauuucuggcacuuuucaaagcacuguuaccuucuguaucucaaggguuuaucauuuuuacccugugcaggaauuaggaugugguuuuucaugccuguuuuacagaggaggcaagagucacaggacauuucuugacagcaguccuguguuguuuccaucuuauuguguuauuucaucaauauuuccauucugagcauuauuuuaucaucuuuauugccuugucucaaaaauacucguauaauacaaaguucuucugggaaaagaaaaaaaaaaccaacaagcuacauguuagaaagcaagccucucuuucauccuuccauucaauuauggaagaagaaagagaugacauggaaaggagccacaggaggggagccccagcuccagcucugcuccuccugcuguguggccucugcaaagucacucucccucucuggcuuuagugcccaccacaguacaagaaggcguggcuuccaacccugaacuaucagaggaaagaaccagggcaaaggcaggcagcaugugcaccaagcuguuggacuaccauacucacuguaacugaguaauuacaagcggauuugcccaugaaaugaaugagccauucuuaaaccucacaucccuguaagacucagaaacugcccaugucagugaaugccaaacaauuagaagcaaauaaagugucucuauuuuuuucccaucucacuagccauuaacuuccccacaguggggcaaggggccaugugggguuucauggauugacucuaccaucugcagacuucgcugaagagucaaaguugaaaccuggaagccaagacacagauacaguuuuuucuuguagaaagcuuuggccaaaauuucaaggauauuucccccuacuugagacuagggaaguaauauuuaccaagcaccuacgacgugcccagcucugugauagcuccuuuacaaacucauuuaaucuucaucucaucuuucaaggcuaacauuaucagaucuuaagaaagaaaaaaaaauaguaaaaccgaggcucagaagauauugagaacuuaagacuauuuaucucucaaguaagaacacugauauuuaacccuauaugucaaauuguaaaacuguguuuuguugagcuguucguucugcuauuccauaccaaaccccuaucaaaauacuccauaggaaucucgugaauuacagacacacacacacacaccauguauguagcuauucaauucuagaacuucuaauaaugaccugaacuccuucagaaccuauuccuaaggacggcagauuucaucagccaccauuuugccucaagaggaaagaccaaagcuccaugcaaacucaggcgacucuugacucaggugaaaaacugggucagauucagccaguuccuuugaaaguuuccacaacccagaccaacagagagauaggcaagaggcagcugugauauaccaaauggucaaauugaaacagaacucauuuaguuugaaugacuaaauagcaaugaucagugaacaccucgccuaacaguaaccaaccuggaggccuucucucucucucucucucucucuuuuuuuuuuuuaacagggcguuaacugguuccacuggaagggccacgaacacucaauccaguuugcugagaugaagcugagaccaagcaacuucagaaaucuugaaggcaggcgcaaacgggcauaaauuccagggaccacugggugagagaggaauaaggcccagagcgaggaaaggauuuuaccaaagcaucaauacaaccagcccaaccaucgguccacaccugggcauuuggugagagucaaagcugaccauggaucccuggggccaacggcaacagcaugggccucaccuccucugugauuucuuucuuugcaccaaagacaucagucuccaacauguuucuguuuuguuguuugauucagcaaaaaucucccagugacaacaucgcaauaguuuuuuacuucucuuagguggcucugggaaugggagagggguaggauguacagggguaguuuguuuuagaaccagccguauuuuacaugaagcuguauaauuaauugucauuauuuuuguuagcaaagauuaaaugugucauuggaagccaucccuuuuuuuacauuucauacaacagaaaccagaaaagcaauacuguuuccauuuuaaggauaugauuaauauuauuaauauaauaaugaugaugaugaugaugaaaacuaaggauuuuucaagagaucuuucuuuccaaaacauuucuggacaguaccugauuguauuuuuuuuuuaaauaaaagcacaaguacuuuugaguu

SEQ ID NO: 21220 - RNA, 13423 nt, Homo sapiens
gcaggcgggugggcugccggcgguggacucgucggagccgcgggcggucagguagggggcgggaaggaggguuggggacuggggaccgcggccggagucgugggccguggcucagcggccaggcgggggaacgugccggcgugcagcggccgcgcccgaauggcaggguguggggaccggaucuggggggggcaggacuaggguggggguggggcugcgaggggcaggcucgggagggauucguggggcugaggagauccgaggagaugcagcugggggaggggagcgaggggcucugaagagauuugcgguugcagcaucucgggagguaugagguaaugucggggcccugaggaggaacgggguguagcaugugggagaugggagggaaucagggcccuggagggaccugggugcagaauuucagaaauaugaaggaacuggggggccccgaugagauuugaggaaaucugggggcgcuaggcaucuggcaaggacagggucugagaugauaggagcaaggucuagggcgauccuaagugcuauugagaaaggguuuucggagugggcugagggugagauugaggggguggggugaguucuugagggacucuaucuuguuagcagaaagaagggagcuggcugaggugugaaggcagcacaugacauucagugcauaagaggaaggagcaggguaugagggcagcacagugcccgauggaaugcaggagaugggggcucagauugagggagagcagaaaucuggggugaggaauuggggcguugaacugaggugcggggcugaguguggcagagauuuggaaauagggauuaaacgaucugaguccgagggauuuggggcauaugagugaggaauugacgaggguugcaauauacagccccaaagauuggaauuuggaauuguaagaggguuggggacaggguuuggagaggauugaaucgugggguggagauguccuaacugggcuauaaaaucaaaggacccugaguagauuuguggauuggugucuugggcugcuaaagagauuuuccuuaaaucgcugcaugggagacagagggaguucaggggacccaaggaccuaaaaguaauguaugaaacuggaugaguauaugaagaugagcagaguucaggugcugaggaacaaagugauaaaucuucaguucagauaauccugaaggagugugguaaucccugugaagggcagaaucuucuucauuuauuaaacaaagauccguuaucaugaggcagguaugguauugccacuaacuccauucugaccaccggucccccggcccacugaaagugguaggcuuuggggaagaagaaguggaacuauucaaggucaucugccuaagcccuuuuucccuguacccccaagcuacgauagcagauagaaagugagaccuccaggggaaugaguggaauaauuuauccuauauaagauccauuacagcuugaaggggcaguggcucugugagugagguguuugggcucggagacagacaaaacaacaacaacaaccaccagaaaaaaaaaagggaacccuuagguauugagcauuuaguccugugcuagacuguaaagcagugguucuuaaccaagucuggcuuugucuccuaggagacauuaggcaaugucuggagauguuuuuugguugucacagggugggggauacuacuggccucaaguggguagauuaaacauuaaacauaauguuuuauguuaaacauuugacaaugugugggauacgcccuucccccccgcaguaaggaauuauccugccuaaaaugucaguaaugccaaaguugaggcacucugaccuagagucagauacccuggguucaaguccuagcucuaucucuuccugacuuuaaguccuagcucuaucucuuccugacuuuguggccuugaaugaguuacuuaaccacccagugccuuggcucuucaucuguaaaaugggguuaugauaacaagaccaaugucacagaauuguugugaggauuuagugaaguaaacuagcaugccuaggaucuggcacauaguaaguucucaaaaucuaguaauuuuuagucuuguaucuacuucuuuacucaguuuucaugacaguccuucuaaguaggcucuacuguauucaguuuuacacaugaggaaacuaaggcuuaggaagugacuugccuaaguuuccauagcuaggaaugacacaguuaagcucauacccagaucucuguaacuccguauauucccgcuuuccuugcuucuuccuugcuagggccugcuuagucuuauuuucucagcccauuccccucuaaugaaaaagaggauugccagugaguaucacugacuaucagauugaacucuaaaguugggggguaaaucucucugauuagguagggaggagcccuggacuuuguucuugguuugcccuuagaccaagaccuggggcuagauaaggagaggagccugagguuaucaggcaggaugaggugcaacggacuauagggugagguauggaggccauuggcuugaaaaaacaccucauagcagggacugaggcugaaggcagucauacucugaaggagaguaacuacuguucuguauggucucuuuuggucugcuuuucccuggaacagaauuuggcucuaucauuuccaggacuagcuacaggguugcugaagccaguucagaaacaaagcuagacugugucugacagcaagacuuagcuggaauaucugugcacaucccuaaaagaaaauaugucaugggaauuaaaucagcccugucuaaacuccuuacucuaauuuccuauguuaccuugucaguagcuacggcacuuguccugucagccucaaucuauuaaaaaugcaaaugauuauaauuuguugagugcuuauuaugugcauuaucuuagugaauucaauccugcuaacagucuagguuuuauuccuuguuuacagauaagaaaaauaacagguuaaaugacuuacccagggcuacagagcaaguagcuagguugggauacaaacccaguucugucuuacaccuauguuacauuauaguaguuuuauuagaagccuuuuccaacccuucagagccccuauguuuaugucuggagaauaguuggaagccagaaguuuauaaggcccuuaaaguagaucauugucuaugcacacugauguguaaccuuugugacauucccuccaucuugucuuucugguaaaacaaucaaauuuaaaaaucauuucuaggugcccuuaccaaccucucagccagacuuugucuaaagcuagggaacuaugaaacauccuuuaaguuaguaauuuuauggcugggaguugauacugggauuugaauccuugcucuauuacuuauugguuuugagaccuuggacaggcuacuuucucugagcauugguuuccuuauuuuugaagaggaaucacacuuacuuuacaugguuauuaugagacuaugagaacauauaaaaaaaugccugacaauaaauaguaguugcuuuaagaguguuagcaauuaugagaggaaggcagugcuggaagagaacuaaguguugcuuugucauauuuauuuauuuauacagggucuugcugugucacccaggcuggagugcaguggugcaaucacaguucacugcagccucaaccuccuaggcucaagugauccucccaucucagccucccaaguagcugggaccacaagugcaugccaccacaccugauuaucuuuuaaauuuauuguagagaugguguuucacucuguugcucaggcucuuugccagauuuugauaacccuaaguagucucugcuagucuccccaaaauucucaucccauuuuguauauuuccuaggaucuccuugauccuuuaaucauaaucucaugauuaaaugaacagauguuauaugcagagaaaggaauugaaagagagagaggguugagguuaguuggaggucccugagaaggggcuauugauuuuuccuuugucuuauauuccuugagucauacuggcagcguagguacuacucaaauguuugugaaagaugcaagggagucuuucuagguccugcaguuuuagaggaagacagagacaacaggcaagcauguuuuccaggaaacccuauuauucauuuagccugcccuugacauaguuuagcuauguuuaacuuaguaauuuagcuaaaguuuucuuucucuacaaacauacuuccuucuggaucguuuuguuugccccagacugguacaacuucaggagcaugccuguguuucccuauaagccccuacuuguugaguuuaucuuaguugucugcaggugccuuaaaugcccugaguaaucuaaacuucaucagaauccucucccacacacaggaguggaugucaggugaugaccucacugaauucguuaaagucaguccugcuaacgaguggccuuugguggcacagugauaguuuugcacuugauuagcauucuguuagaaugcaugaggaauaaaguuuagaaagcugacauaaaaggaaaugagauaaaccuugcaaaaaacccagucaaaccaggggagcgugucaauaguaggauggaccuuuaugucuugugaaaggaaaugcaauauuuuacauguugucuaguuuuuaggggaaagcacuguuuaugucugguuuuugcucaaaauuguaucaccaguaccguucacagggccagacacauaguaggugcuuaguaaagauuuguuuuguuaauugcuuaaaguucuccaguuuugcucauggccuaagccaccaaaggcugauauagguaaaggaaauggagauaucuagagaaccaccccaugguggcaauucaagcauuaggugaagauuugaaaccuuagaucaucucuaaucuuuagauucugggaucagguaaaacaauuucuaggagggcuuagaauuuuuauuauuuagguuuauguaucuggggccuuggguacagucugcugaaaagugccuauucauuucuucuaauagguugggugguggcagcagcaguugcugcuacugcuaauaauaauaaaaacuauuauuuauguauaguuaauugcaugccuggcuugguacuguacuuagugcuuuacacacauaaucucauuuaaucuuugcaauaacuuugugaggaagauacuauuuuaaagucccuuuccauagauaaacugagaacuacagaaguauuaauaacuugcucacgucuccacaauaaguaguagagcuugaauucaaauccaggaaagccugaucccucaggccugcuuccuuaaucuauauaauacuguccacuccuaguucgugucuuuuaguccuaguucuguugugugauuuguggucuuaauuucccucuccuggucuuaguuuucucaucuauuuuacaacuugagauuacuaccuuuucuuccccuuuugcccaggcugaaguacaguagcaucaucacagcucacugcaaccuccacuuccuggucucaaguaaggagauugcuacgaauucuagcauuucauacuuagucucugcuugaaggagcuacagcagcucauuuucugggcaagacaaguuguaaauucauuuacccaucaguuuuuagccuguaugucuggcauucucaaucaaaacucuucaaaacugaccagcccuuuuauuaaucuuuauaugccuuuauaugccaugaaaggaaagguuguucaugcuuucaaaauguaguuuguaaacugaaugcguuauuaauacuaguacuaguuauuguuaaugcuguuucugguuauuauuuauuuagcauccuuuuauuguacaccuaaggguaucaggcuaaguacuuuauaugcauuuuccauagucauuacaguacucuuuuuauaaacuaagaaaacagguuuagacagguuaaauaaauugccugcuuccccacaacuugugacagugcuaagauaugaucucaguccuauauaacuuuaagguucauucuuuuguuuuguuugcuuuuucuacuaccuugguuacucauuucauggaauggggaaaacccaguggugcuagaagaggcgagauuaauauggaauauaauuauguaauuuuucugagucuuagggcagccagaguagacacagcuuaagggacagauucucaucgggagcugaagagaugugcuaguacaguaugguaugggauguacaguauuaaucauuaggucaagggaugugggaagaugguaggcugauguuagaugaggugggaggucaagaauuaauggcacaaagugcacaacaggaaacagacauucaagggaucaugaagggagccaagaugauacauagcauguuggauacucauucugauugguuguacaguugauagcuggcagaaaaugggcagcuuacuuaaagauuuggaaugauaagacaauuccuuuuauuuguguagucuuuuggggaaacugaagucaaauugaccuucuaucugagucauucucaguauuacaguaaugaccagaugugcccuucuggaggagacgggcucuaucugccugucucuuagcuccauuucaggcuaagauccuucacaaagcaguguuuucaagucauggaagugggaaaagugguucuggcuuuuuccagguuugagacuauuuccgugccucaugcuuuagugaggggaacacagguuuuccuggcaaagcauggcagcuuuggggcaggaauucuugacauccucagagagcuuggugaagcuguagucagcugagauaauuuggggaugugggcauaguaaauucauuuuuuuaaaccugaugucuuagacagagagguaggaagcuuuucaauugaaggagggauaugauauuccagaaagcuugggaaauaauuugcugcuauuuuuacaaguuggcagccuuguuuaauaaacugaucugcacugccagcucugggaagaacacagaugucccugugcauuguaagguaacguucuagauucaaacuccaaauguccucagucuguugucccagaugauagaagagagaacuguagcuauugauuuagaauugagaaggguugcauggauccugaguuguaauuucucuuuuuuuuuuuuuuuuuuuugagauggagucucgcucugucacccagucuggagugcaguggcgcgucucggcucacugcaagcuccgccucccagguucaugccauuguccugccucagccucccgaguagcugggacuacaggcgccugccaccacgcccagcuaauuuuuuuuuuuuuuuuuguauuuuuaguagagacggaguuucaccgucuuagccaggauggucucgaucuccugaccucaugauucgcccaccucagccucccaaagugcugggauuacaggcaugagccaccacgccuggcccugaguuguaauuucuaucaguaugucuaugcuauugccccuagacacuuggcauuuaagaauuuaccauucauaguuucagauauccacaucagaccucauacgcucaugauauaugguaaauauuauuuugcugagguauggauuugagucauaauggguugcaagcuugcugugugagaguaggucacucagcuaauaaaucaaucuaucccacucuauagcagcagaaucucauaacuauauuaguguuccuucuguguuauggagaaaaugcguaugcuauaaggcagcauuccccagagcguggucaagggaacauuaguuaaucauuguuaugugacaguaaaaaauagcuugaaauaauguuggguuaaauaaaguaaaaauaucuguacuucaagguuccacuauguuugagcugugugaccuugagcaaguuuuucugagcauucguuuccucaucuguaaaauaggauaauaaaaauauuaccacuucauagugucaucaugaagauuaaaagagauuaagcauauaaaguaucugucauaguaacuagcauauaauaggcacuagaugcauaguuucccuugcaguacaaaggaagugggauaucagggaggaaggauuaacuuuagauaauugugcaugucugcugcuauauauuugucagauugcauuccaaagcuaauaugguagaaauuuguuguaauguauaucucuacauuaacuccccuucuucucuaugccuggagaaagaguugaugucaugugcaaaguguucuugagcuaaaugcauuguccuuaaaaucaaacgaacuugcccuccacuuccuccuucuccugggugguugaccaucugcagaucacaagacugcacagauacagcuguaggauuugcguuuaugaaaugcugacuuuaucauaugccucaacuugcuagaccuauucauucugauuugggguauacguugacagugaccuaaggcuacagagcacugagaucucucugggucaacuucauaaguauauguauaucaagaggguuggaguguucaugguuuguauugggugacgcagaggguacucuaagccagaaauaaacugucuugauaaggcacugcuauuuuuuaaaucaucuaggcuugagucuuuggcuaucucugcucuucaccacucccccaccauaauccacucaccuuucaaaucuuacugacuauacuucuggauauugcucaaaugaaucuuuccauuuccaccaccugcucccuaguucagacuccccauuauccccgucuucucugauguuuccccacuccauuccugcuuugaucauaucaucuuccugcuucaaaacauucaucaccucaccaugcccuugaaaaugacgcucaaaaaucucauuuuggcucugaagaccuuuuauaauuauucccccaauuuaccuuuccaagucuguuacucuauuccccauauauacucccacaguuuuaaucuaaggauaauaaaaaagagaacuaaaauucauuaaaggcuuuuuuggugcagagccaaaucuuagcauucuauacacucuauauauuauuucauucuuacauuaacucuguaaagacaguauuuuuccauuuuaaagguggagaaaauaaaaugcauagaguuuaaguauucucuguuuucuuucuaauacaugaaacuucuuguccuuuccuuugccuuuuauacuuuguuaagguugugccuuuugcccacuucuuucuucccucuccauguauuuaugcaucuuuccaggccaauauaaaaugucaucuucccuuugaaaauucuguaucccuucagauuggaaugacuccucaacccccaucaaacuuaguuuuuauuucguuuauaguaccacuuucugccuucauuauuauuuaccuacaugucuugucuuuuauaaaguuugaauaucugaagagcaggaucuguauccuaaagaccucuuguaucuaguacagaacaagauaccuaaacuuagauggguggauaggugaguaaguaggaggauagaugcguggaaaauguguauuuucugaucugauguuuugcagaucaccuaaaacuaaucaucacaauuuucugcuucuguggaugauuccuaggcccccaaacaugacacaauaaacucugugacaugauuaaaaaaaaaaaaaaaagccuccacacuuuugcuuacaugguuuucuuugcuuaaaguaccuuuauccucauuccuucauuucuuucaagacauaucuuaggagugaaacugcuuuugggaagccuuccccaagucuguuagguagaauccaucauuccauccacuguacuccagcagaacauuauguggacuugcauguuauacuuauuccuuuuacugugcauaauucuccugugcuuuucucuuaguguaaaucagaaguuguaaaauucaccaaauaugaaaauaaucauuagcucauuagcauuuauuacaaguauacuacuucccuggugcuauacuaagcacaucauauuuaucuuguuacuuagcccuuauaauaaccauauaaggcagacaccauuauuacuucuauuuuacagaugagugauggggaaagagcuuuuggaaguuugaguuaauuccuuauggucaugcagcuaaguaagugucugagacuacagaaucugaauuauuucccacuaugcaguguuuugucugguuuguuucccuaucugucacccucacgugacauauaauagaccucaauaaaauaguuguuaaguaagggaaugacugaaugacuggucauagcuauucucuaaauguuucuugagugaauuuauuuauauagucagaggaaaaugaauaaugguuucuuuuucucuuuagcaggaauuugacccucuagggcaugaauacugugcuguucaguucugagcugugcuagcaauacccuucaaaggaagagcaauggcugcagcagcagcuucucaccugaaccuggaugcccuccgggaagugcuagaaugccccaucugcauggaguccuucacagaagagcagcugcgucccaagcuucugcacuguggccauaccaucugccgccagugccuggagaagcuauuggccaguagcaucaaugguguccgcugucccuuuugcagcaagauuacccgcauaaccagcuugacccagcugacagacaaucugacagugcuaaagaucauugauacagcugggcucagcgaggcuguggggcugcucaugugucgguccugugggcggcgucugccccggcaauucugccggagcugugguuugguguuaugugagcccugccgggaggcagaccaucagccuccuggccacuguacacucccugucaaagaagcagcugaggagcggcgucgggacuuuggagagaaguuaacucgucugcgggaacuuaugggggagcugcagcggcggaaggcagccuuggaaggugucuccaaggaccuucaggcaagguauaaagcaguucuccaggaguaugggcaugaggagcgcaggguccaggaugagcuggcucgcucucggaaguucuucacaggcucuuuggcugaaguugagaaguccaauagucaagugguagaggagcagaguuaccugcuuaacauugcagaggugcaggcugugucucgcugugacuacuuccuggccaagaucaagcaggcagauguagcacuacuggaggagacagcugaugaggaggagccagagcucacugccagcuugccucgggagcucacccugcaagauguggagcuccuuaagguaggucauguuggcccccuccaaauuggacaagcuguuaagaagccccggacaguuaacguggaagauuccugggccauggaggccacagcgucugcugccucuaccucuguuacuuuuagagagauggacaugagcccggaggaagugguugccagcccuagggccucaccugcuaaacagcgggguccugaggcagccuccaauauccagcagugccucuuucucaagaagaugggggccaaaggcagcacuccaggaauguucaaucuuccagucagucucuacgugaccagucaaggugaaguacuagucgcugaccgugguaacuaucguauacaagucuuuacccgcaaaggcuuuuugaaggaaauccgccgcagccccaguggcauugauagcuuugugcuaagcuuccuuggggcagaucuacccaaccucacuccucucucaguggcaaugaacugccaggggcugauuggugugacugacagcuaugauaacucccucaagguauauaccuuggauggccacugcguggccugucacaggagccagcugagcaaaccaugggguaucacagccuugccaucuggccaguuuguaguaaccgauguggaagguggaaagcuuugguguuucacaguugaucgaggaucagggguggucaaauacagcugccuauguagugcugugcggcccaaauuugucaccugugaugcugagggcaccgucuacuucacccagggcuuaggccucaaucuggagaaucggcagaaugagcaccaccuggaggguggcuuuuccauuggcucuguaggcccugaugggcagcugggucgccagauuagccacuucuucucggagaaugaggauuuccgcugcauugcuggcauguguguggaugcucguggugaucucaucguggcugacaguagucgcaaggaaauucuccauuuuccuaagggugggggcuauaguguccuuauucgagagggacuuaccuguccggugggcauagcccuaacuccuaaggggcagcugcuggucuuggacuguugggaucauugcaucaagaucuacagcuaccaucugagaagauauuccaccccauaggggaugagaaauuaucaguuucuucugcucccaagccaacuucccuucccuuaguucuugguuguuaguggcacaugcagaauagacucagccuauguccugauuccagcuggguaguucuagaacuucagaagcuccaucuuuuaauguuuuuauuuguuaugucccccuccccgcuucccaccuaaauuuagagcuuuaaaagaugcacugcccaaauaggacacacgaugguguuagcugaaguuugauuagcaauuaggcacuuccaaggcuuuaguagagagagccacuuuagcccuuugugccauguuugaaauuugcccuuguauuaaauccuugauuuuuucccauuuggcuuugaugcccuugauccauuguuuccuuccuacuauaaugugcuucaucugugacacuuucucuugaacucugauuggauucacugugcaugcuucagugggaucugcuccaccuuucagugacauuuaagacaucauauucccguaacauuaugucucagucugaucgucuuuaccaguaugaaagucauucauuuagugcuaccaaaggggauacacaagcccuuuaggaagcaguaccucucgccuggaggaucugugccaucuuggauugagaauugcagaugugacagaauggauugacccuaguugguugguauugaugacuucagccuggaaauugcuugccuuuuaaagaagcauauauggguuggaauuaugccaaagcauaggaagcugggaauaagcaaacaaaugcugauauagucagcaaauuuggauagucucuagggcucaucauuuuucauacuaccucucucuucuggccugugucuaaggaauuguacaacauaggccagggccaacaaaguggagagguggacacauuuucauguucauuacuaaaacaaacagcaaaacuauugguuuguuauucuguguuuuccucaagucaguacauacuauuugguuucaggauuucuuuccauuucucuaucaagcauuaaauaauugagaacuguuucuucaucu

SEQ ID NO: 21221 - RNA, 65504 nt, Homo sapiens
acuggacuccuuccacacaucucagaguuauauuauuguaacaaaucagucaaaauuccauuuuacaguuaaauaguacagaagacaguuuacuguacaagcaaguugugcguuaaaaacaaacaccaagcaaacgauagugcaaagcaguuuccacccagcuccauccucucgccagcucugggaugguuuuacaucagaugagugcagcaggugucacaccucagcaugacaauaugucacaaaagauugguacccacuacugacaggcucacaguaacacuauaucaaaacgucuuccuuuccucgugcuuccuacaucaguguguuugccuaguacaacuuuaacgcagccuuguaaauaaggaccuacuuuuaccagcccaggcugucuguacccacuuugggccuuacagacucaguacggcugccgucacuuuuugucaggggaugggggaugggguaggaagagcaauuuauuuacuaucccugccucuccaggaucaggaaggguuaguaaucugggaugagacuacaaagugcugggcacugggaacccaaaggugccucccacgcugaccugggaccagcuauaaccagagaacaggagggaagaaacuacaaggacaauggauucauagcugcuuccuaagaaggcauggagaggccccuugggugcagggagucagcaacuauuuugaggagauggagacuguuuuuccagugaggacaggccaagagaaaccgcagcaggagggaauggaauaggaucaccagaaggacugccuaaccugccagugugucucugguguaugguucuggccguugugacagguuggguggggacagugcucucacagagacaaccaaugaagagcauuuuguagggcagauuucugcauccacagaggccgaggcagaaaguuaaaauaccgcaugcugcuagccuuuaugaguucccuuacgccuuuucuaagccuuucuagggccagagaacucugaugugagaauccaugcagccuggcccuugggcaagcgcccacuuucccauuuugcaaaauucaggggcaagacuucaccucggaacgcagugcagcugagcugcggcuggagagcccuuuacagugcuucuguccugccacgcacagccaguacuccccaccucucacauccugcccaccuccgcccagccuccuggacagauguccuagagccacagaggagagaugcccagcgucucaucagcguuucccucguccucccaggggagccuguggugcaggcuggugggaugcugccugauggggaguguagccccuugagaaaguauugagacccuaauaaccccacacccucaggaggcagcuggggguccgcgggggggagagggggcggggauguugcuuauaaucacagagcuaucauaaucacggaacuauaccuguaagagaccuuguguuugaaaacguuagauuaagcuucuuuuucuaaaaucaguuuuaaaaacuguuuuguuuuuuuuuuguuuuuuuguuuuuuuuuuuuuuuugcucaggacuauuugcuuucagagcacaaaacagguuacagacaggugugugccaggagucgcaagauuuggcuggauccucccaggaggcuugggggauggggcacagcuuggcuggacccaggggggacagggacauugaugucugacccaaaaugaucccucaccucaaugccuucugcuaggaccuaucuaucuggcccuccuguucucuccacaaauggaauuaugagaccaccuaggggaaaggggaccuccuauccccccucccccgcccugccaagagaacagagaguggaugcguugagcugguaaagugcauggaggagccggucuguaggugcuuuccuggguuuaagaaccugaugccauagacucaucuucucuggggccugggacccgugcggcugggggaaagccaacaguuaggaacggaggggaagcugggcuggggggacuggcuuggauguguucucaaaccaucucugccagcagcgugcuggguccugccccaucuguacaaugaggggaaccccgcucgaggguggugggggugggggacacuuuccaguucugacucaaaucuguguaaaugcagagggggcuggacccaggggaugcaggggcuccaacgaaggugcaggggucgggagguuucccagggccugaggcuuauccugugggccaaugcugccucucucuggaagagagauggccucugucccaggagacaugggucccaugcagcacugggcauagcuggagacagugagguccuuccggggggguggcaggaggcugauuccccacagaaguaugggaugagacggccaggaucugggccgggggcaguaucccgggccggggugggggugguaaccuaugccucuguacaaggauguggcugcacagaugcagccagaggcucccaccagcugggaccacccugggaccgagaccacccuggagcgcaggucccauucccgcccggagccucggagccggcccaucacuggucuugaagguuguuaggguccccgccuccagcgggaggaguccaccagggcggucaguagggccgccacacggccucauccaugcggccuggcgugcucagggccgugggugaguugcuguggcugccgucggccuccacgccaucacucuggccgcccaggcugggguucaugagguugccggcggcgacagaggcagcgcugcuggugcaagaggccagcaugcggguaggugagcggucgcccccacugcugcugccggccaccauggagaacugguaggagccagaggaugucccguaguagaggugguagggggacggguuggccuggaagggcccgcucugguucugcggggcccccggguaggguggcgggagguagguaugguggaagcggcugguggccggcaugcccgccacgcugaggcugcugaugcucgugcccgagggcguggcgcuguaggggaaggcagcugacauggccccgggauaaugcauccuggggucugggaagcggcucuccgugaggguuggcagcguggggaaggagcggucaaacuggcgggggucggagaauggguucaguuccgaggugccuggaggacagcagggaagaggucaguuccagcucgagacaaccccaggagggcuuccugaagaaugaccuugggcucugguucccaaggcccaucugggggaccccuaguucuagaccuggcucuccucuuccugcccuaggcugcccggggccucccccgccaggacuccgaacacagaccugccgggaagcugguuggagcgugccccgggccaagaggggccaugggagcccccccacagcagcaacagaacagaggagggggucuauucuucuuuuuaaauccuccuucccagccucgcagaggagaggccuaggaugcggugguggggcugagggcagagucagcucaggccucccagcagcccugcccaggcagguuccucuccccaccggcccauguuaacagcugggaaggccguggauguguaaagggcuccaaugaccgugugagacugggaguuggaacccgcuuuugaagacaagaaaauggaggcagagagagagcaagacugagucucuguggcagagaaaggacugguucucaucacaaggccucugcuggggacacacgugccucuccugcccaggugcagcacgcggagguucugugcgcucacaccuggguugugggcacugaguucacaggagcucuggccuccaccucacccugggccugugucucuggagccgacucguggccacacagugacuggaugccacccuaaccugccuuggcagcaaagugagacagcagucagacaaacuuggggacccagaccccaaccuggucacaguguccagcccagacucugccccugcucccccaggaauguggcuucucaaugggcuccaaggcaaggguguuccauccucuguccccaacuuuugucaucacagacccccaaaaccucagcauucaaaggggcucagggauugagucuaacacccuugauggggaaacugaggcccagacagggugaggcacuucccucagggucacacagcacauuggaccuggcacacaauccuagggccucugguccugagccccaacacguacuugagagggagcugucccgucuuugaggcagcacaggaucaaggcuuacuguguggcuucuggagccggacaguuauccugguuuggacacuuacuagcuuuguguccuugggcaagucacuuaaccucucugcgcaucaguuuccccauauaaaacaugagacgauaacaguucaucaggauucaguuaauucacaucgaguacuuagaauggcacugggcacagagcagggguccaugaggcuuugcaaggccacuguggcuguggugucucuuacucuggguacccaggagaacuggcucauucagggcccugccaaguugaggcccuggugcagggccucccuucuacucuggcagccgggggagguggaugagcccccagcagugguccagaggugcagucuguccagcccagcaaccccucugugucacccaccaaaggauaagggccggugcuagccggagugggcucugccugccacgccgaggcuuggcugaggacggagagcuaugagccugaggugugugugacuucggcugggacuuggaacuucucggggcuuuggggucuucccaagucagcugggguauguuucccucagcagcguacucuggcccugggcguggauccgaacggagugaugcuccuggcuuaagguaagaagauguggggacagcagucuggguggcgggggccuucugggacaucugggauguucccuaguaggucacuuggcugucccggccccuugaggccgagagccuccgaggcaccuggcugccaguuuucaucuggggagccccucggggggagagguccuguugcaggugcugggcacgucagcacagcugagaugggugggguggaagugggugcuggccgccugaugggaaccccauucucaagacgaaggaaacaaauggggaccgcaggauacaacggcaggacugugccccucagagcucacgcgggcugcagggcgcugggcugggccucccuggaccugccaccauccccuccagccucuuuccucagggccaccaccccuccuccgggguggugggggaaguaccugcccucagcacucccucagaccccccagcagcuuccuuggagcuccuguacccccacccugcggccucgcagccccaggaaacccgagcugcccggggcacugucgaguggccaaucccaacaguggaaagaaauguuuauuuucuucuccagauuguccgggcugcugcaugguggcugaaugagcccuuucagcugugagaagcccccauugugggcggcugcggcugggggcuggggcugggguaugggaggugcuggggucucugcacugcuugccagugaccaauauuggagggucaaagcacuuaacaggcaccgagggaaguggugguggggugucccaagggggauccccaggagggaguccgagggcagagggaggagggccugugagagugacuucccaagccuaggucugccagcaaccccucuuugucagggaccuccuucuccccacuucacagaugagaaaacugaggcugaguuuaagugacuugucuaagaucauacagccaaugccuggcagagccugaauuccuagccugguccagcugacugcagaguucaugcucgcccuguccuggucauccgaggcccuuucucucacccaaaggggaugggccugaggauggagaugccuggcugccuguggcccagugcuguggggggcuagcgagggacugggccaggccucaggagggagcaggcagagaagcagaagucagccacugccccacacaggcugggcuccuuuccucccagcccaggauggaagcagcagcugugccugccguggggccaggcauugauucccaagcugugcccacccagcaguggaugggcagaugugggcucuccuuccaugggggcugguggacaggaagccacuguucaccccaccuccuggauucuggcucccccgcugagccccgauccccuggccuggcucuguccauggcagagaaaggcuggcucucaggcuacugcaccucgacagaugcuggcccauggguagcagaagcagaggcagcuacgcggcaggggugggcgugagcacagcgugcagggcuccuuccgcuaccucuugagagcagaccuccaacuccugggcucgagagcugagagucucaaaugcacuagcuccugggcucagagaggcugggccuggggcuucucccaaccuuggcgucucagcaggaccaaggccaaaaguccugagcccaggccagaaggggagggguccucucuucacacugaaggccugcauccagccccuggcugcagcacuaugccuggaacaaugucaguagagagacccagucggcccccaccucagcguggcaccggaaaaggggguggggcaggcagaccgguuggcagcccuguuccaggccccuuuaucuguccccucagaaguacagaaaguucuugggagcagguacuguggagacuguggaccuggucacagaugggcugugugacccgaggguggcucugaaccucuuaggccucucaauucauucaucugccaagggguucuaaccaggcucuggggaauugagaaagaaugggcacaguccgugacggcagccagcugccugccucuguccacccggccaccaagcacccuuggcaccccacuuagcccaagggccggcugugcacacagccucccauguccccagcucacugacugagagaacagaggagagaugcagccggcagccguuuagugagcggcuacuaugcgccaggcaccucgauacuccagaagaccugccugaggccuggcugcaacugugcuugcuguauccgucuaggcaguggagauggagaccccagcucggucuucccuuccaccucagcuccuccuguuugggaggaugcucugggcagggugggagaccuuucccaggaaugcuaugugccucucuaggguuggaaugucacuuaacagugugcaaaguuugugugaguacaguaaugucauuugaaugucaucccagcccuggguggaggcauccgccccaauccacuuucagaugaaaaaucgcaggcuguggggcagggguggggaaacuguacauggcaggggcgagucugucacggcuccuuggacaagucaugccccaauuuuaauaggggcacuaugggguuaaccccauuuccccaggcacagugaacuccugguaugcagaucccuggggccaggcaccaggcaugugucaguaaugucaguguuugcugagugaacgaaugauggcuagcacacagaaagcccacaggaaccgucugcaggugccaaugagcaccagcagcuccucuacaaaacaagggggugcagugacugaucuucggacaggcuuuuggucuggggcagauuggaccacaucgaggcccuccacccccaccucaccccgcugcagccccucccuccgugccguaccuuggauuggggucuggggcuggcugcugaaguggcuuguggugcugagugagccucgggggcugggugugcucggugucacccgcaugcgcagccguuccagguccccaaagcggucagggaacggcuuggucugguccuccagcuucugccggugcccugcagagcacaggaagcccaucagccguugcuuccccagagucucaguggagacagaaaugccucacucugcugggaaguucuuccugaggucugaccuuaggccucugcugggagaacccugaggucaccgccagccucuucacagagguuuucaaaagacuuucugaacagagaauggucguuaugugccaccccacauaucuaaaccucuacaacacacggugauccaaaccucuacaacacgcggugaucuaaaccucuacaacacgcggugaucuaaaccucuacaacacgcggugaucuaaaccucuacaacacacugugauguaaaccucuacaacacgcggugaucuaaaccucuacaacacacggugauccaaaccucuacaacacacggugaucuaaaccucuacaacacacggugaucuaaaccucuacaacacacugugauguaaaccucuacaacacgcggugaucuaaaccucuacaacacacugugauguaaaccucuacaacacgcggugaucuaaaccucaaccacacgcggugaucuaaaccucuacaacacgcggugaucuaaaccucuacaacacgcggugauccgaaccucaaccacacgcggugauccgaaccucuacgacacacggugauccgaaccucuacgacacgcggugauccgaaccucuacgacacgcggugauccaaaccucuaugacacgcggugauccgaaccucuacgacacgcggugauccgaagcucuacgacacgcggugauccgaaccucuacgacacgcggugaucugaaccucuaugacacgcggugaucugaaccucuacgacacgcggugauccaaaccucuacgacauguggugauccaaaccucuacgacacacggugauccaaaccucuacaacacacuguuuggcagaagaggaaacugagggccaggugcaguggcuuacgccuauaaucucagcacuuugggagacugagaugggaggaucaguugaacccaggaguuugagaucagccugggcaacuaucgagaccccugucuguacaaaaauuaaaaaaaaaaaagaaaaaagaaaaacuuagccaggugggguggcacaagccuguagucccagcuacugggaugacugaggcaggaggaucacuugagcccaggagguggaggcugcagugagcugauuguaccacugcaucccagucugggcaacggaacaaggacccuagaucuaaaaaaaggaaacugaggcaacagacaugagaaaguggcucaugcccccaagggaggcagggagauaacccaggagcacugccacccucugccucccagcaucccagccugccuugcacacugucucccaugucuacaagaacaaugggagguggccccaggaggggacugcaggcuuuuccagcccuaagucacucugggauccccagaacaugccuucuucucucugggccucaggcagaaaaauaacuccaccaggaugcugggcagagguguagggggcuugcaugagggacuagacagccaucucugccuggaagcuggggucaggggacgagaugucacaccuggagaaaacugccagcauuuuccacucccuaucugccagagcccacacaggaagaaucccagccucacauccgaggacucagaggugcugggagggucaagguggccaggcucccacccuccugcggccugcugaggccgagggacacuucuggagugauaucaagcuugcagggaccucccccgccacacacacuuuuuuaauuacuaauuuuacauuucacaagcaacacgugaauauuuacaaaaauaaaagcauuacagauaaggcucuguccaccgcucuaagcuccucuccagaguccccaccgugaccaguuucuuuccagacauuuuucaucuuccaugaauggaaaacgcaaaguaggcuucucauggaacucucuugaacagccucaguccgggugugucauucuguaacuugcuuucuuaguagcacaccuuggagcucaaacucaguuucccuaucugcaaaauggggacaguaauccagccccacagaaaugacggaguucccauaaaacccuggggauccucccugcuacggaagggauucaacaagcauggcgagaaugacgcugcucucccucuuuccugcuggccacuggaggcacaguucacuccgcaguccucuccacccacauuucaguccuucucaagcuuccccuuuaguucccuuacaugcaacacucccgggaacgucccuguucgcacccccuaguggcugcagcuucuccagggcugacccgaggaaaggacggcucccuuggaggacugugcacuccaggguucggcugaucaacccuaacacggucacggccauucuaccucacgugacuuggugggaggcugccagucaggcaggguggccaggcccucuuuuacaaguaagagaacugcaacugcggagaggcgaggaagcuuguuggaggccacacgccgaacaaggggugggauuuccuggaccugggacccuuuagaaaagauggaggcuaggcaugguggcuacgccuguaaucccagcgcuuugggaagccgaggcgggcggaucaccugagugaggucaggaguuugaaaccagccugaccaauauggugaaaccccgucucuacuaaaaguacaaaaauuagccgggcgugguggcgggcgccuaugaucccaacuacuugggaggcugaggcaggagaaucgcuugaacccgggaggcggagguugcagugagccaagaucacaccacugcacuccagccuaggugacagagcaagauuccaucucaaaaaaaaaaaaaaaaaaaaaugugggaggggguaagggggaggagaagguuugccuaaggccuugggucuagaaugacaugugcguuuucuaguuuggcagagggagaagaggcaagauguaggugggagguaaaacagaacucacugcgcuucuuggggccugaacaagugauugcuggggacucgaaaagugggaaaagccugucgaccacuguagggcaugaggggacagagcccgaggccucgcaugggccugauuucugauuuucagaaugggaacgcaauggauucugguacuuguaggcccccaagcucccuacgcaucccuguuggaagcucaaacagguaucugggagccucagaaagaaagcagggggccugggagccacaggggcucagccagucaccaagaaccagggagccccaccuucuccuccaaugaggccccagaccaggaauccaugggacacuugguggcaggaauaagaccauuuggucucuggccaggcccccacugcugccucccagggcccuuggcaacaaaggggaaaacaugggcugggggcgaguuuagcuggagcuggggcugcaaacucagaugcccauggggauggggcaagucacgugaacgaggcaagugggauggguggggccuggagcggauggggaggagaugccuuguggaaagcaccugacugcuacccugaggagggcaggcccaguacggccagagcuuccaauuccagaccgaguccucagcccuaacaggccuuggaggaaauguuguccuugcuccugaggccacuggaaauggcagggagauguggaugagcugggggacaagugagcagaagaaucuuaacaggcaugaagccugccggguggacguggggaccacagacugauccgacaacagccugagugcaaaggaucuggguguuuuagucagccacaagcuugaagggagccaauagggcuggugcaaaaccucaggccuuguuacuuucgucacaggagaauaaaguccccuguuucugagucacaccauguacaaagaguguuuacaguuacuccugcggccuggcggaagagggcgggguugacagccagccuggguucgaggacggguccugucacuugcagucugguggccucacucaagucacacuccuuucccccaccccgagcugcgguguccccaucacacugucuuuguggguugaggugcuggccuaagguguggacacuuuccagucacgugggucaccaccaucaugaccaucgcuuuuaucucugcucaugcccaaaggaagcagaacuaucauccccaugcuggagaccgggguguggaggccaggaugcugaagucgugugaggaacacagagccugagcagcaaggcaggauucacacccggaucccccgacuccaagcccagggcucuuuuccugacacuuucccuuuuguucccauuguuuagacggggccaccgaggcuucaccaugagaccgacgcugagcgccuguuccgggacccaggcugugggucagguaaucugaccccggaacccacgcucccaccacaugcucccuugcccuccguagggcagacuucccggaggaggggaguccaacagcacuucggaaauagcuuccuuguuacuguggaacgcuggagccacugccagggaggggagaggggagccaaggcggccccacguggccagggcgccagagagucucagagccacagggccagggcucucacacugggaauaggacagaaguuccagugccugaggaaagaagauggucuucagaaaaagccucuuucauucgguuacccagagcaagagcugcguggggagcucuggcucuaacccacuccgucaccuugggcccaguccugcuacgccucaguuuccccucugcacagucugcucacugaggccccuuccuuuugaaagucccugauuuaagguagcaaagaucagccgcuggucagaggggccccagaaagaaaagaaggcagggcugcuggccccagggcccacccacuaccacuucuuccugcugcugcuguucccaguauuucuugaauauucucugccccccacucuucagagccucagcucaggacagccucugccagcaaugcuuucuguccugugaagcccaguccaggagccccuccuccaggaagccccccuucucccacaguagauccccaucacaccucugcaggcuagggcuguccuuuaaagcagucgccagcaggaguggaaaucaucaaaacggcagcagaugcuugcugggugcuuccuccacggcagcgucuaagcagcugacaagcaccaucuuguuucgccuggcagcauccccuugaguaaugucugccaccauccuaucauaugggugaaaaaacugaggcucuggacagccagugagcucaaggucaagcagaagacacacagccaccugcucucccuagagccugugaaaacacaucuauuguggcggaagagggcgggguucacagccagccuggguucgauacaucaauagauguaucgggacuccacaauagauguuagggccccguccagccccaggcccagagcugcuaucugcaggcccaggaggauaggacuugggagaggaagaugagaaggucucaguggacuccaccaggggcccuucccugcucugaagcucaggguugagagugcaauuuccaaucauacccugcucuagaccaccaagucacucucugccucugggccacaguuuccacaucuguaaagugguuaucauacugucuaaccccugagggugccgaugagcuggaggacaggccacaugcuuuuaaaagcagaggacugagauggcuggggaaagccccgcguuggcccucagggccuguccuggcugcugucagccuccagcugcugggcucagaucagacagcuccuccagcauggccuggauuagugucuaugacccucacuuaugggagggcagaucccagccugccccucccaagggcccaguggccccaagcucauaccaggcagcucucacccaccaguggucacugucuugggcaagccacucuugccuucugggccucagcugucuuaucugcaaaauggggaucacaccucuaacccccgagggucaggaaagguuucaagaauuacacagcccaccaggccuuggccuuugaggaagguguucuggguucccauucugacuuggccaucugcuccuaggcaaacagcuccucucugaugcgucugugcagugggggugacccaccucacaggcauaugauaaaggccaaagugggagcaggaaugcugggccccagccagucuggggacucaccagggucacgcagugugggagcuagaggaccagggcuggauucuggguuggcagcuccuuuaccacuguccccagggaauccuuccccaccaccagccuggccagccugggguccuacccccgccagguaccugaugcuucugggggaaccaagagaccaucaggguuacccccuugccuccaugcaggcccaacacaagccccugucauaggaguggcaaccauuuuagcaggcauccaugaugugccgggcacugugcaaggggggccaugcaugucgucuccaagggucauaucccucugacaggcugugacuaucacccccguuuuacagauggaaaaguggaggcacacggucaaggucacacgguguguggcaccccugagauucaaaccuggaaaggucacacauggagcucagcugcuaaggucaucgcuucccaagaccuccaugagagaagagcugggucaccuggccguaagguccagcuggcaagaggccagcucaguguucagccucuugggaaaagcagagucgggcagggccacaggaacagcaucgucugcuggggacagugugggcuccaaugaccaggcccgucacccaucugaagccacucggcagccuucuuggccgccuggugcggcugugacccagacacagcagccacugucuacccagcagcaggguggggcgccgggcccgaggccggcucugcggccugucaggagauuuacacccgacucuuaacagccucgcggaaucgcaggcgggugccgggccugggguggucugcugugaaucggcccccugugagcagaugaaagccgggucgguggcugggcagggaaacgggcuggccgggggccagcgggcagggaggcgagcgguucccucccagggcugcaaguggggcuuccagaggccugggguugauuaggagaacccaggaggucugugguuaaccccuucccuccugcugggcagacuccgcuagcccugccccuagcgcaggagacacuccuggggguuguggggaucuugggagccagggaccuggagcagcugccucuccucagcccaggaagaaacuacagaaacucuaaggccuucaaaggcccaacugcgggcucagggucacuucuccugcccacgccaaacccucggcagccacacucugcuggcugcucacuucaggccccugcucaaaggucaccucuucaggaggccuccccgccccaucccuuguuccaucccuugcacgcuccacuccuucucccagcuuuguuuuucuucauaggacuuccuacuacccgaaaugacauuaaugaaucauuugcuuauucaucaacgauuuauggagcagcugugaagggcuccugcccacauucucagggucuagcuauaccagggccuggcaaaccagagcaaagaacucugcccuuguagagcauaaacaacagggggccgggugcgguggcucacgccuguagucccagcacuuugggaggcugaggugggcggaucacuugaggucgggaguucaagacuagccuggccaacauggugaaacccugucucuauuaaaaauacaaaaauuagcugggugugguggcgugugccuguaaucccagcuccuagggaggcugaggcaagagaaucuccugaaccugggaggcggagguugcugugagccgagaucuugccacugcacuccagccugggcaacagagcaagacuccaucucaaaaaacaaaacaaaacaaaaugggagaaaugaauaacaaaugaaacaaacuaucggacuagauagcaccuuagaaggugguagugguaagugcucgggguaaccuuaaagccaggaaggaaaagggggagaggugaggaaggcugugugugugccacuugaaacaggcgggcugcugagaagugcagaggcuuuagggugugaaggagugugccaugcaucuggggguguccggggaggaguguuccagauagaaaaaagagcagugcaaaggcccccgaggcaggagugucccuggcaaguucaaagaccagccaggauaccaggguggccagagcaggaugugggagggagggcaggggguaacgggcacaggcuaggggggcgugagggccuuucccccaccgugguccaugccagacuugccaggugucaccgccccuccugcugggauccuggaccuggcucagcaaccugcuucuuaaccagcccccagugacucugagggacaccagcacugagaaccucagaaaccgaggccacacaggcaggaagccaccaagccagccuucaaacccagcuggccaccuggcugcaggccgggcacgcucugcagggcaccagaggggaacgacccggccacagaacccacagccggccucagggaucuacagauucccaguccuuggcucccaggaccagccccuacucccacuucaccccacagcgggcucagauuucagagggucggagguggcaaaacaggaaaaaagccgggaaaggaaguccaggagcacaaaaggccuguaacaaccugugaagguugugggggcacuuccuggggccaggccccgguaaacucagucaaccuucacagcgacuccccuaggcagacaccaauaccauccauuugacagcugagcacacugaggugaaaaggcccuuccaaguggcccucacuucccgcagcccccgggucggagcccccagggugugcugacagucaccuugggcaaaagguuuugcgcccuggccucuauccucuccugggguugcccaagagaucaguuacuggggacuuugcacagggccugacgcaagggaggggguugcucagugaccaggagccgcugagcuggucccuucacucuuacagauggggacgcugaggacccgaaaggccaaggauuuguccagggccaaagacaaaggaguggggcugcaacccaggguauggggggggaccugaucucagggccaggauaugccagggacaggaacaggcagguccuaaggaugggggaccuaguagacugccccccgacuccaucucugcucuguucuguaaauaaaaccacugauccagccgcugccggggcccagagagggaggucaccugucucagguggugcagcaagccuggcuucugacgccgugggucuccaggcccagccucugucccucccucuuguugccucguccugagccacgcauuuaccuuccagcucaccccagaaggggccaucucaggucugggagacccaggcagggaagagcaggcaggggauucugcuggaaucucccacaggcagggcugagucuccaugcucauccaggggucccagcagggcagagugggcggcucuggggugggcugggcugagcauggagggcucucagaggggccaaccuugcccggucccuuggaucuucccaccaagcgucaagaccccgucccgugccucccucuuucuggaguggcuccccucuuucuggaguggcuucugagugccgcauccccacccagagcccaacugaggcuccuguccaugcugacccugccccuggagacauagggcagggcugccaccuccuucaauggagacuugauaccugcaccucuauuaccaaggcagccacccagcugcugcccaugagagagcucaccguugacuaauggugguggugggagugcaggaagggggcuggguacugaggacgacaaaacgcugcggacccagugacucaugggaccccucugugcuacggccacgugcuguccacaugucgccccugaucuccagguccgcaggguggguggcaucaucacacuucauggaggagggagcugaggcccagagaggucagugacuugcccuaggucacacugcagauaacagcccuggcuaaagugacggaucccuugcuaacccccaccgcuaagugcuuucuauagauuaagccacuguuuccucgcaauagcaucaugagguagcugcuugugcgaauaucauuuuucaguucaggaaacugaggcacggagaugacuagcccaaggacccacagccaggaaggcuggcuuggaaacugcucucuacaccaugguggucuauggcucaugagggcuucccagccaucaccaccuugagacuccuggagucacugauccaguucucagaugacaaaacugaggccacaaagaagacaugacuugccuagggucaugaagcccaaggccaagggcaugggcuggucuaugucugaucucagcaggagggaaccagcaggaguguggccagggcaagugcuggcugggagcugacggugcaggccugaggaugcgugccggggcucagggcuggcagaggugacccugagagcccuggagggaaacucuuccagggcugcuggacucagcuccaagccuuucccaaguggccagaugcugggaugggcccaggaauuggaugauggggugucaggcccagcugacucccaagaagggaggggccagcccagggcuaggccuccugccccaggccuccugccccaggccugcucagccuagaaucuugccucugggaagacugaagccuggggcgccuuccugcuccuugcacagcauuagguccuauucagguacccaacucccucaggccuggauucucuccucacuggaacuugggugaccccucuggcucugcugucaucaagaucccauucaauagugacugcuaaaaggucuucuaaacuacaaagggucacauuucugagaaagagaggggugggccaaccuucagugcaccaagcugaaaaugccuuggggaggugggauggagcucaggaagcuggcuggcucuauuucauucauucauucauucauucagucagucagucagucagucauucauucauucuguggacacagagccucagccuacccucccacuuccccagccuuaaucugaccuucagcaagcagagagaauuaaacacaaacucgcuuugauggaccagaacucccugcucauagggucugggugcccggacucugggugaccugagcaagucacaugcuaagauucaaagacucaguuuccaaggaagaggccuggccucacagccagaccagccccugacuuuugaucacuccugcccuccaugcaucccucagccacccgcagagaagcugggggcagaguaaagcaagccuggcucaaccuccacccagaaacacacaagcacccgacaaaugccauaucugaaagcuuucuccauccuuuuccuuuccuugacucccucaguagucuccauggacagucaucuccacucccagccuccucgcuggccucccacggucucaggcuaagcccagaggguuuagggguuugccagcaggcacgcagugugugggggcacagagccaaggacugcaaccccccgaggagggcuccaucugucugaccuagcugcuguccuucccgcacuggacccuccucccccgcgcaggggcucagggggcucgguggcacuuacgucugggcucccgggguccguccacggucaccuugauggcucggugguaggucgccacuugggugggguuggugaacacagugauggucagggugaaacucuucccuggggagaguggggaauagaggcaggugguuggcaccuggagcuuccacaauacccugcucucccaccuguaucuaccccuggaagccccuaacugucaagaaggggcacucuguccucuuugaacaugggcagaagauagggcucugggugaaguucaagcucuugggcuuggcauucaaggccccugggggucugacgccaacuuugucaaccccccgccccaugccgugaccacccuggcucauguuccccucuucuuggccuuucugcugucucuucuauucagagacccacacgauuuugugguggggagcaggauggguauauucuauuuucugaaaguaauuggugaucuuuguagaaaaauucaagaacauacaaaauauaaauaaagaagaaaagacaccccccccccacgguuccacuagcuggagauagacaccguuaccauuugguguuuucccuuucagcucuuuuuguauggguuuguauauuuacacagucgcagugguacuaaaauacagauuuucauacuguuuuuuuuuucauuuaaccucacaucagaagcacuuucccacgucauuaaaacuccauaaacuucguuuuuaauggcugcaaaauauuucaacucaaggaagccuccucaucuuuuauuuaucuaccuccuuacucucggguauuuacaucguugcuaauuucuuauugaugugugcagcuggagcugaaaaaggacugauuugggagcugcagacauuucuucuguagacacaacuguuauuuccagaauguucuauuuuuagauagacauuuggcuccaaagucuccauucaaaauuccugagaggggaaaaaacuuuuaaaauacuacuuuuuuuuuuuuuuaccauuuaaaauaaaaugaaagugaccuucuguuuauaaaaaucuuugucugcaucucugcuuauuuccuuagaagagauuccaagaagcggugagugauuucacggcagcagaggguugggacauauuacgggcgcggaucccucuuggagugagaugacucuccggagagauuuagucgucacccucgcgugugaggcugcgucacaccccagggaugugucuaucaagauggaagaucuuuuacacgcucuugauuuuguuugccuuuuuuucuauuacuagugagaaugaaacuuuuuauaugauuauuauccaucauaauccaacacaaauuacugcuucauguucuuuuacuuuccugugaagguuuuagugccuuuuaaaaauugcuauauauuaagcuuguuaauacuuuccaugcuguauuuguggccaucaguuuccccgggcacaggccugcacauuuugccuucacacgcugggugguuuuucauuuucacuucuauuucucguucuucuaucguuuuauguucagacggguuucuccguguagaaagcaguuuaugaagauuuacuuucgacagucuucucucuacuuucuacagugaauucucugaugugucugggaguuugggggucuggguaagaguccuccucucacccuauucucuauuacgauccacagccucaugcuuuaugagauugguggccgggagcgggggagauuugcggaucccccaagccagacuuuaucccccuaucccugccucuggaucccacguacaggccugggaacucccuguggguaggggccaauggucucgcacucucaccuguaccccagggcuggcacaggauggucaaggagagaggcugcccaagcgcaucccucuggugucccccugacacgccuccaaagugagcagguagguuucaacagccccacguugcaggugggagaugaagcucaggguggagaccaguaucucacaguucucuuugcauggccggguacuuguuagucaacugaucaagugaaaauucuagccccagaggcaggagaauccggaacaaaauuaaaccagccaggcugccaggagccaugccacaggacccaaggcccucugagacaccagggggaauuuaaagcucaagacccacugagugucacuccagcugggaaaugaggggcuucucuggaagccuuuuccuaagccagucggcugaggcagggauagaaauucugacugcacuugcccccggagccccaggucagaacagaccuggucucccacucucaggucacaggggccacuuuguaugauuucuggaagcagaagugcagauggucuagggaagugccaggcagaugccucgggcucccugcccgaccccuccuacugccuuuccucacucugaggucauuucucugcuggaccucuuucuccuccaaccagcccagcacucuccuggggucccugagccucugacccugccagcauuguccagcaccuucuugguuaugacggggaguuuaggcagacagcccagagcccuaggggccagacuggagacacggaggacuaaugggucccagugcccugccacagggccccgggcccacagcagcauuugaaagcuuacuaaaacccuccuucaggucgcccaccuucucagucaggccuucccuggucacuuuaucugaaguaggcauuuuuaauuuuaauuaauuuuuuugagacaaggucuugcucugucacccagguuggagugcaguggcaugaucauagcucacugcagccuggaccucccgggcucaagugauccuccugucucagccuccugaguagcugggacaacaggugagcgccaccaugcccggcuauuucuuuuuuucccuuccuucuuuuccuucccucccuuccuuccuuccuuuccuuucuuuucuuucuuuccuuucuuucuuuuuuuuuuuuuucaagcuuuuacuaugugcccaggcuggucuugaacuccugggcucaagugauccuccugccuuggccucccaaaguguugggauuacagucguaaaccacuacaccuggaaggcauuuuuaacuuggcuccguagaguugaaugagccugagaacuaggguaggaaaaaauuacaauuguauugucccuaaccucuaacugaaauuuagcaucacucucaaguacgagcguaggcaacaaaccacagagguauuaucagccguaccugugaccuugucaccaacagacgucacagauacuuacauaucacauuacaguugcugcagauugcucuaaauaucuuuuaugcucaucacaacuucaaaaccaugguugucauuaggcccaaugcuagaucuuauuuaauacauugaauaaagcagcacauuuaccacaauuuuuaaaguauuuugcuauguuuuaauagaaaugguuucuauuguaauacuuuguauuugauuuuauaccuuaaaaauaucauuguucugagaaaggugugcgggcuucaccagcuaucagaggggcccacagggcaaaaaaaaaaaaaaaaaaaaaaaaagcgcuaagcagcucaaccugaaguaucacaggcccuaccacucccuuucucuauucccugcaccugcuggaauuuucucacaaugcauaugcuuuuaauaauccaucuacucauuuugucuccuucuacuagauuauaaccuccccaggggcccaaguuuuugucuuguucaugcagugucuccagccccuaggacggcauccggcacagaguaggugcucaacaacauuuguuaaauaaauuaagggcagagauaauggcucccauuuugcacacagguacuaacgucccgcuccugagaagugagaagcccccacccauaccagguagcaaaccacaugccaccccugaggucaccagcacuccucggccgcuuccaccagcuuccacgccugucaccaccccucccagguacaaaggagaggaguguggggccuaagaggaggagugagagggaggggcaggaguccuggaccucgggagacagggagccuggggagcaggggugggagaaagcugucucccugagugccccucagcuaccccggcccugcccagcucucucucugccuggcaguggcaaacccauccaucccucucucucagccucuagauauaacucugugcaggagucccaggcaaaccugcaauccaucaggagcccaggaaguguaaacccaggcucucugagggcuggcccugguugcaggggagaagucuuggucugggaaauggguuuccuuuagggcuccagaaacuccuccaggacccaucaucaaccagccgggguggcagcagggccucaggcaaguccuugagcauucucugccuggguuccuauguguauaagguccccgccccacccacaggagcugcauggguggggggaggggacgugucucagucucaggggaccucgggguuuucucagcuucagccaagaagccauucaucucucccccaaccagcgguuccccucagccugcaccggcacacugcaccccgaaucucugucgacacacaguugcuuuuuaaccaguugaucacagcucgagagcucaugugcuuuucauuuucacuuaggccaguggccgccugcuagaggggcauuuuugggauuugugguggcguguggucaacauaguguugggguggcacugccagcguuagggguggggugcguguauguggugggggaugccagcacccaacgcugcccaggguggugaagauucaauucuuccugggagggaaaaacuugcuuauaaaaguucucuggcuggucgcaguggcucaugccuguaaucccaacacuuugagaggcugaggcaggaggaucgcuugaguccaggaguucaagaccagccugagcaacacagugaacaacacccccaucucuacaacaaauaauuuuaaaaaaucagcugagcaugguggcgcaugccuauagucccagcuauugaggugggaggacugcuugagaccaggagguugagacugcagugaucgcaccacugcacccuggccugggcgacagagcgagaccuugucccaaaaaaaaguaaaagaaaaaaaaauuaucugagucaugaaccuaacucaguuuuacauaaaacaaggguuuuuuuuguacuuuuaauaucuacugaauuuuccagaaggaaagacaguucuuuuuuuuuuuuuaauuuuguucagcgcuuugccaacagguguugacaacuucagaaagucaugguauuggcagcaaggccagguucagauugagcccugccacccugccuguucccucugcugugggcuucugcauggagggcauucguccaccucauggaguccuguggccccaacguuuacauauucaaaucaguguuuuauuauaaauuacuuucccuuuuuuucuccaucauagcuauggaauaacauaguuugcaacugcauguaaauagguagguuucauuauuuauacauuucaacguagaauaguaaggcuugauauaaaauauguauuguaagaaaggcuccucgugucuggcagggcagggaccucagcccuaaucacugcaggagacagcaaugaccugguuuuccucccuuccuuuucuugguucacaccuucagcccuguuguuaagagcucugugguguuacugggugcgugucuuucauggaaagccaucuuccuggaauucagacagaauguagaacuaaaaauugaggcaacaagcagagguuuccaucagacuucuuaguucuggcagaagucaagagacccaggcaaggguucugggucccaacccccagucuuaacucccaaagugucccaucuccuaaaguggcccagauugucacugucaaccacugacuguucucucaggugggaauuucccagucagcaggaugggcacugcagaugugugucugcaugccagcggacccggcacccuccuuccucccugccaaccgccuccaccucucccacucagcaguucacaccuucuggguuucccccacccccgcccaaaccacacaguaaucagagaaucaguggcugucaccgcucaaagggaccucaaaguccuccuccagucccaggcauuugaaguaacaaaaucucuaacauguauccagcucucaauaugcgccagcugauacacuugugucaauuucccuaaccuucccaaaaucucaugagguagguaccauuaucauccccaucucacagaugaggaaacugaggcacagagugguuaagucauuugcccaaugucauccagcaagucauuagcagagcugggacucaaacgcaggguggcugauacuagaaugcaggcucucaaagaccucgagccucugaaggcugaacgccuuagccacaguuccucagacaucggaacuccuccucagaucacuuccugccucccaggaccacugagacugguuauggaccucugagaggagauggaugagagaaugguuuauaaacucagccucuugcaucucccagagccacagucccagccucggccauuccugcuacaaggacaagcucccaaccaacgccuuggaaacccauuucccucccugcaggccuggggaggggggcucaaggucugugggcaugaaaaccccuaaaaaaaucauucucagugugcagaauggccagacaaggucucgguaacucagaaaaucgucgucucuucucuuucucucgcuucccaggagagagagugggaagggagaaucaaguuccugaugccuugcugggcucccagaucgacagcaccuucugcccgccucgcaacaggcagcagcuauagugcuccugacacauaccugggcuagcagaccuggccacugccccgcagucagcagagcucaucagccuugucugccaccgaccaaggaccagugacuguccucucaggguugggauuaagucgcaaaggguuugagagauuggggaugacaaaagggacuuggagacuaauuaggagcagcaaugaaagcuuaauucauaaaagcaaacauuuuccauccaucaaccugcaaccaguuaagggcaccguuugaaagaaaucuguguguggggaagggagccaacaggaacaggaaauguuugaaagaauguaaacuauuucaguuucauaaaaaguaacaaguaaacaguuauuacaugcaaauaauguccugguuuuaauuaaugcugaaaagucaaaauauggcugacauuuguauguauacaucgaacggcuggaaaggaaaaaauggugcccagaugccuguuucagagcggggcuggcagcucagagggaacuagaaccuugagaagguccuguuuauuggugaugaaaagcacgguucugcuucagccacuucagccugcuguggaguuggggagcagagggaacccagcuuacuucuuaacaaagcuagaggcgggccuggugcuugggaagggcgacucccacuucagccacuucucguaggcaggcuggucuuaaagggccaguggacccucaggccuccguuccacaggggcaggguuuccaggacuuucccauccaggaguuaagugaugauggguuucaggucccagaagccucccauucaacagccccccacccccgucccgccuuccuucugcugcucaaggucggucagacaggcaggguggcacacccgccuugacucuggggcaggagauggcagccuucgagcugugcuuuccaacauucagcugcguuagcuuccguucuagaccaccuagggcucaaaggcgcugggaaacugggucugggagaccacagcuggagagacagccucagagugugggggauauucugcccccuauggagagaguggcuggggugcuugggccccacagaucagggacuuguccugcaaccgccuugcugaaagaccuauaagcucccuuuuugagcuuguuaauccaccaucuccugccagcauuuuuugugagaccaggugugcuuaaccgggaaagaggggguggcaugaacgguuucaggaguugguaaacccuagaaacugggagaaaauugucuuuuucuggcaagagaccauaacuuuccucaccuccucaaagcgaucuguaauauccuacaggauuacaaauugcuguuuuuagacagagcugcaucuggagaccuguuuuucgggauucuaaggccccucuuucaaccuccuucccugcugccccugccauugccaaugcugaaauggcgaggccucccuuccacuuaccucgcccacugcggcccacgaagcgaaggucguugaaccuggccaccugguucuucaugacggccgaggcauugcgcagcucagcggaguaguucucgucauugccugccaucacagucaccaccguaccauccggcacgucccccaaugccaccaccugaagacacggggcggggggaugcagggggacagcuuagaaaggaagagggugaccagggaaaggaggggaggggcugggcugggcagcucccccaggucccaggcacacugaguauuucuccaaugcaggguggagaagaggcuuaaaaacaauaaagaccuucccccaaauaucacgaaaacaagaagauggaaucucgagcuuccacaccaaaauccuagaucaacugcuuacauaaacugugucccaagaaaucauccuuucaaugaaaucuaagccagagcugugaaucagcucagucacuaugauguggggugcaguuccccuguugucuucggcugcagcgaaagaggaaucaacaugcuccuagcaacgaagucuccaaaugagaaagaguaacaacaauaauaacaacagggcugcuacccccacucaauuuaugcaagagcuguuuagggcaugaaauuuggcccugaaauguggaccaggcccaguuuauuggccucugcagagccuaaauucguuaugcagagaaaaugcagaaugcaaaacucacugguguuuugaaaaaggccaccagaaaaccccuuuaaagugagaguggggcuuuugauaauggaaggaugcaccugccgggaauugcaggauggggguggcgaugucccccuaaacaccaucucccccaaaucccccacccccaggagcacggagaggcggaugccuuuugaaaaagaaucagacuuuaaacagagucacaacuauuuaaacguggccgccgcgugcagggacuggggauccauaugguaaaaauuucaaggagaaaauguuugggaucugauuaagaagaccagauuuccugucaacauccugucuucuuuuaauuucaaagacuccuuuuaagcuccaagugacaguaaaaccuccgaucugacgauuaaagucacacgggccucccgccccucccggcgagauuucccccacugguauuuuaagaugucacccgggagaccucaaagagccacucuuccuuuuuuucccauuuagagucgucuuaaugggagcagggacggccucagcuuccagccaccucgggcagcaccacccccagccgccggcccuuccugcccugcccuuuucucacggcagcugugagagguuuaggggaaaaccgaggcguuuucguuucaucucgcugcccccuuaaaaaaaugaaaaugaaacagucgccuacucccuggcauaaagaaaaagguccucuaaauggcugggggcugccaggguuaggggucccccaaucucaacucgccauucgggacgcauaauauccccgagcaaacgucuggagagcagugccccgaucccggccuagcgccguccgguaaaauuucggaagcccgagggugugagcaggaagcuuuugcgaagcggcgcgggaggaggggugcuggaggcggaggguaggcccuuucaccguucgcaccccacccgcgguguccuugccccugucccgggauccucuucuccguuacccgcagggcuguaucugagcgauccggguuaggggggcgcaaaaccccauccgcccauuuccgcaccaacgucucuacgcaaggcgccccaaaacccagguggagcggggcaaccccguuaaaagucauuccugcagggcgcauccaaaacggaacgccgaggucccggagccgagcgcgcagccagacugaaccgggugcccgggugucgccgcggcgucucgggcaccucccauccccacugcucccgaggcucuggcucccgcagcucagacgcccggagccccagggccggcgcccucccgccccgggucccgcacucaccuugaaggcgacgggcagcgucuuguugcagcgccagugcgagggcagcacggagcagaggaaguuggggcugucggugcgcacgagcucgccugcgugguccgccagcacguccaccaucgagcgcaccucgggccgggcgcgcccuccgggccccacggccgccugcgcgcucagcgcgccgcuguucucgcccaucuugccgccgccgccgccgcaggggaaggccggggagggaggugugaagcggcggcuggugcuugggucuacgggaauacgcauaacagcggccgucagggcgccgggcaggcggagacggcgcggcuucccccgggggcggccggcgcgggcgccuccucggccgccgcugccgcgagaagcgggaaagcagaagcggcggggcccgggccucagggcgcagggggcggcgcccggccacuacucgccagggcccgcccgcugcgaggccucgcuggcccgacggccgcccgcagccugcccggcuagucccgcauccucggcgcgcggccccgcgugcggccgccccucguggcugucccggcugccugggccgcggcggggcccgcgcggggcugugccgcugccgccgccucccgccccgaagcucgcccgcggccgccccgacuccgcggccgcagccccagaacaaauccuccagaaucaaguggcggggccgcggccgcccgcgcgggguuaguacccccggggcccgcggggcggggcuggcggagcgacgcgucgcacagccaaucggcggagcccccaucgcgggcaccucgguggcguucgcggggaggaacggggccugccggaggccgcccaacggggaggggcggaaggcgccaccccgcggaggaggccccagugccacagcccagggcccccgagagcucugggagcccggggcaaaugcuagaaauuugcuuagaacguccgggucccacggaaggcgcccuugccgcccucucucgggucguagcucccugacgcuggggcgcaaccccuucgcuccuccuccccgcuggccgcggccgggcuuccccagcucuugcugcuucgggccugugacuucugcaaccccgggcugggggccgcggggucucagggccggugacgccgcacugggagccgccccaaagagguuacucaccucccucgucccgcacauuauucugacccaagagccuccaccccacacgggauuuugcgcgucguccacgcccggccggcggccuuugcugcucccagcccugcgcggcuuuggucccagccucgguggccccugugccaaaccggggacaggcggaagggagucuccuagggacccuaaguagccuggggccaacaaccccuuuccucucugcucuccccucaaaacaaguuucaggaucuugcaggccucgcggcgucguucuucguuguggcggccuguggcucuuugaaaaacacgacgaggccugcaaaaugcguuuuucuuuuuuuccuuuacgcauguaaccacgguccugcaucgugaaacgguacgcgcgucgguggcaaaagaaaaacagcaguggcugcaaagcuaagggcccucgcuuucagaggagagaauuuucuuucuccaugcggguggaaaguggccucugcggguccaaccccacuucuucuugggcccgugcgcuccggcugcgccgcagggaccgcggacagcuucgccaaggcacugccugcccgcccggcuccggguccccgcucccacucccagccgcguggcccaaccucuccugggcuucacugcaaaucaccccuuccucucccgccuccuaagucugucgagcagaccuaggggccggcuacaguugggagggcaacgggaaagaucaagccacaaucauuccgaauuaucgccccagacaccucccuagacucuggggaacgaacgcgugcugagccuccccgccgcuuuggagacggggcuagauuuucguugccuccggcucucgacaggugcaaaacaaugaauuccaagccucggaagcaaagaagcuuaggauccgacgguggccgcaagaucucaucauggaucugaccccugcucagcgcgcgccauuucgucguugccaaacgaaaucaagccccgcgugcgcuccaggggcgaaggacucuggacucaccccgaccaccgggagagcuggccccuacccaccucgggaccucacagcacgcccucaggccgugucgaaaggaaggacggcaaaggucccuuacugaaccuuuuaagagagccugcgccuggcaguugucgauugcggacccaggcccgcgcgcccucggacgcgcuggcacgagcagcagaacuagaggaaagcgagugauccagccugggcgcucccaccuccgggaacgucuccgagaaggcgcagcgcgucguggccagguagggcccuggccgggggcgggcaacacgugcugcccucgagcagguugcgggaccaugacccgcuguuucagguggugguaaauuccauuugucgaaugguuucgguuugcaccgugcccuuugcuuguuccuccgccugauuucucccucuccgcuuacgauggguucacagacaaguuuccagagaaugagggacucuugugggcccuggcaccuggcgcagggcccggcacggcuccggcucuccguagggcgcuggcuccccgugggcaccagauccaagggaccagggcggcggggggagggggggcgggugcaggcccuuggguccccagaccaaggucgcggggccgccuggcaggcacaguggcgggagccgccgcuaguuggcgcccgcgcccugccagccgcggaggugcgggcccggccgggcuacagaugcgcgccagcugcggccccgggugcaggcgcggcgaccgcccccgaggagcugcccuuuccuugccauccaugcggccaggucucagacaaaccgauggcuuugugucaaaccaaggccgccuuccucaccucugauaagauggacgccuucugucuucgcguuuucaggcacccggggaagacccacagaacaggcuagcuuguucccaauuuccaccugcuuccuccccaucccggaccgacaaaaauugucgucuguuugaugggagggagaacuccgacucccccaccuggggcaugcagacacccucgcccuuccccaguuggcauggaccgucgucuuuucucccucuuccaucagaucgauggacaaacaggccaguuucuccccaguggcccccaccuaagagcacccuaaguuguccacagcagggcuaggaagcagaaggucaggacacuccccuacccuaccuugacuuagagcuggguaaacccagaacccauccccgggcaaauagagccagcuccuuugccccaggaaggggauucgucucccucuggcauuuaggagugcucucuaagugcguucuuggcagugagggugccgccuucccagggcaggugugauucauguggacucuguggcgccugggcagggauccccagguauaccagacaaggggcaggugugcccugggaaaccgccuaagagguccaugggcuauggaaggagcugggguccacagucccucugccugagcgugucuuuuucccucacccacagcgcucuagggaaaguugccuaaaccucucugagccucauuucuuucauuuguaaaguggggcacucauaguggcccuucauagaauuguguguaaagugcuuagcacaggccuggcacauggagggugcuccagccuccgggagccaucacugucaugaaaaaauaagaccucucaauccuugcugggggccuuugacccaccccuccucucucugggccucacacuuccaucugugaaauguccaguucucauauucaaagcuuacuaggacuccaagccaguccaugcuguccugaucccucaauucgcccacaggcugccugggggagguaaggacuggcugugaccuaccuccacguggagucagcucauagcgggguuuccagcaaccaucacagggcggccagagcugggucucgaugauugccugucugaccauuccucucagaaccucacuuucgcccccagccggccgcccuccugugggcagacccuuuccugaguagcaacugggccucagcggacacugccagggaccccguuuccuucccaggaggccucuguuccccauaucccgaaucacacaggagccuaguccagcgaagagagcagaggacucucuucuagaacugaaaauuucucccagccuggcccuaaauccccuguccagagggacccguggugaaaccuaucuccugcccagugcccuagaacucaaaggggacauucaugccccucacugagccucaauuuccucuucugucaauggaggucauucuaaccacuccauuucacgggagggggauuaaggauucccucuaggaggggaggggcaucauugugauugaugaucgauuguuugaagaaacagaaagaaaaugcugcugaguaaacuaggacucaucugcauccugauuucagauaaugaucucugaauauauaagcgagaaauguuaaugaaaaauggcaauauaucuggguugagggguugucuccuguaggccggggguccagcuccagagaguccagcucuggggucaucuauccugggcagccucucuggaaggauucagaaugugugggagcacaaaugugcuucucaaauuacagagaucuuucuuccuuuuuggaaaguuccagacuuggaggggagggagaaggagcaagggagagcaggguggugaggguguuaggacccagaugcugccugugcggucugagacuuuugccugguguccacgcuccccugagccuugguccccgaggguaaaaugggaagaacaguaacagcugggggugcugaggcuuuaccuugugccaggcgccgcacaugggcauugcucaugguauucaauccccacggcgucauaugugguagguguuaugcccauguaagcaaagaggaacguuguccgaggucagccaggcuagagagggccagacccggguuaaaagucugcucugguucaaaauguggggcaugaacgcaucaccuggccaagcaugucagcacucuccuccuaguggcugaguaaugggaagagcuagcaucuagauacagaggaaagagcuauugugauggggagagggagcuggguuugguaaauccugcuaagcagcccugggcuuggaaaucaguaaacucuucaaaucugcagggagucaggaaggacuugccagggucauucgggaggguccugugauagucaaggugcacccaccaccugcucuccuuuggccucagaaccagucugcgaggaggcaggacuggcaguaguccccaguuuacagaugggaacacugaggcccagaaaggggaaagggcgugaucaggaucuggaaugagcuccagcaaggccaggagcaagcaccucgaggcaaaacgcaguuggacaggaccuuugccuugcaggagacugcagcccaguccugggccucauacacuagcacccugaugccacauucagugccucucgcccaggggaagugcuaaucagacguguuucccucugggccucaguguuugcaucugaaugcgggggugcacuuucaaggccccucuacaugccaugcggguuccauaggaccccaggguuugguugugacccgaggccccuccuccccacccaccuccucuccaccucccgcggggcgccagcucccuugcguccacaugaccucggauccuuccacgcccauccccacccuguucugcagguggguggucagagggugcucugcuuugaggaugggagagagaaagggaggcaaggacggagaaaagagacuucuuuugcgggagcgcagagcagaaaaaccgucuccaucgguuaccagggaagggguuucugguuucagaucccaucacuugguggggccuuccuaccacccucccugcuacucgcucuugucaucuguaaaucagggaaauacuucuggaagacaguuaucuggucugugacuuugaucauuggucuaugacuaauaauugcccuaauuuuuugaacaccugccgcaugcugggaguuuuccgccaauugucgcucacccucaggugccucugaagggcagagauuuuauucuuuccauuucacagauggggaaacccaagcuccgaaaguaaagagcuuuuccucugugggccucagaaucugagaaguucaaacagguucucaggagcccuuccagcaccccacuccucgaucagggaggggcugucugcacucugaccgcugcucucagcgcagagcucuccauccaaagcagcaggugcgugcagagcuaccugccagcagagccaucaaacacggacucuucuacugggagccauggaguggugagagagaccugggcagcuuggagccaagggggcuucugggaaacaugugcccuucccccagggugggguucagcucuggcgggcagggagagaaagggcucuucugaguggcuguugcuuuacacacauuuuugcuucacaguauucuuagggaguagcgacaguuaucacucccauuuuacaggaaagaaaacugaggcuuagagagcucaaguaacuuguccaaguuggcaccacugggaaaccacagggguaggauuccaacgaggcagccuggccccagagcccauguugcugcccacuacacucuacucuuguggacuaaaaccagaugcucagaguuacagucauggaauagaauuagaauccuggcagaagaacugugggcaggauucggaauuuuacaaugucagacucgaaagggcucugagauaucaaauccaaauccccauuucucaaaugacagaacugaggccuaggaaggaagagucucacucaaggucacagccagugccagggacagagucugcacccccugccucuccagcuaccucccgcugacuccgcaccuuccucucucgcaggcccuccucuccccacugcccacccagcagcuucugggcccagccaggcccauuagggauuuuccaccuccccaaaaagguccugaugacugucaguccuugugaagccuuaauuaaucucagaggccgauggcucggaggagacugggggcuuuggccuuacgcagaugaagauugcggcucuauuucaugugguggugaaagaacgccucagacauuccugccagcaauaaaagccacauggcuuuccagcaucgcccuuggaaaagaaaaaaaagugcagcccuuugcggaaauaaaucaacuaugugcuguacgcauggcaugagauacaaaugggcauacggaggugggcaacagucggucuuuuaugccgccucugauguccacugacaguggcagggccagcggucauggucccagcugcaauccuggggagagggagugacccccaguguggugggggaagccucagcuucuccaccugaacuggauuugagccacccuagauaucccagaggcagggccggcuuucuggccugugacccaugcagucgcacagggcccuggucucagaaggguccugagcuuguuuuaaugcccugccaccacugccuugaacuucugaauacuugcucaacaaagguccugcguuuucauuuuguacugggccccccaaauuauauagccaguccugaccacaaauccaccccucaucaccaauugucacgucucuccuggccccugccauguacccaaucccggggaguaggguuucuugagugccuacuagccaguuugcuuauaucaccugagaugaacuucagaaugacuuugugaauugggcagauguggaaaauugaggcucagagaggcuuccauauggcaaggaagccuagacuugaacucaggucucccugacuccaaagugagugcucuuagcagcucuacauucugcauuauuucaucuucaccaugcccagggggauggggauacacacaguuaggcugcucuauucccagauaacagaaggcauaacugaggccagagaagugaagguucucaagucagugucaaaccgagggccugggcaacaguggaccugggccuggauccauagggcuggggauggagucucaguuuuauaguuguuugugccacuuguaaauuuauuagcucuuuccaugcaggucacugccuugagucuggucuggaauguggcuggagcccuacccugucccccucccccacagcucuccauucuaaacaucuggaaguccuuccuugugucuucuuccacucuuucacgcugcaguuuuccucugccacccucacugguugggaagcaguuggaucuggcaccuugauaaacucaaaagaguccaaauucuugaugaaaguuggggcugaacagagcccauagauugccauguccuauaaccaggccugggccuaaggcucauagagccaacugcuagauccagggcagccauuuccuuguuccuugcuggguaaccuugagcaagucccuucccucucuggcccucagacuccccuucagggagauaaaugcauuggaccacaccugagccccaggaggccucucugucuucaacauucuagaauuccauauuaaucuacaacaggucuguucauuuccgcaucuaauagcuggggaaaccgaggcccaggaaggaucagagauuugcccaccgucacagaaggugcuuauugacaaguggacuugacucugaggcuccugucagcuggcccgguugccucugcacaaacuuucggaggaucuggccucagcaucagcucagcuugcccuugucccgccgccuuuagcccagguggucugucaggcacccucaguguccaggccuggaaaucacagcuaagaguccuuggcaggcaauaaaguuccucuucuauggcuugaaugucucccaaaagucauacauuaaaacuucacccccauugugaugguauuaagaggcaguggggggccuuucgggaagugauuaaguggugaaggcucugcccucaugaauggauuaggcccucuuugcccuucugacuucaggacacaauguucuguguccuccggaggacacagccagaagacacugccuuggaaacagggaguccaggaccucaccagaugcggaaccugccagagccuugaucuuggacuucccagucuccagaaccauguguaguaaguuucuauuucucuauuuauaaauuaucccgucucagguauuuuguuacagcgacacagagugaacuaagacacucucuuuagacaaaagugggccaggggauggcagcaacccuuuucuccccaaucgcauuugggcugugucaguguuuccguaauaaaggccccuuuuccagggguuauaauuuggcuggaaaaugaggaggaaagaccagacuccaggacuggaggggcacaugaaguaggaggcuaggaugggaaaagucuccacuggacccugggcacgcagagugcacacacacacgcacacacaucuauacccuacaugugugcacucacacacagcacccacgcucaugggcacagucucucacacauucacuggcagcucacacccacauggacaagcccucauggaggacagcauuguuacagugcagccacaggugcaaacaguuaagugcaggugugugcaaagaugcuccuaggagaugccucugucugcaucaucaugcauggaccuauugguauagaugcgcagauagaugcacagauaggccccauuauaugagugguguggacacacacaugggcagaaacccacaucacagcuguguaaacagcagaccauuguguggacaaaucuuuacacacagaggcaggcauggaaucagggcucagagcuuuggauuuguucuacagagcagcucugggaggagucgaacccuggcucuggaaguuucugcuucuccucaauucagaggcauggacuuucugggugguuugccccccuggggcuuccaaaccauuccccagcaucugaguuuaacccgcucccucauuguucgauggggacaaggagagccugucuuccugguccagagaaaggcagugggaggggagaagugggaggguugcagcuagggugccccacggcagcauggguggaagggcagggcacuagccuaggggcccagagaccugaguuuggguuuagguugagaugcccuaggccaacacauggccucucugggcuucauccugagcccccucuguuagggccaugugacacccccaggggccucagcauggggaagagcacugaaaccaugucacaugaugaacuauuaaagcaacuggagacuuugcccuggaggagagcaggcuugggggguaagagcuccucuggcagaucuaugaagagcucccagguggcagggaccauauggaugcugggggcuccauaccaggaauagaaauauugagagcuggcuuggaauagggacacguccccucagagguagagaucaaguugagaccaggauauugugcagggaguucgaguguuagauggggcaggggccggaccagauacuagugucucaaacgcucagcucauagcaaacacguauugaacaaaugagagagcgacugcagagcuccauuucugagccaaucauccgugauucagagcauaccagcucuggguucccaccuugccaucugcaugaccuuggcccucuccaaaccucaguuuccucaucuaugaaauggggagaacaaauuauuuccaagagcuccagcaagucacauccccuauuguuggucuuucaggucaucccagaauuucugcucuuauaaauagaaaaugacauugaaggugaaaagcagacagacaagcaagagaauaguuaauacaaaaaucauagcuaggcgugguaacuugugucuguaaucucagcuacuuggaagggugagguggggggaucuacuugaggccuagaguucaagacuagccugggcaacaaagugagacucuguaucuaccaaaaaaaaaaaaaaaaaucaggagagugguccccaccacuugccaccugugaugaguagggagagggaugcagucagggaagggacacuggugggagcccuaaggucccauuagugcuuuguuuuuuaaagccaggugguagguagauagaugucugcuuuauucuucuucuuuaaacaauacuuauauuuuauacauucuucuguacauguauuuuacauguuuaaaaauauuuuaaaggaaagcaaaagauaaaauauagaaaaaguuccccugccccaaaccucugaaaaaauggacaauaugcucaaaugugcauaauaucguacaauuauucaugaugcagcaaagcugcacuguuucauccggaugguccuguguaccaucacacucucaguugaaucucugcaggcccuugcagcuguccucaucauggcaacccccaccuagguaagcacuucuagguaacagccccugcugagcacgcuccccaagcacuccucauggccgaccaguagcccuucagguaugugucagugggcccacuuuacaggcaaggaagucccuugcaccuacauaggaaggggcagagcugggauuugaaccagcucugucaaugccaaaguugugcagcaaccucacccgaggagccaggccccuugauuauaguaacuagcguuauguacacucacacaugcuguugaauccccggagccacuuuuguauuagguacauuuaucaucauccccauuguaacaguaggacaacggaggcauagcaaggucaggaacguguucaaguucacacccuaggugaguaucagagcugagccuugaaccucagcagccugaucccagauuguguuuccuggccuggcuguguggggagcucagacuucauggaaacaaaagacagaacgguggcuccaggguccacagcggaucccaagggaccagaggccagcagggggguuggcugggguuggaggaugcugccuaggagaucugcucccagagugaugcuagcccugugugaugaccugaguccccgccuccuuacagggucauggcugcuggggaggugcugaggcuguggguacagccaaacggagcuagagcaggcuuuggacucccugccuggcaaguccaggugacaggcucagacacugggcacucugucauuugcuguuggcauaaguuuccacuggcaggaaugugacauuuaucaccugagugggcuuccagaagcccacugaauguccucagaccugggguggggggcccucucacugccucaccucugagccuuaaucaaauccaggguggcuggaugaucugaaggcccuuuuagcucacggaggccugggcuugccccugcccccauccguguccucaggggaaaagguucccaguccugcccuuagcagcucugagcuuagaugagggggggagaugagauggaaaggaaaaggagaaguaagaaacagacagaggaaaaggaguuggcacuagauugaagcagucaacacacacuuauuaggcaccuagggcuauuuuaggugcuggggauacaagcaauggaccagaaagccauggagcuccuugggggcuuugauuccagcagggcagacagaagacagacaaggaggcaaauaaauaagcacgccaauauuugauagugucuugggacacucaagaaaacagauggggguaaagucagagagagugacuggguggauggggagagaggggcucuuggcaauacuuuagacaggguggucagggaaggucugucggagcaggugacaugcgagcugagaccagaggguugagagggacccaggaagggagaagggggcugguaggagggcccacugcacaguggaacuggcuuuacccaccugccuucuccccacuccucugcacugcuaguauccccaguuccuaaaacucuuacugcccuuucucucuguugcuucucccacaacagcccugagagccagauggggugagccuaaguagccugaccugcagugcaggaaacugaggcuagaguggggagggucagcaucagcggugcccuaaugccaggaccugacccgggcucccgccucccagccuggugcuccucggagccugcccauugccuggcauguuauucaaccaccccaguccaggcaggcugcagccacuguggagccagcccgugggcaccgcuccugagaggucacaggcuggaaaugugggcagcuggguagggucuaggagggggcagcggcucaggacugggcggggguccggagcggaaggcgcccagcccugauuggaacaagguggcagcaccgggagccgagccgggugucauugaucuugcccgguguuccagccaccaggcgggaccagcgccgggcagacugccgguuuucccagguguggggacacccugagggaaugacuuuucaugugguuguggggcaggcaugccacccagcacgugggggaggccagggcuuugggagcaugcuggcagcaggguggaggggggugucuggagacucagaaucccacagccagcaaaugugaggcuccuggagacagggucauggacuugaggcucugagacccugaggauguuagaaucuucaucgcaguagcucccacugauggugugcucacggugccaggcacgguucugagaacucacacagcuuaacucuucauccuugcuccauccuaagaggggguucugugaucauccccacuuacaguuggggaaacugaggcucggcaagguuaaguagccugccaaacacacagcuaccagguuuuugucuuaggaaauaagagcccuggaacaguuggccagugcggagaggacccccgaagaucucugaggcuaguccccuugugucggaaaaacaggucuggagaggggaugugacgugcuggggcccaggggaguccaaagucaggacucauucuucccccaggucaucgugggaccuccgcuggucccugaaugucaggcccccugagggcaggguccucagccaggaccuaggcucccagauguuaccaaccuuaacugacaguuuucugcuagcacacaggaaguucuuuugaacaucuaaccugaaucccucguuugcagggaaagccucuuccuucucaucuugcaguacucuaagaagaguuuggccuuugauguuagggaagaucaccaguucccugguguugugggaggugagacugugccccucucugccauaaaauaucucuuuacuguccaucgcugggccuaaacauuagcgacuuagcccuuggggccuuacagaguuucuuauuaaaaugugaguacuccuggaaugggugucagcuuagcaggacagggugguacuucaggggcagggcuugggggccguugaggggcaggagagagcugauucuccccuucuagccaggcuugauggggucuacaugaccugccacccuccaccucucugaccucaucugcuuccacucugccccucccucacccugcuccagccacccugccuucaaauaugcccaucauacucccaccacagggccuuugucugugcugcccuuuaccuggaaaacccuucccauucugucugccuggcucagcuacccacuucauucaggucccugcugccuccuccaagaggccuucucuggucuccugugguaggcagaauaauggccacagagauguccacauccuaauccccaaaccuguggcuauguuaccuuauauggcaaaagggacuucgcagaugugaugaaggauaaagacuuucagaugggagauuauccuggauuccccaggugggccccauaugaucacaaggauccucacacauggaauagggaggcagaaaaggacagucggagggagaugggguguggaaacugauuagggaaccugagagauggcagcgugggaaaaacauggcucaaagcugugggcuuugaagguggaggaaggggcuaugagccauggaaagcagacagccuuuaggagcuggacaagacaaggaaacaaauucuccaccagagccuccagcaaggaacacagcccugcccugaccuugaucuuggccaagggagacucauagagaauuucugaucccuggaacuguaagauuauaaaugcauguuuuuuuuaaggcacuaaaaguggguuaauuuaugauggcaggcauaggaaacgaauaugucucccuuccuugauugacaguuccucagcacauuuauuagugccugauacacaauagcuugacuuaugaauugucucuuuucucucacagaaggucagcugcaggagggcagggauuuuuugcuugcuugguguuacauucgcagauagaguugucacauuuaacaaauggaaauauaaaacacccaguuaaauugaauuucagauaaauaaugaacuccuuuuuaguauaaaguugccccaaauauugcaauuauuuaucguuuaucugaaauuaaaauaauuuaggagucuuguauuuuaucuggcgaauucauccccaacacauaaaaccauuccuggguauguauuaggaucucaauaaaugucuguugaaugagugaaauagauaagcaaaugaauucacauuaacuucuagcuuaaaaacccucuuuggcucccagaaugccuacaggguaaaguguaaaucauagcaaaugauaaaagcagacaguuucauagccgcuucaauaugccagacccgggcugagugcuuuacacuuauuaacucacucgguucuugcaauaacccaaugaggugguuagcccauuuuccagaugaggaaacugaggcccaggaggcuuaguaacuuguucaaagucacauaaccauugagcagcagagccaggcaauuccaggccuuugaaaacuuggcucauggaauguucuaauguuaucucccuacccauuccccugaacacuguggauccucucucucuaacagcccccgguuccuuuucaggguaugugcuuccgcauucucugacugcugaacuccuccucauacaucaaagcccuguccuacuuuucucucuuugugagaccaucucuaaaacucccaggaggacuuggcccccucucuuuccccuccccaccauggccccuugucugaaugcguuguaaggacuugcuauuguguccuuuacguucccugacugugaccucccugagaacggagaugggccccuuucagcucuuuggcauggggcuucaaacugagucuggcuuuagggggguucccagaagcauuugagaaugaaugaaugaaugaaugaaugagugagugaaugaauggcugagugaaugaacgaaugcuguuuguuuccacucugggccucaguuucagagucuauaaaaggggaagaacaauccugaaccgccccccauuccuuaaaacaaaacacauuuuuuucugauuauaaaaauaauacacauucauuaaagaaaaauuggaaaauaauaaaauuaugaagaagaaaauuaaaaccauccauaauccugccacccagaacaaugguucccacuggguguucagccuucugcucuucuuacuguauguauagauuuauuaucuucuucucuuccccgcccucccucccuucucuccuuccuuuuuuuuuugaguguugggaacauacaguaugggguccuuuaaaccugcuuuugaaaucccccaacauguguguauguguguucuccuguuuucuuaaagccucccugauggcaggggacaaguggcugcuagacaagccugguaggggccaggguguggaaagcccauucccccccuacucauggaccaccauaguucccuugugaugggcuguuuaggggguuuccagauuucugucagggaacacccugcguggaugucuuagcugcaucccugguuccuuccuuaggacagauucugggacugggguugcugagaccaguauagacacugagaggcuccggacaccgccccacauccuccccacagcugcucuccagccccacucccacuggcagccuggacuucucagcuuggcagaaagccgggggcaguauuccaccuccuccagagaaaagccuugucuacacccaaggccucacugauuccauccaacgcugaaaauacccauuuacucagcuauuucuccacguuauggucuaaggcccagaugcuuaguuccaaccaaaauagccacagaggucacuguggucugaggguccucuggaccucaggccuguguagacaucauacuugguaauaauuaacccacggagcucaccacgugccagacccucugcgucucuguguguccucacgguaacccugaagcuagggauggcugucucccaucuuacaggugagaacacugagggugcuccagagagcugugggcccuaggccuugucaccugggggugcaaaggcgcugccccaguaguccggcugccugcuaccuggcugccugcuacccaauggggcaaagucccagcacuaccccgaaacaaggacaagcuuuggccuagaagcugggcagccagguccugugccuguuuuuucuccauaugugcccugggcagcucacccucuccgucugugaaaugggagagcagggagucagagacagccuccuaggccuguggcggcucugagcacagugggugcagauacucagugcugagucaaagagagagagaacccugccagaugggccagcucaccacaagcagccaagcccggucuuugagggguuggagugggcaggccuuugaccaaggcugagcuaggagggaccugacggccccagauggaggcuggcccacccugccccagcagaugggaggcuauuuuuuaaccccacaggaagaagaggacagaaaugauugcaggggguuaaccuaggccccuggggacgcucccuguuugcauccuccuuuccccacaacccagagagcuaugugggcuucaccuggaguucccugaauccuucuggagcuccccgcagaucacagccggagcuggcagggccugaguggccccugucugccaggcgagggacccagagcccagagaaguuugaccaggacuggcuuccucugcccucucugcugugugcuuccaccaggugaggcugccuccuccgcuucuaccuuucuuccuggggugaccuggggaggccccaccuucucccgggccaguuuccccaucugucagacaaugggacccuccagacaucacugaggcuucucccagcugggaaaccuccuucugagcuggggcccugacucugucacaucaguccuggauuccuggaggccucagcccuccagaagcauccacccaguggacaggagcucguggcaggugucuggggacccccaggaagaggaaggauuuccuggccagagauaagaagagcagcguggguagggguuaagcauccucccccugcagccucccucagaccacgccaccagguggcccuugguccccccaaaaggaguuccugaaaagucugugucuguugcagcaggugcggccugugaaguguguguaugcuugugugagggugguguguguucacaugcacauggugggggugggcacacaaggcgggaggccuaacaugguggcagggacagacuuugguugcugagcugggacagccugugacagaggccccagcacacccgcaggucuuaccagaaacccucagauggugcuggucugaccugaaggugggcacaugcagggaagggguacaugcaggacaggggugcaugugggggagggccauguacagggcaggggugcauguggaggagggguacaugcaggaugggugcaugucggggagggucaugugcaggacggggugcauguggggggugcgugcaagacagaggugcaugggagagaaggguuuguacauggcaggggugcauugggggugcaugcagggcaggugugcaugugggggaggggcauauccaggacaaggguacauguggggaggccacagggcucaaaugcugucagggccucugggaagcugggaccccagugaaugcuugaggggagccaacucugccugaccuccucuuaugauugucuauuuaaacaauacuguaaauuaaucacauuaaucgaacccaccucccugccuccugcugcuugccccugugauacaaauaauaugagcacaaugaaaaaucuuggaaaauacagaaaacacauaaaaaauguuaaagccugaagucuuauaaccacagugaacacugcgagugucuuugaggggaugggggucugcaggucuucuugauacaaucacauucauucccacauacuggagcauuucccacgggcggcuguggagcugagcacuucagguuugucuuagugaauucucuaacagccugagagggagguacuguuauucuccccauuguauggcugaagaaacagcaaaaaggagguuaaauaucccccucaggguguaagaagcagagccaagauuugaauccaagucuggcuaaauggaaagugcaaaucguccagcguccagggcugcacuccagccaugccccgccccccgugagcagaccacucauuuauucauuccuccaggagcauuuacugagcaccuccugugacucagacccugcccagcacccacaccaaggacuuggcggaugugaacgagacagagagaggccccaaccugacuccccaagcggccacaaacugagucccaaccuugaccacagcuugauuucuaguccaaguugucacugacccccacuggccuucaucacugacugaacugugaccuggccuccugcacucugcaguggccucugugagcuuuucauuccccgugaugugugugaaagccaaggccagcagcccaccucacccagccuaucauccacgcggccugggccagggaggccgucaggagcccacccaccaccucuggccugccacucugggccaggccucucuggagcggggguuuggccuuggcccuuggcacccugcuuggcagaagggugggccuuggcucagagcauggggccaccccaggaggggucagcauagcugagcucaggguaccugugggcggggcuuccaugucccaggguccucacacugcagccuccucuuuuugccugggcccuggaaccccaggagaccccaggagccguugcucccuccucucacuugcagaaacucaacagggcagcucaucugagcucccccgaugccugcacuguauuucuggggguccugcaugucucuccaauccucaggcagggccaguuaccuacuuuauaggacccagugcaaaaagaaaauacaggaccccuuuucaaaaugcaggaacaaaaguuuuuccuuucuucuguggacucucaacccacggugguguuuuuuauuugcuguucaaugucacacguacuuggaccuggggagacuugugcagaaagugcagacccucacagaugcucaggggccaccccaaaacuuggugugcagauuccaaccccuuucuccuccccaugccugccucaguggagggcggcagugcagguagugggcugcugagaacccaucccuggaggcagcaggaggcagacuggacccgggccccaaguccccaggcaugcugcacuagcccaucaggcuucauuuacaacacacuaauucagagcgaaaaugauccagcauuucaauauggcaacugcugagcguuaaauucaagcacaggaggugggggggccagguagcccuggaacauagcagucucacagguggcugggcgugggguggaucucuguucuuggaguagagggauguggaguaccucccucugcuuggaguaucugggguaccuggacaagcacagggggccaugaacagggccaugccugugugccugccccucgcucagaagagggcaccugacgggaauaccagggcauaucugcaccaugcccgggcaguaggccugggcaugacccuggaucaggcagaccuguaguagguggaagggccccaggagagcugaggagccuaggggagaggaacccagaggucccugccaaagugcuugaugugcugccguaagaagggcagcauaggccgggcgugguggcucacgccuguaauccuagcaccuugggaggcugagguggguggaucacgaggucaggagauugagacccuccuggauaacauggggaaacccugucucuacuaaaaauacaaaaauuagccgguugugguggugcgugccuguaaucccagcuacucggaaggcugagguagaagaauugcuugaaccagggaguuggagguugcagugagccaagaucaugccacugcacuccagucuggcaacagagagagacuccaucucaaaaaaaaaaaaaaaaaaauaaggcagcaugggugccugcugagagagagagaaagaagcucuuucccugcauguguugccaugggauucuggcccagcucccuggggugcucucugagcucagcuuuggcccugucccucucucucugugccucaauuucucuaacuaugcacugagcaaggagaagaccaccacaccucaaguaccuucugcaugggccauacacugaguuuuaugaaucuccccucucuuguuccacaaaugauuacuggcccauuucucagacgaggaaacugaagcccagaggaggcaaugacucacccaguaagaaggugguggagcugguucugccuggcuucccuucaccccuugagucgcuccagccucucuagguuuggguggaggacgugggaaccaagcucgugggggcaccaccagcucuugccagaaauggggccaagagaagaccaaggaugcuccuugaccugaggaaacguccauuaauucauagcuacugugcuuuggcgagccacgcaggcucuggaugcaggcugccugggugggugaccugagcagaugccuuaaucucucugggguucaguuuucucaucuguaaaauaggccucauaagagcuuuugucuuauaggguugugaggauuaaaugagcuaagguauaucacuugagccugggaggcagagacuuuagugagcaagauuaugccacugcacuccagccuggaagacagagccagaaccugucucaaauacauauauaaacaaaaugagcaaagguauggaaaacacuuagacaguggcugacauagaguuaagagcuauguaaauguuuacugcuaauggaacuauuuaaaaguugagucauaauuuauauuuucuagacugucaauuacgaauugauucauuucaauguugugcuuuucccuuuuguauuuaggauccagcaaauuuuccuuugaaaucucaauacaauuuccuagguccuugagaagauaauuuccccgcccccacagugcuuauagcccaugguggauccaauagcucucucuagagcagcuuuuccaaaaguggacuuugcacacaccagccccuuccagaugcaucaucucaccccaagagauaacucaauaaacaguugagcauacacuauuuuagaucuccauggcccaacaagguagccauuagcauaucaaagacucugacaaguccugcagcaaaacaccauugaacauuguuugaaacaaccaaucccaaucuuguuugaccacagaguuccauuauuucugcucaacagcugauaacaucugaacacacguugggagaugccacccucauuuccugcuuucuaggaaauggcaaggggagucagagcugugaggaacacccucucgcagggaugaguggcuccaccucuacagaaaucaucuccagucaugugcaccaucgcuaggccauuccuccuguucucaccuuccuugucugauucagcccccacagcggccuggagaggucacuagcaucaaugucuccaucauacagaugaggaaauugagguucacaaagguuaagugggcacauagccaguaaguggcagauccgguagacaaacccacagcuucugauucuaaaccccacauucguucuucuguauguugacuggaaaaguaaaaauagauccuauucuaacaggaucaaucuucccccaucauaggcuuuuaaaaaacucagguauuuuuuuuuuccgguagcauugaaugcuuuaaaaacuuaaaauuuuuacuaucuuucuuuugauuacuaaagcaguacgugcuuguuauguauaaaacuuuucaaacauuuugaguugaaaaaugaaaaaaaggcagggcgcgguggcucaagccugcaaucccaucacuuugggaggcugaggcgggcggaucacgaggucaggagaucgagaccauccuggcuaacacagugaaaccccgucucuacuaaaaauacaaaaauuagccaggcguaguggcgggcaccuguagucccagcuacucgagaggcugaggcaggagaauggcgugaacccaggaggcggagcuugcagugagugcgauugcgccacugcacgccagccugggcgacagagccagacuccgucugaaaaaaaaaaaaaaaagaaaagaaaagaaaagaaaaaugaaaaaaaaaaaaaaacagaucugcauagcccuacaaaguagccauuagcuuuuaaaugaaaauacuuaaaugcuaucuaaaugaaaauaguuaaaaugaaauaagauaaaaaauucaguuccucaguuacaguagccacguuucaagcgcucgggauucacgugccccugguggcuacuguguugggcagcacagacaugggacauuacuaucaucacagagaauccuacgggacggugccguucuagauucuucuuagacauauccuaacaccuauacagguugauuaucccuaauucaaaaaucuaaaaucugaaaugcuccaaaauccaaaacuuuuuuagggccaacaugguacucaaaggaaaugcucauuggagaauuuuggauuuuggacugaaguauaauccaacuauuccgaaaucugacaaaaucagaaguccuaaauuugaaugcuucuggucccagccaucuuggguaagggauguucaaccuguaaugacuguuaaugugugguuuuuuuuuuuggagaccaggucuugcucugucgcccaagcuagagugcaguggcacgaucauaguucacugcagccuucaccucuugagcucaaguuauccuccugccucagccucccaaaguguugggauuacaggcgggagccgccaugccccagccuauugauauucuuguugagguucucagacauaucugcauggccucacacauggaggaaagagacccacagaggcaaaaacaagacaugggguaaaaauagacuggaaggaaacacaccgaaugauagugguuuuuucuggguguugagauuaccgagcuuauuuuuaaauuucuuagauccuucagguguucuacaacguaaaaugcagacaggguggggacguugguuggagucauguuuucccuaauguucuuacugguucuaaaaucuucaagcuaugcucucacccaaggcuucacuuauuauuauuuuaacacuguggauucauaaagaauggaagcccacacaaguccagggaaggaaggaaaggcagacagaggcuuauuuucaggccugggcaguugcacagggucccuugcuuagaagggccucaugcuugguuucguguucuguggucgcuguccugaaauucuuacugauuuuugaacaagggauccuguauuuucauuuugcacugugcccugaaaaucaugccgccgucacuagcccugggauucuccccaggacagguuucccuucagcugcucuaagccuucgcccuuguccuuguccaaccacggacguggccauccacggagcccucuacgugccucagagcaagugugcuucggcugcucaggugugugucuagagacugauaaaaacagggcucgugagugggugcgggaggccccuguggucucuguucacacacguaccuacccucaaggccaugucuacacuggccuauuucagagaaccgcccugugcaucaugggaugcuuugccccacaucacggcccagcuugguucaguccuggagcccuguguccugaagccaugaccaaccccaggccuggcccaccuucuuccucagucuccucucccucaagcccuccacaggacccauaaaccuuccaucuccauguaauccuuuugugugauccuucuuccauaccuuugcccaugcuguucacucugcuuguaccagcaagguuccuuccuccccagaucugcccuuucuagacccaucucagauuccacccuuucuagaaagacuucaggaaguauuugagaagggccugaagaugcugugguugcauagaggaggauaugaaucaccucgcuuagagguaucggggagggcuccauggagguggugcccucaggccaaggaagagaagauaucuuccgggcagaagggagaguuugacgggcugguuugaugucagacagaccacaggaugacucaagguccucuuuccucuucuuaaacauuaguugcagcaagucccaccaucugccugagucuguuuucaucuccacaauggagguggugaugcccagcacacggagcugugaugaggauuuaauggggaauccagagcauuuauggaagugccaggaggccaagauucugcauagguaggaaggaccuaagccagagggguguggguggccagaggagagagccuaccuuaguagggcuugguaggcuaaggucugggcugaaucucgaggcucuggagcuuagaacagcaucugcaacucccuggcugucgggguucaggcaaggacugccuccucucugagugucaguuuccccaucuauaaauggaaagcugggacacugaaaaacacugggggggagggugguuccugaggcagucucucuccacacaucacaggaauguggcgccccagggagaaggcaucuuuguccauuguguucacuucugcaucuccagugcccagaacagugcuugcaugcaguagaugcucaauaaauguucauugaaugaaucagcagcaaccaauucgcccaccucacauccuaaguccgcuggggacguaggcccaccucuccagggaaacugucugcagauugggaccacaccucaggucacaagcauuuccugagcaccuacuguaugcauggcucugcgcagcccggggcagacccuugcuccacagcccgacagggcagagccaaggaggcaggugacagacacagugauuugggaagaagaacagagagcaggguggccagcagggccuugccugggugggagcaggccguucccaggcuggagcucaggcugaugggagccccagcuugccuguuccugggagggugggacugccucuuccucuuucuuucucugaaaacaaaaauuguuuucccuuaaauuuacaaguauuaaaaguuuggaaaauacacaauaaucaaaagaauauaaaauaaagguuaccugccaucauggcggaccacacaguauuaacuacuauggacuuuucaguguuucccucuagucuuuuuucugagguggcuuugcucucagagguggcuuucucucccccugggaagggauauagcugcucuguaggagaugugggggcaccaggcucucuccaugggcucuuuaucacuucugacuuggagguccuuucuccacccccccuggaccuagcaccucuucccgagacacaggggugcgaagagcugggggagguacgucagcaggccuccccuccugccccugcuuaccccacggagguggggugggacagaacucaggcuugaggaaggagcacuggaggccaagccacaggugcugguccucagcccuggugcccaggcaaguuggguuugggaauaggggcaugaccaaaauggaccccuccuuuccuccccaccccuuuccacuccauccgccuuucccuuugcguucuccaagcguuccgucccccagaugcccucuguuuccucugcuccagccuuuuaacuccucucaacaaaggccaaggaaucaggcagacuguggacacucaggugugcaugaugggaagggaccugcauuuacaaaagcucccccccacagggacugcaugugcugguggaaucucagucaccaugucccacguugaaggauguuuggagggggcugacuuuggucacccuucaaaucauaaguuauaugcgucugcccuuuccgcccacacguaagucugaaccuuuugccaaaaacacuuuucccagacucgaaagaaaaccccaaagaggaaccuaaaccuucacgcugccugcaccgauuggaccggagugcucaggcucgcgccaacaaguguuucaaagaagaagccagacagugaagggggaagugagggagaagcuggaaaacucucaggcugaccaaucgucagcccauucauucguucauccauccauccauccauccauccauccauccauccauccauccauucuuucuuucuuuccucuauccauucagugagaagggcugaauaucaccugugagccugccccugcucccaagaacacccuuuggacaccuguggggugaguagugaggggcagcaauggcagagcacccccaccgccuggaggggagaaagggaagggcugggaaggcuccccaagggggcggccaugaagcugggccuugagaagacaggccaggguuucucaccuuccacauccugcuuagagucagacagaaggcuuuugcagaggaggaggaacauuaaauaguaguaauuucuggcauuccaugagggcuugucugugccgggcccugugcugugcacgugauacacacuaccucauuaaaccuacccaacaugccuugagggggugcuauucauuuucuccauuuuacagguaagaaaaugaaacacagagaggugaggcaccucucccaacgccacacagcgaggaaguggcagagccuggcugcagcugaggcuuauagccgcauuuuacauugcuuucucuccgaagagugccuuccuuuaucccugggagccauugacaaggggucugacagucccucuagucuugugccugcucagcccucucuagcccugaaaaaaccagggcuuggcgcuggagaaagagcaggagggugagauguggaaacaucuguugaguggcaggggaucacgcuggcgcagaggggcccgagccgaucaggaggccggccugugccaggccagugcucccuguguaccaggugccacaugcggggcucaggguagggccacaguugcuccucccaaccacccuuugaggucaguguuacuagcccauuuuacagaggaggaaacugagaccuuaagaggugaauuaacaugucaggucacccagcuaccaugcaguuuaagccuagauuguucugacuccuaaacugugugcaaggcggaugauuggaccccagggaggcaaggaaagucaguuuuccugcugcugaauucaauguuuuacaagaccacacaccucuuuagaccucaguuucgucauguaugaaaugaggaggggaacucucugccuccgggcucugauaugcuccuggacugauucacuguuccuuguucuugugacuucucaaagcaagaccagagucccacucccagcccuaggcccgagauucccauccccacuguguccaggggcuucaggaggugcuauuuuagggcagauggcaaaggccugggcuguagauccacugagggcuaaaggcaaucuuucuucccuccaccccucccuuccuuccuuccuucucuuuacuuccacuaagcaagguagggaacuacucgcugagucucagggcaggcccacggacugaagcucaggaggacagggcuccccaguggcugcaggugucccagcacugacuccuagcagaggggguguuuggguucagucuggaagauugggugagauuccccaacuacggggggugggggcacacucuggguggcagauuugaggaagagucugcagauaaggcauccccaggagauggcaauaagagcugguguuggggcugccccacugaacccagagcccaggccuguuuccccacccauggaggaguccggacuggcucaguggcaaggccggggucagaggcugccacucuccuccugccucucacagcccgcuggaaggucagguuuucaggcucugcuuauccgucucccggccuccucccuccagguaaccgagggagccuccgcuuugaugcggccaccuccaggcccaggcgucaaugagcccucuauaugaccaguggggcugcugggggccuccagcccgccagagugggugcggugaggccuggacacacagucccgcuguguggggucggcucaugccugccuagacccugugggcaguggggggcuccuaggaaugcuuuuccagccuggggggcacuuuggacaggcaggguggucuggggagacgggugugugcagggcagccucagaagccgccaucaaagggaccuagcagacguggcgccaggcaagcgccauagugggcacggaagggcuggcggucagucuguuccucucccagggauggcggggagggggaggccccauggacacaugugcucagggugaccagccaucagggguugccugggaugaagggguuuccugggacguggagcuuucagugcuaaaacagagaguccccuguuauuggaacuuccuggaccuucggaaaggauacagugacugaccucucuggucugggcagccuccucccuguccggugaccucugagucagaccaucucggccagaccugcccagggccauuuuguccacccccugccuccacacaggccugccucauacccaagaguccacuuuccauuucucccaggcaucuucaggggaggagcugccggccaacuccaaccacugcuagggggaccucggccagacccacaccacgcucccagcccucccuguggcucccgagccagcucauacuuuccugcuuccacaccuuugcccaggacguuccuucugccuggaacauccuuucccugucuuuguuaccucuuuacccuuagggacccaguuuccaagucacuccuccagaggacuuguucucucuuucccaaggcugggcuaguaccccucuuugaacucacagcccugguucuucucccaaaaaaccuuugucacgccccagggcaauuuucuguugacccaucuuuuucuacaccagauggugagcucuuaggauggagauccugacccaguuucccccgggcucccaguacaaggccaugcucaugguguucaucaaauggaaaaugcuuauugagcaacuacucugugccaggcaucaugcuccuuuaauucucuccauagcucugcaagguugguguaaccccuacagaugaggaaaccagagacagagaagugaaguaacucaugcaggugacggcagagggcagagucaggacuugaaccuggagagccuggcucuaaagcccaagcuggaaucucgauacucuacaccucgauaaguuuuugggaaaugacugacuaaacagaugaacgcguuugcccccccgccgccccagagcccccuuaaagccuacauguggcaguuugggcccauuuccuuggcuucccucccuggaggggcacccacugccagugucccuggugaguguuugccuguggggguacaagugaggguucagcaaaggugaccuggugugaggggggggugccccagggggugcagaggagggccucaugaggcagauucagaaugaagguucuggcccccaguggaaccgugcaugggcaagggguccucagggccauuggcccauaauugucagacggggaaacugaggcccagagagaggaagggacuuguccuuaguuacacagagugucuggaucacagcucuuaggucucagcuuccccauuugucacacagggagaauaaaucccccuuguccugccuggggguagaccccagggggccccugugcccucucacaccuuccauuccagcuucuagaauuccaccauccaugcaccagcccugaggguaggcguugcccucuucucaccuccugcucacgccucuacugcaggaugggaaccaaaugccucuccacccuuuucccacaccccuucucuccacagugaacugaggggaguuucugaucccuuagcucaaagucagagaaacugagaggggagggcugggugggagccgugggaaugucaugcacaagcagucggacucuccaggggucuggaucucucccuugcugccuugaaggccccugcacaggcuguggcacuggcugaguacaggugccugaaggcagaggcauggaugggaugcuucauucucagccuguuuuugccagugaagacaaaagggaagucaucuuccguuggucuauggggacccugagguaguaggagcucggugauaauucuagggaccacccuggguugucaggugggggagacagagaagcccacauaggaggcaccaaaugcaacucacucgugcccuuuuacucaugagagaacacggauccagagaugucaagugacucagacacagucucacagcacacaggcggcagaggcagguaggggacugggcuucccuggcagcaguccccaagccugccugagaggcacaucagaaucgcuuuaggggauuugcaaaaccacaccugcccaggcccaaacccuagagauucugauuccgcagucugagguaggaauggagaauccuccacagccugagguaggaacugggaauccaguguuuaaaacucucuaggggcggugauuucagaaaaccugcuggcuccaucacacuuugcucagggacugagaugggauggcauuuggaagacacagguaggaggaagaggaggcaguggggggcacagggagacccuuccccuucugguaaaagccuguggacgagagaacagcccgaguaagauucugagaacccgagacccggauggaccuggaguuuuugucuugcguauaauuuagggggucugugacacugggcuggagauaaccgugucuuuccuuucccuggccucuagcugaaauuuagcaucauauuccauggcgauuuuccaccaguggaaaucacagguguucucugguaucacagcggggucagggaugaccugaaauauuguucaugcucaucacaacugcauggcccaccgcggggucuugucacucagugaguucuugaagaggcacagacaaauggaguucaacaaauggaaaacgugagucaauaugucaccagcuugcuuucugaguuugacaaugguauuuccaucgauuucuuuuccuuuguaauccuuuggauuuugucuuacgcguuuaaaaacgcaacuccgaggaggaaccugaagguucccugagacugccaagggucgguggguuagggacccuguagggggcagcgugggguuggcacccugcaaaugggacccuggggcugcgucucuuugaggaaggaauuggcagcuggagcccuguaagccuccagggaugggauuugggagacaggcccccauggcgagcacgucgugagcagaaaugaacaggagagagaaggcugaagaggggagacaggucuccacaaaaguggagggaaggcccucgggccacagaccccagauccaaacaucuccacagacccuagccuaugaggcgccuucugugccacugcuggccaggaucagcccgcucugcccagcggccuccugucucugggcgcauacaugacauguugggccaaagccaccucucccuuugugcccuuugugcuacugccagccaccucccaggcuccgaggaucaggacccagcccaggccgaccggggcucuagcccugucucccaagguuccuuuguuuuaaacccuacauuucuccaucuugcgcacggaaggagaaauacagauuacaaagacccggcaaauggauuuuauaaacucuuauuuucuugccacagaacugccuuuaauuagcuccgaggacuacaaagggaacaacguuauaauagcagcaacuccaaggaagcagccacagcucucagcucucagaccuggggcugccgcucaucaucagcuacagcuagguuugaugggagugcccccauuucaggggacagcaggcccccuucacuccccgacucaguccccaucugcagcagcacagccuuccuuggccucaccagggaagaagaacaggccccgcucucagacaagccuucccagaagccugaggacucaaacacccaaaugugucugggucccugccccgagccggccacccaggcagcagcccugaaucacucggucagccagcggcagggcaggccaaugggcuggaggguaggcaggcaggcagacccaccucugcaucucugcugacugccucggcugaggaaaggcagcaccagcccccaacccugaaguucuagaucucaugcagccucucuguucuggaaccauccagaggcacugcccuuauacaugguccacccccaggcucagacaaugagaauuccacaagcagaggggacucuauuuggggcacagagagguuaaguaacuccccuccuaaggucucucagcaaggaagccacugagccgugggacuugagcucagggacucuugauccccagucucaggugucacagccccaucugggcuccugcuagggaggaggaaggcagcagggggugucugaggccagggugcaucagcccuaaaugccagacagaggcaggagaagucuccccaugagucccagccccauuagaggcuccaggucggggaucccagacccccuauccuugcugggagacacaacccagaacucugcaucccugcagccaccaaaaaaggcaaaagcugcccagaaacacuuucuccucuuccguggccaaauccacgaacuuucucgaggucugucccccugccccgugcagguccagcuucagugcagcccagcucugugcaguuuuccacaaaagccuguggcuuccuucuccucccucugcuucugauaccccaggaguuacacacaaaauguuggcgguggucuccaggaagaccccugcaucccacagcucuccccagaaguugccagcagugaccuccugagcccagguggggagucccaggcaggacaggggcuggggcugcaggcccuggggcccuguuagugaagcagcaagccgagggucccugagaguuucccuuggccccucugagggcugcccuuugaggucuugaggucuuggaguauccaucgcccccacggcuuacuguccccaccagcggaggaugaaagugccacagcgauguuccacgccaagagaccacagagaccaccaaccccucuucccaccucaggcuuucagaggccagcggauuuaggcggacaggcugugcgcuugagggcagccagggcggucaguggagggacgugguccggggccuggccacagcuccccacccagggcccugggcuauuguuacucaccgcggaugaaggucggcgaguaggucgggaaggagucgaagaugcuguucgaugccaugccccgcucugaagaaggcgagaauuuucagcccuucaggggguuggguugggauucacuugguuggcuguuguuuuauuuuuuuuuccucuagcuacuuuugaaaauaaaagggggggguguugcuuuuuguuguuuuuuguuuuguuuuugucucuuuuuuccccccugcugcuacgaaaaagaaaaaaggaaagaacgcgagagugugugugagugagagagagaaaaaaauccccaaggaaaguaaguuucuguuuguacccaagaauuuggauucccggucccacaggaaugucuagccacaaauucucaacagaagcguaugcagaguguaucauuagauggcgggaaggggcuuucggcagccaggguggaggagcuccgaagcugacagagcagagugggccgccuccagugccacggggaaugaaug

SEQ ID NO: 21222 - RNA, 79313 nt, Homo sapiens
cuguguugugauaaaaaguauuuuauuuguuuaaugauaugcaugcuuuucuucuguaaauauauaauaaauuuuuguagauagucuugaugugugaucuuuauuuuguauuucucuguguaaaaccagugaauauaacuaaaguguuaguggauuggauuaaaagaaacuuauuaggcaagaacagguaauguaguuauccaugacuacuuuuaaccaugcagacuaauaauauucuggagguuuauagcucggcaccuucaccuguuuaaaaaaaaaaaaagauaaaaauuaguuacauauggggaugugguugacuuuugaauuggcagguaguugaguguuuccaaauaaaugaagauguuaaaauauggggauaaaggauauaugaguaauuguauaaaugauaugcuggagugcucuguggaacucaaguuacaugauuuuagcuaugaaaggcaauuuugcuguauugguugaugcaucaaagguacaucuuauuauagaacuggaagagcacauuucacaaugagauucagagagguuaaagaccuuuccuuuguaguccggaucuccuucaaaagguaaaguggaggaauaauuaguagcagagcugagacucaaacgcauggcuugacucuuagcuacuguucuguuucauugccugacauuacacauuauggcugaagagaaucugaccaaauacuucuuuacuuaauauuucuuuucauaucacagcugagugaucugcacaguggaaugguuugacacauggugacgguaaauuuuguucuuuugucuaagggaaagccaauucagacaucaguuucauagaacuauauaaauguaaaguagcacugcuaugacacaggauggguucuucagaggaagcuuuuuggcagugaaggaaggggaggcagaacagaacuggguauuugccaauauacucuccuuuguggccuuuucuuuuaaaagcaaaagugaagggcgagaauugcccacaaucauuuucuuuuaaauaggaauuuaauagucacaacacaaagggaaaaugccaaguagauagguagaaagcuaugggaaauagaagccauuccaggcaaguuugauuuugacucuuacauguuagauaagguaaaagcaucuaagucauaauaacgauguucagucacccauccagauaaucuuuuggagucucaugcuguacauuuuaauggcauacuuaaugcccuuauggguugcuaacuacagaauuucaucaauagcuacgucugauacuuucauacuuaguucuguucuuuuuaaagcaaauguacuagucauuuuuaaauggcugugagauuuauuguguaccuuuuuucacugguauuucauguaaggcaucaaccacuguaauuuuugcugaugcugaagccuguccuugggaauuggaugcauggcacucauauucuccagcaucuuccuuacuuagaggagauaccugugaaagaaaaaagaucuaguauuccucugugguggucuucucuuuugucagugguuccagugaggucauuauuucauaaauuuccuaagaugaccaggggauucauagcaaagguacugcuagaagcagugcaaguccugugauaggagacuucgauaacuaccauauuugguuugcugaggauucauaugaggaaaugucauggacaacuuuugaucauacugcauagguuaaaaacuggauagguacacauuaucgguuuaagggcaaccuugauaaggguauaugaucaaaguauucuccaugaauauccagggucaaguaaaauaagguauuuauuaaucgauaaucaguuaaaacaaugcuugggccacgcagcuccgugugaggauuuugcuuugaacucuuaggaaaauacuaguucuuguuaauucauugguuguuuucaaaacaugcaauaaagcacuuuuccuuuaguuucucugaaagaggagcagcgacuccaugguaaggcuauuccaaacagauguggaagagcaagcaccuuuaggcuggcgguacaucaggcaccuuugccaggucugcuuaugucuaaugcuaagaaugaaacucuugccagcucuugguacugguacucaccagcacccagccaguuacuucaugcuuuucugggccaccccgggucugaauggccagguugucccggucaccaggcaggaguucuguccuuugaacuccauagugaccccuuuuuaccugcaaaaacaaaaggagaguaauacugaguuuuguacaccagaucaucuacuuggaaguggccacaucccuacaauugcacauaguguaugucagacuuucuaacagaguaaacccagcauuucacugaacuauuucccuuuccuaaauacuuuuaaaauauagauccucuuuuauuucuuccugccaguuuccugcuaagcguacauguuuuaaacuaauguauuuuucugcaugccuggggaauauacauggucauaauuuccugccacuggucaccaucauucauucacucaugcucuuggaaauucugcuucucaguuccaggccuuuugccugucaugccauguucaacugaugaacugucacccagcacuagguuugaugcuugggaccuuggggcucuuccugcaacagcuucaucaauggaaaauaggcugagaccaaagccaauaccauuacuuuauucugagggcuaagaauuaaucaaaugauuuacugaacaccuaagauaaaaaacaccuaucaaaggaguucgagaccagacugaccaacaugacaaaacccugucucuaguaaaaacacaaaaauuagccgauuguguuggcgagcacccguagucccagcuacucuggaggcuaaggugggagaauugcuugaaccuggaggcggagguugcagugagcugagaucgcgccacugcacugcagccugggcaacagagugagacuccaucucaaaaaaaaaaaaaaaaaaacagcugucaaauacaugugcugucauuguucuuuuaugacaaaacuugcugacuguuucuguguaugucaugucaagauucagaagaaacucaguuucuuuggugcaaggccaauacugaauaguauccuuuuugcccucauuuuaaaaggcaaaauguuuuauuauauaaacucuggaaaauauacaaaagaaugaaauucacuuguagcuccucgauacauauacauuuagcagcugaguuacagaguacaaauauuuuaagccuugugauaauggugaguuuuaaaaaaaaaaggauauacgaauuguuuguucauuccaucccagaucuccuuuaagagccaaccugacauuuauugauauuaccuuuguaauuagaaaggauuuacaaccucaaauagcuaguuuccuuuucauuuucuucuauaauaaagcaaaucuuaauaaagaccagauaauaguguguauauauagacaccguauguauaaauauaauaaauauauaaauaaauauauacacuuuauuaacuuccaucucaguguugcuuuucccauguggaucccacuccuaccauguguuuuuugguacucugcuguugugucggcuucaaaccuacacuguauuuucucagcuuuaugaugccaggacugggauucagcaaaccacaugugaucuaggccaauuccugcucuagaaaaaauaucuugcaugauuuggaaagccuggcuuuuugcauuuuuuuucuggaauuuucccacauugccacuauuagugagagaaaaccacguaacuuaaugucuuucucauaaaugcugugaagacaaacauacucaauagguaccuuuucccuuaguuucccaaguagcuggcagaaacgguuuaugcuaauacagcuuuugaaauaguuacuuaaaaauggguuguaagaauauuuugguagaaguauuaauuugauccaaggucucaaguaauaugacucugaccuuuauuuacugaauuucagaaucauaugaguuuuaugugugaccaaagcaagaaaauaaacacugcagcacugaaauacugaaucucagcaacuaagccucaaaucccauagcucuuaguaacagcauuuuaugcuaauuaaccugauccacuauggaaagggaaauguaucuuguuaaauauaauauuuaacauaaaucacaauauagauauacuuuauuuuucccuucuuuucacaaguguuggcauggcguauuuuaauuaauguuacguaauuauaaaagguuauacaucauguagaaaacauagaaaaaagugccaagaauuuucauaugacaaauuuuuauaugucaaacucucccuuauucguguaaggggauucuaaguguuguuaaguauguguuuucuuuuuuuuuugagacagagucucgcucugucacccaggguggagugcaguggugcgaucucagcucacugcaaccucugccuccgccuccgggauuccagugauucuccugccucagcuucccgaguagcugggauuacaggcaugugccaccacgccuggcuaauuuuuauaguuuuaguagagacgggguuuugccauauuggccaggguggucucgaacuccugaccuuaagugauccacuugccuuggccucccaaagugcugggauuacaggcaugagccacugugccuggccaauaaauauguguuuucuaguuaaaauuggaauuaaaacuaaaaaagagagguuaauauucagugcuaguaaagaugcagagaaauggcacuucuccauuucuggugggagugugaauuacuacaaucuauuuagaaaguaaucugacaaugucuguuaacacugaaacaaauauuuugacuuagguaacuguuggggaaucuaucuuauagcaauacaaucacuaguauguaugauauguguacuuugaugcuuaaaguagguuuuuuaaguuaacaaaaauuuggaaacaacagaaaaaauacagaacugauuuaauaaauuacaguauucauacuuggaauauuacguagcuguugagaagcagacuuggacggauguccaugaaguauuuguugagaaaagcgaguuucagaauaauuuacuggcacacuauauucucauuucaccguagggauauauguuugaauaugcuuggauaugaaaaagaguguggaaagauacaaaccagggcaguucacauugguuaccucaggcaggaggaggagguggggggagauucucaacucuuucuuuauacgucuuuggauaauuucugcuuauuacuauuaccuuagaggucacuauuuuugauuaaaaaauauucuuagaggucaaggaagcccuaaucugaagaaauauucaggcaagaaaagaauuaaacagagagccucuccgucucagaaacaaauauugggaagguguuuugcuuucgcugugagcaucaucuuugauuuaaaaggguuaagucaaauauggcuauuucaguucacguucccauuucaaaauauugcccuucgaaucuuucuaggcuaggaguuugcugaaagguauggggcuuguuaaagccagcuuuccuuacuaccaguaaggaaaguaaagaccacucgccaggcugugccaaccguaagaauugccaccguagucucaagugucauggagaaaaggcuuguaccauuaauucugcuguugcuaagaauccuugagcaagaaggacaugcugucuuuauuugagccucaguuucucuuguuuuacaagugaggauucuaauaaucuauccaaaaagguguucuacucuuaaauuggauuugaaacacacaugauaguaaauauguuuguauucuuaacagucugguuacaaggacagcgaugagaaaacaaauacccuguuuaauuauuuaggucagugacuucccaaguuuccuuaguuuugacauggaccaaacuaucguauaucuggaauauacaaaaguuuuaggaaaugacaccuucauaagugguaagugugaugccuuaacauagguucuguucuauuuuuuauuuuuuauaagaacauggugguugugaucgcuacauuaguuccaggagucacugaugggucauggucugcaguguaagaaacauugcuuugggucaugcauguggcaaauuacauuaugaagguagaggaaaaccggcagagcaucacaguuggguuuugcuuguucuggaaagucugcagaaaaaauuguuucucuccuacuuccucuucacuucuuuacuucagcacccaucucguugacugacauaguggguuuuuugguuuuuuuuuucagagacaggaucuugcucuguugcccaggcuggagugcaguggugccaucauagcucacugcagccccaccuuuugagcucaagcgauccucccaccucagccucccgaguggcuagggacuacaggugcgagccaccacaccagccucaacugccuugguguuucugacuagcccugaggacaagcacucagggaggccuugucuauugggaucugcccuguacaguccuaaaagggaaaagauucccgaggcagacguauuccucugguaugugaauacuguagcugggauuggguagagcaaggacugaagaaauuauucuuugccaagauuugccaauaaggucacaugccccaggacgcuugggugacccucgcuucucauuguguaaguaucccuagaaaacuguagagaacugcaacggagcuuuucauggguauuccucggaacauuauuucuccaccuccccacacccugagcaaaccagcaaucuccaaauuagcagugaggaacgccugcaguucuugcaguaaggauggaggggaacccauccacggacugcauuucugcucuuacucuugcuccgccuuccucuuaaaaacauaacugaucggggugaaauuuuauugcuccuuuaagagaagcuucacuguaaaggaugguauaguaguguugccucugccaucacccccaccucaggcauuuucugguaccuguucccagauuuuacacaaaccaggcggauucacgccggugccaaugucaguggccgcaucccuccggccgcaugggggagccagagcuuagcaggugacccgaccugggcuugagcccuucgugggauuuucacaaugcagcagggagaagggaagcccuuucuuuccucuggggucuuuaagcuguaauaaaaaugugaguggaguugauaucucccacugcauaggaagcuuucugaagcagaagaaaaugagacuaguauauugagagcaaagagucaagaguuagaguucugauggcguguguaccuggaugcaggggcccuugaggcuggaucccgccccgcuuuuuguuuugccuaggcugguuucaaaugggcugguagaacuugcaacagaaagagcuccgacugcgggagccacaguccuccuggaguucuagaaguugcuucuccggucacacagagagcaaacaaaauagucaagggagacuaucauccaccuuagagcuugcuggagaaguaaggcagcuuaaaauggaugucugguuaugcccuuuuacuuaaacuaaguuccuuuuuugguagcaugaguuugauaauuuuuuaauuuuuauuuuucguaggauaguugugaggcucagcaauucaaaauguauaaaaaggacaaaaacgaccaggcgcgguggcucacaccuguaauccuagcacuuugggagggcaaggugggcguaucaccugaggucgggaguucgagaccagccugaccaacauggagaaacccugucucuacugaaaauacaaaguuagccaggcgugguggcgggugccuguaaucccaacuacuugagagacugaggcagaagaaucacuugaacccgggaggcgagguugcggugagccgagauggugccauugcacuccagccugggcaauaagagugaaacuaugucucaaaaaaaaaaaaaaaaaaaaaaagacaaaaacguaaguguaugguauaauugugagguguuaguugauggcaaauaaguguuuucuuuucccuucuccauacaugcugagaugauguuguccuucaaauaugaagauaauuauacaagauaaugccacuugaagggaaaaauuuccaggaacaguagcuaaugucuacugagugcuaacuauguaucaaguaauuuuuacuugcauuacuuuauuucaucuuuaugauaauuacaugcuacuuuuauaagguagagaacagaguugaggcuaacagcagugguuuucaguccagggcaauuccccagcuccacacccuuaggggacauuuggcaaugucugaagaugcuuuuaauucucacgacaggggggaugggggaaugcuacuguuauauaguggguagaggcuggggauacugcuaaacaucuuccaaagcacaggcagcccgcacaacaaauaauuaucuggccccaaaugucaauagugcugaggcugagaaacccugacuugcagagaacucagccacccuggcuaaggaauucacacucuuuuuuuuuuuuuuuuuuuugagacaggcuagagugcaguggggcaaucacagcucacugcagccucaaucuccuggcucaagggguucuuccaccuuagucuccugaguagcuggggccacaggcaugccucaccaugcccagcuaauuaaaaaaauuauuuguaagaaggaagucucacuguguuggucaggcuggucucaaacuccaggacucaagugauccuccugccucagccucccaaagugcugggauuacaggcaugugcuacugcacccagccucacacuuuuuuuuuucuuuuuuuccauuugggaagucauuucaaagcugauuuauuaaaagaauaucaugcuuuuuccacuuggggcuggggccagcauuuagcaaaauucagaaaggagacauuuuuuucuuugcuauuccuccucuuguuccuuuuuaaugcucuguucuggaguggucuccucugucccuaacuuaugguucuacagccuugguacuuaggagaauagaucccaccucauuccuucuauccuacuuccaagugcccuuaaaauguacucauccaucucccagcacuuagggaaucugaaaaaauaauccaugcucccaggagaaggcuacagggcuuuguguccuuuuaccuucuuagccgagccucccaguaaaauaauaauaaugccuccaagcagacaggaucuaaauuaucagcuaaauguucagucuuaaaugaggagacugaugccaucacaaacagcuuggugggggcuuggaggugguauuuugggacagaaagagagaaacguacgcuuuuaaccccuaugcuauacugucuccacugagggcgcaaacacagacacacacacuuucacucgcacccacauaugcacacacauacacacaccacaggugcacacacacccugaagguggguucagguguucagcauuauuguucuuccaguuucucagauucuaggaugcugcuaacaaaagcauggcagggacugguuuuuguuccaugaauccaggggaggggccuguaugacugcccuaaggcuucaccuugcgggagccgcagucaacaaagcaggcugaggauuuaacguuuuaccauccuugugcagugcaagagaagcuugucagccuaggaugucucuuaaagucugugccacagaccuuguuccagaugaggacaggugucgggauuccgaugaccucacagcucaaguacaccugggcaccagugacauuccagauguccuuggggggcgucacuauggaaggaccugcaggagagggcacaaagccaaagucaucuuuuaaacaguccuucacaugagucagcaucuuagggagaaaauaauaauuuuguuuaugaggccauccccuugauggauuaucugaagcaaauuucaaagaccacacuggcuuccuccugccaccaacaugauuuuaagguccacuuugggaaugcauaaaucuaaacaaacaaaaacaauuaggaagaaaaauguguuauuaaaauuuucuucuuccccagaccaugcuuaaaugagugcuaauuuaccagcuguuuuuuuauuaucugggacuuuuccaguaguaauaaaauuuuaguuccaaaauguucaauguuuuucuucuuuuguuuaccacuauuucuauuuuggguuggaaaggcaacaagcaaccgcuccauggguaaugaagaaaaaaaaucuaagagaauauuugaaaaugugcuaagcacccagacaagauggaagucucugccucaagaagcuuaggaucuaagguugaaaagggugaugaggcagggaagaaaagaaacauguggagugcugugugcgucaggggauuggaagggacaucuuuauuuuuaauuuaauuuuauuauuauuuuuuugauacagaaucucauucugccacccaggcuggagcgcaguggcuugaucauagcucacugcagccucaaacuccuggucuccagcgauccucccaccccagccucccgaguagcugggacuauaggcgugcaccaccaugucaguuaauuuuuauuuuuuauuuuuguagagacggggucuugcuauguugcccaggcuggucccgaauuccuggcuucaaguaauucuccugccucagccuccccaacugcugggauuacaggugugagccaccaugccuggccaggaggcaccuuugaacagaagaggcccgggugucgaggaaggugguacagggguccuucuuccagugugcucaggagaggcagcugguaagaaggaagaagagugacugaucuauugggugugaccaggguccccaaggagagggcccuuucccagcguucucaguguccaggucccuggcaggaggcauuggcaaguggggggcacccucaagccacggccuaaauagagucagcagguauggggccacugagagaggccagaaugaugcuucuccauucccccaauuagggaacacaccccccaccuucuguaucauggcacccucuggagaaguucccuacucagagucaacacaaaccauguguauccuuuuugcuaugaaagugguaugacucucugguccuggguuagcuaacuauggccugugggccaaaucuggccugccaucuguuuuugcauggcuuaugagcuaagaaugguguuuggauuuuuguuuuuuuaaauuaagaaaaauuuuauuuuuuugagacagaaccuuacucuguugcucaggcuggagugcaguggcaugaucuuggcucacggcaaccuccgccucccggguucaagcucaagcaauucccaugacucagucucccaaguagcuaggacuacaagugcaugcccagcuaauuuuuguguuuucaguagaaacagcauuuugccacguuggccaggcuggucucgaaccccugagcucaagcgauccccccaccuuggccucccaaaguguugggauuacaggcgugagccacuaugcccggccugcaguuucaaaugguugaaaaaaaauuaaaagauggauauuucaugacgugugaaaauuguaaaggaaauguccauaaaauaaaguucuguuggaacacagccacacuuauuuguuuccuguggucucuggcugcuagagcaguuguggcugagacuguauggcuaaaauagucacugucacuggccuuuuauaaagaaauuugcugauuccugcucuaaucaacugagggagacugaugccuaaauaagacauuaugggaaagucucaggacuucaauccuuuacacauuuuccagagcugaugcaaguaacccccugggugauuucugguuuggcucugaaacacaaaacuguggaagccaacagauaccgagagagcgggugcuugcugacugcgccuguccccugacggccuggcuucccggcaucugcaauagagaugugaacaccaacuuuuuaguuacugguaauuaguaugucacuucugcuaauucugaaugccaggguucaaucaccaggggccuucagaaagacuugggaccguccgcagaggagggucauggagcuggcagucugggauccucauguggggcagugugagacuccagaaccuaaccuggcucuuauuccaugcuuagcaugguuucuugaaugaauaaauuaaugaucccuucugaauuuuaaaucucugcugacuugggucuccuauccuagcaaaguacaaacugcagggucaucuugcaucagaguccugggaaagggacaaccuccccuuuaggacuggaaaguuuucuggcauaaucagcauucaaaggacauaaagucuccccuucugcaacaggcuauuuccagcacaauauuaauuucuugaaacagaaaggaaaugaccccagugugcaagauuuucccacucaucuaaagcauuagaagcugauuuuuuuuaaucucaugggauauuuuuauuuuuguaggaaugugcaaaacaaucaaaaguuuggaaagcucuaaauacauuucaugcuuccuucccuccaaaccauaggucugaauaggaagcauauauccuggccagggggcuuggcucuucugcugcaaacaugaauguggugagcacaguggugcaguauuuacguuucuggcucugucucagacauuuccuagucuggaugcagcaauacagaacccugcaaagggcugggccucacccuaucccgggcuuccucuagggcuaugggaccccaaggguuuggacaccacagagccggaucuggcugggcuuugaacugccuucgcccaccucucugauggcccucaugcugcucuguucuccuucccacacacagacuuggcaggaggacuucaaagcucaggggaucucaaaggauuguucugagaagagcauaccaguuuucagagauuugagggggagcucgggaacaaagcugcuucucucauauccaaaccacacaaggaaugcaagacaauuuuauugugaggaucugagggccucagcccugccaaaaccuacuuacuuuaaccuguguccaucucccuauugccaauacagguagcagggucaucggucuugggcagggggcagauucuggagugcuaaugggcaaguuccagccugauuuucugccagagaucuugaagacaugcuauggauuuuucccaugggauuuuaaaacagauguucuuaguuuuaguauaguccaauuuaucaaguuuucuuuucugugguuagugcuuuucguguccuguuuaagaaaauuuuugccuagcccaaggcuaugaagaucuccuguuuucuucuacaagcuuuaugguuuuacuuuucacauuuaaguuuuugcuccaucuugaauuaauuuuugugugugcuaugaggcagaggucaaguuucauuuuuccuccccuaaaaggacauccaauugcuucagcaccauuuguugaaaagaccaucuuuuuccuaaugaaucauaauaaugccuuuguggaaaucuguaagacccacuguauaugugugcgucuauuucuggacucucuguucuuuuccacuggucuaugugucuaucuuugcaccaauaacuauggcauaauuuagaaauuaauuguacuaaaguugaagcacuaaauagagggcagaucuaauauaucuguucccccccaaucaucuuacuauuccaagaagcagaacacucuaggacaaguaagaauucuuuuuuuauuuuuauuuuuguagagacagagucuugcuauguugacuaggcuggucucaaacucgugggcucaaguaauccucuuacuucagccucccaaaguacugggauuauggguguuagcaacagugcccagccaugaauucuuuaaaaauaccugaacccaggaauacuuugaaugacagccaucgucaggggauucaauauuaggacaaaucauaucauggguuccuauuucucucucccaaugcuuggaauaccuuagguaaacaggcugagucaacauuuggauuauucuaagaauguaaaugauuuugucaauccugccaccaggcuauuucuagaauucuacaagacuuccauaccacaaaaaucuauaauauccacugacuccugcuggggugauguaguggaagggcagaggaggggcuguuaggaccaguuugcugcacaacauuuacaaaaaccuuugacuauuucaaauauccuugaacaaaugcuggguuuacuaacacaaugaaaaguuuaacaaacaauacguaaacuggaaagugcuaagaaauaaggcuacagaacggccuuuugguuuugagaugcagucucuugcaaaggaaagucacaucaauaaauuauuaguguaauauucaagggaccaaacagaccucuuagaguacauggaggcggguuggccuccacgugacuuccuguguuggaagaaucuguagggauucaacauucuuuccaguacuuucuucagagcugauacccaguaggauaccuauuuacuaagcucugauugguucuuuaccacuuaccuggucuggaaauucccccagaauaugcagagggaauggaaaaacuccuuuuuuuuuuuuuuagauggaguuuugcacuuguugcccagggugcaauggugugaucucggcucacugcaaccucugccucguggguucaagcgauccuccugccucagccucccaaguagcuggaauuacaggugcucgccaccaugccuggcuaauuuuuguauuuuuaguagagaugggguuucaccauguuggccaggcuggucuugaaccccugaccucaggugaucugcccaccucagucucccaaagugcugggauuacaggugugagccacugcacgcgaccaaaaucucuugauaaaagcaaauuacagaaguuuuagagaaagguaaaugaagauacauggugagaaagaauaagcaagcgacuuaauggugacccacagggacaccaagaggacaagucuuguauagaagagaagagaugcugaaaauguuuucgguggauacaaugccagccccaacaaugcugcacucuccuccccgacucucaagaacuaucaucccacacauuccauugaucagcaauuucacugccaacaaucaucuugaauugcaggucuguccugcaauucaaucccugacaguucuguucuaccucaggagagcacuguacucaaugacucuguaccaaauaacuucuaacucuuuccacucuaccuuucuuccaagaagggcaaggcagaucgagaauuuauuucuguuuuuaagaauaaagaaauuuuuaggucacucugagcuaauuuucucauacagaaagcucaaaaucaguccucaaggccaggucaaggguaauaacaacauuaucaucuaacucauacucaguguuuggauuccguuuaaaacaggucacagaauucuuaaauguauagggacaaacaucaggauagguccaauuauuuauuuauccuugcccuuguuccauuaagagcuccagacugcucaaacaucugucuagcaaacauccuguucauagaauaaaugacugugcgcugccucccucugccuuguacccacccucggcaacuccagaaagcaaccaagucaucugcagugcugccugauguaaagagauguccacccaagguggacuaccuacauuuuucuauccagaugacuguacccaaaccaggcuaccccacuuuccuuuuaccuuacacacucaauuaauucucauucaaucucuuuagauccuucucaacccucuaaauucauuuucuugccuucccuauuuuuuauaacucucgcucaguaacuuuagagugucucuuccuuuugaucauuccuuagagggucucuucuuuuugaacauuccuugaagggaaagaagggagagaggaugauaugguuugacuguguccccacccaaaucucaaauuguagcucccauaauucccaugugucauggguugggggguacgcgguggaagguaauugaaucauggggacagguuuuuccugugcuguucucguaauagcgacuaagucucaugagaucugaugguuucauaaagggcaguuccccugcacaugcuguccugccugcugccauguaagaugugacuuugcuccuccuucgccuuccaccaugauugugaggccuccccagccucauggagcugugaguccauuaaccaucuuuuucuuauaaguuacucagucucggguauguauuuauuagcagcauaagaacagucuaauacagaggaggugaaggagaaggagaagaaagaaaaaaugaagaaagauagccagauccugaaggaaguuauagcaaggaagaagaaaguucuaaccuuggaagaaaacaaaaauucacuacuaugaaauacauccuuggaacaaaauuacauuuguacuccauaaguuuaugcaaauaaaaaauaaacauuaaaaauaaaguaaauuaaaauucaauuuaaugaaucauaucaccuuaaaaguacuuagaagucuccugcagaaucuccaccuaagucugcauacuccuccuuugcuacauuuuuucuuuuuagagacugggucuucucugucacucaggcuggagcacaguggugcgaacauggcucacugcagccucaaucuccugggcccaaacaauccucccaccucagcuucccaaauagcuaggacugcaggugugugccaccacgccuggcuaaauuuuguauuuuuuuagauauggggucuugccauguuggccaggcuggucuugaacuccugagcucaggcaaccugccugccucggccucucaaagugcugggauuauagguguaagucaccaugccuggcuucuccuuugccccccuccgccccccuuuuuuuuuuugagacggagucuugcucugucgcccaguguggagugcaguggugccaucucggcucacugcaagcuccacauccugggcucacgccauucuccugccucagccucccaaguagcugggacuacaggcauccaccaccacucccggcuaacuuuuuguauuuuuaguagagacggggugaccguguuacccaggauggucucgaucuccugaccucgugauccaccugccucggccucccaaaguacugggauuacaggagugagcaacagcacccggccuccuuugccacuuuuaauuaaguucuagacaaaggacucacagacuaccagauuauuuuaagaauauuugauuauaaucuagaaauagguauguucugaaaaaguacuacugauacagaaaagguaguuuuauagauggauggauuuaaauuuggaguauuaugaguugguucagaagaauuuaagaaaggcaguucucacaaaacacacaaauaucaugaggaaaagacuuugacaugaaauuaauuuugaauuugaccagcaauucauuccagcugauuuuauauaaagucuugguagugaggacagaguuaaaauguguuauccuauaaaaagcacagcaggaacaauauugaagaaguaugugaacaauuuccuagucccuuacagagcacaaagcacuccccagccaugaccugagauguccucaugauguuacuauuuaaaaaaaagagacaaaagcauucuuggggacagaacacuuggcucugaauccuugucuacaauuuauagccaaaagaccuuggacaagccacuuaaccacuuuuacaagaugaagaaacuaggaagugucuaagaauauccucuuuggguuuggaaguaagugaaccuaucaugaauguguccuagagcugggacauagaugucaaagaugcuuugacauuuaugaaguucugaagucucacugucugggucuggagcucucauucucugcaaaucaguucaaugcauuuccucaccuaccuaaacacgauguaugugacucauaacaugguucacuuccucagggauuaaaaaaauagagcuuauaaagguaucacccuuuacccaguuagccaauuuuuuuuucaucugaaagagcuguguagaagauauuaggagaagucauguuugaaagcuaaauauacuugaauuaagccugggaaauggucaaaagucaaauuacccccaauaaucauuucuguccuccaauaucauauuguacuauauauuuuuugcuucguugcuuucucauuugcccaucaucucuuccauuuuuaccaauucacucuucuaugucauuucuacccaaacucacugucugcucccagcaguccugcucacccaccauuacauguucauuaccccuuccagcaccuuugcuuaugcugaugcccuuaccuacuuggaauaucuucccuccucuuauuucuuaucacacuuuauuugacauucuaagacugaaguuucauuucucuuugacauuuuuugcggccugacagcuucaggcucccccuuauuucuucucuaaaauccuguugguuucgguaaguuccacagaguguagugcaucacuguuuucuaaugcuuuccuuagcuggccuaauugaggaugccagcauccugucggaaucagaacagaaccaggaacuacggaaucaaaagaucuucauguucauuggaaggagacagagcucaggcugugugaaguggguauagggcagcaguaacuucagaacaacauaacaugauuagccaaacagaagugaaaagauagccacugucuugaaaaugcaccaguguacacauggccaaaagcguacaccucaccaaagugguguuauaacuaucuuauuuaucagcuggcagauuauuaaucaugauuuucuuuaaucuuucacuugacuuucucuugccauaagcaguguuucuuggcuacuaaccacucaccaaccaauuaguauaugaccaggagaugcaaauuaauuugaauauacaucacuugaagcaaaucccaccgagauggguaggucugcuggaagaaaaugauuaucaauuauccucacaccaaaaucaugcuggguuauacuauucacauuaugguucucacugaacauuuauuuuauuuuuauuuaaguuuuuuuuuuuuuuuuugagacagaguuucgcucuuucgcucaggcaggagugaaguugugcaaucucggcucacugcaaccucugcccuguggguucaagcgauucuccugccucauccuccugaguagcugggauuacaggcagccaucaccaugcccggcugauuuuuguauuuuuaguagagaugggguuucaccauguuggccaggcuggucucgaacuccugaccucaggugauccaccugccucagccucccaaagagcuaggauuaaaggcauaagccacugcaccuggcuuuucaaaaguuuuuauagacagagucuugcucugucacucaggcaggagugcaauggugcuacgaucauagcucacugcagacuccaaacuccuagucucauggguccuucugccucagccucccaaggagcuaggacuacaggcaagugcaaccaugcccggcuaauuaaaaaagaauuuuuuuuuuuuuuuuguagagacagggucuugcuuuguugcccaggcuggucucgaacccuuggcuucaagugauccucccuccucggccucucaaagugcugggguuacaggcaugagccacuguucauggccucuugcugaguacaugcuaacauggcuaagacauuugaguauggggacuucuccgaguuaugauagauuugcaaacaacacucaccuugacucuugaugcuggguccugaaaauagugugugcauuaauaccaaauaaggggaaaaucaggguuuaagaaggaccucagauaccacauauggagauagagaguucagacaacuuggcaaaaaucccuagauugagaugagauucugauaacacauuaaagggaacaggagcacacaaaaguacaaaacgggaaaagaauaguaggaaggcacuauggccaagauggggaaggggaugaaacaaguggaagcuuccugauauuaaauaaggggaagcaguaacuguauggcuaauuaaagagcagagccaucugccaaggcaagucauuuagggaacuuccagaggcgggaugauguagcagcugaacccugguaugggaaucuagcacacggucucagggguacuggcugaggacagcaggggaggagaagaaaguacaacagcuuaagcagcauaggccagauuuaaucucaggcuuuuaguuuaaggcaaauucaucuaguuauggaagcuacuguuagucauuuccacuuuagugugaaugaagaaccaauaguuuauaauaaugggacccugccaaacacuguuuagggcaaaaguguguaagaacugcuuccucuucucuaaauauaaucuguuggggugguguuggggaggcuuagcgcauuaagaguaagaacaaaaugcugggagguaauagacuauagugacuuuggagcguggacuuggaaucaggaauucugcucuaccacuccugaguuaugcaacauugcacaaguuauuucacuuccccugcuuuauucaucugugaaauggaaugauaguaucccagucauuagaccaucaaaaggaucaaacaagauacagccauuagcacaguaccuggcaugggguaaacauucaguaaguaugagcuguugcuuuucauuucagaaauuagacuuucaucaaggaaggugaaagacagggaccugccugaggagaggcaggaaaacgcuggccugccuugaauagugagcaugcgggccagcucgggaagaggauucgugugugguguagggcacagcagaaagcagaugagguggggccucacccuccaaugugucucugaaagugggagugucaugauucaaguggcauuucccaagaugauuuuggaggucuccgcaucaggaugggacauggcggggauuaaggcucuaacucaaggucgcagcaaugagaagacagagaaaaggggaagacuugggggauuauucaggaagaacuaacacuacccaguaacugacuggauguaggaaagagaggcaugauuuaaaggcugugagccucaaagguuccaggaggcugccgcaccaugaacagaagcaggggugucagucugaggaaggugcuggauugaagaaggggaaaggguggacuuggguuuaaauuugcugaauuucagguaucaccugggccaugaggaggcacugaaccccaguggggagaccagaagugccaaggcaagcacugucuagcugacauuuuagcccugggaaggcuaugugggguccuuuggguggaaggaagacagauuuggcacucccucucacuaguuucuccagagggaguuccaucagcucacugcugaccaccuggcccguccccaccccaccccagguaaagcagauaagugaauagcacggccuugcuuagcuuccaggcacguauuugcagggccaguccaucuaagagcagaccauucaauacaaugcugcccuggugaccgcgugcccaggucuugugaguugaguuccuggcugauugcuaguuaccucuggauuaauaagacaccucguuuuggguccaaucuuugaugcugagaaucuucguagggagcaugaagucuguuuuucucaaguggacauaguacucaaauaucucacuacgaugacugucaaucuugugauaucucacaauuaucacuguaauuuugaauugaccacagaacaugcacagaaaguugcuucuugcaauguguugguugcuugcaaacaaaucucuuauuugaugaugcuuucuuuucuaucuuuuuuuuuuuuuuugaaaugaagucuuacucugucgcccaggcuggagugcagugguacaaucucggcucacugcagccccugccucccagguucaagcaguucuccugccucagccuccagaguagcugauacuacaggcacacaccaucacaccuggcuaauuuuuguaauuuuagcagugauggaguuucaccauguugaucaggcugaucucgaacuccugaccucaggugaucugcccgcuucgggcucccagggugcugggauuauaggcgugagccaccgcaccuggcccuugaugauguuuucuuauucuuguccccuuccuuguaugggucuagcauuaaaaaaaagugggguacugacaaagagucugacuccagggugugguucuugcccauggugguucugguacauguggucuggugucauucuugaagggacccugcuacugccaugaagcaaauccaugaaggacuugaaaccauguucaggugugcaagauggugagcucgcucugguaaccaugugauagaugagguaacauggggcugugccaacaacauugcccagggaugagcuaacguauucagcagagcuccccuaggaagcuggaauaccuacacuaucauccuaauaccagacuggcugagguccacacaaguugaaucagcaggcuagguuuugaauugguuugaggaccuggaagaacugacuuuauagagagugcuuucccgagacgaaacucccuagugauguuaacauagccuuggaaacacauuuuuuccacaucucaugggccuguccugucuggacuaugacucaccuuaaauacaagauauuaaauguuuuugcuagcgcuuucuuauucugcaagcacugaauugggugggaaguucccauaggaaacuuauugcuaaccacguggauggucacaccugauucugggauuccuagaagccuagauagugaguuucccuaggaaauuucuccuucuuuucuugggaugagaucuuguuacauugcccagguuggucuuggacucccaggaguccaagcucaagccauccuccugccucagccuccugaguggcugagacuacaggugagcaaccaccaagccuggcuaggacacuucaucuuggagucccugcccacucucaggccccuacauacuaacccagugccugguauccucagacaucaggaaggguuucuugaacuaccuguaagggaggcucacccaucuuuaaagcuuagucucuauccguaggcccugcgcugacuaacaagaauucuaagcaaucugcuuagaaauagaugugcuuggcugggcacgggguggcucaugcccguaaucccagcacuuugggaggccaaggugggcagaucacgaggucaggagaucgagaccauccuggcuaacauggugaaaacccgucucuacuaaaaauacaaaaaauuagucaggcuaauuuugguagcacgugccuguagucccagcuacuuggaaggcugaggcagaagaauuguuugaaccugggaggcggagguugcagugcaccaagaucacaccacggcacuccagccuggcgacagagcgaggcucucucucacaaaaaaaaaaaaaaaaaaaaaaaaaagaagaagaaauagaugugccccuggggaagaggauguaagagauucccaagugaucuucuacuucaggagagcuggacuugcuaaaccuccuccugaaaacauuuugcgacgcugaaggccaaggccugaacucccugggaggaugcuacaauggggccaguucugcuguucccuguacacucggacaaccaaggaggaccaggagacuuaacaccuugggucuucaguagaagacuaaaguucuucagcucccugagaaccagacacguguuuagcaccacucugcccaaggaaaagauucacacuuuagaaaucccagcaaauccuucaggcgaggcugacggcacuggaaagugccugugggguccgacagugcaguauagggugacccucuuagaccaggagcuaccaagcagagguuuauucagucuccagaaggcuaugcagguuggaaaagauuucauagcggggcaucugcagaaauaggcagcagacacgcagagccucagccaccggguacuggccucuaggaaggauucuguccugcaggaucuuauccagugguugccaauccuggcugcacacuggacucaucugggugugucgaaaaaaaugcccauuccugggcugcacuccuaguuucucacuggucugggcguggagucugguacagguaucuuaaaaaaaacucccuagguagaaguacucaauuaaaacauuguuuuugaguaggagauacucagaugauuaggaagacaggaagguggaaaguuagaaaggaggagagggggacagauuagaagaaauuauguucguaggucuuuuuggggagugagaggccaaguacuacuugggaggugccaguauucacggagaauugagaaaauccagugggcugguucugggugaaggguacagacaccugauaacaccagcaccgccaccacuucaaucacgcggggguggacagggucaucgcgguucuccuggacugcuuuccauuuucauaaaauagggcagucaucucccaccugcacccugucccucuucugcccuccucauuccugcccuugacuguucuguauggagauggggcucugugucuggagugcaugggucuuaucuaaaaucccucgaacuugggagccgcccuuugcucauuucugguccgauugccucucuguuaagacauucgguuuggcuuuaagcgggcaaggaggagguugaauaaagggaucucugugugcgaauagcccccuucagacuuccauggagcagagcgcagggcgugauggcugcuuggcgggcgucuggcguuuguacuugcguauguuuuuacccuccaggccccggacucccauugucacagcccagccaccgugacucccuggcagacaaccccagacguuagccagccgcgcauaacugagcuccuccugcucuuucucaguguuuuccucuucuccagcuuggccccucuggucauuuucugagccguuuugugaugucuagagacugaaaagcugucuguuaucuaucccauccuuugcucaugcauucuuugcugaguguucucagauuuucucucagcuuccuagcaggauuucguguuucuucucccauuuuugguauuuucucuagugucgucccuaaggcugaaccuggaauagaaugcuccucuuacgcuaguguagggcuaguucuucucgugugugugucuuggguacuuaggauaaguauuacuguguguuugaguucagcuacaagacaauuuuucugagugcuaagaggaauugagaaggugcuagaugugggugcaguaaacagucugggccaggaacagccagacuguucaagugaggcucaaaagugccaaauagcacugcucugaaaucagggaaauggggaugucucucugaucacaggagaggaggaccugccuggugagaacuggaaggcuuugcauaaggaauuuaccauuuagcaaggcaagucacccuugcuuuuaucaggcugggggacagaggaguccaucuggcugggugugagcugugagaaaugggaacaaggugaagcaaagcuaugccaaugcacgugggacauguuaccucacagaaggagauugcaguggcauggaaauacucuuuucugcucuuauuggcauuuuucacaucagaaaucucugcauuggcacuuuggcuaauuuuaggcagugauuauuuuucuuuaauuaauggugcuuucuuuuuuugaguuuuguuuuuuauuucacuugaauuauuaguucccuaacagugcagggagacacagaaaggaguuuuucaugauuucuauaguagauuuuuuuuucuuuuuuugagacaggcucucacucuguuauccaggauggaguauaguagcacgaucauggcucacugcagcuucguccuuuagggcucaagagauccucccaacucagccuuccaaguagcugggacuacaggcacauaccaccaucccuggcuaaguuuuuaaaauuuguuuuguagagacagggucucccuguguugcccaggcuggucucgaacuccugggcucaagugaucccccugccuuggccucccaaagcguugggauuacaugugugagccagugcacccauccguagauuggguuuuaaaggugaggacauuaugccuuuacaaggacugggagaaacuacaugcaaaguauccuaacggucacgugaaccuggggcuuauuguagaacuuccaaaggcauuucuucuagagcaaccaucaguucuggccuuggagauuuuauucuuuuguuuauguaaaugaaaauaauuuccucauaaaacaggggauuucagauuuggcgccucuucagagcaaccauacauaaaaguaggaaacucauucuuuagaggcacgaggaagaaaauguucucaguacucccgaaauuggccuuggagcugcuguuuaugccucccucauccuugcuuuuuggguauguucucagggagucucuuuaacaacaugugugacccuuuuaggaagcugggcacuucaaagauaaugaauggaucucugaacuuggcuaaggcagcagacuucaagcacuaagacaaugcuuuuucacaaacaccagcugcuugucaacaaaggggaagagguagaaaguaauccagguuuaccuaguccuugggaaaggguuauggucugagccaguacaucagcugaacugacacuugaagagaagaaagcucaaaguaaacucaaauagagaaaauaagaacaagacucuugggauacauaugacuuugaccugucuccaaauuuccaccccauauccaugggagcuuggccucuguggagaacagggagucauggucuguggaacagagagagagaagauuaaucccauucacaaaaaagucguggguaauuuuuuuuaaucagcaaggagcauuuuaacuuacaaaaaaauaaggaauaauaauuccauaaauauuucauaagguuagcacuagcuagcuuuccucaauggcuuguaaugugcucagaagaugauuaaagaacagaucuuucuggaacauacugaucaucauauguuaaaucaggcuggacagaaguucaauuccuaauaauuagggaacauaaaaaaaugucagaggcaucacguuacuugacuucagacuauacuauuagggcuacaguaaccaaaacagcaugguacugguacaaaaacaaacaucuagaucaauggaauagagagcccagaaauaagccugcacgccuacaaccaucugaucuucaacaaagcuaacaaaaacaagcaauggggaaaagacucccuauucaauaaauggugcugggauaacuggcuagcaauaugcagaagauugaggcugaaccccuuccuuacaccauaugaaaaaauuaacucaagauggauuaaagauguaaauguaaaaccccaaacuauaaaagcccuggaagacaaccuaggcaauaccauucuggacauaggaacagguaaauauuucaugacaaagacaccaaaagcaauugcaacagaagcaaaaauugacaaaugggaccuaauuaaacuuaagagcuucugcacagcaaaagaaacuaucaacaggguauacagacaaccuacagaauaggagaaaauauuugcaaacuaugcaucugacaaaggucuaauauccagcaucuguaaggaacuuaaacaaauuuacaagaaaaaaccaaccccauuaaaaagugggcaaaggacaugaauggacacuuuucuaaagaagacacacauguggccaauaagcauaugaaaaaaagcucaacaucacugaucauuagagaaaugcagaucaaaaccacaaugagauaccaucuuacaccagucagaauugcuauuauuaaauagucaaaaaacaacagaugcuggcaagguugcggagaaaagggaacacuuauacucuguugguagggguguaaauuagcucaaccauuguggaaagcaguauggcgacuccucaaagagcuaaaaacagaacuaccauuugaugcagcaauucuauugcuggauauauacccagagggacauaaaucauucuaccauaaagacacaugaacaggaauguucauugcagcacuauucaccauagcaaagacaugggaucaacguaaaugcccaucaaugacagaucgaauaaagaaaaugugguacauauacaccauggaauacuaugcagccauaaaaaagaaugagaucaugucuuuugcaggaacacggagggaguuggaggccauuauccucagcaaacuaacacaggaacagaaaaccaaauaccacauguucucacuuacaagcgggaacuaaaugaugagaacucaugaacgcaaagaggggaacaacagacacugggucuacuugaggguggagggugggagaagggagaggagcagaaagggcaacuauuggguacuaggccuaacaccugggugauaaaauaugcuguacaacaaaccuccaugacacgaguuuaccuauguaacaaaccugcacauguacccccaaaccuaaaauaaacuuuuuuuaaaaaagaauauuuaaaacaaaaaaaagaaaaaugucaucuaaucaucaucaacuuuaauaucuaucccuauaucuagagcacuaacuuguacuacugcuucguugaauuaauuccuuaaggggaaauuccuauggaaaaugguuuaaaaggugagaaaggacuacaauaauaacuaacuaaaucacauuucagcauuguauagcauuaagcaggugaaaacauggaauggauuaauuugucccaguccaucaugaacuaagugaugugcugggucacaugaggaauagaaagauguuaggguuggacuccugucccauagggauuuacaaucaggaagugaagacaacuauacaugcaauuauaaaacaggcgaagugcaacugguccuacgauagaaauacaaauauaaaaaauaaucuccugggcuguaaucccagaguucccagacaaaugaggucuggcugcuuguucucgaguccaauaacaagaugcagacagacugggaaaggagggaguuuauuuuugcaaccaguuacaggaagaaggucagaguaacucaccagaucaacucaaaguuacaaguuuuccuuuagcuuauauacacaauucaagcucuaugucuacuugugggaguguuucuuaaucuaauuuuaacuaugggucuguggguaggaaaguuucuuaagugggucuuggugcacgcuuugaucccucaaucagguuugagguugaggaaguccagguaagguuuuaauagguuuguuuuugcauucgagcuuucuuacucaggcaccaguuaccccaguucguuauccauuguuuucuacuucugcuuuaauguuuaacuuauacauuccucauuacagcaaaggguuuauggagauccagccugcuacaccagcacuuugggaggcugaggugggaggaucacuugagcccaggaguuugacaccagccugggagccugggcaauauagugagaccucaucucuaaaaaauaaaauauaaauuagccaggcgugguggugugcaccuguagucccagcuacucaagaggcugaggcaggaggauugcuugacccugggaggucaaggcuacagugagcuaugauugcgccacugcucuccagccugagugacggggcaaaaaaguuuuuuuuccuguagucccagcuacucgagaggcugaggcaggaggauugcuuaaacccaggaguuugaggcuguagugccugugauugugccugugaauagccacuggauugcagccuggggcaacagcgagauuucgucucugaaaaacaaaaaaaauucuuacugaguaggucagaacuaaauucaugaaagaggaaaugggcuuucaggcaaggggaucaguauguucaagaugugggaaaacugugugucguuugcaggaaaaauaaaaauacaauaguccacccuuaucccuucaggggauacuuucuaaaacccccaguggaugccugaaacuguggauaguaccgaacuuuauacaguauauauuaauaguauauauuaauacuauguuuuuuccaauauuuuccuauauauacauaccucugauaaaaucuguuuuguaaauuaggcacgguaagagauuaacaacagcaacuaauaguaaaauagaacaacuauaacaauaaaccaaauuuauuauucuugcgcuuuggggccauuauuaaguaaaauaaggguuucuuggaacacaagcacugugauaccaugacagucaaucugacagcugagacagcuacugacugacuaaugagugggugguguugacagcguggauacccacacaaaggaaaaaauucacaucccagccuggacagagcuggauggggugagauuucaucacgcuacucaggacuguguggaauguaaaaccagaaaguguuuguuuuuggaauuucccauguaauauuuucggaccaaaacugacugcauauaacugaaacuggaaagcaaaaccauggaugagggcggacuccuauacuuuacauuaauaaugggcuuuacaccucccagauaaauuuuauuuuuauuuuuacuuuuuuaaaaauaaugagauagggucuugcuacguugccaggcuggucucaaacuucugggcucaagugauccuccugccucggccucccaaagugcugggauuacagcugugaaccacagcaccuagccucacagcaaguuuuuauagccauuacuucauuuuguuuuuccuagcaaucuugugagagaagccagucauuuuacagauaaagaaauugagguucagugggacuaagugucuugugcgaggucacacagacuggaaauggggugggcaggacaugaauuuagguuuucugaguccaaacccagggccuccccgaugcuaccgugauaccugucuacauaauccguauggcuggaguguugugucucauuuugcuuuguuggagagugagguguuugcggagaagaaaacagaaucuuaagaacuguaggccaaacuagauuacagagguuuucaaugucaagccaaggagauuaguuaugucuacaagcuaccaagauagaaagaaaaacaagaaaguaaaagcauuaauauauuuuggagaaaaggucacauauugcuggaaucauaaaccggugucauggcuuuacuauuugcacccggucugaaauguuucugagguguuaucugagugguucuggauaaguagcuuagacuugcaaccccaaauaggugggaaucauccuccuuuuacugaauucuggguggaugauaaccccaucguggccaaauggcugaaguccuacccauaucuuagaauaaagugaucugggaacccgagcccuuuuuauuggauuuuaauguuuucaaucaguguuuaaugugaaaaucaguauuugaaaauaugcuuuguguuucgucuugcaaaucauuaaaaagaugccauaugcauagaauuaccuuguauggcaggaauccuaggaaaacuuuaaaagucaauguuaacacuuaguaaacacuccuggguagaguccagcaauccuucuauuagagaaaauguuuucucucugggauuugaaauguuuuagauuuacaucuuccucuugagaaaaacuuucuaacuaccagaaagaagauaaugguccugaaugaauacauuuacuaaacuguaaaauccagaauagauaagaucuggcucuggguagcuuuucccagccucauuucuugccacaucccuccugaacccugagcuccagccauaaugaacuugcuguggcuccucaagcaugucuugcccucccuagccccuagccuuugcacaugccauuuuuuucuagaauauuccccccauuucccaccccuccguagcuuugcuugguuaacuccuagauauccuguaugucucagauuaguuuccuuuuuguuugacaaaccuccuuugaccuuuccucaccucucuucacuccugaauccaaccccuccaacuuagaaugugggccugguucuuacaugacucucccuuaucauagcauuuucacaaugcauugaaauugcugcauaccccauuagaucgugggcucugugcugcuaaggaccagucaauugauucucucuaguucuuuccuguguuccaacgccuggcguugagcagguaaucagcaaacugcugaguaguugagugaaccaaugucacuaccaaaauacacaguuuaguauuuuccuaugaagguuuaaauaacaagaguuuaggaaccauuccaagaaacuggcuuuuguuguugcagaucauugaaaagauuuucaggggacucuggacuaugcuagacauagcuagcuaugacuacuuuuauuccacaguuuguagaagggcaugguuuagcauuuggaaaagauucaagugcagagauuuugauuaacugugaccuauuuacaaauugguccucagcuguuuguagguacaaacaggucaauguuuggguaugcccuuuuuauguuucugacucagccacucaacuagagcaauaaaaugaccagaguugcugauucucaauuuuuacccuuauacuaacauagaucguaaguuaaauaucuauaaaacaguagcaauuucauuuaaaaacuuagauaaaacccaggagauaaaagauaaagauuaacgcuguagcaacauauuccuuuauuagucaauuuauaaaauuuaaaaauuggagguuaaguggucagauuuuuuagugggagaagcccgagugacauuuagaguaacgauugaaaacugcaggccggcaugauggcuaucaccuguaaucccagcacuuugggaggccaaggugggcagaucccuugagccuaggaguuucacagcagccugggcaacacggugaaaccccaucucuaccccuccaaaaaacacacaaaaaauaaaauuuagcugggugugaaggcaugugccugugaucccagcuacuugggaggcuaaggugguuggaucccuucagccuagugaucuucccaccucgggagguugcagugagcugagauugcaccacugcacuccagccugggugacuaaaaacaaacaaacaaauaaaacugcagaagugcaagucuguguugacaagcaauauuuuuauauugggaaaauggauuuaaaagaaacaaccagcaaagcauaagccucaguuauacaaagauguuaagaacauuuguaugguuuuaagagaaaaacaugaauuuagauucuauuucccaacaugaagaaacugccgauuccacaaugcagagggaaaucucuugcuaaggugcagauccuuucuagugagcugggugacaagagaaaguauagagauucuccucuugugauaaauaaauccuucccuacuaauauuuucauauuccuaaaugaugguauagccaaugaacuugagacuuagaagggcccugagauccaucuugaccaaaucucuuauauaagaggccccagggguuaaauauuugccucagcucauuccuagauaacggcagaaaaggaacuagaauuacaggaauucaacuucuugcacuuuauuaauaacauagcaaaaacaugaucuguucucaauuggcuggcuaccauggaaacagugcgaagcuaagagauuaggaaggugcugaggaaagccauuaagcauccacagcuccacugccuaggcagauggucagcaggcaguuuaguugugggaguauuuccaauuugcaugaaugaaacauggacaaauaagauaaggcuggcuccagggaaguaauucccccaguuccccugagccuuggaucuggaaaacugcagcccauccuggaauuagggaacaucacaaaacguacuggggagaacuccccauguggccucggcccacgccaggaggcggucaaggucccaggugccggcucgcccacaagcuauggcuaagacagaaaaacaaaggaaaaaaaguccuccccaaacacacacauaagcaaaacccaucuuccuguguucucugccaagagagcuggagcaaaagagaugaguuugagacucugauucauccaucaagacaaauaaacucagucuauggagguuagcagggcaauuugugaagcaaacaaaaguugaguuuuggaaaggggcucugaagaaaaugaagaugacaucccaggaauuuaacuucaugacaagaagagaaagugacucacucuugacgcguggaguacugaaaaugccaacaggcaaacacccccaaaaggcagcuccagagacuauccggccacggcgucggcccuccucccaauccgcaaaaacgugcagucugaguuccgagcuagcguccugcugagcugaaggagcaucuccaguggagaagacggcccgauggcaccguuccauuucagcagcagcaaaagaagcucugauugguauaaugcacuuccuccaguggcgccaagcuccugggcuggccuggggcauccacccuugcucuuuggucaaaaccacugucuuuaccugcauucacuucucugguggccuccuggccucaaccucaggaaaucucuaacacaucuuugagucauuuacuccauucccguuaucucucucugcuccacgguccucacucccagaggacucucaggguugucuggccagguguuccuuugcucccuacccccaucuccagccccagcauggaccauagcugugaguuugugcucagacuccauacacucuuugucccugaguaucacuagaguaucugguuaaggucccauccacccuucugguggcaugggucuuccaucccuuuaucaaauccaccccccacuuuuuagguggagcuaauucugcuccccuugaguguggucuguacuuagugacuuacucuggugacgcacuugaauaaaauacagugggagggacagugcaugccugcagcuucuuucuugcuuuuugugggaucacuugcucugggagaagccagugcugugcuguuaggaugcucaaagggcacaaaggagagguccaugugaugaggaacuggguccuccugacaacggccaugugagugagucaauccaaagccagaacaaagucccugcugacauacugacugcagccucaggggacacuccaggccagaaccacaaaacuaagcuacucccaaguuuuugauccacagaaacugugugagaugguaaauauuuauuauuauuuuaggcugcuaaguuuuggacuaauuuauuaugcaguagcaaacaaauaauauuuuccuuuaguuuuaaguuuuuuuuuuuggagauggagucuugcucugucgcccaggcuggagugcauuggugugaucucggcuuacugcaaccuccgccucuuggguucaagugauucuccugccuuagccucccaaguagcugagauuacagguaugcgccaccaugcccagugaauuuuguauuuuuaguagagaugggguuucaccauguugguagggcugguuucgaacuccugaccucaggugauucaccugccucggccuccuaaagugcugggauuacagacaugagccaccaugcuuggcuuuaauuguuuuaaaagaagaaaaaaaaacugaauaauacaacaucuuugaacuuucuccaucaucagcuagaguucuuucuuaauuaauaaucauaaucucuuuuuggaagguuuuuuuuuuuuugguguguuuuuagucauaaaguccucucuccaagaauuaggguaaaaaaccaaaaacaaaacaaaguaucaauaacauauucaaacaaaguccucauggauggacaguuauuuauuugggaacauuaugaguugaccccaagaagaugucugcaaugaugauauauauuuucaagggcuguucuuaacauguucuuuguaccugccauccuagaaucuuuuauguuacuuucaucauuauacgaaaaagagcuggaacuuauauccucccagggaccccaaaacguaagccuuaacugugagccucuauaaccuuaaacagugcauggaagacacaagggauuuuuuuuuguuagucuuguauuuacacuuuaagaaauaauaagugagauuaacuugucauaugccauaacacagauguaccuguaggacauuaugcuaaaagaaagaagccagucccagaagggcaaauaugacaugauuccauuuguaugagguaucuaaaguauuuaaacuuauagaagcagacacagaauggugggugccgggggcuaggguaagggagaaaugaggaguugcuguucaauggguauaaaauucuagagaccugcuguacagcaaugugcuuauaguuaacagcacuguacugcacacuuaaaacuuugugaagagggcagauuucauauuauguguuuucuaucacaaaacacaucaagaaaaaacauagugagugagauuaaaaugaccuuauuccaagauucaaagcagugauugcuuuuuugcaacacuucaggacuucuccaauagaccaccgaguauuguauggucucaaaaauuccucaaaacuaaaaaaaauaaaaaauaaaaaguuuuacuuguuuuucauaaaaaacaaaaaauguugcucucuucccccuggagaauaauugauaggguagcgaaaaauguggauaucauaaaauaucuaaaccaaacauaaggagaagagguugugguuacaagaaauuugggaaucacugaucuggaaauagguugagguuucaaaagaagugggcuuuaggcugggagugguggcucaugccguagucacagcacuuugggaggcugaggugggcagaucucuugaguccaggaguucaagaccagccugggcaacagcccuguguggaugugcaugccuauaguccuagauacuugggaggccgaggugggagaaucgcuugagccugggagguggagguugcagugagccaagaucgugccacuguacucuagccugggugacagagacccugucucaaaaaaaaaaaaaaaaagugaguuuaacaaaaaauaugugagcauuugaaaugcuaaccuccagucaaaggacugacaucaucaguuuacuaucuaauuuccccuauagcaaagauguguagacacaacacccaagggaggcgggggaaacggcagccagugacaagcgaugacaauaaguaaugagcuaaugcacagauaagaugggccuagaaacacaucaguaacggcagagaaaaauaaaggaggcugagauacuuucuauucaguagugcaugguuggagucaaaaaugaagaacauacaaauggcaggauuuugucauauuauuuuccacagaaaaaauaaaagaaaauaucaaaagaugggaacuggcacaugaaagguugaacugucacagugcauguauauaauuaucacugccaagcaguaaaccaagaaugggauuaguugaaggcaccgagggaagugaaaggaaaccggauauacaaggagaaagggacagauuguguuuaaauuuagaacaugggcucaugcccucaaaguugacugauagcuggagcaugcuuucucuucagucauuccuccauuugcuacuuuuuuuuuuacaauaaaagcuaauucugugaagcuuuccauggccacuuuuggaugcaggccccuucugaaggacacgagagaaaugugaaagugguaaggaagccuuucuggccaagauuggagaaauucucugagccccucacccagcucacccauaagccuagagggucuuaugugggugguugaaucaccaguuugaaccgccaggcuugccccucccaggccuccuucuagggguguuuuuaggaggaaggagaccucauguacuuuccuggcauuguuucaagacaggaucucaccaagacaucuugaguuguccaguaaagaaacucaacuuaguggggaagcuugacugcccauuuggggucuugggccaucuguggggcuggagggagcagaaaagagaaucaagacagcaaauaggccuggggugauggcucaugccuauaaucccagugcuuugggaggccgaggugagaggauuguuggggccagauguucgagaccagccugggcaacauagugaggucuggucucuacaaaaaauaaaacaaaaaauaaaaaauuagccaggucugguggcuguccagccuguccuugugcugucuuuuuaaguuuuccuuagauggucuguccuucugugguggcaccugccuguagucacagcuacucgggagguggagguagaagcauugcuugacuccaggaguuugaggcuucagugagccaugaugucaccacugcacuccagccugggugacagagaaggcccuaucucuaaaaaaacaaacaaacaaaaaagacagcaaauaagcagagagaaggugggcaggagccacacauuacagaaacuucucauuauugagauuucuaucuuucuaggcuguuuauggucucucacaacaaaacaaaauggggucaggugcgguggcucccuccugcaaucccagcacuuugggaggccgaggcaggugaaucacuugaggucagcaguuucagaacagacuggccaacaugacaaaacccugucucuacuaaaaauauaaaacagcugggcauggugguguacaccuguaaucccagcuacucgggaggcugaggcaggagaauugcuugaaccccagaggcagagguugcagugagccggaaucgugccauugcacuccagccuggguggcaaagugagauccugucucaaaaaaacaaaagacaaaaaacaccgaaauggaagguccucagugggaacuauucagcaccagcccucuguagguccugggaaucuuaagugagucuuuccucuuucuucuagaaguucucccagaguaccauauuuuucccucaaaaugacuggaaaaauucauuguauaaugucuuauuaagaaaguaauuuucuaaagagguugguuuaaauaaaaacaaaaaccacauaaauauucagcuuauguuugagggagcuuuuucuacuuccucuaucccgucccuuccccacaacuaaacaaaaaauuugauugucuuauuauguuaacacagauucaguuuaucuaugcauuuccauuauggcuaacaaauaaaaaaaguacauguccugcugaaaaucacacuuaacaaaucccuuuggggacagaaaaaagugcaaaccauuuaaaaauauuaguuugugggaggaagaagucaguugcaaaucacuccucugcauuauccucuaguuaaaugaguuggaugccccaggccacauuuauaaugauguaaggcucucaaucucuuacugcaggccugaaccauaacuguucucaaaucaaacaugcaauguacaaccaaaagguucaauaagaagaccuuuguuuucucuucugaaagucuaagacaacacaagccagcucacaaacuggccgcagggguaaugagcauuggauacaagggauguucagugcauuuuucuacuugauuaaaaucgauuaauucuaaaacacaaauguguucaagcuuguggaucaguguugaaugcuguaacacacacaucucaauguauuaaauaaucuguucacauaaaauugcuaauuaaaaaggccaauucauuugaagauggguucucccugcaccuauucauugcacacuacuucauauuucuucugcucugaacacaccuggcccugcaaguuacugaagucccgaggguccaugugcauaaggugguggcaaagccugucuagaagaagugugugaaucuauauaagguaccgcaugagcauauguuggucaaaagugaugcccaucaaugcaguacuccagauccuacugaaaacacuguuuuugauauauugggggggaaugaaauacuugguguuuacaaagaauguuccuccugcugcagccucuggaaagccacuucuagucaaccauucaauuccaugcugucauugaauauacauacaucucagcaagucagagaggucugcaugcguuaggagagcaggaucugucaguaggaggccuauuuggggcuuuuacaucugaugugucuauuuccuuucuuuaucugugcugacaacuaaguuugcacucagucugguaucauagcugguucuuaaucacuugggguuagauuaagcaacccuggaucucuaacacuggccauguugcaacacacacaaggaaauugggucucucuuucuuuuucccuggguggucacugugugggcaguguccucuaacagcacacauguggccaucaggcucuccgcccagaauaagggacugaucucaguugauaucagaauaggucuaagggagccacaucagccuugcuguggcauauuuggucauggaggcuagcaggguacuccuaggcagguuucauaugggcugucaaagcuuugggucugcuuaggaagguuugucuugaacagcuuuuucucugaggauugggaaccuuggcugggguaagggaggugauuauuaaaaauguccuaggcuuggugcaguggcucaugccuguaaucccagcacauugggaggcugagauggaaagauugcuugaggacagaaguucgagaccagccugggaaacauggugagaccccuaucucuuuuuuuaaauuuaaauuuuaauaaaaaaaaccuuuuauuuuagguuuggggguacaugugaagguuuguuacauagguaaauuugugucacgggggucuguuguacagauuguuucaucacccagguauuaagcucaguacucgauaguuaucuuuccugcuccucucccuccucccacccuccacugucagguagaccccagugucuguuauauccuuuuuuggguucaugaguucucaucauuuagcucccacuuauaagugagaacacaugguauuugguuuucuguuucuacguuaguuugcuaaggauaauggccuccagcuccauucauguucccacaaaagacacgaucucauucuuuuuuauggcugcagauacccuaucucuacaaaaauauauaaaauuagcugaguguguuuguguggggugccccuguggucccagcuacuuaggaggcuguggcagaaggauugcuugagcccaggagguugaugauacaacgagcuguguucacgccacugcacuccagccuggguuacagagggagacccugucucaaaaaaauuaaauagucaguugcaguuguguucuuuaaguuccuaucuuucugucagugccaccuagauggccugucaaaaccuugacccagccaccaccagcguugcugcugccuagccaccaccagcaggggugcugcccgguaccuugugggcaaaaggcuacagcaggaguuggugaccuucacaaugccuagugacacagggauuucugccuugccugaaucaggcaaccuuuucaaauggguggggaccauccauugagcagcuggcacagcauaugaagaccugagguauaagcucucccuagagcuccccaggggcuacccuuacaauguacccauggugaaguuccucacgcccugcuaccaccccaacauggacacccaggguaauaucugccuggacauccugaaggacaaguggucugcccuguaugaugucaggaccauccugcucuccauccacagccuucgaggcaaacccaacauugauagcucguugaacaggcaugcugccaagcucuggaaaccccccacagcuuuuaagaagcaccugcaagaaaccuacuuaaagcaggucaccagccaggagcccugacccaggcugcccagccuguccuugugucgucuuuuuaaguuuuccuuagauggucuguccuuucugugauuuuuguauagcacucuguaucuugagcugugguauuauuauuauuauuauuauuagucuuuuaagccuccaguugagugcuugugauguauauuaaauaaaugcauuuuggguugggcaugguggugcaguucugugaucccagcacuuugggaggcugagaggggaggauugcuugaguucaggaguucaagaccagcccggacaacauagcaaaacccugucuccauaaaaaauguaaaaauuagcugggcaugguggugugugccuguaguuccagcuacucaggggacugaggugggaggauugcucaagccagagaaguugagguugaaauaagcugagauuccugccagugcacuccagcaugggugacagagugacccugacucaaaaaaaaaaaaauuaaauaaauaaauaaauaacaacaaaaugccccagaacugcccaagauuacuagugucucuggcucaugaggucagacuaggaggggccucuucaaacagcccccuaagcuuccacaacuacaguuacaggccaggcuacaagccaacccagaugccaauuccacugucaccaccaccacauccacggccacagcccauuuguggugagccuucuaaagcguguucucuuuaucugauccucaggacaguccuguggaguugaucgggagugaucauaaucucuaucgcacaaaggugaggaaaaagggaagaggaaagaugggaggaccuagcgacuuucccaagggcagcagcucacccagccacuguccuggcaccagcaagcgagcuuccaaacucugcccaucguacuuuccucuuuggaaaaugcaucucucucucucucucucucucucucucuuuuuucuuuugagacacagucucgcugugucacccaggcuggagugcaguggagcaaucccagcucacuacaaccuccaccucccaaguucaagcgauucuccugucucagccucccgaguagcugggauuacagguucgugccaccacgccuggcuaauuuugguauuuuuaguggagacggggucuugccauguuggccagucuugucuugaacuccuggccucaagugaucugcuugccucugccucccaaagugcugggauuacaggcgugagccaccucguccggccugaaaauuuaccucuaaucccaaauaaaaacauuccccccacccaccauuuucuccugccucugaagguguuaaaaaguuaaaaagaagcugcaacuggcaucuggccucuacuucccauucaggggagugugaaaguacuauaggcuucacccauuucucuccucacaugagacacaaaagagucuccagccugacuucaggggcuuacgucacuuuugcccagacucucccauuucuuuccucuaccucuuaaaguuggaggaaggcccuuuuuccauagcauccucugccucuguccuauuuauaccauuugaaaaccaagcucuuuuaaacacuuuuucagacagcuugcuucuuuuaagucuuucaauuaaaagaaagaaagaaaagauacagcacccaacuaaaacacagccacaagcacccaaggacugucaugcuucaggaauuuaaauuguacuucauuuggcauaaucuguguuaaaacaauauagcauuaucugcuuugaaugcacuaggcacccucaggguggaguugcauuuuguaugaguuauuaaaucugguuggaacucaacaagaaacagugccauguggggaaauccgugcugauuggacccuugacugaucacacgucaaagccucgugcuuugcuaaagggcaucuuccuuuaaaaauaagcaauccuauuacucagagccuucucugcacaccgugucuuugaaggaauuugauaguuugcaaauucaaaguuggaaauuaaaaucccacaaauaagacuugaauccauuuauucaugcuaaaaugaguauagcuuuggaaagucuuuccuuauuaggaucauuucaguauaaucugugaucuggugugagguugcuuaacuaaccuccugcccacuaaaggagacauauuuucuaagauaagcucugccuucaaaggacucaggagaucccauagaauaauauuaacugaagugcauuucuuuuaaaauaauguuucauuguuuccuuaaucuguguuauuuuuauuuugccaggcuuaggauaucuucuccuccccuaaaaugcauuaaaauaaauccuggccccugcaggagugaucaaagcucuaccauucacagaggaaugucuauuccuccaagcuuggggagguuuccuaacuaaugaacuagaacauugucagaugucucauugccaaguaauauauuaaagugcuuuucuaaugagauuucugcaagguaaccauaaaaccauaaaaagcacacuaagcuucagugaagcaaaaacauuaaaaaaauaaccaaaugccuuuuagagauagaagaggucaacacaacagcuaaaaaaagcuaaagagaauuugacaaguagaaaaauaaaguccagauaauuuucacauuugaaaaaaaagguagacacaaggcagaggaaugugguggguagacaggucaucaaggagcuaccugaauaucuguguaugacugaaguaccugccuuuccacucauccuuguccacuuggaacauggaucuguuauauauaacuauauaugggcccuaugaacaucucuuuauuuucagaacuuucgagaauucaggaauacgauauaaaaaucucgaauaccaaggcucuugucucagucggccugggcugcuauaacaaauaccauggacuugguggcuuaagcaucugaaguguauugaaugggaaguccaagaucagggugcgagcaugguaggguucuggggaggcccacuucuuggcuuguagauggcugccuucuugcuguagccucacaugguggaaagagagaucaucuuucuuugucucuucuuauagcacacuaaucccauucaccucucgaaggccucaccugugaauaccaucacacuggggguuaaagcuuccacagagaaauuuucugggggacaccaauauucagaccauagcugaucucuuuacuagaaccaacguaccaaggaauucuugcucaaagcacaaacaacaggaaugccaugaagccucuaccauggaucacuuggaaacaguccuuggaugucccucucuuggcucuugcuugucacuccuccuucauuauuuaaccaugcaaccucccugacaucagugaagccagaaagcuaagaagccagccauuuuggucaccuucguguaagcguauggcuccagccugcucuguacagauccgacagucuugcagcacuggcucccuuccaagaggugaagaguagaaccgacagauuaaaggaucuuguggggucugaaaaccagcuuagaaggugacguggguguuuagcuuaaggaagagaagccugggguggggacacaccugugaaauauccucuacauuugaagggaagccaugucagagaaugagcagucuugauuuuaguuacuucagagggaagcacuaagaucaaagaaucauuaccuauuuaaggucaagguaacgaaggucugucagcaguaaaggauauccaacaauaaagagacuuccugaaaacgcagucauguguaucugagcaauaguugaaaguugucagggauguauccuucaucuuacucauaauuucaaucauauccaaucaaaugauggcuugauuccaaaggaaaauuuuuuaugaauaaauauuauuuauuuuaaacgcuaaccucacuaguacugaaacaugauuuacucaaaauuaauaguauuaaaguauuuuucaaaauauguacucuguaugucaguauaguguggaaacagaaaaacaaaaaacaaaauauggugcucugcguuuauaugaaagagacaaagcagaauaaggcaugcauucauggauguuauacauucacuucuaugagaccacagaacgcauccaaacaguccuccuuuuauagcaguucuucaagaaaggcauauuuauuuauuuauugagacagagucucacucugucugucgcccaggcugggauguagugaugugaucucggcucacugcaaccuccaucucccggguucaagcgauucuccugccucagccuccugaguagcugagauuacaagcacaugccaccauacccggcuaauuuuuguauuuuuaguagaaacgggguuugaccauguuggccaggcuggucucaaacuccugacuucaagugaucugccugccucagcaucccaaagugcuaggguuacagucgugagccaccacagcugaccaaaagaaggcauauuuuaaaaggucaaauaauugacagaacauauuacucuggcacuccaaggccaaugcaaaugcuggaaugcagccuucaguugaaucuuguacugaagcaucaucagucuucaggaauguaacaggaaaugaaaugcaaagggaacagaacugccgcgucacucacagaaucucugcauucacacaggucugcauuccgauccaggugaugcuggcuaaaugacuuaacgguuugagccucaguuuucucaucuacagaaugggguaauaacagcacucaggccucguggaguguugugaugcaggcgcagggcuucccaugcugucuggcacacagagcacucaaucaauaaaucggcacuauuacuuacaauuucaaaacaauuauuuuaaaaugcaauaggauuuguuuccuugguuaagggggagcuggaccggaugacuuucaugguuccugucaacaaccacauucuauuauccuguuucauguuacucuuuuccccccucaacucauuccugccacgcaccacccaccccacccaacuguggccacgguaacaaaaucaacagcaauaccuguucacugacugcucacuaugggcauucauauguguaaauaauuuaacccucacgacagcccugugagguucguacugucuccuauuuuacagaggaggaaacugagacacagaaaggucgaguaacuugcccagugcuacaaggcucauaaaugauagagcugggauuaaaaagcuagacaccuccuaaccacuauuccauauuaccucauagguaaccuaaaauucugccucaacaaauuaauuagccacugcacaaguaaacuacuugguguagcugaugggaaagcgguaaaacucgauuucaaacuugucuaaaaaaaaaaaagaaaaaugguaaaagauccacuguuugccuucagucuccucuuagucuucaaugcaguucuuccagcucuuaaucugaagagcuucgcuccugcuuaaugauuucucuuccuccccucucacagaacacccuuacccuugaugggccagugauauaaauaugcauuucccauucacuugugaguuuaggauuuuuuuuuuuuaaagagcucuaccauguuccuuugaucuuugcuuuuuaugcagacgggguccacagagaaccagcuaauccagagccuacagagcccggagcacagucaggcauuucagaaaugcacauggaugguaacuaggagauuucuugaacaauagaaaguucccaacaaagcuguuagggcucaagaggaccagcuccaccacccaccccugcugaucugggagcugcuaccugggcugagcuggcucccguccacagggcccccaguucucuggcucaauucaauaccuccugcugcgguggcuuguuucuucuuguccugaauguuguucuucagagcugaugauuaaugccuuccauuuagggugagaaaaaugaccuugcugucuaugcaagugaggaucauuuauuccaucuacaaaagcagcacacaucuacuuggcucaacucagaguauuucucuuugcugucuucuuguuaaacacgaucguuucuucaagcgagguuuauguugucuugugauuucccuuuuuugguguguguguguguguuuuaaaaaaacaaauugcaggugauacguggcauuuugcauugcuaaaauucacaucccacuguacuucauuaguaaaagccauuuaucccccaccuuucaacacugcuggcugagacgcaaauagaaccauuucaguuuuccaguugaacagccaugggaaaaaaaaaagagcagagccuugcuuaucucuguguuacacauuaacacgguccuccuuugcagagguucuucaagguagacagacuuuaaaaagucaaauaauugacagaauaauuacccuggcacuccaaggccaaugcaaaugcugggauguagccuucagcuaaauucuacacugaaguuucagucuucaggaaaguaauagaaaaugaaaugcaaaggaaagggaauuucccaauuucuccacuaagauuuuuuuuaaaccucaagugaaaaaaaucuaguaagucaaauucuauaugaaaucuucccaguuaucuucuguccaacaucuaacagcgcuuuuccuaucacucucaugcuauuugucucauuaauaauuguuaauaauaaaaguuacuacuguccuuaccauugccucuauuaucauuuacugaguuuacuguaugccaggcacagugcaggcucauccauauauuaucucagguaauccucacagaaaucuaguuaaguggcuaugcuuauuaccccauuguagagaugaggaauuggaggcuuugagagguuaaauaacuugcccagaaucacagagcacaugggaagcagagccaggauucaggguagguuugacucuagaacuuccauccugaccacgauucccacgguuuucugagugauggccuauugacauggcccuuuagcccaacacagggucucccacagggcuugguggguaccugaaugaaugaaugacuacaagaaugaaugaaccaaugacaaagugaaugagauuucugaagacuggauuuucaaaauaacauacuuuaucucaguaagaaaagcaagaaaugucuaaaacugaguaugggaauacuuaggacuuuaaaaugagauaauuucucuaccugucuaagauucaaaggagggaaauugacacugcugcauucuacucacauugcccgagugcuccagccuacagggguuauagcugaaacaacggaagcugauauauucaaaagaauauugauugcagacacacgaaggguuuuccuaaaguugguaucagaaccuuucuuccaauacugaguccccaucuucccauuuagaggaagauuuugagugaaauuuauuuuauuuuuugagacaggaucucacuuuucacccaggguggagugcaguagcaugaucauggcucacugcagccucuaacucauaggcucaagugauccucccacuccagccuccuaaguggcugggacuacagaugugcaccaccacaccuggcugacauuuucuuuucuuacuuuuuauuuagaacugaccagagagaauacuagucuuacucacucacccuaugccuaccgugcacaccgauccaggaaaugucaggagacaaaccaaacagccaaugaaaaggaaaaugcuaaaagacauuagcuggaucagcaccaccaaugaaaguguguugggucacaaaaacgaccugcagcuuuccuuuccacugccaaggggauaucucuguuggcuuccgcucaucaaucucuccuccuuggcccuggccaauguucucagaaugucuccggugggcugaggaugcugacagaugccaucugguccuucucaccuuuccuuuccuggaagucaacacccauuuccucuauggagcuucccccuuuugucagcaggggaagugaagaucccaaccuggguacuuaaaaugggccuugagugauacuuucuggaacauucuuagcuucagggcagggcccagggaaagugccucuaaugauccuaauguuaguuuuaaacuugcuugguaaucacuuuggaauugcccauuuuuuuuucacagagcuuucuggcccauacucagcuauggguucuaagucugaaagccuguuagggcauuaaaaaugacagcuguuaaaaugcuuaagaauuaugaagggaggaagcuaaugcuuagauuuaccccccaccagccccucccacucacaccauagaccacauauuuuccccucagaaaggaaaacauuccugaccucuguuuaaauguuuaucagaaguugucuggacuuguaaauucucugaagucacacucuuuauuagucacauccuucuugguguguggugugacccuucuaucagggcagggggaaugucgggccuugugcagaaaucauuuggugcgggaaacaucaaccaccacccagagauuuucauguagcccaaacacaagcagaagcugagcaaggaccuugagcuuccccaugguggcagggcuuccguuuugaauaugugugaaaaaaauuccuuaguucugaguccgcuggggccuugauuuuaaaacaaagccccagcaugaagucuggcuccagagaaagaaaaguggaaguucuagguccucagcacaaaauaaaggacuauucagaguucuauucuggcuccaaagugcugcugcuuuggguuugcaauugaaucacccugccuuccugguccuuugacguugauaacuuagcuucuacuugggauucuguguaaacaguuugcauccaacagacuuuggcuuaccaggugaaaggcacuguuguagaaccgacucggggaugcuggugugugagaaagaaagguacuacuagagcaacagaaaaugcacugauuagcaaguaggggaaguggguuuugguaccauuucuccccacauuuuacuuaguccucaguuuuuucaucuguaaaauggaaagguugaagcaaugaucuaggagguccuuuggggucaagaauccucuuugucucuacaucagaaguggaggaacaggugugaguuucagcccaaggaauaucaguuauaauaagaaagacuuuccugagagaaggcugaguuuacaaaggaugcucugugauuuuccucuuuugaccagugugggucccaaaucgcggucucagagagcucuucugggaccugcgucuuuggaguugccauguuugaaaucucuuagacuaagaugauacagggaagugguuagggaaagguuaaugaugaacugaaauaucaccccagaaucauucuagaucuaugaguguauaguuuuaaauuugaaucaaguuuuugguaauuagaagaaggaaagaaaagaaccuucgaaauuuaguuaugaggaauaucaaugauguagugguucaguauucuuuuaaaauauuuuguugcuauuuaaaaaaugcaaaagugcaugcucacuguaacaauucaaauauacaaauauauaaagaagcagcaaguugucuacuuuuaccuccugauaauccuaaccccccaacaacuuauauaaacuguuuauacauauaguuuuuauuuuuuuaaugaaaauuucauaccuauuaacaugcaagcugcuuuaaauuuuuuuuaaaguuuuauuuuaagacacaggguuugucuauguugccuaggcuuaucuugaacuccuggccucaagcuuccugaguagcugggucuacagguguacaccaccacaccuggcuuaaacugccuuuuuuucagugaacaauccauguauuauguauuagcuuuauuaguucaauacacauaaaucaaauucauucuuuccaauagcugcaaaauguccccaaacaugggcauaauucuuuaagaauauuccagauguuccaaauucuucuauauacaaacuaugauacaauaaauauucuuaauacuuaugucccuaugcguuagcacuuuuguuucuguaggagagguuuccagaaauaagauugcugggucaaaggguaugagaauguuuaauuuuaauaaauacuccuagauuacuuuugaaaagcuuguuaggaauucuggucuuggcaauagugcaggaagguccccauuucccugcacauuucccagcagugggagugagaaauuuucaaaaaauuuggcuaagcugaacggggaaacauuguagguuauuguuguucuaauugcauuucaggacuuguugugaaguugagcaacucuucacauguuuaauggccacuugcaguuguuccuuuuaauucacuauuuauuacuuuucucuuuuuccuguugcuuuaucgaucaacuuacaugagcucuuguuuacuacagauauuuaguuugcuuaucaaauauuuugcaaauaacuucuccaggcuauuacugucuuccuguuuuguuuaugguuuugguugccauacagcaugccacaagggcagugaugcuggcuguuuaguacauugcugugcccucagcagcaggaauggugcguggcacauaguauguucucaauaaaaacaauuaucucaugaaugggugaaugaauaaguaauaaauuugaaauuuuaaugcagcuaaucuguuaauccuuucucuuaugguuucuggguuaccagaauaguucuauuuuauuaguuuuauuuuucuugaaauuaauccuuuuauccaucuugaauaguuuuuuauuaagaauuuuucuuuucuauuuggaguccuaauccaucuuaaauuuguucugcaugugguaugaagcagggcaaacugacccuaaaguuuggccauuacuuugugugaaaagcauuacaugaaaugcaaauuauuuuuagaauuuaucugaagguguccuauacaguaaaauacaaauauacccuaccacucauuuuauguguuguuaaaauaucuaaaguuaacuaaaaaauaaagacuggauaaugcuuuucugacagcuaauuuuguucgcauuuuugcuugauuauauaugauuaauuuugucucaauuaucaaugaaugcagauuaucagggaguaucacaaaauuuaaguauguggcuuaucaucucuaaugaagucacugaauuguauacaauuuauuuaauaggagcauaugcuggauuaacagaaucaauuacucaaauuucaguauuaaaaaaaauuccuuuagccaaaaaugaagugccuuuucuaaaaaucaugaagaaaaaacauggacaugaaauggugugcaaugaauucaacauuauacagacuugaacauuuugagaguaagucacauguuuaugcauuauacuauucugaugucggcaguuuaaacauuuuccaagauuucuuuaagaugcaaucauuccaccuccuccaugaagcccuccuagguggaagucauggcuacuuccucugaacacgugcagcaauucuugcuuccaccacuuauaaggcacugcccaaaaauggcuugcaaggaaaccugaauugccucuauuauucaauggcuucuaguuucugugguaaaaucaggggcugucaaaugaucugaugauaauguaaucuuuucccuuauaagucauuuaaucuuuuuacucagauguuuaaaaaagguuuuuuuuuuuuuuuuuuuugggacaaggucucacuguguugcccaggcuggauuauagucaugugaucacagcucacugcaaccucagacuccugggcucaguuuguccuaccaccucagccucccaaguagcuggaacuacaggugugugacaucaugccuggauaauuuuuuuuaaaaauggauacagggucucacuauguugccugggcuggucucgaacuccugggaucaagcgauccacccaccuuggauucccaaagugcugggauuacagaugugagccacugcaccuggccuagauccuuuuuucuuuuucuuuaaagugcaguauuguuuucacuagaauaucaauagguauuugucauucuagauccauauucucagguauacugucuggucuuccaaaauguaguucuacauuuuucuuguauuucagugaaguuuuuuggaguuauaauuuuuaguguuggcuugcuuucuugcuuugguuuccuucuucagugacuccuguuauccguaugcuagaucugcucugcauaucuucagugguugcugcuuuugaucauuccuccuuucuuuuuaauuuaauaauuuuccuccuuuuaaccuccuagucuuuuaagggauucucuauuguucuuauucgcuauuguguuucuuuugguuucauuucugaaauaacaacugagaucuucaccacauuuucgaguuauucuaauuuuggcuuguuacucuuuauuuguauuauuuaaaaaaugucuuuuagcucauguuauucagauagucaguuguauguaguuuucaccuguuugcagacgugcuuucauugcagguagggauguuauucccuuucucucucucacucuucucuuauauaaaauuucuuucuaguaugggguuuggccuuaaucuuucucugugcuuuuuuaaaauguaaaauugguuuuccacagccuuacaaggagacauuguccaaaauaccuuuuugcaacuccucagaacuccauuuuguguuguuuucauuuaguguuaaaaacaguaacuugcuuucugugauuuucuggguuuguuucccuccuucacuuuuauuuggucuuuuguuucauucaucucuauuguuucuguccugcucaauuuugauucuauuccuaguaguuuuucuuuggugaagggcccuguccuggaagggagcuguauuaguccauuuucacacugcugugaagacauaccugagacuggguaauuuauaaaguaaagagguuuaauggacucacaguuucacauggcuugggaggccucacaaucaugguggaaggcaaaggaggagcaaagguacaucuuacauggugucaggcaagagagcaugcagaggggaacugcccuuuauaaaaccaucagaucucgugagacuuacucacugucaugagaacagcaugggaaaaaccugccuccaugauucaaugaccuuccaccaggucucucccaugacacuuggagauuauggaguuacaauucaaugugagauuugggugggaacacagccaaaccauaucaggagccccggcuggggguuuugagaguucacgggacccaggcuacucaagccccuuccacccuuugggucccuugcacucacccacuaauggacuuuccagugaaaaccuguuggcuauguugagauuuaccuauuauuggaucugucaucaccucauuacugcccucugugucuuuccaccuagcugcugacagccugcaggcuugguggcauagguggcuuguuccaacccacuuauauuuuggcauuuguggggauagcuugucaccuuuuugugguaaauguuuuccauggggcuuggguuuugguaucuagaggauuuacguuuuuguuuucuaauuuuaaaaaauuguaguaaaauacacauacaaauuuuaccaucuuauuuuuuauuuuuauuuuugauuccgaguuucgcucuuguugcccaggcuggaguguaguggcgcgaucucagcucacugcaaccuccgccucccaaguucaagcgauucuccugccucagccuucugagcagcugggauuacaggcacauaccaccacgcucagcuaauuuuuguauuuuuaggagagacuggguuucaccauguuggccaagcuggucucgaacuccugaccucaggugauccaccugucucggccucccaaagugcugggaccacaggcgugagccacugcuccugaucuaguggcucaguuauuaugaggagauugaauacaggagaccgacacacuguugcugcuucagccccauuuaacgguaacccccuggaaacuggagucuguguucugugccccacagcaccaggauggcaccugacacauagaaaacacucacacauuuaagugauaaaugagucauucuuaauuccucugucuuuuggcagggugauaggaugcuuucuuguacucauuaaagugauugauggauaacauaaaaguugccauugguaccuggacuaauaccuuugcaggucaauaugcagcaugagcuucuagaugggaaaacacugccaacccuugaguacccaacuaaugaagggcaggagaggaacagacuaucucaaaaggaugccaauuuuaaaauacuuuauauuuugcucuguauaaauuuguuguagcagauuccuuacuaacuguuugguucuggcuaauguuauaacacaggagucccugggcacuacuugcugauagugauuugaaggggaggaguggaccagagguauauaggaaaaaaguaaauaacugacacagcuauacgcaagguuauaucaguuaacugacugggcauauuugagaguuguuacuacaauaguugguaaagucagagggaauacaaucuuggauucauaaaggccuaacaguuacaaaggcuuucaaaucugugacuucguuuauuuccauaacccuaacccuaauccuuuaauacagguccugcuugcuccauuucacaggugagacaacagagggacaaagagauuaagcaaugugccaaugaucacuguuagucaauguauagucaggauucagaugcuuggccaggugugguggcuuaugccuguaaucccaacauuuugggaggcugaggcaggaggauucagacucuuuucuucuaaguuuaguacuuuauguuuauuuugauacagggcuuugcuuugucacccaggcuggagugcaguggcacaaucacggcucacugcagccucaaauuccuagguucaagugauccuccuaccucagccuccugaguagcugggacuacagauaugcacuaccacaccuggcuaaucuuuuguuuuguuuuguuuuguggagacagggucucacuauguugcccagacuggucuugaacuccuagucucaagugaucuuccugccucagccucccaaaguaucgggauuagaggugugagccaccaugcccaggcaguuuagugcuuuuuacagcacuauugcuguaucugaaaagcauggugauguaaacugccacaaauauaauguuaaaauaagguaggcuauaaauuguaaguauauaaaaauauugagguuccgaccaguuugggcaagaacagcccucauuuucuccauauaauaccauccaaucauuccuaccacucucaguuucugcuucuacccuucaucccaucucuaguuaucccuccagaaaaagagggaagaaugaagguaaaaguaccauaguaugacauuugagggcuguuucugaagcauuagccacuacuacuaaugauaaaagcaacggccagauugagacccuauuguguggcaagcacuaugcuuagaaccucauaugaaguuaauacucucaccaacccuuuggguaagcaauauuguccccacuuuaaagaugacaaaacugagguuaagaggagcaacuugcuggcugggcacgguggcucacgucuguaaucccagcauuuugggaggucaaggcaggcggaucaucuggaggucaggaguucgagaccagccuggccaacgugcugaaaccccaucucuaccaaaaaaauacaaaaauuagcugggugugguguugggcaccuguaauccuagcuacuugggaggcugaagcaggagaaucgcucaaaccugggaggcagagguggcagcgaguggagaucacaccacugcauuccagccugagcaacagagugagacucugucucaaaaaaauaaaaaaaaaaaaaaagagaggcaacuugucauuuaauaaucacacauuuaguaagugggggaguggggauuugaaccccacccucuccaaaacauuaaucuccauaacauguaugacuuaaauaagcuuaaaaacacuacaauaauuagaaauucaccuuacuuagaucugaggaugaauugaaguuuauacaauuuauaaaaaugaaaguagacuuuuuuaaagcaguuuuacugcaucuauccauauacaauuauaacuuuuucuguuuuugaguucauuuuaaaauuaucccuuuccacauauuaaauuaaaucaggcaggaacccucaauucugguagccauuauuucugugaaggaaagagugaaaugucauuucaaaauggacucuaugugguuugacaucuuucagauaggacuucuuuccacugaacuuugggaaagacauauuugcuacaaagcuuuccauuuuuccccccagcuaugaccuauuuuaucaucugauuucacacuucagugaagucugauggggucuguggucucuaaaacacuaagcuucuagucacccuuugaauucaccuucagcaacugugucugaaaugaaaagcuaaaaagaacugcugcccagcuauggcagacaauguagccggcugacucagccccaguguccaccacccccuucucugucucuuuugacaauagggugucccagugaucauuucuggccaaugagauuaggcagaaauuugcugaguaugggcuucugggaaacauuugcucaccugauauaaugggacauguggcuggcauuguccuuuucucuauuccuucuaaaugucuuuaaugaugacgaugaucugaggugcagaagccuucuugcaauuauuaagcauguauacaaaagccaacaugcaaaggaugauagagcagaaagagugaaaggacccugguccuugacagcacugcugagugguuaaagccacaccagaaaccaucuacaccuaaacucccuguucuacaagcaaauaaaccccauuuuggccaagccacuagagccaaguuuucuauuacuugcagcugaacacauucuuuaccaauagaccagcuauuguccuucuuggucaucauucuucucuuccucuuccccaaaucccaccaucuccuuauauguugagggauugauucagaaaacugccgucaacuguuccuucacucuuuguuugcguaagaauuuccugagucuugcuaccaugagaaacguaguauuuccugcuuucuugucagugucugaaguuaggcuuucuaguucuuaugauauacccuauuguuuuuaaggacuuagugggucacagucacaucuuauucuguaguguugaaacacacacacaaacaacaauaaagucuccccagagcacucaauuuuauucaaacugacugaacaguuaauuuguuccucacaaaguucuuaaugcucuucagugauagagguuuuauuuuuagaaaacaugugagaaggcagggcaugguggcucacacuuguaauccuagcacuuugggaggcugaggcgggcagaucacuugaagucaggaguuagagaccagccuggccuauguggugaaaccccgucucuacuaaaaauacccauacacacacaaaaauagccaggugugguggugcacgccuguaauccuagcuacuugggaggcugaggugggacaauugcuugaacccgggaggcagagguuggcagugagcugagauugcaccauugcacacuccagccuaggugacacagcaagacuccaucucaaaaaaacaaaacaaaacaugugagagcaacaguuuauuugaucaccuuuucuaguuuaguuaacauuuuucacagaaaaugaaauuauacauugguuauuuuauucagcagagcucagagauccaggccauguguauucuuugggaguuggaucaccuguaauuaaccacgcauauaggaaccugggggauaauuuuaucaugcuauguuagacaacugccacugccaacaccuggaauuuaaguugcuuuaauuuaccaaaacaaagccuuagagucucuggauguguuucuucaaaaacacacacacgguugaacaaaacaggcaaaagcauaugcacuuccacauacugguaaugaccagaguaacuggagacuguggaaaugcagaguauuaacuaugcagggaauuuaauguaggagauacaagauuaggaauggaagaaccaugaaugaaugaaugagugagugaagcauauuuauguuuaacugcuucugacacucaauuuuagcuuccuuuggauugaaauguggguacauguguguguguccguguacacaccaacucaccuggauuccucauuccagcuucauucaauucccauuagcaguggcucugcuuggacacucaaacacacugaaucuugguugccuaauuuauuaauacaaugugaggauaauacuuuaccacaggguuauugugaggauuaaaaaaggugauaugcauaugaacauaugugaaaauucuuagaaaaugcacugugcuguuacuguuccuaucucccagucgaauacgggaauaauucugccugaaaaucacaugcagcuuuuccauuuuauacauguauucucagcacuguuuacuguauuaacaggaauaccugccuuacaaaggacaauuguugcugaaugugcuggagauuaaagggcuugagaaaaagagaaacaaggcuuugccagcccucuuaaggacccaaggagagcuccaagggcacgugugguaaaaauguuguaaguaaauucuuuucuaguuuuaauaaguggagcaggaaacaggcugucccucacaggaggagaauaacagcacauaucagaaacugaagugaaacaagcggucaaaucauggucucaguauuaugcagggaaguugcauuuaaagagcugcugagauucaaccuggagguaugccauugacuguagucaaauagaauaguagagaccuuuucuuuucuucugugaaaaaaaaucuuaaagacaaaaccuccaaauuucacaaaguuuuucccguuuacaucucagauggguggcugcccuuacaacaaacauuuucaagcugcucuaguaagaaugcggaugcuuuuuaugaaccucaauucaauuauguacaaaggaauauucuuuccuucucccuguuauuuugaaauauuugauugaucaaauugaacuuaaaaaaagaaaacuauuauaguacacauauccuuucuguucuugcuggaauaacucuucaugaucugagauagaaaccaugauuccugguaauauuagaugcaaacuagguaacaggcagggucccugguuuuauggcuaguaacugcaaauuuuauaaauagaaacuaggaugcagguacaacucucaauggucucuaugccauugaagaugagcagucacaauacaaaucuaaugauaauuaacaaguaauuucuauuguauuauugaaauguuuugcuuuugggcuuuuguuuuuaggagauaaugugucugaauuguuuagaagaggcuguuaagcuggaaucacuaaugucaauacauaaaaauuuauauauauauauauaaaucuucauaucauuuuauugguaauuccaauuugggaucuauuauaaagaaauaacucagaagaaagaucuuugugucuaaagaugugaauuaaaagguuauuuaugacagaaaaacgaguaaauuaugguucauucaaauuauuacaaauauagauuuauaaauaaaauuuauaaaauauuuaaguacauggaaaauauuaguuauaaauuuaaaauuugcaaauauauggacuccacauuugcaaauucaccuacuugcuaaaugaaaaacaagauauaaauacauaugguuaguaugaucaaaauaaugucauaugagccuagaaaaaaacuagaauggaauacaaaauauuaacaaugacugucuuugauuucaaugaauucuacaaauuuccacuguuaguguuuaauaacaaaaaagaucuuuagugaaaauaaaaugaaauuagcuuacauucccaggacacacugaagcugcacagcagcuaaaguuuaauuaacaaggauauguaaguuuagaauuuaaaauccaggcugggcgcaguggcucacgccuauaaucccagcacuuugggagaccgaggcgggcggaucacuugaggucaggaguuugaaaucagccuggccaacauggugaaacccuaucucuaguaaaaauacaaaauuagcuggguguggugguaggcaccuguagucccaguuacucaggaggcugaggcgggagaaucgcuugaaccugggagguagagguugcagugagcggagaucacaccucugcacuccagccugggcaacagagcaagacucugucucaaaaaaaaaaaaaaagaauuuaaaauccacugugguuuguccaaaaagugaaacuucugacaauuguuagagacuaacugccaaacaguauucucaucaauaggucauugcaccuauuaaauuuuuuuuuuacacauuugccagggagcuagguagagugaagugaauuuacugcauauuuuuuccuuagcauuuacuaagguauuuaaauacaaucuuuaagauucuuuuggaucaauauucucuccuuagcucaagucuaagcaaacauaagauucacucaucugcacucuggaaugucacuuugggcaaaguaauaacuaauucauuuauguacuaccacaccucuagccauaguuacauuauguauaagcucauagagucugcaaauuauaauguauucacaggccacagauguaaauguaccuuuguucauuuuuuccccuuccaguagaaauugcccagaaaauaugcuuccaauaauuaaaaaugaaggguugaggggugugugugugcauucuuuguuccugugcauuuuauuggcuuggcuuacacagggacucucuuauauugagucuaacucccucuucuuucuuccaccaggauggacugcagguuucuaagcuccuuagagcaggggcagucuuucuccuggggcaaauuuccaucuggcacccagcacaucauuuacaaaaagcaggcacuggaugugagugauggaauuauuauaauuuuccacuuucagugauagugaggauccaaguaaccuuguguccugagcuaaaagaugggugcacuccacagagccagggacagagccuacuugccaaguggaaacugggagagagaugacaggcgugguuguggggaggguguggacaggacagugccuuugaggguggcuccaugugaaguaagggccacgugggaugcucuguagcuggugggaaggcugugcagagaaaugggaggagaagccucccacaaaaccuuccugccacuccuaugaaaacuuaaugaacucuacacuucucacuaacaucuuguaggagggugcagggcaaaaacaggcucaucaugggauagucaaaacaaggcuaguuuacguguuuguuaaacugcaucaagagucauccaagaauuauuuccuaaauacugcucugugcccugaaugacguuuuaugcuuugaggcauauaaaggaagcgucacccacacuuggguucugcccucggaauccuugguaguucucuaaugcuuguugcugaacccuugaccauuuccaaacacugucaauccucacuauuuguggaugccauauuugcaaauucaccuacuugcuaaaguguaauugccucccccaaaucaaaucauuugcagacaugcacagagcagcaaacauuugagucacgggguccccacugagguggaacaaggcaccacucuggcuucuaguuucagcugucacacuaucaaacaagcaccccuccuacagucuguguggugccacuucuuuuuguauuuuugugcuuucugauggugacucagcugucuaaaauggccccaaacuuugugcugaagugcugucuagucauuccuuaugagcaagcaggcugugauaugccuuauggaaaauacggguguuagacaagcuucauucuggcuugagcugcagugcuugcuguuggccaugaguucaauguuaaugaaucguaauuuauauuaaauaacgugccuuuaaacagaaucacacauaaaacaaaaugacauauugaucaguugauaaaaaugugauuggaggcuugcaggaaccuaacugaauugcucccagaagcagugguucaguauuugcuaauucagugcuuguggugacuuacuagaacaaaacuucagugaauaaugagaauguauuguacuuaugccuuccucugcuacuguuuaacugaagggcaagguagacuaagauuaaccuuuauuaaaggccaauugugggccaaacacugugcuaagaacuuaaaauacauuaagucauguaacucucacaaccgccuugugaggucgguaguaucuucacuuuacagaugagaaaacugaugcucagagagguuaaguagauuucucaaggcugcacaauccccauacccauugccugggaaaugauuagaggggagaugauaaaauggaacggaacacugcugucagucucagagauuuugugacaauagagaguaacuauaagggauaauuugagaagaugcccaucggaaaggccucagccaagugacaagagauacuccccuaagcugggggaccaauaagcugagcagagccgccucucccuaucagagauuccagauagaugacagaggugggcuuccaucagugugaagguuccccuuuccaacagggcacauaauaaauccacucuuaauuaugcauucauuuugcaacaagaaucuauuaagugccuaccguaucccaaggacgguuuagacauuggagauucaguagugaacaaauagauaaaaagcacugggcuaauggagcguauguucuagugaaauaauagaaagauuggaucauguggcuuuaggugaauacuuuucugaguguuuugggauacauuuuuaaaauaccaacaaaacugacauauuuccguucugucugauucaaauaagagcucugaaauagccaaaaagauaagaaguagccaaaccauuuaugcugccugcacuacauugggugaucauguuuucuagggcuuacacuucccauggcacacuagaucuucucaaagucccccguugcaaaacacuagaugcuggauaaacugagcaaaaacuggccuauuauuauuaugauuaucccaaaggaaugaagcaucccaaaaagugacuugaagucuuuuuagaacaauaguucugaacuggggcuggacauuaagucaucuggaaaguuuuaaaaaguccugcugcccaggucacauccaaaccaauuaaaugagaaucuuggaguggaacucaggcaucagcauucuguaaagcuccccaggugauucugauguacagccaaggugaagaaccacugcuuuagaaggugauagagugcauaguauauggugagucaguagucccaauguucugccaauuucacucaagauugcuggcgaugguggaucugaaaaguuauccagcuucuuaaaccucuucuucauaccuucauuucuuuacucgucaacacacccuggaagguggacauuaucaccucucagacagaugcaaugaaucaaccuaagugggcacuuucugagucgaaauacaucuguuuauaguugaauguuuugauuuuuaaaugauuuuuaaaaaaugaguuccugcuaagcuaaggcuacauguauaagccaaagaagagacacaugaauuacagcaauaacuuuauuauuuccgccaauaagacucuaaaagccaaagauaauacucaauauguacauaaugggcauuaauugugcucuuuuucugccaaacucugugauuuugguucauauucucuuuggggccaguacuucaauuuuuucccccaugaaccauccaacaaaaauuauugaauauuuccuauguauaaaauacugguagaauauccagggaggagagaguccagugauuacuaaaugugagugaccucugaauucaaaaugauucuauaucuaaaaggugcuauuaaaaauaaugugagugacaaugagcuugaagauggaaauauuuuaugcugcaaagcaaagcauguccucuggccagcauccugggugguucccauuagacugucugcauuuggacucugggaucuuccaagagaugggcagaacucccuguucuagaaucucugcagagcaagauggaaguuuccacgaauuuucuuuuuaagaaaacuacccuguuauuuuguuuacgcaggucugaacauagguuucagaucuaaccugggaacacaugaggcaguauuguguuuggacuggucaaaguaggacaucagcaaggcacuaauauauuaauucauacucaguucuauaaugcuaauaacaauaaacauggaaacgaaacagcauuuagugaaauccuacuacauaccagguaccaauguuuuucauguauugccucacuuaacuucacaaaacucuaaguauaauaacaucguuauuauaccugucuugcagguaaaaaaaaaucaugaaugaaggagguuagggucacacaaauaguuaaguggcagaguggggauuugacccagguggucugacuccaaaguucaucuccuuaaccacucugcuuuauuuccccucguacaccagccaaucuuggcuucugggugacccggcacuaagaguugaaaguaacugguagggacagcccugggugagcacuggagaccugucaaacccacagucacaaccaugggguuacagcucucucuccuaccccuugggcuuguccuaaaaagggagauaggcuuggggcugauauaugguguggauuaugauccuaagacaugugaaaaacuucaucccaauggagugucaagaacaaaagggcugaccaucucuccuggaugacauggacugagcuggcugccuuucagagguggcauaccaaguuuuugcuuauucgcucucucuugggagaacgucagguggcucauaaaucuggggacggaguuaggaggaguggaccgagcaggacucaccauuuauaaaguuacuggccaagcucuguaacuaagaaaggguuggugggugaagaaaagaaaaucucacuucuuugaguucagucagacaagagaaaggggcagcaugcaguaacaggccaggcugaaugggugagaagaaagaggccucagaugagaggacauggagaggugggaaaggggcacgagcugcucacuuugccacacugcaacuggguccagaacaggccugcccugcccugccaguuauuuucuagugaaccaaaggcccagcagugcagaaagagucaagucagaucaacuuuuccguccugcucugaggcucugaucugagacacaacagagcagagaggggccucuggcuccgaagcccuggccugucaaauaucuggcagcgucuugaucucugccccagccugcccuuucccacugagcugagcauuucuacuaagcagccacacugcaugggacucucaucuccccuucucucacucagagagcacugcugcacaagcauuucauucuccaucaaacgcucuauggcuuccugagggggguccuuuggaagccaggggugcaguguaauugcugcaucugcuauugaaauucacuuuuggaguucuguuccuggagcagaaaguucugaaagcucccauggagaaggaacaggcucugaauccugcaggcuugggcuacccuaaaaaauucuugaagccucauuucuguguggucucuuucaaaaccuucugaauguuccaggagaucuauuucuugauaaauuuuucuuucuugcuuggggucaggccagaagagagcagaacagaugucagaucuaaagcuuucccaauucaaccacuugaacacuugcacacuaaucuguggugauguaaaugaaaaugccuuugagcauuucucacucagagaaaaagacaaaccucuguagaagcuggagacuucccuucaagaaaaacaacaugaaagaacaggaugauuggagucagcugccuuucugccuguaagaauaugaaagcccucuuuuuucuucucccucaaaaagucuaaauggauuaugcuuaauugaguucucaaaccccugcaugaauuuuccuucugcaaguugucacuuagcugacaaaaacaugcuucaauuuaaaaaaaugcaaauuccuuagaccauagcuuagauauggacuaaauauuauuacucaaacugggaaaauugaugaugggacagugcuggagucagggguuaaggucaacauucaggguuaaaccucaggugaaagcaaauacuugagcauguugacaguuaccuuagugauucuuuuccucuagccuacucagaguuacuagaaagaccuggaaaaugaucaaacagcacacgcaaacauuaugcuccaagaggucuuucuuggacuaauauucaugccagcagcccuagcacacucgcugauccuucaagaaccucuggauugcaacugaaagguugggcucuaagguuuuccuauuuuuugagacagggucuccuucugucauccaggcuggagugcaguggcacaaucauagcugacugcagccuugaccuccugggcugaaagugauccucacaccucagccucccaaguagcuaggacuacaggcacacaaccaagccaagcuaauuuuguaauucuuuuuuugguagagauagggucucacacuauguugccaggguuggucuugaacucccggucucaagggauccucugcaucagccucccaaagcacugagauuauaggcaugagccacugugcccugccaggcucuacguuucuuauuucuuuuucuuuucuuucuuuuuuuuuuuuuuuuugagacagcgucucaccuugucaucuaggcuggagugcaguggcuccaucauagccuccugcagccuugaugacugugcuagagcgacccucucacuuuagccuccugaguagcugggacuacaggugcuucccacugugccuggccaauuaacaauuucauuuuuauuuuuaguagagaugagaucucacuauguugcccaggcugguccugaacuccugagcucaagagauccucccaccuuggccucccaaaguacugggauuacaaacaagagccacugugccugaccaggcucuaagauugcuaaucuggcuauagaaggacuaauguuagccaccucagagacauucauucauuuuaagaaacaucaucuuucacugaauauaauaugacauuuuuuagaaggcacagcauauauguaccauaaagagccaucucaacucugacauaaacuuuguuaucauacagcauguuuauuuuaugcgaaugaaagagcucuuuuagauguauuuagacacaaauauaucauauaacccccuugcucauucaacagaaacaaaauauaggcaaaauaaauucaggaaagucuuccuaaaacuuuuucacacccaaggguuugacucuucugaaucucuuuuguuagaaacuucuuauuuugaaauaauuccgaguuuauaaaaaagaaagauagcacagagagucaauguugcuggucuacauaccacacuuugaauagcaagccuguagcagaauaucuaaaguaaguaccagaauugcuauuuaccaccugugugaugucugaccugcagugucuuuauuuggaauuugggauaacaauuccccuuaccuuccaggguuguuaugaguagcauaugaggaaaauccacagaaguccuuagcaaacugucaaguacuucacaaauacccguugcagaugcauuccuugcccucaaggcauuuacagucuaguuaauaauucuuuacaguuauuuggugcagcauaguccgcauaguuuacacagugcuuucauaucuguuauguaauuugaccuucucaauaauccugugaagguaugaaauuguaccuucauuuauuauauacauucuccugaaguuuugaggggguuguuuuuucacaguggccaagccugcuuugaaccugucggguuggccuuggccuugucagugcucuuuacugugggaacuucauaucauaugaauggggcuuugucaacacaggguuccuaggucuguuucaccugaaaugaaccuuucuuauuuuucagacacaaaacuucucugcaacucuggccugcuuuugggaccagaggccccucccuggauucccgggacugcuccucucccugguaacccucuccugguagggacauugaugggggugaggcuuacuguuagcuccagcuguuucuaauuaacuuugacugcucuccucuguaaaacaguaaaggcaauucaacacauuagcuuuuucaaaagggccauaucauuuugccauuaauccaacuugggauaaaacagaggucaacuauuuaacacaaucaauuuuaaguaaaaaaaauaaauaaguaaacguuucccccccuccccccauuaucauccuggcuuuuuucuucugaucucauuuucucucagaggccugguggaggagacggucuugauugaccuggaaaagccauauaugacaggcugggggaagcuucccuugaacauuucuaguccuccacugcuauccccacauaagaguaaaagacucacugggaaaucuuugaaauuaccuuaaauaagugggcuuauuaauucacauauaccuaagucuccuuccauuucaaagcuuucuaauugugccacuccuaaauuucaaauaaagguuacacucauauucccuggcuuaaaaauuuuuuugacgauaauucaggguuccccagcugcuaaaaacaagauguuauuugucuaacaaugaaaaacacagaugaggucagauuguuugugggguagggguggcuugagguaaaggaagcaucauaaucucauccacuguagggaggaauuuugaaucagugaaggcuagcuggccuuggacuccauccaaggguguucugucacugaacuauccaagagagccuuauaaggcgguuucuucuagaaggccagucuacaguggaccccgagggcaggcucuagggacaggauggaaaucguauuucaggauguuaacaaaugccugcucagcuuaaucauuccaucucaaagcuguauaguuuaagagauuuaaaaauuauaaaauccucccccagauguggccccucccccucaaguuauuucucagcucuccuaaagagagucuccugacuucugccugaacacgguauccuauucaauaguuuuuacuggaaaguucuuccugcugugucaucuaaaugugccuuguggcuauuuaauuccaggccuuuuaaugcuguccuccugaagaacuguauuaagagaauaauuuuucaggcaucuuccauuuaauaacuaauucccaaacgaugaagaaacauuaacuuguucuuuagauuacuuuccucugaaagaauccuaaguccucuaaggccccacuuuguccuucaguuuuucaaaucuuuccuaaaaugcagugauugaaacuggacaaaaugauuauaaagaaccagugauucauucaauauucuagaaauuucugugcucaagaagggcagcugaggccagaaaaauuuuaaagcauuucuacuggacuggagcagacucuuagggaaggugacuuuuucuguuucugaucugaaagcagagagaaggaguaauagggacuuuagggggaagagacuccugaaaggagcaaguggugguaauuuggaggcaggacuggcuaauaaggcaagcgaggugaaggcacuuuaugagcagucaccgaauaagaaaaagcuccacaagggcuuuucacucccaaguagcaagcagcuugccauggcaggcugggaacccagauuugacaaugcuucuaagaucagagagggaagucuugggaaggaguguaggcaucuguuguugugauuacaguaacagcuuccuuaugggagucucugacugcagucucacccccuuccaauccauucucccaacagcagccaacaaagcuuuucuaaaagcacaaauccagcuccaucacucagcgcucccauugcucugugacagcgucucagcuccuuaaggggucacaggcccuccccuaucacugggcucugucacgcagccagcugccuccuucucccuaggcagucccaccaaaccucaugcgaguccuucugcuggcuaugcucugguuaucuccuuucucuuaaaaaauuguuuuaacugauaacugaaaauuguauauauaugguauacaacaugauguucugaugcauguagacauuuuggaauggcuaaaucaggcuauuuaacauaugcauuaccucauacacuuuuuugugugugugguaacaacauuuaaagucuaugaucuuagaacuuuucuuuuuuuuuuuucuuuucuuuuuuuuuuuuuuuugaggcagggucuugcccuguuacccaggcuggagugcagugguaugaucauggcucacugcagauuugaccuccugggcucaaguaauccucccgccucagccuaccaaguagcugggacuacaggugugugccaccacacccagcuaauuuuuuuauuuuuuuuauagagacgaggucucacuauguugcccaggcuggcaauuuucagguauauaauauauuguuauuaauuauagucaucaugagggacaauagaucucuugagcuuaugucuccucucuaaccaaacuuguguguccuuugaccaacaucuugccaauccuguccccuccucccaaccccaucucugguaacugcuguucuauuuucugcuucuaugaguuugacuuuuuuuagauuccacauauaagugagaucacauagcauuugucauucugugcuuggcuuuuuuuucacuuaauauaaugccuuccagguccccucauguuguggcaaugacaaaguuuccuucuuuuuaaaggcugaauaguauucuauuguauauauacaguguuuucuucucaucucccuucuaacucuaccacaaccucuaugcuagcucuucuccacccaauuccuucuuaucccugucucagucaggacaucauucuuccacuaagugauucuuggcuuuuccuccacaaaccuggguccccuccucuggcucucugacaguccucaugguacuacuguguuaguuuagugaaguauuacacugacuugcacucccccaagauaaaccagacaauuaacaacuucauuuaauuugaaaccccuuuguuucaacuuucaaugaaguucauacauuuacugaaggauaguagaacauggacauuuaaaugauauauuaucaacauaaaaaaugagucuaaugaaucuaaaaugagcuucucaaagaauggagguuuaaaacucaucaaauaaaaugaguaccugaaaaucaaaaucuauacugaagcauuuuccacuuacagaacaguuucuauagcucuggaccuaauuuuacucggcaaggggauauggaaauguugggauuuggggggaaaaguuaccauccaauauuagaguucaggauugcugaugacagaaaggaaggcaaaucaaugucagaugaauucccuggccuagacuuuaggaaggcagaagaugccaggaggaaagagagcagacaggcaggagaggggcuuuccugcauuuccaaacaggaaggugcuuucuuaagaggauuccuuuguuaaucaacaaauauuuaugauaugcccaauuauuagccagacacuguguuuauaaggaguuauaagaugaaaucccucuuuuaaaaugguuacagucuaguggggaagacagacauucaaagagcccuuuuguggcaguuggggaaggucuauaguagccaacuuguucuccacucagggcccaaggccuugcuguucccuuugcugaaauccucccaagcguucuuagcauggcucuacucaccucacuuaauacugcucauucaucuggagucucuaaccuauuucuccgauguacacccuucacagcauguacacauugugugaaaauauguuuccuuguuucuguguaucuuauucaaggcuacuuacccugagauuaggagagugccuagccaauucauagguugauucauucauugauucaugcauuagacauguguuuaaagaacauacuacauaccaugcacuuaucuagguccuugggucugucuauaugagggagcaaaaucucccuucccaccuggagcuuacuuugauguugaauaaugacaacaauuaauguucauccacgcuuucuauggauaauauucaugacauuuaaucuucaugacaacccuaugagauagauaaugguuauaaucccugucuuauaagugaggaaaacccugggcagacaggucaaauaacuugcucaaggcuauaguuaguaaguggucaagauucacaccaagggagucuggcuugagagcuccucaucuuaacuucucugcuauacugccucuuauauacagauacacaguacacguggaauaaauauuaguugaaacaauggcuggaugcauagcucuagaagaacaaauacaucauuuuggggugggggaaagucagaaugcuucucagagaaacugacagagcugauccuugaaggcuagguaacagcccauuuuuuaaauuuuuuuuuuuuuuuuugagauggagucuugcucuuuugcccaggcaggagugcaguggugcuaucuuggaucacugcaagcucugccucccagguucacgccauucuccugccucagccucccgaguagcugggacuacaggugcccgccaccacgccuggcuaauuuucuguauuuuuaguagagacgguguuucauuguguuagccaggauggucucgaucuccugaucucgugauccgcccgccucggccucccaaagugcugggauuacaggcgugagccauggcgccuggcugcccauuuuuaaaauuuuuauuauuauuuuucuuucaugucagacagguaaugugccaaugucauaaaagguuugggggcgacauaccucacacauguguaugaacacucaaucaucaugcuuaugaacuacaaaaggaucauaggcaagaguucaaaggauggaaaggaagugaaggagggugcaauuguggugaguguggaggugagaggcguugcaggcagaaggcacaacuucuacagaggcaugaaagcauagagacauaugugcugaagugugaauagcagacacuuacuguggcuagugcauaaaggagguuggagagaagaggucaaaauaauagaauggaguuauauugugaagggccuguuauguccugcuagguaguuugaacuugguccuaaagguacuaauaagggagacccuuaagaaugacauucugauuccagaagugaaaauuaauucugagggagaaaggaugguaccuaaugagaccaaagcggcugaaaugggauugccaaagagcucagauuuaaaagacuuugaacaaaagguauaaucaguaauuggaauacagaagcaucauguucucuuccaacuaugaaauuuuauuauauaucuuagcuucuuuguaucaacuucuuuuuauuaaauggaaucuucaaauucccccuucugguuauccaugacuucagggaccucaauacaaucuaauggcaguaaauucauaaugacaguuccaagauuugaaauuauuugcugauuaucuuucagacauauuuucaagcagaucgcuuugccuccuaccagagagguauggaaaacaagcagaccaagaucucuucccaguuggguaaguggugaucuuagaaaggaggaagacuggggcaagcuccagggcuccagggcaagugcucugggaggugaguuuguaacuuguacagauacuuucuuaaucagcaacaucaaaucuguuuuguacaucccugguauauagcaccuaguacagugcugacucaaguuagcugcucaauaaaugcauguuaaauggaaccaaagaccagagggcagauugaaucacaccauuguggcugaaucccacaaugcugccccuaccuggccccuacucaaguuauacucaagcauaacuuaaguuucuucugagaauagaagggaaccuagaggucuagaggaaccuagacaaugcauuuccuauucugugcaaagccccaguaugaaauggcacagaaguaaauggcacucuguccaguuugcuucuaugauugucaaaacccauccaggugucagaagaaauauuuaggggaugugauagggaucagucuauugucucugcuguggaaaguuucugcugugggaaaggcuucccauucucuucugcucucuuuggcauucuccuauaaauggucucugccauuuagaacucaucucucucaauuuaggaugagaagaaauggcuaauuuaagucaagguuuccaguuuuagaugcuguuuucucuaacauuuccccaaauauaaagaaaagccgggccggaacccucaaaggguuugcagucuggagagguacugagcuggguguacaugguaaugagguuaugaaacugguucuauaugacugucagucucaauauuuuauaaucagacugugugaguguuuggugauguaaguagcaggugagaaaaaggaauauuaaguauaaacuagaaauugacaacacuugaacaaucaccaagcuaaccuucugcucugauaaggcaaguaucugccauuuugaaaaaacuauaaaguuccccauuguaauguuuauaagaaaaucucaauauuuggaauaaauucuuaaauaacgcacauuuaucuuuucaugaugugaccgacaaaugagauccaaaguaacaaauaacuguuucuauuguaaacauaugcagauuauuuuggguugcaauuuucuaaguuuaaggugaugauacuauaaauaguuacuagugaguuacacaauuuaaggcuuucaauagugaacucugaaauugaugacauacaaccuauuaguuuguggacuucugggaaaagcucuaaagaaagaauuuggaaauucuggagaaagucugaacuguguuaaagaagcaacagcuucuguaaccucagaacugccuccucucccuuuucuaccuuggcuaagaucaggagcugccaacauugaaugucugacuuucccuugaaaauacugccaauggaaaauguuauuucaggcauuagaguuaaaauuucuauguguguguguaugugcguguauuugcaaguccagacuuuauuuucuucuuucuuucuuuuuuuuuugagauggggucucugucugucacccaggcuggagugcugucaugugaucucggcucacugcaaccuccgccucccagauucaagcgauucuccugccucagccuccugaguagcugugauuacaggcaugcaccaccaugcccagcuaauguauauauauauauuuuuuauuagagaugggguuucaccguguuggucaggcugaucucgaacuccugaccucgugaucugcccaucuuggccucccaaagugcugggauuacagacgugagccaacccacccggccuauuuccuuauuucauuuacagcaagcuuggacuuguuuggaauaaaauaaacaaucaaacauaaucucaaagacauuucugcugaacaguguauccuggggacaaauuaugcaaaacaauacaaaucaaagaaauaggaaggaaaaacaaaauggucagaagguugacaacaaagugcaucacaaaaacagucuucaaagaguuuguauuuuauuuuugcccacaaauaauuagcuaguuagauuacuguuugagaaccuauaauuuuuagaaaguggacuauuuucuucaauacuaagaaaucagggcugugcacggugguuuaugccuguaaucccagcaggccgggauuacuugagcucaggaguucgagaccagccuaggcaacauagugaaacuccgucgcuauaaaacaaaacaaaacaaaacaaaaaaccaaaaauuggccaggcgugguggcacaggcuuauagucccagcuacuugggaggcugaggcaggaggaucgcuugaggcagagguugcagugggccaagaucgugccacugcccuccacccugggcgacagagcaagauccuaucuuuuaaaaaaaaaagucugucuggaaguccuuacuuuauauuuaauugucaaacuccuuucccccaucucuugacuucaccucucucuacauccccaagccaagaaugaugagaaauggacagauguuagcacgaguugggugcgcuuugggcauggggaagucugaggucucggaaaaucuuuucuacauauacacccggcccucacuuucuggacgcacgcagcaaacucucaaaauaaaaccaccaaaaaggagaagggggggcgucgcccaccgcuccuggcauuccgcggcugccaacucuuucccucccaucuggcuccugggaugcccgcgggggaaucgcagugagcagcgcggggcgaggccgccgcggacgccccgucggaugugcccuucgcugggccgagcggcgcaggguuggagagggaagcgcucgugcccaccuugcucgcaggugcccuugcugaccugggugauggccuucuccccgcggcucucggcccucuggcuggcggcgcgcagcuggcagccgcucggguagguggugccgucgcugccgcacaccggguagcggcucuugcacacgcacacgccgcuuacacccggaccgccggcugcugccccggcuuuacccuuccgccucuugcggcucuucacgcacuccaugcccggcgcgcaguacccccugccggcgccgccacccccgcacggcucgcccucgccgcgggcgcacauagggcagcagccgcacgcgucgcgggucucgcccagcaggcagcccagcgggggcaggggcgggcaggaggccggcucgcaggggccgcagguguccgaagaggaggaagaggagaggggcaggagcaggagcagcagcccagcggcgccgaggagcagggcgcgcagcgacggccgcuccauggcggggugcgguggcagcggcaagggcgcgagu

SEQ ID NO: 21223 - RNA, 79313 nt, Homo sapiens
acucgcgcccuugccgcugccaccgcaccccgccauggagcggccgucgcugcgcgcccugcuccucggcgccgcugggcugcugcuccugcuccugccccucuccucuuccuccucuucggacaccugcggccccugcgagccggccuccugcccgccccugcccccgcugggcugccugcugggcgagacccgcgacgcgugcggcugcugcccuaugugcgcccgcggcgagggcgagccgugcggggguggcggcgccggcaggggguacugcgcgccgggcauggagugcgugaagagccgcaagaggcggaaggguaaagccggggcagcagccggcgguccggguguaagcggcgugugcgugugcaagagccgcuacccggugugcggcagcgacggcaccaccuacccgagcggcugccagcugcgcgccgccagccagagggccgagagccgcggggagaaggccaucacccaggucagcaagggcaccugcgagcaaggugggcacgagcgcuucccucuccaacccugcgccgcucggcccagcgaagggcacauccgacggggcguccgcggcggccucgccccgcgcugcucacugcgauucccccgcgggcaucccaggagccagaugggagggaaagaguuggcagccgcggaaugccaggagcggugggcgacgcccccccuucuccuuuuuggugguuuuauuuugagaguuugcugcgugcguccagaaagugagggccggguguauauguagaaaagauuuuccgagaccucagacuuccccaugcccaaagcgcacccaacucgugcuaacaucuguccauuucucaucauucuuggcuuggggauguagagagaggugaagucaagagaugggggaaaggaguuugacaauuaaauauaaaguaaggacuuccagacagacuuuuuuuuuuaaaagauaggaucuugcucugucgcccaggguggagggcaguggcacgaucuuggcccacugcaaccucugccucaagcgauccuccugccucagccucccaaguagcugggacuauaagccugugccaccacgccuggccaauuuuugguuuuuuguuuuguuuuguuuuguuuuauagcgacggaguuucacuauguugccuaggcuggucucgaacuccugagcucaaguaaucccggccugcugggauuacaggcauaaaccaccgugcacagcccugauuucuuaguauugaagaaaauaguccacuuucuaaaaauuauagguucucaaacaguaaucuaacuagcuaauuauuugugggcaaaaauaaaauacaaacucuuugaagacuguuuuugugaugcacuuuguugucaaccuucugaccauuuuguuuuuccuuccuauuucuuugauuuguauuguuuugcauaauuuguccccaggauacacuguucagcagaaaugucuuugagauuauguuugauuguuuauuuuauuccaaacaaguccaagcuugcuguaaaugaaauaaggaaauaggccggguggguuggcucacgucuguaaucccagcacuuugggaggccaagaugggcagaucacgaggucaggaguucgagaucagccugaccaacacggugaaaccccaucucuaauaaaaaauauauauauauacauuagcugggcaugguggugcaugccuguaaucacagcuacucaggaggcugaggcaggagaaucgcuugaaucugggaggcggagguugcagugagccgagaucacaugacagcacuccagccugggugacagacagagaccccaucucaaaaaaaaaagaaagaaagaagaaaauaaagucuggacuugcaaauacacgcacauacacacacacauagaaauuuuaacucuaaugccugaaauaacauuuuccauuggcaguauuuucaagggaaagucagacauucaauguuggcagcuccugaucuuagccaagguagaaaagggagaggaggcaguucugagguuacagaagcuguugcuucuuuaacacaguucagacuuucuccagaauuuccaaauucuuucuuuagagcuuuucccagaaguccacaaacuaauagguuguaugucaucaauuucagaguucacuauugaaagccuuaaauuguguaacucacuaguaacuauuuauaguaucaucaccuuaaacuuagaaaauugcaacccaaaauaaucugcauauguuuacaauagaaacaguuauuuguuacuuuggaucucauuugucggucacaucaugaaaagauaaaugugcguuauuuaagaauuuauuccaaauauugagauuuucuuauaaacauuacaauggggaacuuuauaguuuuuucaaaauggcagauacuugccuuaucagagcagaagguuagcuuggugauuguucaaguguugucaauuucuaguuuauacuuaauauuccuuuuucucaccugcuacuuacaucaccaaacacucacacagucugauuauaaaauauugagacugacagucauauagaaccaguuucauaaccucauuaccauguacacccagcucaguaccucuccagacugcaaacccuuugaggguuccggcccggcuuuucuuuauauuuggggaaauguuagagaaaacagcaucuaaaacuggaaaccuugacuuaaauuagccauuucuucucauccuaaauugagagagaugaguucuaaauggcagagaccauuuauaggagaaugccaaagagagcagaagagaaugggaagccuuucccacagcagaaacuuuccacagcagagacaauagacugaucccuaucacauccccuaaauauuucuucugacaccuggauggguuuugacaaucauagaagcaaacuggacagagugccauuuacuucugugccauuucauacuggggcuuugcacagaauaggaaaugcauugucuagguuccucuagaccucuagguucccuucuauucucagaagaaacuuaaguuaugcuugaguauaacuugaguaggggccagguaggggcagcauugugggauucagccacaauggugugauucaaucugcccucuggucuuugguuccauuuaacaugcauuuauugagcagcuaacuugagucagcacuguacuaggugcuauauaccagggauguacaaaacagauuugauguugcugauuaagaaaguaucuguacaaguuacaaacucaccucccagagcacuugcccuggagcccuggagcuugccccagucuuccuccuuucuaagaucaccacuuacccaacugggaagagaucuuggucugcuuguuuuccauaccucucugguaggaggcaaagcgaucugcuugaaaauaugucugaaagauaaucagcaaauaauuucaaaucuuggaacugucauuaugaauuuacugccauuagauuguauugaggucccugaagucauggauaaccagaagggggaauuugaagauuccauuuaauaaaaagaaguugauacaaagaagcuaagauauauaauaaaauuucauaguuggaagagaacaugaugcuucuguauuccaauuacugauuauaccuuuuguucaaagucuuuuaaaucugagcucuuuggcaaucccauuucagccgcuuuggucucauuagguaccauccuuucucccucagaauuaauuuucacuucuggaaucagaaugucauucuuaagggucucccuuauuaguaccuuuaggaccaaguucaaacuaccuagcaggacauaacaggcccuucacaauauaacuccauucuauuauuuugaccucuucucuccaaccuccuuuaugcacuagccacaguaagugucugcuauucacacuucagcacauaugucucuaugcuuucaugccucuguagaaguugugccuucugccugcaacgccucucaccuccacacucaccacaauugcacccuccuucacuuccuuuccauccuuugaacucuugccuaugauccuuuuguaguucauaagcaugaugauugaguguucauacacaugugugagguaugucgcccccaaaccuuuuaugacauuggcacauuaccugucugacaugaaagaaaaauaauaauaaaaauuuuaaaaaugggcagccaggcgccauggcucacgccuguaaucccagcacuuugggaggccgaggcgggcggaucacgagaucaggagaucgagaccauccuggcuaacacaaugaaacaccgucucuacuaaaaauacagaaaauuagccaggcgugguggcgggcaccuguagucccagcuacucgggaggcugaggcaggagaauggcgugaaccugggaggcagagcuugcagugauccaagauagcaccacugcacuccugccugggcaaaagagcaagacuccaucucaaaaaaaaaaaaaaaaauuuaaaaaaugggcuguuaccuagccuucaaggaucagcucugucaguuucucugagaagcauucugacuuucccccaccccaaaaugauguauuuguucuucuagagcuaugcauccagccauuguuucaacuaauauuuauuccacguguacuguguaucuguauauaagaggcaguauagcagagaaguuaagaugaggagcucucaagccagacucccuuggugugaaucuugaccacuuacuaacuauagccuugagcaaguuauuugaccugucugcccaggguuuuccucacuuauaagacagggauuauaaccauuaucuaucucauaggguugucaugaagauuaaaugucaugaauauuauccauagaaagcguggaugaacauuaauuguugucauuauucaacaucaaaguaagcuccaggugggaagggagauuuugcucccucauauagacagacccaaggaccuagauaagugcaugguauguaguauguucuuuaaacacaugucuaaugcaugaaucaaugaaugaaucaaccuaugaauuggcuaggcacucuccuaaucucaggguaaguagccuugaauaagauacacagaaacaaggaaacauauuuucacacaauguguacaugcugugaaggguguacaucggagaaauagguuagagacuccagaugaaugagcaguauuaagugaggugaguagagccaugcuaagaacgcuugggaggauuucagcaaagggaacagcaaggccuugggcccugaguggagaacaaguuggcuacuauagaccuuccccaacugccacaaaagggcucuuugaaugucugucuuccccacuagacuguaaccauuuuaaaagagggauuucaucuuauaacuccuuauaaacacagugucuggcuaauaauugggcauaucauaaauauuuguugauuaacaaaggaauccucuuaagaaagcaccuuccuguuuggaaaugcaggaaagccccucuccugccugucugcucucuuuccuccuggcaucuucugccuuccuaaagucuaggccagggaauucaucugacauugauuugccuuccuuucugucaucagcaauccugaacucuaauauuggaugguaacuuuuccccccaaaucccaacauuuccauauccccuugccgaguaaaauuagguccagagcuauagaaacuguucuguaaguggaaaaugcuucaguauagauuuugauuuucagguacucauuuuauuugaugaguuuuaaaccuccauucuuugagaagcucauuuuagauucauuagacucauuuuuuauguugauaauauaucauuuaaauguccauguucuacuauccuucaguaaauguaugaacuucauugaaaguugaaacaaagggguuucaaauuaaaugaaguuguuaauugucugguuuaucuugggggagugcaagucaguguaauacuucacuaaacuaacacaguaguaccaugaggacugucagagagccagaggaggggacccagguuuguggaggaaaagccaagaaucacuuaguggaagaaugauguccugacugagacagggauaagaaggaauuggguggagaagagcuagcauagagguugugguagaguuagaagggagaugagaagaaaacacuguauauauacaauagaauacuauucagccuuuaaaaagaaggaaacuuugucauugccacaacaugaggggaccuggaaggcauuauauuaagugaaaaaaaagccaagcacagaaugacaaaugcuaugugaucucacuuauauguggaaucuaaaaaaagucaaacucauagaagcagaaaauagaacagcaguuaccagagaugggguugggaggaggggacaggauuggcaagauguuggucaaaggacacacaaguuugguuagagaggagacauaagcucaagagaucuauugucccucaugaugacuauaauuaauaacaauauauuauauaccugaaaauugccagccugggcaacauagugagaccucgucucuauaaaaaaaauaaaaaaauuagcugggugugguggcacacaccuguagucccagcuacuugguaggcugaggcgggaggauuacuugagcccaggaggucaaaucugcagugagccaugaucauaccacugcacuccagccuggguaacagggcaagacccugccucaaaaaaaaaaaaaaaagaaaagaaaaaaaaaaaagaaaaguucuaagaucauagacuuuaaauguuguuaccacacacacaaaaaaguguaugagguaaugcauauguuaaauagccugauuuagccauuccaaaaugucuacaugcaucagaacaucauguuguauaccauauauauacaauuuucaguuaucaguuaaaacaauuuuuuaagagaaaggagauaaccagagcauagccagcagaaggacucgcaugagguuuggugggacugccuagggagaaggaggcagcuggcugcgugacagagcccagugauaggggagggccugugaccccuuaaggagcugagacgcugucacagagcaaugggagcgcugagugauggagcuggauuugugcuuuuagaaaagcuuuguuggcugcuguugggagaauggauuggaagggggugagacugcagucagagacucccauaaggaagcuguuacuguaaucacaacaacagaugccuacacuccuucccaagacuucccucucugaucuuagaagcauugucaaaucuggguucccagccugccauggcaagcugcuugcuacuugggagugaaaagcccuuguggagcuuuuucuuauucggugacugcucauaaagugccuucaccucgcuugccuuauuagccaguccugccuccaaauuaccaccacuugcuccuuucaggagucucuucccccuaaagucccuauuacuccuucucucugcuuucagaucagaaacagaaaaagucaccuucccuaagagucugcuccaguccaguagaaaugcuuuaaaauuuuucuggccucagcugcccuucuugagcacagaaauuucuagaauauugaaugaaucacugguucuuuauaaucauuuuguccaguuucaaucacugcauuuuaggaaagauuugaaaaacugaaggacaaaguggggccuuagaggacuuaggauucuuucagaggaaaguaaucuaaagaacaaguuaauguuucuucaucguuugggaauuaguuauuaaauggaagaugccugaaaaauuauucucuuaauacaguucuucaggaggacagcauuaaaaggccuggaauuaaauagccacaaggcacauuuagaugacacagcaggaagaacuuuccaguaaaaacuauugaauaggauaccguguucaggcagaagucaggagacucucuuuaggagagcugagaaauaacuugagggggaggggccacaucugggggaggauuuuauaauuuuuaaaucucuuaaacuauacagcuuugagauggaaugauuaagcugagcaggcauuuguuaacauccugaaauacgauuuccauccugucccuagagccugcccucgggguccacuguagacuggccuucuagaagaaaccgccuuauaaggcucucuuggauaguucagugacagaacacccuuggauggaguccaaggccagcuagccuucacugauucaaaauuccucccuacaguggaugagauuaugaugcuuccuuuaccucaagccaccccuaccccacaaacaaucugaccucaucuguguuuuucauuguuagacaaauaacaucuuguuuuuagcagcuggggaacccugaauuaucgucaaaaaaauuuuuaagccagggaauaugaguguaaccuuuauuugaaauuuaggaguggcacaauuagaaagcuuugaaauggaaggagacuuagguauaugugaauuaauaagcccacuuauuuaagguaauuucaaagauuucccagugagucuuuuacucuuauguggggauagcaguggaggacuagaaauguucaagggaagcuucccccagccugucauauauggcuuuuccaggucaaucaagaccgucuccuccaccaggccucugagagaaaaugagaucagaagaaaaaagccaggaugauaauggggggagggggggaaacguuuacuuauuuauuuuuuuuacuuaaaauugauuguguuaaauaguugaccucuguuuuaucccaaguuggauuaauggcaaaaugauauggcccuuuugaaaaagcuaauguguugaauugccuuuacuguuuuacagaggagagcagucaaaguuaauuagaaacagcuggagcuaacaguaagccucacccccaucaaugucccuaccaggagaggguuaccagggagaggagcagucccgggaauccagggaggggccucuggucccaaaagcaggccagaguugcagagaaguuuugugucugaaaaauaagaaagguucauuucaggugaaacagaccuaggaacccuguguugacaaagccccauucauaugauaugaaguucccacaguaaagagcacugacaaggccaaggccaacccgacagguucaaagcaggcuuggccacugugaaaaaacaacccccucaaaacuucaggagaauguauauaauaaaugaagguacaauuucauaccuucacaggauuauugagaaggucaaauuacauaacagauaugaaagcacuguguaaacuaugcggacuaugcugcaccaaauaacuguaaagaauuauuaacuagacuguaaaugccuugagggcaaggaaugcaucugcaacggguauuugugaaguacuugacaguuugcuaaggacuucuguggauuuuccucauaugcuacucauaacaacccuggaagguaaggggaauuguuaucccaaauuccaaauaaagacacugcaggucagacaucacacaggugguaaauagcaauucugguacuuacuuuagauauucugcuacaggcuugcuauucaaagugugguauguagaccagcaacauugacucucugugcuaucuuucuuuuuuauaaacucggaauuauuucaaaauaagaaguuucuaacaaaagagauucagaagagucaaacccuugggugugaaaaaguuuuaggaagacuuuccugaauuuauuuugccuauauuuuguuucuguugaaugagcaaggggguuauaugauauauuugugucuaaauacaucuaaaagagcucuuucauucgcauaaaauaaacaugcuguaugauaacaaaguuuaugucagaguugagauggcucuuuaugguacauauaugcugugccuucuaaaaaaugucauauuauauucagugaaagaugauguuucuuaaaaugaaugaaugucucugagguggcuaacauuaguccuucuauagccagauuagcaaucuuagagccuggucaggcacaguggcucuuguuuguaaucccaguacuuugggaggccaaggugggaggaucucuugagcucaggaguucaggaccagccugggcaacauagugagaucucaucucuacuaaaaauaaaaaugaaauuguuaauuggccaggcacagugggaagcaccuguagucccagcuacucaggaggcuaaagugagagggucgcucuagcacagucaucaaggcugcaggaggcuaugauggagccacugcacuccagccuagaugacaaggugagacgcugucucaaaaaaaaaaaaaaaaagaaagaaaagaaaaagaaauaagaaacguagagccuggcagggcacaguggcucaugccuauaaucucagugcuuugggaggcugaugcagaggaucccuugagaccgggaguucaagaccaacccuggcaacauagugugagacccuaucucuaccaaaaaaagaauuacaaaauuagcuuggcuugguugugugccuguaguccuagcuacuugggaggcugaggugugaggaucacuuucagcccaggaggucaaggcugcagucagcuaugauugugccacugcacuccagccuggaugacagaaggagacccugucucaaaaaauaggaaaaccuuagagcccaaccuuucaguugcaauccagagguucuugaaggaucagcgagugugcuagggcugcuggcaugaauauuaguccaagaaagaccucuuggagcauaauguuugcgugugcuguuugaucauuuuccaggucuuucuaguaacucugaguaggcuagaggaaaagaaucacuaagguaacugucaacaugcucaaguauuugcuuucaccugagguuuaacccugaauguugaccuuaaccccugacuccagcacugucccaucaucaauuuucccaguuugaguaauaauauuuaguccauaucuaagcuauggucuaaggaauuugcauuuuuuuaaauugaagcauguuuuugucagcuaagugacaacuugcagaaggaaaauucaugcagggguuugagaacucaauuaagcauaauccauuuagacuuuuugagggagaagaaaaaagagggcuuucauauucuuacaggcagaaaggcagcugacuccaaucauccuguucuuucauguuguuuuucuugaagggaagucuccagcuucuacagagguuugucuuuuucucugagugagaaaugcucaaaggcauuuucauuuacaucaccacagauuagugugcaaguguucaagugguugaauugggaaagcuuuagaucugacaucuguucugcucucuucuggccugaccccaagcaagaaagaaaaauuuaucaagaaauagaucuccuggaacauucagaagguuuugaaagagaccacacagaaaugaggcuucaagaauuuuuuaggguagcccaagccugcaggauucagagccuguuccuucuccaugggagcuuucagaacuuucugcuccaggaacagaacuccaaaagugaauuucaauagcagaugcagcaauuacacugcaccccuggcuuccaaaggaccccccucaggaagccauagagcguuugauggagaaugaaaugcuugugcagcagugcucucugagugagagaaggggagaugagagucccaugcaguguggcugcuuaguagaaaugcucagcucagugggaaagggcaggcuggggcagagaucaagacgcugccagauauuugacaggccagggcuucggagccagaggccccucucugcucuguugugucucagaucagagccucagagcaggacggaaaaguugaucugacuugacucuuucugcacugcugggccuuugguucacuagaaaauaacuggcagggcagggcaggccuguucuggacccaguugcaguguggcaaagugagcagcucgugccccuuucccaccucuccauguccucucaucugaggccucuuucuucucacccauucagccuggccuguuacugcaugcugccccuuucucuugucugacugaacucaaagaagugagauuuucuuuucuucacccaccaacccuuucuuaguuacagagcuuggccaguaacuuuauaaauggugaguccugcucgguccacuccuccuaacuccguccccagauuuaugagccaccugacguucucccaagagagagcgaauaagcaaaaacuugguaugccaccucugaaaggcagccagcucaguccaugucauccaggagagauggucagcccuuuuguucuugacacuccauugggaugaaguuuuucacaugucuuaggaucauaauccacaccauauaucagccccaagccuaucucccuuuuuaggacaagcccaagggguaggagagagagcuguaaccccaugguugugacuguggguuugacaggucuccagugcucacccagggcugucccuaccaguuacuuucaacucuuagugccgggucacccagaagccaagauuggcugguguacgaggggaaauaaagcagagugguuaaggagaugaacuuuggagucagaccaccugggucaaauccccacucugccacuuaacuauuugugugacccuaaccuccuucauucaugauuuuuuuuuaccugcaagacagguauaauaacgauguuauuauacuuagaguuuugugaaguuaagugaggcaauacaugaaaaacauugguaccugguauguaguaggauuucacuaaaugcuguuucguuuccauguuuauuguuauuagcauuauagaacugaguaugaauuaauauauuagugccuugcugauguccuacuuugaccaguccaaacacaauacugccucauguguucccagguuagaucugaaaccuauguucagaccugcguaaacaaaauaacaggguaguuuucuuaaaaagaaaauucguggaaacuuccaucuugcucugcagagauucuagaacagggaguucugcccaucucuuggaagaucccagaguccaaaugcagacagucuaaugggaaccacccaggaugcuggccagaggacaugcuuugcuuugcagcauaaaauauuuccaucuucaagcucauugucacucacauuauuuuuaauagcaccuuuuagauauagaaucauuuugaauucagaggucacucacauuuaguaaucacuggacucucuccucccuggauauucuaccaguauuuuauacauaggaaauauucaauaauuuuuguuggaugguucaugggggaaaaaauugaaguacuggccccaaagagaauaugaaccaaaaucacagaguuuggcagaaaaagagcacaauuaaugcccauuauguacauauugaguauuaucuuuggcuuuuagagucuuauuggcggaaauaauaaaguuauugcuguaauucaugugucucuucuuuggcuuauacauguagccuuagcuuagcaggaacucauuuuuuaaaaaucauuuaaaaaucaaaacauucaacuauaaacagauguauuucgacucagaaagugcccacuuagguugauucauugcaucugucugagaggugauaauguccaccuuccaggguguguugacgaguaaagaaaugaagguaugaagaagagguuuaagaagcuggauaacuuuucagauccaccaucgccagcaaucuugagugaaauuggcagaacauugggacuacugacucaccauauacuaugcacucuaucaccuucuaaagcagugguucuucaccuuggcuguacaucagaaucaccuggggagcuuuacagaaugcugaugccugaguuccacuccaagauucucauuuaauugguuuggaugugaccugggcagcaggacuuuuuaaaacuuuccagaugacuuaauguccagccccaguucagaacuauuguucuaaaaagacuucaagucacuuuuugggaugcuucauuccuuugggauaaucauaauaauaauaggccaguuuuugcucaguuuauccagcaucuaguguuuugcaacgggggacuuugagaagaucuagugugccaugggaaguguaagcccuagaaaacaugaucacccaauguagugcaggcagcauaaaugguuuggcuacuucuuaucuuuuuggcuauuucagagcucuuauuugaaucagacagaacggaaauaugucaguuuuguugguauuuuaaaaauguaucccaaaacacucagaaaaguauucaccuaaagccacaugauccaaucuuucuauuauuucacuagaacauacgcuccauuagcccagugcuuuuuaucuauuuguucacuacugaaucuccaaugucuaaaccguccuugggauacgguaggcacuuaauagauucuuguugcaaaaugaaugcauaauuaagaguggauuuauuaugugcccuguuggaaaggggaaccuucacacugauggaagcccaccucugucaucuaucuggaaucucugauagggagaggcggcucugcucagcuuauuggucccccagcuuaggggaguaucucuugucacuuggcugaggccuuuccgaugggcaucuucucaaauuaucccuuauaguuacucucuauugucacaaaaucucugagacugacagcaguguuccguuccauuuuaucaucuccccucuaaucauuucccaggcaauggguauggggauugugcagccuugagaaaucuacuuaaccucucugagcaucaguuuucucaucuguaaagugaagauacuaccgaccucacaaggcgguugugagaguuacaugacuuaauguauuuuaaguucuuagcacaguguuuggcccacaauuggccuuuaauaaagguuaaucuuagucuaccuugcccuucaguuaaacaguagcagaggaaggcauaaguacaauacauucucauuauucacugaaguuuuguucuaguaagucaccacaagcacugaauuagcaaauacugaaccacugcuucugggagcaauucaguuagguuccugcaagccuccaaucacauuuuuaucaacugaucaauaugucauuuuguuuuaugugugauucuguuuaaaggcacguuauuuaauauaaauuacgauucauuaacauugaacucauggccaacagcaagcacugcagcucaagccagaaugaagcuugucuaacacccguauuuuccauaaggcauaucacagccugcuugcucauaaggaaugacuagacagcacuucagcacaaaguuuggggccauuuuagacagcugagucaccaucagaaagcacaaaaauacaaaaagaaguggcaccacacagacuguaggaggggugcuuguuugauagugugacagcugaaacuagaagccagaguggugccuuguuccaccucaguggggaccccgugacucaaauguuugcugcucugugcaugucugcaaaugauuugauuugggggaggcaauuacacuuuagcaaguaggugaauuugcaaauauggcauccacaaauagugaggauugacaguguuuggaaauggucaaggguucagcaacaagcauuagagaacuaccaaggauuccgagggcagaacccaagugugggugacgcuuccuuuauaugccucaaagcauaaaacgucauucagggcacagagcaguauuuaggaaauaauucuuggaugacucuugaugcaguuuaacaaacacguaaacuagccuuguuuugacuaucccaugaugagccuguuuuugcccugcacccuccuacaagauguuagugagaaguguagaguucauuaaguuuucauaggaguggcaggaagguuuugugggaggcuucuccucccauuucucugcacagccuucccaccagcuacagagcaucccacguggcccuuacuucacauggagccacccucaaaggcacuguccuguccacacccuccccacaaccacgccugucaucucucucccaguuuccacuuggcaaguaggcucugucccuggcucuguggagugcacccaucuuuuagcucaggacacaagguuacuuggauccucacuaucacugaaaguggaaaauuauaauaauuccaucacucacauccagugccugcuuuuuguaaaugaugugcugggugccagauggaaauuugccccaggagaaagacugccccugcucuaaggagcuuagaaaccugcaguccauccugguggaagaaagaagagggaguuagacucaauauaagagagucccuguguaagccaagccaauaaaaugcacaggaacaaagaaugcacacacacaccccucaacccuucauuuuuaauuauuggaagcauauuuucugggcaauuucuacuggaaggggaaaaaaugaacaaagguacauuuacaucuguggccugugaauacauuauaauuugcagacucuaugagcuuauacauaauguaacuauggcuagaggugugguaguacauaaaugaauuaguuauuacuuugcccaaagugacauuccagagugcagaugagugaaucuuauguuugcuuagacuugagcuaaggagagaauauugauccaaaagaaucuuaaagauuguauuuaaauaccuuaguaaaugcuaaggaaaaaauaugcaguaaauucacuucacucuaccuagcucccuggcaaauguguaaaaaaaaaauuuaauaggugcaaugaccuauugaugagaauacuguuuggcaguuagucucuaacaauugucagaaguuucacuuuuuggacaaaccacaguggauuuuaaauucuuuuuuuuuuuuuuugagacagagucuugcucuguugcccaggcuggagugcagaggugugaucuccgcucacugcaaccucuaccucccagguucaagcgauucucccgccucagccuccugaguaacugggacuacaggugccuaccaccacacccagcuaauuuuguauuuuuacuagagauaggguuucaccauguuggccaggcugauuucaaacuccugaccucaagugauccgcccgccucggucucccaaagugcugggauuauaggcgugagccacugcgcccagccuggauuuuaaauucuaaacuuacauauccuuguuaauuaaacuuuagcugcugugcagcuucaguguguccugggaauguaagcuaauuucauuuuauuuucacuaaagaucuuuuuuguuauuaaacacuaacaguggaaauuuguagaauucauugaaaucaaagacagucauuguuaauauuuuguauuccauucuaguuuuuuucuaggcucauaugacauuauuuugaucauacuaaccauauguauuuauaucuuguuuuucauuuagcaaguaggugaauuugcaaauguggaguccauauauuugcaaauuuuaaauuuauaacuaauauuuuccauguacuuaaauauuuuauaaauuuuauuuauaaaucuauauuuguaauaauuugaaugaaccauaauuuacucguuuuucugucauaaauaaccuuuuaauucacaucuuuagacacaaagaucuuucuucugaguuauuucuuuauaauagaucccaaauuggaauuaccaauaaaaugauaugaagauuuauauauauauauauaaauuuuuauguauugacauuagugauuccagcuuaacagccucuucuaaacaauucagacacauuaucuccuaaaaacaaaagcccaaaagcaaaacauuucaauaauacaauagaaauuacuuguuaauuaucauuagauuuguauugugacugcucaucuucaauggcauagagaccauugagaguuguaccugcauccuaguuucuauuuauaaaauuugcaguuacuagccauaaaaccagggacccugccuguuaccuaguuugcaucuaauauuaccaggaaucaugguuucuaucucagaucaugaagaguuauuccagcaagaacagaaaggauauguguacuauaauaguuuucuuuuuuuaaguucaauuugaucaaucaaauauuucaaaauaacagggagaaggaaagaauauuccuuuguacauaauugaauugagguucauaaaaagcauccgcauucuuacuagagcagcuugaaaauguuuguuguaagggcagccacccaucugagauguaaacgggaaaaacuuugugaaauuuggagguuuugucuuuaagauuuuuuuucacagaagaaaagaaaaggucucuacuauucuauuugacuacagucaauggcauaccuccagguugaaucucagcagcucuuuaaaugcaacuucccugcauaauacugagaccaugauuugaccgcuuguuucacuucaguuucugauaugugcuguuauucuccuccugugagggacagccuguuuccugcuccacuuauuaaaacuagaaaagaauuuacuuacaacauuuuuaccacacgugcccuuggagcucuccuuggguccuuaagagggcuggcaaagccuuguuucucuuuuucucaagcccuuuaaucuccagcacauucagcaacaauuguccuuuguaaggcagguauuccuguuaauacaguaaacagugcugagaauacauguauaaaauggaaaagcugcaugugauuuucaggcagaauuauucccguauucgacugggagauaggaacaguaacagcacagugcauuuucuaagaauuuucacauauguucauaugcauaucaccuuuuuuaauccucacaauaacccugugguaaaguauuauccucacauuguauuaauaaauuaggcaaccaagauucaguguguuugaguguccaagcagagccacugcuaaugggaauugaaugaagcuggaaugaggaauccaggugaguugguguguacacggacacacacacauguacccacauuucaauccaaaggaagcuaaaauugagugucagaagcaguuaaacauaaauaugcuucacucacucauucauucauucaugguucuuccauuccuaaucuuguaucuccuacauuaaauucccugcauaguuaauacucugcauuuccacagucuccaguuacucuggucauuaccaguauguggaagugcauaugcuuuugccuguuuuguucaaccguguguguguuuuugaagaaacacauccagagacucuaaggcuuuguuuugguaaauuaaagcaacuuaaauuccagguguuggcaguggcaguugucuaacauagcaugauaaaauuaucccccagguuccuauaugcgugguuaauuacaggugauccaacucccaaagaauacacauggccuggaucucugagcucugcugaauaaaauaaccaauguauaauuucauuuucugugaaaaauguuaacuaaacuagaaaaggugaucaaauaaacuguugcucucacauguuuuguuuuguuuuuuugagauggagucuugcugugucaccuaggcuggagugugcaauggugcaaucucagcucacugccaaccucugccucccggguucaagcaauugucccaccucagccucccaaguagcuaggauuacaggcgugcaccaccacaccuggcuauuuuuguguguguauggguauuuuuaguagagacgggguuucaccacauaggccaggcuggucucuaacuccugacuucaagugaucugcccgccucagccucccaaagugcuaggauuacaagugugagccaccaugcccugccuucucacauguuuucuaaaaauaaaaccucuaucacugaagagcauuaagaacuuugugaggaacaaauuaacuguucagucaguuugaauaaaauugagugcucuggggagacuuuauuguuguuuguguguguguuucaacacuacagaauaagaugugacugugacccacuaaguccuuaaaaacaauaggguauaucauaagaacuagaaagccuaacuucagacacugacaagaaagcaggaaauacuacguuucucaugguagcaagacucaggaaauucuuacgcaaacaaagagugaaggaacaguugacggcaguuuucugaaucaaucccucaacauauaaggagauggugggauuuggggaagaggaagagaagaaugaugaccaagaaggacaauagcuggucuauugguaaagaauguguucagcugcaaguaauagaaaacuuggcucuaguggcuuggccaaaaugggguuuauuugcuuguagaacagggaguuuagguguagaugguuucugguguggcuuuaaccacucagcagugcugucaaggaccaggguccuuucacucuuucugcucuaucauccuuugcauguuggcuuuuguauacaugcuuaauaauugcaagaaggcuucugcaccucagaucaucgucaucauuaaagacauuuagaaggaauagagaaaaggacaaugccagccacaugucccauuauaucaggugagcaaauguuucccagaagcccauacucagcaaauuucugccuaaucucauuggccagaaaugaucacugggacacccuauugucaaaagagacagagaagggggugguggacacuggggcugagucagccggcuacauugucugccauagcugggcagcaguucuuuuuagcuuuucauuucagacacaguugcugaaggugaauucaaagggugacuagaagcuuaguguuuuagagaccacagaccccaucagacuucacugaagugugaaaucagaugauaaaauaggucauagcuggggggaaaaauggaaagcuuuguagcaaauaugucuuucccaaaguucaguggaaagaaguccuaucugaaagaugucaaaccacauagaguccauuuugaaaugacauuucacucuuuccuucacagaaauaauggcuaccagaauugaggguuccugccugauuuaauuuaauauguggaaagggauaauuuuaaaaugaacucaaaaacagaaaaaguuauaauuguauauggauagaugcaguaaaacugcuuuaaaaaagucuacuuucauuuuuauaaauuguauaaacuucaauucauccucagaucuaaguaaggugaauuucuaauuauuguaguguuuuuaagcuuauuuaagucauacauguuauggagauuaauguuuuggagagggugggguucaaauccccacucccccacuuacuaaaugugugauuauuaaaugacaaguugccucucuuuuuuuuuuuuuuuauuuuuuugagacagagucucacucuguugcucaggcuggaaugcaguggugugaucuccacucgcugccaccucugccucccagguuugagcgauucuccugcuucagccucccaaguagcuaggauuacaggugcccaacaccacacccagcuaauuuuuguauuuuuuugguagagaugggguuucagcacguuggccaggcuggucucgaacuccugaccuccagaugauccgccugccuugaccucccaaaaugcugggauuacagacgugagccaccgugcccagccagcaaguugcuccucuuaaccucaguuuugucaucuuuaaaguggggacaauauugcuuacccaaaggguuggugagaguauuaacuucauaugagguucuaagcauagugcuugccacacaauagggucucaaucuggccguugcuuuuaucauuaguaguaguggcuaaugcuucagaaacagcccucaaaugucauacuaugguacuuuuaccuucauucuucccucuuuuucuggagggauaacuagagaugggaugaaggguagaagcagaaacugagagugguaggaaugauuggaugguauuauauggagaaaaugagggcuguucuugcccaaacuggucggaaccucaauauuuuuauauacuuacaauuuauagccuaccuuauuuuaacauuauauuuguggcaguuuacaucaccaugcuuuucagauacagcaauagugcuguaaaaagcacuaaacugccugggcaugguggcucacaccucuaaucccgauacuuugggaggcugaggcaggaagaucacuugagacuaggaguucaagaccagucugggcaacauagugagacccugucuccacaaaacaaaacaaaacaaaagauuagccaggugugguagugcauaucuguagucccagcuacucaggaggcugagguaggaggaucacuugaaccuaggaauuugaggcugcagugagccgugauugugccacugcacuccagccugggugacaaagcaaagcccuguaucaaaauaaacauaaaguacuaaacuuagaagaaaagagucugaauccuccugccucagccucccaaaauguugggauuacaggcauaagccaccacaccuggccaagcaucugaauccugacuauacauugacuaacagugaucauuggcacauugcuuaaucucuuugucccucuguugucucaccugugaaauggagcaagcaggaccuguauuaaaggauuaggguuaggguuauggaaauaaacgaagucacagauuugaaagccuuuguaacuguuaggccuuuaugaauccaagauuguauucccucugacuuuaccaacuauuguaguaacaacucucaaauaugcccagucaguuaacugauauaaccuugcguauagcugugucaguuauuuacuuuuuuccuauauaccucugguccacuccuccccuucaaaucacuaucagcaaguagugcccagggacuccuguguuauaacauuagccagaaccaaacaguuaguaaggaaucugcuacaacaaauuuauacagagcaaaauauaaaguauuuuaaaauuggcauccuuuugagauagucuguuccucuccugcccuucauuaguuggguacucaaggguuggcaguguuuucccaucuagaagcucaugcugcauauugaccugcaaagguauuaguccagguaccaauggcaacuuuuauguuauccaucaaucacuuuaaugaguacaagaaagcauccuaucacccugccaaaagacagaggaauuaagaaugacucauuuaucacuuaaaugugugaguguuuucuaugugucaggugccauccuggugcuguggggcacagaacacagacuccaguuuccaggggguuaccguuaaauggggcugaagcagcaacagugugucggucuccuguauucaaucuccucauaauaacugagccacuagaucaggagcaguggcucacgccuguggucccagcacuuugggaggccgagacagguggaucaccugaggucaggaguucgagaccagcuuggccaacauggugaaacccagucucuccuaaaaauacaaaaauuagcugagcguggugguaugugccuguaaucccagcugcucagaaggcugaggcaggagaaucgcuugaacuugggaggcggagguugcagugagcugagaucgcgccacuacacuccagccugggcaacaagagcgaaacucggaaucaaaaauaaaaauaaaaaauaagaugguaaaauuuguauguguauuuuacuacaauuuuuuaaaauuagaaaacaaaaacguaaauccucuagauaccaaaacccaagccccauggaaaacauuuaccacaaaaaggugacaagcuauccccacaaaugccaaaauauaaguggguuggaacaagccaccuaugccaccaagccugcaggcugucagcagcuagguggaaagacacagagggcaguaaugaggugaugacagauccaauaauagguaaaucucaacauagccaacagguuuucacuggaaaguccauuagugggugagugcaagggacccaaaggguggaaggggcuugaguagccugggucccgugaacucucaaaacccccagccggggcuccugauaugguuuggcuguguucccacccaaaucucacauugaauuguaacuccauaaucuccaagugucaugggagagaccugguggaaggucauugaaucauggaggcagguuuuucccaugcuguucucaugacagugaguaagucucacgagaucugaugguuuuauaaagggcaguuccccucugcaugcucucuugccugacaccauguaagauguaccuuugcuccuccuuugccuuccaccaugauugugaggccucccaagccaugugaaacugugaguccauuaaaccucuuuacuuuauaaauuacccagucucagguaugucuucacagcagugugaaaauggacuaauacagcucccuuccaggacagggcccuucaccaaagaaaaacuacuaggaauagaaucaaaauugagcaggacagaaacaauagagaugaaugaaacaaaagaccaaauaaaagugaaggagggaaacaaacccagaaaaucacagaaagcaaguuacuguuuuuaacacuaaaugaaaacaacacaaaauggaguucugaggaguugcaaaaagguauuuuggacaaugucuccuuguaaggcuguggaaaaccaauuuuacauuuuaaaaaagcacagagaaagauuaaggccaaaccccauacuagaaagaaauuuuauauaagagaagagugagagagagaaagggaauaacaucccuaccugcaaugaaagcacgucugcaaacaggugaaaacuacauacaacugacuaucugaauaacaugagcuaaaagacauuuuuuaaauaauacaaauaaagaguaacaagccaaaauuagaauaacucgaaaauguggugaagaucucaguuguuauuucagaaaugaaaccaaaagaaacacaauagcgaauaagaacaauagagaaucccuuaaaagacuaggagguuaaaaggaggaaaauuauuaaauuaaaaagaaaggaggaaugaucaaaagcagcaaccacugaagauaugcagagcagaucuagcauacggauaacaggagucacugaagaaggaaaccaaagcaagaaagcaagccaacacuaaaaauuauaacuccaaaaaacuucacugaaauacaagaaaaauguagaacuacauuuuggaagaccagacaguauaccugagaauauggaucuagaaugacaaauaccuauugauauucuagugaaaacaauacugcacuuuaaagaaaaagaaaaaaggaucuaggccaggugcaguggcucacaucuguaaucccagcacuuugggaauccaagguggguggaucgcuugaucccaggaguucgagaccagcccaggcaacauagugagacccuguauccauuuuuaaaaaaaauuauccaggcaugaugucacacaccuguaguuccagcuacuugggaggcugaggugguaggacaaacugagcccaggagucugagguugcagugagcugugaucacaugacuauaauccagccugggcaacacagugagaccuugucccaaaaaaaaaaaaaaaaaaaaccuuuuuuaaacaucugaguaaaaagauuaaaugacuuauaagggaaaagauuacauuaucaucagaucauuugacagccccugauuuuaccacagaaacuagaagccauugaauaauagaggcaauucagguuuccuugcaagccauuuuugggcagugccuuauaagugguggaagcaagaauugcugcacguguucagaggaaguagccaugacuuccaccuaggagggcuucauggaggagguggaaugauugcaucuuaaagaaaucuuggaaaauguuuaaacugccgacaucagaauaguauaaugcauaaacaugugacuuacucucaaaauguucaagucuguauaauguugaauucauugcacaccauuucauguccauguuuuuucuucaugauuuuuagaaaaggcacuucauuuuuggcuaaaggaauuuuuuuuaauacugaaauuugaguaauugauucuguuaauccagcauaugcuccuauuaaauaaauuguauacaauucagugacuucauuagagaugauaagccacauacuuaaauuuugugauacucccugauaaucugcauucauugauaauugagacaaaauuaaucauauauaaucaagcaaaaaugcgaacaaaauuagcugucagaaaagcauuauccagucuuuauuuuuuaguuaacuuuagauauuuuaacaacacauaaaaugagugguaggguauauuuguauuuuacuguauaggacaccuucagauaaauucuaaaaauaauuugcauuucauguaaugcuuuucacacaaaguaauggccaaacuuuagggucaguuugcccugcuucauaccacaugcagaacaaauuuaagauggauuaggacuccaaauagaaaagaaaaauucuuaauaaaaaacuauucaagauggauaaaaggauuaauuucaagaaaaauaaaacuaauaaaauagaacuauucugguaacccagaaaccauaagagaaaggauuaacagauuagcugcauuaaaauuucaaauuuauuacuuauucauucacccauucaugagauaauuguuuuuauugagaacauacuaugugccacgcaccauuccugcugcugagggcacagcaauguacuaaacagccagcaucacugcccuuguggcaugcuguauggcaaccaaaaccauaaacaaaacaggaagacaguaauagccuggagaaguuauuugcaaaauauuugauaagcaaacuaaauaucuguaguaaacaagagcucauguaaguugaucgauaaagcaacaggaaaaagagaaaaguaauaaauagugaauuaaaaggaacaacugcaaguggccauuaaacaugugaagaguugcucaacuucacaacaaguccugaaaugcaauuagaacaacaauaaccuacaauguuuccccguucagcuuagccaaauuuuuugaaaauuucucacucccacugcugggaaaugugcagggaaauggggaccuuccugcacuauugccaagaccagaauuccuaacaagcuuuucaaaaguaaucuaggaguauuuauuaaaauuaaacauucucauacccuuugacccagcaaucuuauuucuggaaaccucuccuacagaaacaaaagugcuaacgcauagggacauaaguauuaagaauauuuauuguaucauaguuuguauauagaagaauuuggaacaucuggaauauucuuaaagaauuaugcccauguuuggggacauuuugcagcuauuggaaagaaugaauuugauuuauguguauugaacuaauaaagcuaauacauaauacauggauuguucacugaaaaaaaggcaguuuaagccagguguggugguguacaccuguagacccagcuacucaggaagcuugaggccaggaguucaagauaagccuaggcaacauagacaaacccugugucuuaaaauaaaacuuuaaaaaaaauuuaaagcagcuugcauguuaauagguaugaaauuuucauuaaaaaaauaaaaacuauauguauaaacaguuuauauaaguuguugggggguuaggauuaucaggagguaaaaguagacaacuugcugcuucuuuauauauuuguauauuugaauuguuacagugagcaugcacuuuugcauuuuuuaaauagcaacaaaauauuuuaaaagaauacugaaccacuacaucauugauauuccucauaacuaaauuucgaagguucuuuucuuuccuucuucuaauuaccaaaaacuugauucaaauuuaaaacuauacacucauagaucuagaaugauucuggggugauauuucaguucaucauuaaccuuucccuaaccacuucccuguaucaucuuagucuaagagauuucaaacauggcaacuccaaagacgcaggucccagaagagcucucugagaccgcgauuugggacccacacuggucaaaagaggaaaaucacagagcauccuuuguaaacucagccuucucucaggaaagucuuucuuauuauaacugauauuccuugggcugaaacucacaccuguuccuccacuucugauguagagacaaagaggauucuugaccccaaaggaccuccuagaucauugcuucaaccuuuccauuuuacagaugaaaaaacugaggacuaaguaaaauguggggagaaaugguaccaaaacccacuuccccuacuugcuaaucagugcauuuucuguugcucuaguaguaccuuucuuucucacacaccagcauccccgagucgguucuacaacagugccuuucaccugguaagccaaagucuguuggaugcaaacuguuuacacagaaucccaaguagaagcuaaguuaucaacgucaaaggaccaggaaggcagggugauucaauugcaaacccaaagcagcagcacuuuggagccagaauagaacucugaauaguccuuuauuuugugcugaggaccuagaacuuccacuuuucuuucucuggagccagacuucaugcuggggcuuuguuuuaaaaucaaggccccagcggacucagaacuaaggaauuuuuuucacacauauucaaaacggaagcccugccaccauggggaagcucaagguccuugcucagcuucugcuuguguuugggcuacaugaaaaucucuggguggugguugauguuucccgcaccaaaugauuucugcacaaggcccgacauucccccugcccugauagaagggucacaccacacaccaagaaggaugugacuaauaaagagugugacuucagagaauuuacaaguccagacaacuucugauaaacauuuaaacagaggucaggaauguuuuccuuucugaggggaaaauauguggucuauggugugagugggaggggcuggugggggguaaaucuaagcauuagcuuccucccuucauaauucuuaagcauuuuaacagcugucauuuuuaaugcccuaacaggcuuucagacuuagaacccauagcugaguaugggccagaaagcucugugaaaaaaaaaugggcaauuccaaagugauuaccaagcaaguuuaaaacuaacauuaggaucauuagaggcacuuucccugggcccugcccugaagcuaagaauguuccagaaaguaucacucaaggcccauuuuaaguacccagguugggaucuucacuuccccugcugacaaaagggggaagcuccauagaggaaauggguguugacuuccaggaaaggaaaggugagaaggaccagauggcaucugucagcauccucagcccaccggagacauucugagaacauuggccagggccaaggaggagagauugaugagcggaagccaacagagauauccccuuggcaguggaaaggaaagcugcaggucguuuuugugacccaacacacuuucauugguggugcugauccagcuaaugucuuuuagcauuuuccuuuucauuggcuguuugguuugucuccugacauuuccuggaucggugugcacgguaggcauagggugagugaguaagacuaguauucucucuggucaguucuaaauaaaaaguaagaaaagaaaaugucagccaggugugguggugcacaucuguagucccagccacuuaggaggcuggagugggaggaucacuugagccuaugaguuagaggcugcagugagccaugaucaugcuacugcacuccacccugggugaaaagugagauccugucucaaaaaauaaaauaaauuucacucaaaaucuuccucuaaaugggaagauggggacucaguauuggaagaaagguucugauaccaacuuuaggaaaacccuucgugugucugcaaucaauauucuuuugaauauaucagcuuccguuguuucagcuauaaccccuguaggcuggagcacucgggcaaugugaguagaaugcagcagugucaauuucccuccuuugaaucuuagacagguagagaaauuaucucauuuuaaaguccuaaguauucccauacucaguuuuagacauuucuugcuuuucuuacugagauaaaguauguuauuuugaaaauccagucuucagaaaucucauucacuuugucauugguucauucauucuuguagucauucauucauucagguacccaccaagcccugugggagacccuguguugggcuaaagggccaugucaauaggccaucacucagaaaaccgugggaaucguggucaggauggaaguucuagagucaaaccuacccugaauccuggcucugcuucccaugugcucugugauucugggcaaguuauuuaaccucucaaagccuccaauuccucaucucuacaaugggguaauaagcauagccacuuaacuagauuucugugaggauuaccugagauaauauauggaugagccugcacugugccuggcauacaguaaacucaguaaaugauaauagaggcaaugguaaggacaguaguaacuuuuauuauuaacaauuauuaaugagacaaauagcaugagagugauaggaaaagcgcuguuagauguuggacagaagauaacugggaagauuucauauagaauuugacuuacuagauuuuuuucacuugagguuuaaaaaaaaucuuaguggagaaauugggaaauucccuuuccuuugcauuucauuuucuauuacuuuccugaagacugaaacuucaguguagaauuuagcugaaggcuacaucccagcauuugcauuggccuuggagugccaggguaauuauucugucaauuauuugacuuuuuaaagucugucuaccuugaagaaccucugcaaaggaggaccguguuaauguguaacacagagauaagcaaggcucugcucuuuuuuuuuucccauggcuguucaacuggaaaacugaaaugguucuauuugcgucucagccagcaguguugaaaggugggggauaaauggcuuuuacuaaugaaguacagugggaugugaauuuuagcaaugcaaaaugccacguaucaccugcaauuuguuuuuuuaaaacacacacacacacaccaaaaaagggaaaucacaagacaacauaaaccucgcuugaagaaacgaucguguuuaacaagaagacagcaaagagaaauacucugaguugagccaaguagaugugugcugcuuuuguagauggaauaaaugauccucacuugcauagacagcaaggucauuuuucucacccuaaauggaaggcauuaaucaucagcucugaagaacaacauucaggacaagaagaaacaagccaccgcagcaggagguauugaauugagccagagaacugggggcccuguggacgggagccagcucagcccagguagcagcucccagaucagcaggggugggugguggagcugguccucuugagcccuaacagcuuuguugggaacuuucuauuguucaagaaaucuccuaguuaccauccaugugcauuucugaaaugccugacugugcuccgggcucuguaggcucuggauuagcugguucucuguggaccccgucugcauaaaaagcaaagaucaaaggaacaugguagagcucuuuaaaaaaaaaaaauccuaaacucacaagugaaugggaaaugcauauuuauaucacuggcccaucaaggguaaggguguucugugagaggggaggaagagaaaucauuaagcaggagcgaagcucuucagauuaagagcuggaagaacugcauugaagacuaagaggagacugaaggcaaacaguggaucuuuuaccauuuuucuuuuuuuuuuuuagacaaguuugaaaucgaguuuuaccgcuuucccaucagcuacaccaaguaguuuacuugugcaguggcuaauuaauuuguugaggcagaauuuuagguuaccuaugagguaauauggaauagugguuaggaggugucuagcuuuuuaaucccagcucuaucauuuaugagccuuguagcacugggcaaguuacucgaccuuucugugucucaguuuccuccucuguaaaauaggagacaguacgaaccucacagggcugucgugaggguuaaauuauuuacacauaugaaugcccauagugagcagucagugaacagguauugcuguugauuuuguuaccguggccacaguugggugggguggguggugcguggcaggaaugaguugaggggggaaaagaguaacaugaaacaggauaauagaaugugguuguugacaggaaccaugaaagucauccgguccagcucccccuuaaccaaggaaacaaauccuauugcauuuuaaaauaauuguuuugaaauuguaaguaauagugccgauuuauugauugagugcucugugugccagacagcaugggaagcccugcgccugcaucacaacacuccacgaggccugagugcuguuauuaccccauucuguagaugagaaaacugaggcucaaaccguuaagucauuuagccagcaucaccuggaucggaaugcagaccugugugaaugcagagauucugugagugacgcggcaguucuguucccuuugcauuucauuuccuguuacauuccugaagacugaugaugcuucaguacaagauucaacugaaggcugcauuccagcauuugcauuggccuuggagugccagaguaauauguucugucaauuauuugaccuuuuaaaauaugccuucuuuuggucagcugugguggcucacgacuguaacccuagcacuuugggaugcugaggcaggcagaucacuugaagucaggaguuugagaccagccuggccaacauggucaaaccccguuucuacuaaaaauacaaaaauuagccggguaugguggcaugugcuuguaaucucagcuacucaggaggcugaggcaggagaaucgcuugaacccgggagauggagguugcagugagccgagaucacaucacuacaucccagccugggcgacagacagagugagacucugucucaauaaauaaauaaauaugccuuucuugaagaacugcuauaaaaggaggacuguuuggaugcguucuguggucucauagaagugaauguauaacauccaugaaugcaugccuuauucugcuuugucucuuucauauaaacgcagagcaccauauuuuguuuuuuguuuuucuguuuccacacuauacugacauacagaguacauauuuugaaaaauacuuuaauacuauuaauuuugaguaaaucauguuucaguacuagugagguuagcguuuaaaauaaauaauauuuauucauaaaaaauuuuccuuuggaaucaagccaucauuugauuggauaugauugaaauuaugaguaagaugaaggauacaucccugacaacuuucaacuauugcucagauacacaugacugcguuuucaggaagucucuuuauuguuggauauccuuuacugcugacagaccuucguuaccuugaccuuaaauagguaaugauucuuugaucuuagugcuucccucugaaguaacuaaaaucaagacugcucauucucugacauggcuucccuucaaauguagaggauauuucacagguguguccccaccccaggcuucucuuccuuaagcuaaacacccacgucaccuucuaagcugguuuucagaccccacaagauccuuuaaucugucgguucuacucuucaccucuuggaagggagccagugcugcaagacugucggaucuguacagagcaggcuggagccauacgcuuacacgaaggugaccaaaauggcuggcuucuuagcuuucuggcuucacugaugucagggagguugcaugguuaaauaaugaaggaggagugacaagcaagagccaagagagggacauccaaggacuguuuccaagugauccaugguagaggcuucauggcauuccuguuguuugugcuuugagcaagaauuccuugguacguugguucuaguaaagagaucagcuauggucugaauauuggugucccccagaaaauuucucuguggaagcuuuaacccccagugugaugguauucacaggugaggccuucgagaggugaaugggauuagugugcuauaagaagagacaaagaaagaugaucucucuuuccaccaugugaggcuacagcaagaaggcagccaucuacaagccaagaagugggccuccccagaacccuaccaugcucgcacccugaucuuggacuucccauucaauacacuucagaugcuuaagccaccaaguccaugguauuuguuauagcagcccaggccgacugagacaagagccuugguauucgagauuuuuauaucguauuccugaauucucgaaaguucugaaaauaaagagauguucauagggcccauauauaguuauauauaacagauccauguuccaaguggacaaggaugaguggaaaggcagguacuucagucauacacagauauucagguagcuccuugaugaccugucuacccaccacauuccucugccuugugucuaccuuuuuuuucaaaugugaaaauuaucuggacuuuauuuuucuacuugucaaauucucuuuagcuuuuuuuagcuguuguguugaccucuucuaucucuaaaaggcauuugguuauuuuuuuaauguuuuugcuucacugaagcuuagugugcuuuuuaugguuuuaugguuaccuugcagaaaucucauuagaaaagcacuuuaauauauuacuuggcaaugagacaucugacaauguucuaguucauuaguuaggaaaccuccccaagcuuggaggaauagacauuccucugugaaugguagagcuuugaucacuccugcaggggccaggauuuauuuuaaugcauuuuaggggaggagaagauauccuaagccuggcaaaauaaaaauaacacagauuaaggaaacaaugaaacauuauuuuaaaagaaaugcacuucaguuaauauuauucuaugggaucuccugaguccuuugaaggcagagcuuaucuuagaaaauaugucuccuuuagugggcaggagguuaguuaagcaaccucacaccagaucacagauuauacugaaaugauccuaauaaggaaagacuuuccaaagcuauacucauuuuagcaugaauaaauggauucaagucuuauuugugggauuuuaauuuccaacuuugaauuugcaaacuaucaaauuccuucaaagacacggugugcagagaaggcucugaguaauaggauugcuuauuuuuaaaggaagaugcccuuuagcaaagcacgaggcuuugacgugugaucagucaaggguccaaucagcacggauuuccccacauggcacuguuucuuguugaguuccaaccagauuuaauaacucauacaaaaugcaacuccacccugagggugccuagugcauucaaagcagauaaugcuauauuguuuuaacacagauuaugccaaaugaaguacaauuuaaauuccugaagcaugacaguccuugggugcuuguggcuguguuuuaguugggugcuguaucuuuucuuucuuucuuuuaauugaaagacuuaaaagaagcaagcugucugaaaaaguguuuaaaagagcuugguuuucaaaugguauaaauaggacagaggcagaggaugcuauggaaaaagggccuuccuccaacuuuaagagguagaggaaagaaaugggagagucugggcaaaagugacguaagccccugaagucaggcuggagacucuuuugugucucaugugaggagagaaaugggugaagccuauaguacuuucacacuccccugaaugggaaguagaggccagaugccaguugcagcuucuuuuuaacuuuuuaacaccuucagaggcaggagaaaaugguggguggggggaauguuuuuauuugggauuagagguaaauuuucaggccggacgagguggcucacgccuguaaucccagcacuuugggaggcagaggcaagcagaucacuugaggccaggaguucaagacaagacuggccaacauggcaagaccccgucuccacuaaaaauaccaaaauuagccaggcgugguggcacgaaccuguaaucccagcuacucgggaggcugagacaggagaaucgcuugaacuugggagguggagguuguagugagcugggauugcuccacugcacuccagccugggugacacagcgagacugugucucaaaagaaaaaagagagagagagagagagagagagagagaugcauuuuccaaagaggaaaguacgaugggcagaguuuggaagcucgcuugcuggugccaggacaguggcugggugagcugcugcccuugggaaagucgcuagguccucccaucuuuccucuucccuuuuuccucaccuuugugcgauagagauuaugaucacucccgaucaacuccacaggacuguccugaggaucagauaaagagaacacgcuuuagaaggcucaccacaaaugggcuguggccguggauguggugguggugacaguggaauuggcaucuggguuggcuuguagccuggccuguaacuguaguuguggaagcuuagggggcuguuugaagaggccccuccuagucugaccucaugagccagagacacuaguaaucuugggcaguucuggggcauuuuguuguuauuuauuuauuuauuuaauuuuuuuuuuuuugagucagggucacucugucacccaugcuggagugcacuggcaggaaucucagcuuauuucaaccucaacuucucuggcuugagcaauccucccaccucaguccccugaguagcuggaacuacaggcacacaccaccaugcccagcuaauuuuuacauuuuuuauggagacaggguuuugcuauguuguccgggcuggucuugaacuccugaacucaagcaauccuccccucucagccucccaaagugcugggaucacagaacugcaccaccaugcccaacccaaaaugcauuuauuuaauauacaucacaagcacucaacuggaggcuuaaaagacuaauaauaauaauaauaauaauaccacagcucaagauacagagugcuauacaaaaaucacagaaaggacagaccaucuaaggaaaacuuaaaaagacgacacaaggacaggcugggcagccugggucagggcuccuggcuggugaccugcuuuaaguagguuucuugcaggugcuucuuaaaagcugugggggguuuccagagcuuggcagcaugccuguucaacgagcuaucaauguuggguuugccucgaaggcuguggauggagagcaggaugguccugacaucauacagggcagaccacuuguccuucaggauguccaggcagauauuacccuggguguccauguuggggugguagcagggcgugaggaacuucaccauggguacauuguaaggguagccccuggggagcucuagggagagcuuauaccucaggucuucauaugcugugccagcugcucaauggaugguccccacccauuugaaaagguugccugauucaggcaaggcagaaaucccugugucacuaggcauugugaaggucaccaacuccugcuguagccuuuugcccacaagguaccgggcagcaccccugcuggugguggcuaggcagcagcaacgcuggugguggcugggucaagguuuugacaggccaucuagguggcacugacagaaagauaggaacuuaaagaacacaacugcaacugacuauuuaauuuuuuugagacagggucucccucuguaacccaggcuggagugcaguggcgugaacacagcucguuguaucaucaaccuccugggcucaagcaauccuucugccacagccuccuaaguagcugggaccacaggggcaccccacacaaacacacucagcuaauuuuauauauuuuuguagagauaggguaucugcagccauaaaaaagaaugagaucgugucuuuugugggaacaugaauggagcuggaggccauuauccuuagcaaacuaacguagaaacagaaaaccaaauaccauguguucucacuuauaagugggagcuaaaugaugagaacucaugaacccaaaaaaggauauaacagacacuggggucuaccugacaguggagggugggaggagggagaggagcaggaaagauaacuaucgaguacugagcuuaauaccugggugaugaaacaaucuguacaacagacccccgugacacaaauuuaccuauguaacaaaccuucacauguacccccaaaccuaaaauaaaagguuuuuuuuauuaaaauuuaaauuuaaaaaaagagauaggggucucaccauguuucccaggcuggucucgaacuucuguccucaagcaaucuuuccaucucagccucccaaugugcugggauuacaggcaugagccacugcaccaagccuaggacauuuuuaauaaucaccucccuuaccccagccaagguucccaauccucagagaaaaagcuguucaagacaaaccuuccuaagcagacccaaagcuuugacagcccauaugaaaccugccuaggaguacccugcuagccuccaugaccaaauaugccacagcaaggcugauguggcucccuuagaccuauucugauaucaacugagaucagucccuuauucugggcggagagccugauggccacaugugugcuguuagaggacacugcccacacagugaccacccagggaaaaagaaagagagacccaauuuccuuguguguguugcaacauggccaguguuagagauccaggguugcuuaaucuaaccccaagugauuaagaaccagcuaugauaccagacugagugcaaacuuaguugucagcacagauaaagaaaggaaauagacacaucagauguaaaagccccaaauaggccuccuacugacagauccugcucuccuaacgcaugcagaccucucugacuugcugagauguauguauauucaaugacagcauggaauugaaugguugacuagaaguggcuuuccagaggcugcagcaggaggaacauucuuuguaaacaccaaguauuucauucccccccaauauaucaaaaacaguguuuucaguaggaucuggaguacugcauugaugggcaucacuuuugaccaacauaugcucaugcgguaccuuauauagauucacacacuucuucuagacaggcuuugccaccaccuuaugcacauggacccucgggacuucaguaacuugcagggccagguguguucagagcagaagaaauaugaaguagugugcaaugaauaggugcagggagaacccaucuucaaaugaauuggccuuuuuaauuagcaauuuuaugugaacagauuauuuaauacauugagauguguguguuacagcauucaacacugauccacaagcuugaacacauuuguguuuuagaauuaaucgauuuuaaucaaguagaaaaaugcacugaacaucccuuguauccaaugcucauuaccccugcggccaguuugugagcuggcuuguguugucuuagacuuucagaagagaaaacaaaggucuucuuauugaaccuuuugguuguacauugcauguuugauuugagaacaguuaugguucaggccugcaguaagagauugagagccuuacaucauuauaaauguggccuggggcauccaacucauuuaacuagaggauaaugcagaggagugauuugcaacugacuucuuccucccacaaacuaauauuuuuaaaugguuugcacuuuuuucuguccccaaagggauuuguuaagugugauuuucagcaggacauguacuuuuuuuauuuguuagccauaauggaaaugcauagauaaacugaaucuguguuaacauaauaagacaaucaaauuuuuuguuuaguuguggggaagggacgggauagaggaaguagaaaaagcucccucaaacauaagcugaauauuuaugugguuuuuguuuuuauuuaaaccaaccucuuuagaaaauuacuuucuuaauaagacauuauacaaugaauuuuuccagucauuuugagggaaaaauaugguacucugggagaacuucuagaagaaagaggaaagacucacuuaagauucccaggaccuacagagggcuggugcugaauaguucccacugaggaccuuccauuucgguguuuuuugucuuuuguuuuuuugagacaggaucucacuuugccacccaggcuggagugcaauggcacgauuccggcucacugcaaccucugccucugggguucaagcaauucuccugccucagccucccgaguagcugggauuacagguguacaccaccaugcccagcuguuuuauauuuuuaguagagacaggguuuugucauguuggccagucuguucugaaacugcugaccucaagugauucaccugccucggccucccaaagugcugggauugcaggagggagccaccgcaccugaccccauuuuguuuuguugugagagaccauaaacagccuagaaagauagaaaucucaauaaugagaaguuucuguaauguguggcuccugcccaccuucucucugcuuauuugcugucuuuuuuguuuguuuguuuuuuuagagauagggccuucucugucacccaggcuggagugcaguggugacaucauggcucacugaagccucaaacuccuggagucaagcaaugcuucuaccuccaccucccgaguagcugugacuacaggcaggugccaccacagaaggacagaccaucuaaggaaaacuuaaaaagacagcacaaggacaggcuggacagccaccagaccuggcuaauuuuuuauuuuuuguuuuauuuuuuguagagaccagaccucacuauguugcccaggcuggucucgaacaucuggccccaacaauccucucaccucggccucccaaagcacugggauuauaggcaugagccaucaccccaggccuauuugcugucuugauucucuuuucugcucccuccagccccacagauggcccaagaccccaaaugggcagucaagcuuccccacuaaguugaguuucuuuacuggacaacucaagaugucuuggugagauccugucuugaaacaaugccaggaaaguacaugaggucuccuuccuccuaaaaacaccccuagaaggaggccugggaggggcaagccuggcgguucaaacuggugauucaaccacccacauaagacccucuaggcuuaugggugagcugggugaggggcucagagaauuucuccaaucuuggccagaaaggcuuccuuaccacuuucacauuucucucguguccuucagaaggggccugcauccaaaaguggccauggaaagcuucacagaauuagcuuuuauuguaaaaaaaaaaguagcaaauggaggaaugacugaagagaaagcaugcuccagcuaucagucaacuuugagggcaugagcccauguucuaaauuuaaacacaaucugucccuuucuccuuguauauccgguuuccuuucacuucccucggugccuucaacuaaucccauucuugguuuacugcuuggcagugauaauuauauacaugcacugugacaguucaaccuuucaugugccaguucccaucuuuugauauuuucuuuuauuuuuucuguggaaaauaauaugacaaaauccugccauuuguauguucuucauuuuugacuccaaccaugcacuacugaauagaaaguaucucagccuccuuuauuuuucucugccguuacugauguguuucuaggcccaucuuaucugugcauuagcucauuacuuauugucaucgcuugucacuggcugccguuucccccgccucccuuggguguugugucuacacaucuuugcuauaggggaaauuagauaguaaacugaugaugucaguccuuugacuggagguuagcauuucaaaugcucacauauuuuuuguuaaacucacuuuuuuuuuuuuuuuuugagacagggucucugucacccaggcuagaguacaguggcacgaucuuggcucacugcaaccuccaccucccaggcucaagcgauucucccaccucggccucccaaguaucuaggacuauaggcaugcacauccacacagggcuguugcccaggcuggucuugaacuccuggacucaagagaucugcccaccucagccucccaaagugcugugacuacggcaugagccaccacucccagccuaaagcccacuucuuuugaaaccucaaccuauuuccagaucagugauucccaaauuucuuguaaccacaaccucuucuccuuauguuugguuuagauauuuuaugauauccacauuuuucgcuacccuaucaauuauucuccagggggaagagagcaacauuuuuuguuuuuuaugaaaaacaaguaaaacuuuuuauuuuuuauuuuuuuuaguuuugaggaauuuuugagaccauacaauacucgguggucuauuggagaaguccugaaguguugcaaaaaagcaaucacugcuuugaaucuuggaauaaggucauuuuaaucucacucacuauguuuuuucuugauguguuuugugauagaaaacacauaauaugaaaucugcccucuucacaaaguuuuaagugugcaguacagugcuguuaacuauaagcacauugcuguacagcaggucucuagaauuuuauacccauugaacagcaacuccucauuucucccuuacccuagcccccggcacccaccauucugugucugcuucuauaaguuuaaauacuuuagauaccucauacaaauggaaucaugucauauuugcccuucugggacuggcuucuuucuuuuagcauaauguccuacagguacaucuguguuauggcauaugacaaguuaaucucacuuauuauuucuuaaaguguaaauacaagacuaacaaaaaaaaaucccuugugucuuccaugcacuguuuaagguuauagaggcucacaguuaaggcuuacguuuuggggucccugggaggauauaaguuccagcucuuuuucguauaaugaugaaaguaacauaaaagauucuaggauggcagguacaaagaacauguuaagaacagcccuugaaaauauauaucaucauugcagacaucuucuuggggucaacucauaauguucccaaauaaauaacuguccauccaugaggacuuuguuugaauauguuauugauacuuuguuuuguuuuugguuuuuuacccuaauucuuggagagaggacuuuaugacuaaaaacacaccaaaaaaaaaaaaaccuuccaaaaagagauuaugauuauuaauuaagaaagaacucuagcugaugauggagaaaguucaaagauguuguauuauucaguuuuuuuuucuucuuuuaaaacaauuaaagccaagcaugguggcucaugucuguaaucccagcacuuuaggaggccgaggcaggugaaucaccugaggucaggaguucgaaaccagcccuaccaacauggugaaaccccaucucuacuaaaaauacaaaauucacugggcaugguggcgcauaccuguaaucucagcuacuugggaggcuaaggcaggagaaucacuugaacccaagaggcggagguugcaguaagccgagaucacaccaaugcacuccagccugggcgacagagcaagacuccaucuccaaaaaaaaaaacuuaaaacuaaaggaaaauauuauuuguuugcuacugcauaauaaauuaguccaaaacuuagcagccuaaaauaauaauaaauauuuaccaucucacacaguuucuguggaucaaaaacuugggaguagcuuaguuuugugguucuggccuggaguguccccugaggcugcagucaguaugucagcagggacuuuguucuggcuuuggauugacucacucacauggccguugucaggaggacccaguuccucaucacauggaccucuccuuugugcccuuugagcauccuaacagcacagcacuggcuucucccagagcaagugaucccacaaaaagcaagaaagaagcugcaggcaugcacugucccucccacuguauuuuauucaagugcgucaccagaguaagucacuaaguacagaccacacucaaggggagcagaauuagcuccaccuaaaaagugggggguggauuugauaaagggauggaagacccaugccaccagaaggguggaugggaccuuaaccagauacucuagugauacucagggacaaagaguguauggagucugagcacaaacucacagcuaugguccaugcuggggcuggagauggggguagggagcaaaggaacaccuggccagacaacccugagaguccucugggagugaggaccguggagcagagagagauaacgggaauggaguaaaugacucaaagauguguuagagauuuccugagguugaggccaggaggccaccagagaagugaaugcagguaaagacagugguuuugaccaaagagcaaggguggaugccccaggccagcccaggagcuuggcgccacuggaggaagugcauuauaccaaucagagcuucuuuugcugcugcugaaauggaacggugccaucgggccgucuucuccacuggagaugcuccuucagcucagcaggacgcuagcucggaacucagacugcacguuuuugcggauugggaggagggccgacgccguggccggauagucucuggagcugccuuuuggggguguuugccuguuggcauuuucaguacuccacgcgucaagagugagucacuuucucuucuugucaugaaguuaaauuccugggaugucaucuucauuuucuucagagccccuuuccaaaacucaacuuuuguuugcuucacaaauugcccugcuaaccuccauagacugaguuuauuugucuugauggaugaaucagagucucaaacucaucucuuuugcuccagcucucuuggcagagaacacaggaagauggguuuugcuuauguguguguuuggggaggacuuuuuuuccuuuguuuuucugucuuagccauagcuugugggcgagccggcaccugggaccuugaccgccuccuggcgugggccgaggccacauggggaguucuccccaguacguuuugugauguucccuaauuccaggaugggcugcaguuuuccagauccaaggcucaggggaacugggggaauuacuucccuggagccagccuuaucuuauuuguccauguuucauucaugcaaauuggaaauacucccacaacuaaacugccugcugaccaucugccuaggcaguggagcuguggaugcuuaauggcuuuccucagcaccuuccuaaucucuuagcuucgcacuguuuccaugguagccagccaauugagaacagaucauguuuuugcuauguuauuaauaaagugcaagaaguugaauuccuguaauucuaguuccuuuucugccguuaucuaggaaugagcugaggcaaauauuuaaccccuggggccucuuauauaagagauuuggucaagauggaucucagggcccuucuaagucucaaguucauuggcuauaccaucauuuaggaauaugaaaauauuaguagggaaggauuuauuuaucacaagaggagaaucucuauacuuucucuugucacccagcucacuagaaaggaucugcaccuuagcaagagauuucccucugcauuguggaaucggcaguuucuucauguugggaaauagaaucuaaauucauguuuuucucuuaaaaccauacaaauguucuuaacaucuuuguauaacugaggcuuaugcuuugcugguuguuucuuuuaaauccauuuucccaauauaaaaauauugcuugucaacacagacuugcacuucugcaguuuuauuuguuuguuuguuuuuagucacccaggcuggagugcaguggugcaaucucagcucacugcaaccucccgaggugggaagaucacuaggcugaagggauccaaccaccuuagccucccaaguagcugggaucacaggcacaugccuucacacccagcuaaauuuuauuuuuuguguguuuuuuggagggguagagaugggguuucaccguguugcccaggcugcugugaaacuccuaggcucaagggaucugcccaccuuggccucccaaagugcugggauuacaggugauagccaucaugccggccugcaguuuucaaucguuacucuaaaugucacucgggcuucucccacuaaaaaaucugaccacuuaaccuccaauuuuuaaauuuuauaaauugacuaauaaaggaauauguugcuacagcguuaaucuuuaucuuuuaucuccuggguuuuaucuaaguuuuuaaaugaaauugcuacuguuuuauagauauuuaacuuacgaucuauguuaguauaaggguaaaaauugagaaucagcaacucuggucauuuuauugcucuaguugaguggcugagucagaaacauaaaaagggcauacccaaacauugaccuguuuguaccuacaaacagcugaggaccaauuuguaaauaggucacaguuaaucaaaaucucugcacuugaaucuuuuccaaaugcuaaaccaugcccuucuacaaacuguggaauaaaaguagucauagcuagcuaugucuagcauaguccagaguccccugaaaaucuuuucaaugaucugcaacaacaaaagccaguuucuuggaaugguuccuaaacucuuguuauuuaaaccuucauaggaaaauacuaaacuguguauuuugguagugacauugguucacucaacuacucagcaguuugcugauuaccugcucaacgccaggcguuggaacacaggaaagaacuagagagaaucaauugacugguccuuagcagcacagagcccacgaucuaaugggguaugcagcaauuucaaugcauugugaaaaugcuaugauaagggagagucauguaagaaccaggcccacauucuaaguuggagggguuggauucaggagugaagagaggugaggaaaggucaaaggagguuugucaaacaaaaaggaaacuaaucugagacauacaggauaucuaggaguuaaccaagcaaagcuacggaggggugggaaauggggggaauauucuagaaaaaaauggcaugugcaaaggcuaggggcuagggagggcaagacaugcuugaggagccacagcaaguucauuauggcuggagcucaggguucaggagggauguggcaagaaaugaggcugggaaaagcuacccagagccagaucuuaucuauucuggauuuuacaguuuaguaaauguauucauucaggaccauuaucuucuuucugguaguuagaaaguuuuucucaagaggaagauguaaaucuaaaacauuucaaaucccagagagaaaacauuuucucuaauagaaggauugcuggacucuacccaggaguguuuacuaaguguuaacauugacuuuuaaaguuuuccuaggauuccugccauacaagguaauucuaugcauauggcaucuuuuuaaugauuugcaagacgaaacacaaagcauauuuucaaauacugauuuucacauuaaacacugauugaaaacauuaaaauccaauaaaaagggcucggguucccagaucacuuuauucuaagauauggguaggacuucagccauuuggccacgaugggguuaucauccacccagaauucaguaaaaggaggaugauucccaccuauuugggguugcaagucuaagcuacuuauccagaaccacucagauaacaccucagaaacauuucagaccgggugcaaauaguaaagccaugacaccgguuuaugauuccagcaauaugugaccuuuucuccaaaauauauuaaugcuuuuacuuucuuguuuuucuuucuaucuugguagcuuguagacauaacuaaucuccuuggcuugacauugaaaaccucuguaaucuaguuuggccuacaguucuuaagauucuguuuucuucuccgcaaacaccucacucuccaacaaagcaaaaugagacacaacacuccagccauacggauuauguagacagguaucacgguagcaucggggaggcccuggguuuggacucagaaaaccuaaauucauguccugcccaccccauuuccagucugugugaccucgcacaagacacuuagucccacugaaccucaauuucuuuaucuguaaaaugacuggcuucucucacaagauugcuaggaaaaacaaaaugaaguaauggcuauaaaaacuugcugugaggcuaggugcugugguucacagcuguaaucccagcacuuugggaggccgaggcaggaggaucacuugagcccagaaguuugagaccagccuggcaacguagcaagacccuaucucauuauuuuuaaaaaaguaaaaauaaaaauaaaauuuaucugggagguguaaagcccauuauuaauguaaaguauaggaguccgcccucauccaugguuuugcuuuccaguuucaguuauaugcagucaguuuugguccgaaaauauuacaugggaaauuccaaaaacaaacacuuucugguuuuacauuccacacaguccugaguagcgugaugaaaucucaccccauccagcucuguccaggcugggaugugaauuuuuuccuuuguguggguauccacgcugucaacaccacccacucauuagucagucaguagcugucucagcugucagauugacugucaugguaucacagugcuuguguuccaagaaacccuuauuuuacuuaauaauggccccaaagcgcaagaauaauaaauuugguuuauuguuauaguuguucuauuuuacuauuaguugcuguuguuaaucucuuaccgugccuaauuuacaaaacagauuuuaucagagguauguauauauaggaaaauauuggaaaaaacauaguauuaauauauacuauuaauauauacuguauaaaguucgguacuauccacaguuucaggcauccacuggggguuuuagaaaguauccccugaagggauaaggguggacuauuguauuuuuauuuuuccugcaaacgacacacaguuuucccacaucuugaacauacugauccccuugccugaaagcccauuuccucuuucaugaauuuaguucugaccuacucaguaagaauuuuuuuuguuuuucagagacgaaaucucgcuguugccccaggcugcaauccaguggcuauucacaggcacaaucacaggcacuacagccucaaacuccuggguuuaagcaauccuccugccucagccucucgaguagcugggacuacaggaaaaaaaacuuuuuugccccgucacucaggcuggagagcaguggcgcaaucauagcucacuguagccuugaccucccagggucaagcaauccuccugccucagccucuugaguagcugggacuacaggugcacaccaccacgccuggcuaauuuauauuuuauuuuuuagagaugaggucucacuauauugcccaggcucccaggcuggugucaaacuccugggcucaagugauccucccaccucagccucccaaagugcugguguagcaggcuggaucuccauaaacccuuugcuguaaugaggaauguauaaguuaaacauuaaagcagaaguagaaaacaauggauaacgaacugggguaacuggugccugaguaagaaagcucgaaugcaaaaacaaaccuauuaaaaccuuaccuggacuuccucaaccucaaaccugauugagggaucaaagcgugcaccaagacccacuuaagaaacuuuccuacccacagacccauaguuaaaauuagauuaagaaacacucccacaaguagacauagagcuugaauuguguauauaagcuaaaggaaaacuuguaacuuugaguugaucuggugaguuacucugaccuucuuccuguaacugguugcaaaaauaaacucccuccuuucccagucugucugcaucuuguuauuggacucgagaacaagcagccagaccucauuugucugggaacucugggauuacagcccaggagauuauuuuuuauauuuguauuucuaucguaggaccaguugcacuucgccuguuuuauaauugcauguauaguugucuucacuuccugauuguaaaucccuaugggacaggaguccaacccuaacaucuuucuauuccucaugugacccagcacaucacuuaguucaugauggacugggacaaauuaauccauuccauguuuucaccugcuuaaugcuauacaaugcugaaaugugauuuaguuaguuauuauuguaguccuuucucaccuuuuaaaccauuuuccauaggaauuuccccuuaaggaauuaauucaacgaagcaguaguacaaguuagugcucuagauauagggauagauauuaaaguugaugaugauuagaugacauuuuucuuuuuuuuguuuuaaauauucuuuuuuaaaaaaaguuuauuuuagguuuggggguacaugugcagguuuguuacauagguaaacucgugucauggagguuuguuguacagcauauuuuaucacccagguguuaggccuaguacccaauaguugcccuuucugcuccucucccuucucccacccuccacccucaaguagacccagugucuguuguuccccucuuugcguucaugaguucucaucauuuaguucccgcuuguaagugagaacaugugguauuugguuuucuguuccuguguuaguuugcugaggauaauggccuccaacucccuccguguuccugcaaaagacaugaucucauucuuuuuuauggcugcauaguauuccaugguguauauguaccacauuuucuuuauucgaucugucauugaugggcauuuacguugaucccaugucuuugcuauggugaauagugcugcaaugaacauuccuguucaugugucuuuaugguagaaugauuuaugucccucuggguauauauccagcaauagaauugcugcaucaaaugguaguucuguuuuuagcucuuugaggagucgccauacugcuuuccacaaugguugagcuaauuuacaccccuaccaacagaguauaaguguucccuuuucuccgcaaccuugccagcaucuguuguuuuuugacuauuuaauaauagcaauucugacugguguaagaugguaucucauugugguuuugaucugcauuucucuaaugaucagugauguugagcuuuuuuucauaugcuuauuggccacaugugugucuucuuuagaaaaguguccauucauguccuuugcccacuuuuuaaugggguugguuuuuucuuguaaauuuguuuaaguuccuuacagaugcuggauauuagaccuuugucagaugcauaguuugcaaauauuuucuccuauucuguagguugucuguauacccuguugauaguuucuuuugcugugcagaagcucuuaaguuuaauuaggucccauuugucaauuuuugcuucuguugcaauugcuuuuggugucuuugucaugaaauauuuaccuguuccuauguccagaaugguauugccuagguugucuuccagggcuuuuauaguuugggguuuuacauuuacaucuuuaauccaucuugaguuaauuuuuucauaugguguaaggaagggguucagccucaaucuucugcauauugcuagccaguuaucccagcaccauuuauugaauagggagucuuuuccccauugcuuguuuuuguuagcuuuguugaagaucagaugguuguaggcgugcaggcuuauuucugggcucucuauuccauugaucuagauguuuguuuuuguaccaguaccaugcuguuuugguuacuguagcccuaauaguauagucugaagucaaguaacgugaugccucugacauuuuuuuauguucccuaauuauuaggaauugaacuucuguccagccugauuuaacauaugaugaucaguauguuccagaaagaucuguucuuuaaucaucuucugagcacauuacaagccauugaggaaagcuagcuagugcuaaccuuaugaaauauuuauggaauuauuauuccuuauuuuuuuguaaguuaaaaugcuccuugcugauuaaaaaaaauuacccacgacuuuuuugugaaugggauuaaucuucucucucucuguuccacagaccaugacucccuguucuccacagaggccaagcucccauggauaugggguggaaauuuggagacaggucaaagucauauguaucccaagagucuuguucuuauuuucucuauuugaguuuacuuugagcuuucuucucuucaagugucaguucagcugauguacuggcucagaccauaacccuuucccaaggacuagguaaaccuggauuacuuucuaccucuuccccuuuguugacaagcagcugguguuugugaaaaagcauugucuuagugcuugaagucugcugccuuagccaaguucagagauccauucauuaucuuugaagugcccagcuuccuaaaagggucacacauguuguuaaagagacucccugagaacauacccaaaaagcaaggaugagggaggcauaaacagcagcuccaaggccaauuucgggaguacugagaacauuuucuuccucgugccucuaaagaaugaguuuccuacuuuuauguaugguugcucugaagaggcgccaaaucugaaauccccuguuuuaugaggaaauuauuuucauuuacauaaacaaaagaauaaaaucuccaaggccagaacugaugguugcucuagaagaaaugccuuuggaaguucuacaauaagccccagguucacgugaccguuaggauacuuugcauguaguuucucccaguccuuguaaaggcauaauguccucaccuuuaaaacccaaucuacggaugggugcacuggcucacacauguaaucccaacgcuuugggaggccaaggcagggggaucacuugagcccaggaguucgagaccagccugggcaacacagggagacccugucucuacaaaacaaauuuuaaaaacuuagccagggauggugguaugugccuguagucccagcuacuuggaaggcugaguugggaggaucucuugagcccuaaaggacgaagcugcagugagccaugaucgugcuacuauacuccauccuggauaacagagugagagccugucucaaaaaaagaaaaaaaaaucuacuauagaaaucaugaaaaacuccuuucugugucucccugcacuguuagggaacuaauaauucaagugaaauaaaaaacaaaacucaaaaaaagaaagcaccauuaauuaaagaaaaauaaucacugccuaaaauuagccaaagugccaaugcagagauuucugaugugaaaaaugccaauaagagcagaaaagaguauuuccaugccacugcaaucuccuucugugagguaacaugucccacgugcauuggcauagcuuugcuucaccuuguucccauuucucacagcucacacccagccagauggacuccucugucccccagccugauaaaagcaagggugacuugccuugcuaaaugguaaauuccuuaugcaaagccuuccaguucucaccaggcagguccuccucuccugugaucagagagacauccccauuucccugauuucagagcagugcuauuuggcacuuuugagccucacuugaacagucuggcuguuccuggcccagacuguuuacugcacccacaucuagcaccuucucaauuccucuuagcacucagaaaaauugucuuguagcugaacucaaacacacaguaauacuuauccuaaguacccaagacacacacacgagaagaacuagcccuacacuagcguaagaggagcauucuauuccagguucagccuuagggacgacacuagagaaaauaccaaaaaugggagaagaaacacgaaauccugcuaggaagcugagagaaaaucugagaacacucagcaaagaaugcaugagcaaaggaugggauagauaacagacagcuuuucagucucuagacaucacaaaacggcucagaaaaugaccagaggggccaagcuggagaagaggaaaacacugagaaagagcaggaggagcucaguuaugcgcggcuggcuaacgucugggguugucugccagggagucacgguggcugggcugugacaaugggaguccggggccuggaggguaaaaacauacgcaaguacaaacgccagacgcccgccaagcagccaucacgcccugcgcucugcuccauggaagucugaagggggcuauucgcacacagagaucccuuuauucaaccuccuccuugcccgcuuaaagccaaaccgaaugucuuaacagagaggcaaucggaccagaaaugagcaaagggcggcucccaaguucgagggauuuuagauaagacccaugcacuccagacacagagccccaucuccauacagaacagucaagggcaggaaugaggagggcagaagagggacagggugcaggugggagaugacugcccuauuuuaugaaaauggaaagcaguccaggagaaccgcgaugacccuguccacccccgcgugauugaagugguggcggugcugguguuaucaggugucuguacccuucacccagaaccagcccacuggauuuucucaauucuccgugaauacuggcaccucccaaguaguacuuggccucucacuccccaaaaagaccuacgaacauaauuucuucuaaucugucccccucuccuccuuucuaacuuuccaccuuccugucuuccuaaucaucugaguaucuccuacucaaaaacaauguuuuaauugaguacuucuaccuagggaguuuuuuuuaagauaccuguaccagacuccacgcccagaccagugagaaacuaggagugcagcccaggaaugggcauuuuuuucgacacacccagaugaguccagugugcagccaggauuggcaaccacuggauaagauccugcaggacagaauccuuccuagaggccaguacccgguggcugaggcucugcgugucugcugccuauuucugcagaugccccgcuaugaaaucuuuuccaaccugcauagccuucuggagacugaauaaaccucugcuugguagcuccuggucuaagagggucacccuauacugcacugucggaccccacaggcacuuuccagugccgucagccucgccugaaggauuugcugggauuucuaaagugugaaucuuuuccuugggcagaguggugcuaaacacgugucugguucucagggagcugaagaacuuuagucuucuacugaagacccaagguguuaagucuccugguccuccuugguuguccgaguguacagggaacagcagaacuggccccauuguagcauccucccagggaguucaggccuuggccuucagcgucgcaaaauguuuucaggaggagguuuagcaaguccagcucuccugaaguagaagaucacuugggaaucucuuacauccucuuccccaggggcacaucuauuucuucuucuuuuuuuuuuuuuuuuuuuuuuuuuugugagagagagccucgcucugucgccaggcuggagugccguggugugaucuuggugcacugcaaccuccgccucccagguucaaacaauucuucugccucagccuuccaaguagcugggacuacaggcacgugcuaccaaaauuagccugacuaauuuuuuguauuuuuaguagagacggguuuucaccauguuagccaggauggucucgaucuccugaccucgugaucugcccaccuuggccucccaaagugcugggauuacgggcaugagccaccccgugcccagccaagcacaucuauuucuaagcagauugcuuagaauucuuguuagucagcgcagggccuacggauagagacuaagcuuuaaagaugggugagccucccuuacagguaguucaagaaacccuuccugaugucugaggauaccaggcacuggguuaguauguaggggccugagagugggcagggacuccaagaugaaguguccuagccaggcuuggugguugcucaccuguagucucagccacucaggaggcugaggcaggaggauggcuugagcuuggacuccugggaguccaagaccaaccugggcaauguaacaagaucucaucccaagaaaagaaggagaaauuuccuagggaaacucacuaucuaggcuucuaggaaucccagaaucaggugugaccauccacgugguuagcaauaaguuuccuaugggaacuucccacccaauucagugcuugcagaauaagaaagcgcuagcaaaaacauuuaauaucuuguauuuaaggugagucauaguccagacaggacaggcccaugagauguggaaaaaauguguuuccaaggcuauguuaacaucacuagggaguuucgucucgggaaagcacucucuauaaagucaguucuuccagguccucaaaccaauucaaaaccuagccugcugauucaacuuguguggaccucagccagucugguauuaggaugauaguguagguauuccagcuuccuaggggagcucugcugaauacguuagcucaucccugggcaauguuguuggcacagccccauguuaccucaucuaucacaugguuaccagagcgagcucaccaucuugcacaccugaacaugguuucaaguccuucauggauuugcuucauggcaguagcagggucccuucaagaaugacaccagaccacauguaccagaaccaccaugggcaagaaccacacccuggagucagacucuuugucaguaccccacuuuuuuuuaaugcuagacccauacaaggaaggggacaagaauaagaaaacaucaucaagggccaggugcgguggcucacgccuauaaucccagcacccugggagcccgaagcgggcagaucaccugaggucaggaguucgagaucagccugaucaacauggugaaacuccaucacugcuaaaauuacaaaaauuagccaggugugauggugugugccuguaguaucagcuacucuggaggcugaggcaggagaacugcuugaaccugggaggcaggggcugcagugagccgagauuguaccacugcacuccagccugggcgacagaguaagacuucauuucaaaaaaaaaaaaaaagauagaaaagaaagcaucaucaaauaagagauuuguuugcaagcaaccaacacauugcaagaagcaacuuucugugcauguucuguggucaauucaaaauuacagugauaauugugagauaucacaagauugacagucaucguagugagauauuugaguacuauguccacuugagaaaaacagacuucaugcucccuacgaagauucucagcaucaaagauuggacccaaaacgaggugucuuauuaauccagagguaacuagcaaucagccaggaacucaacucacaagaccugggcacgcggucaccagggcagcauuguauugaauggucugcucuuagauggacuggcccugcaaauacgugccuggaagcuaagcaaggccgugcuauucacuuaucugcuuuaccuggggugggguggggacgggccagguggucagcagugagcugauggaacucccucuggagaaacuagugagagggagugccaaaucugucuuccuuccacccaaaggaccccacauagccuucccagggcuaaaaugucagcuagacagugcuugccuuggcacuucuggucuccccacugggguucagugccuccucauggcccaggugauaccugaaauucagcaaauuuaaacccaaguccacccuuuccccuucuucaauccagcaccuuccucagacugacaccccugcuucuguucauggugcggcagccuccuggaaccuuugaggcucacagccuuuaaaucaugccucucuuuccuacauccagucaguuacuggguaguguuaguucuuccugaauaaucccccaagucuuccccuuuucucugucuucucauugcugcgaccuugaguuagagccuuaauccccgccaugucccauccugaugcggagaccuccaaaaucaucuugggaaaugccacuugaaucaugacacucccacuuucagagacacauuggagggugaggccccaccucaucugcuuucugcugugcccuacaccacacacgaauccucuucccgagcuggcccgcaugcucacuauucaaggcaggccagcguuuuccugccucuccucaggcaggucccugucuuucaccuuccuugaugaaagucuaauuucugaaaugaaaagcaacagcucauacuuacugaauguuuaccccaugccagguacugugcuaauggcuguaucuuguuugauccuuuugauggucuaaugacugggauacuaucauuccauuucacagaugaauaaagcaggggaagugaaauaacuugugcaauguugcauaacucaggagugguagagcagaauuccugauuccaaguccacgcuccaaagucacuauagucuauuaccucccagcauuuuguucuuacucuuaaugcgcuaagccuccccaacaccaccccaacagauuauauuuagagaagaggaagcaguucuuacacacuuuugcccuaaacaguguuuggcagggucccauuauuauaaacuauugguucuucauucacacuaaaguggaaaugacuaacaguagcuuccauaacuagaugaauuugccuuaaacuaaaagccugagauuaaaucuggccuaugcugcuuaagcuguuguacuuucuucuccuccccugcuguccucagccaguaccccugagaccgugugcuagauucccauaccaggguucagcugcuacaucaucccgccucuggaaguucccuaaaugacuugccuuggcagauggcucugcucuuuaauuagccauacaguuacugcuuccccuuauuuaauaucaggaagcuuccacuuguuucauccccuuccccaucuuggccauagugccuuccuacuauucuuuucccguuuuguacuuuugugugcuccuguucccuuuaauguguuaucagaaucucaucucaaucuagggauuuuugccaaguugucugaacucucuaucuccauaugugguaucugagguccuucuuaaacccugauuuuccccuuauuugguauuaaugcacacacuauuuucaggacccagcaucaagagucaaggugaguguuguuugcaaaucuaucauaacucggagaaguccccauacucaaaugucuuagccauguuagcauguacucagcaagaggccaugaacaguggcucaugccuguaaccccagcacuuugagaggccgaggagggaggaucacuugaagccaaggguucgagaccagccugggcaacaaagcaagacccugucucuacaaaaaaaaaaaaaaaauucuuuuuuaauuagccgggcaugguugcacuugccuguaguccuagcuccuugggaggcugaggcagaaggacccaugagacuaggaguuuggagucugcagugagcuaugaucguagcaccauugcacuccugccugagugacagagcaagacucugucuauaaaaacuuuugaaaagccaggugcaguggcuuaugccuuuaauccuagcucuuugggaggcugaggcagguggaucaccugaggucaggaguucgagaccagccuggccaacauggugaaaccccaucucuacuaaaaauacaaaaaucagccgggcauggugauggcugccuguaaucccagcuacucaggaggaugaggcaggagaaucgcuugaacccacagggcagagguugcagugagccgagauugcacaacuucacuccugccugagcgaaagagcgaaacucugucucaaaaaaaaaaaaaaaaacuuaaauaaaaauaaaauaaauguucagugagaaccauaaugugaauaguauaacccagcaugauuuuggugugaggauaauugauaaucauuuucuuccagcagaccuacccaucucggugggauuugcuucaagugauguauauucaaauuaauuugcaucuccuggucauauacuaauugguuggugagugguuaguagccaagaaacacugcuuauggcaagagaaagucaagugaaagauuaaagaaaaucaugauuaauaaucugccagcugauaaauaagauaguuauaacaccacuuuggugagguguacgcuuuuggccauguguacacuggugcauuuucaagacaguggcuaucuuuucacuucuguuuggcuaaucauguuauguuguucugaaguuacugcugcccuauacccacuucacacagccugagcucugucuccuuccaaugaacaugaagaucuuuugauuccguaguuccugguucuguucugauuccgacaggaugcuggcauccucaauuaggccagcuaaggaaagcauuagaaaacagugaugcacuacacucuguggaacuuaccgaaaccaacaggauuuuagagaagaaauaagggggagccugaagcugucaggccgcaaaaaaugucaaagagaaaugaaacuucagucuuagaaugucaaauaaagugugauaagaaauaagaggagggaagauauuccaaguagguaagggcaucagcauaagcaaaggugcuggaagggguaaugaacauguaauggugggugagcaggacugcugggagcagacagugaguuuggguagaaaugacauagaagagugaauugguaaaaauggaagagaugaugggcaaaugagaaagcaacgaagcaaaaaauauauaguacaauaugauauuggaggacagaaaugauuauuggggguaauuugacuuuugaccauuucccaggcuuaauucaaguauauuuagcuuucaaacaugacuucuccuaauaucuucuacacagcucuuucagaugaaaaaaaaauuggcuaacuggguaaagggugauaccuuuauaagcucuauuuuuuuaaucccugaggaagugaaccauguuaugagucacauacaucguguuuagguaggugaggaaaugcauugaacugauuugcagagaaugagagcuccagacccagacagugagacuucagaacuucauaaaugucaaagcaucuuugacaucuaugucccagcucuaggacacauucaugauagguucacuuacuuccaaacccaaagaggauauucuuagacacuuccuaguuucuucaucuuguaaaagugguuaaguggcuuguccaaggucuuuuggcuauaaauuguagacaaggauucagagccaaguguucuguccccaagaaugcuuuugucucuuuuuuuuaaauaguaacaucaugaggacaucucaggucauggcuggggagugcuuugugcucuguaagggacuaggaaauuguucacauacuucuucaauauuguuccugcugugcuuuuuauaggauaacacauuuuaacucuguccucacuaccaagacuuuauauaaaaucagcuggaaugaauugcuggucaaauucaaaauuaauuucaugucaaagucuuuuccucaugauauuuguguguuuugugagaacugccuuucuuaaauucuucugaaccaacucauaauacuccaaauuuaaauccauccaucuauaaaacuaccuuuucuguaucaguaguacuuuuucagaacauaccuauuucuagauuauaaucaaauauucuuaaaauaaucugguagucugugaguccuuugucuagaacuuaauuaaaaguggcaaaggaggccgggugcuguugcucacuccuguaaucccaguacuuugggaggccgaggcagguggaucacgaggucaggagaucgagaccauccuggguaacacggucaccccgucucuacuaaaaauacaaaaaguuagccgggaguggugguggaugccuguagucccagcuacuugggaggcugaggcaggagaauggcgugagcccaggauguggagcuugcagugagccgagauggcaccacugcacuccacacugggcgacagagcaagacuccgucucaaaaaaaaaaaggggggcggaggggggcaaaggagaagccaggcauggugacuuacaccuauaaucccagcacuuugagaggccgaggcaggcagguugccugagcucaggaguucaagaccagccuggccaacauggcaagaccccauaucuaaaaaaauacaaaauuuagccaggcgugguggcacacaccugcaguccuagcuauuugggaagcugaggugggaggauuguuugggcccaggagauugaggcugcagugagccauguucgcaccacugugcuccagccugagugacagagaagacccagucucuaaaaagaaaaaauguagcaaaggaggaguaugcagacuuagguggagauucugcaggagacuucuaaguacuuuuaaggugauaugauucauuaaauugaauuuuaauuuacuuuauuuuuaauguuuauuuuuuauuugcauaaacuuauggaguacaaauguaauuuuguuccaaggauguauuucauaguagugaauuuuuguuuucuuccaagguuagaacuuucuucuuccuugcuauaacuuccuucaggaucuggcuaucuuucuucauuuuuucuuucuucuccuucuccuucaccuccucuguauuagacuguucuuaugcugcuaauaaauacauacccgagacugaguaacuuauaagaaaaagaugguuaauggacucacagcuccaugaggcuggggaggccucacaaucaugguggaaggcgaaggaggagcaaagucacaucuuacauggcagcaggcaggacagcaugugcaggggaacugcccuuuaugaaaccaucagaucucaugagacuuagucgcuauuacgagaacagcacaggaaaaaccuguccccaugauucaauuaccuuccaccgcguaccccccaacccaugacacaugggaauuaugggagcuacaauuugagauuuggguggggacacagucaaaccauaucauccucucucccuucuuucccuucaaggaauguucaaaaagaagagacccucuaaggaaugaucaaaaggaagagacacucuaaaguuacugagcgagaguuauaaaaaauagggaaggcaagaaaaugaauuuagaggguugagaaggaucuaaagagauugaaugagaauuaauugaguguguaagguaaaaggaaagugggguagccugguuuggguacagucaucuggauagaaaaauguagguaguccaccuuggguggacaucucuuuacaucaggcagcacugcagaugacuugguugcuuucuggaguugccgaggguggguacaaggcagagggaggcagcgcacagucauuuauucuaugaacaggauguuugcuagacagauguuugagcagucuggagcucuuaauggaacaagggcaaggauaaauaaauaauuggaccuauccugauguuugucccuauacauuuaagaauucugugaccuguuuuaaacggaauccaaacacugaguaugaguuagaugauaauguuguuauuacccuugaccuggccuugaggacugauuuugagcuuucuguaugagaaaauuagcucagagugaccuaaaaauuucuuuauucuuaaaaacagaaauaaauucucgaucugccuugcccuucuuggaagaaagguagaguggaaagaguuagaaguuauuugguacagagucauugaguacagugcucuccugagguagaacagaacugucagggauugaauugcaggacagaccugcaauucaagaugauuguuggcagugaaauugcugaucaauggaaugugugggaugauaguucuugagagucggggaggagagugcagcauuguuggggcuggcauuguauccaccgaaaacauuuucagcaucucuucucuucuauacaagacuuguccucuuggugucccugugggucaccauuaagucgcuugcuuauucuuucucaccauguaucuucauuuaccuuucucuaaaacuucuguaauuugcuuuuaucaagagauuuuggucgcgugcaguggcucacaccuguaaucccagcacuuugggagacugaggugggcagaucaccugaggucagggguucaagaccagccuggccaacauggugaaaccccaucucuacuaaaaauacaaaaauuagccaggcaugguggcgagcaccuguaauuccagcuacuugggaggcugaggcaggaggaucgcuugaacccacgaggcagagguugcagugagccgagaucacaccauugcacccugggcaacaagugcaaaacuccaucuaaaaaaaaaaaaaaggaguuuuuccauucccucugcauauucugggggaauuuccagaccagguaagugguaaagaaccaaucagagcuuaguaaauagguauccuacuggguaucagcucugaagaaaguacuggaaagaauguugaaucccuacagauucuuccaacacaggaagucacguggaggccaacccgccuccauguacucuaagaggucuguuuggucccuugaauauuacacuaauaauuuauugaugugacuuuccuuugcaagagacugcaucucaaaaccaaaaggccguucuguagccuuauuucuuagcacuuuccaguuuacguauuguuuguuaaacuuuucauuguguuaguaaacccagcauuuguucaaggauauuugaaauagucaaagguuuuuguaaauguugugcagcaaacugguccuaacagccccuccucugcccuuccacuacaucaccccagcaggagucaguggauauuauagauuuuugugguauggaagucuuguagaauucuagaaauagccugguggcaggauugacaaaaucauuuacauucuuagaauaauccaaauguugacucagccuguuuaccuaagguauuccaagcauugggagagagaaauaggaacccaugauaugauuuguccuaauauugaauccccugacgauggcugucauucaaaguauuccuggguucagguauuuuuaaagaauucauggcugggcacuguugcuaacacccauaaucccaguacuuugggaggcugaaguaagaggauuacuugagcccacgaguuugagaccagccuagucaacauagcaagacucugucucuacaaaaauaaaaauaaaaaaagaauucuuacuuguccuagaguguucugcuucuuggaauaguaagaugauugggggggaacagauauauuagaucugcccucuauuuagugcuucaacuuuaguacaauuaauuucuaaauuaugccauaguuauuggugcaaagauagacacauagaccaguggaaaagaacagagaguccagaaauagacgcacacauauacagugggucuuacagauuuccacaaaggcauuauuaugauucauuaggaaaaagauggucuuuucaacaaauggugcugaagcaauuggauguccuuuuaggggaggaaaaaugaaacuugaccucugccucauagcacacacaaaaauuaauucaagauggagcaaaaacuuaaaugugaaaaguaaaaccauaaagcuuguagaagaaaacaggagaucuucauagccuugggcuaggcaaaaauuuucuuaaacaggacacgaaaagcacuaaccacagaaaagaaaacuugauaaauuggacuauacuaaaacuaagaacaucuguuuuaaaaucccaugggaaaaauccauagcaugucuucaagaucucuggcagaaaaucaggcuggaacuugcccauuagcacuccagaaucugcccccugcccaagaccgaugacccugcuaccuguauuggcaauagggagauggacacagguuaaaguaaguagguuuuggcagggcugaggcccucagauccucacaauaaaauugucuugcauuccuugugugguuuggauaugagagaagcagcuuuguucccgagcucccccucaaaucucugaaaacugguaugcucuucucagaacaauccuuugagauccccugagcuuugaaguccuccugccaagucugugugugggaaggagaacagagcagcaugagggccaucagagaggugggcgaaggcaguucaaagcccagccagauccggcucugugguguccaaacccuuggggucccauagcccuagaggaagcccgggauagggugaggcccagcccuuugcaggguucuguauugcugcauccagacuaggaaaugucugagacagagccagaaacguaaauacugcaccacugugcucaccacauucauguuugcagcagaagagccaagcccccuggccaggauauaugcuuccuauucagaccuaugguuuggagggaaggaagcaugaaauguauuuagagcuuuccaaacuuuugauuguuuugcacauuccuacaaaaauaaaaauaucccaugagauuaaaaaaaaucagcuucuaaugcuuuagaugagugggaaaaucuugcacacuggggucauuuccuuucuguuucaagaaauuaauauugugcuggaaauagccuguugcagaaggggagacuuuauguccuuugaaugcugauuaugccagaaaacuuuccaguccuaaaggggagguugucccuuucccaggacucugaugcaagaugacccugcaguuuguacuuugcuaggauaggagacccaagucagcagagauuuaaaauucagaagggaucauuaauuuauucauucaagaaaccaugcuaagcauggaauaagagccagguuagguucuggagucucacacugccccacaugaggaucccagacugccagcuccaugacccuccucugcggacggucccaagucuuucugaaggccccuggugauugaacccuggcauucagaauuagcagaagugacauacuaauuaccaguaacuaaaaaguugguguucacaucucuauugcagaugccgggaagccaggccgucaggggacaggcgcagucagcaagcacccgcucucucgguaucuguuggcuuccacaguuuuguguuucagagccaaaccagaaaucacccaggggguuacuugcaucagcucuggaaaauguguaaaggauugaaguccugagacuuucccauaaugucuuauuuaggcaucagucucccucaguugauuagagcaggaaucagcaaauuucuuuauaaaaggccagugacagugacuauuuuagccauacagucucagccacaacugcucuagcagccagagaccacaggaaacaaauaaguguggcuguguuccaacagaacuuuauuuuauggacauuuccuuuacaauuuucacacgucaugaaauauccaucuuuuaauuuuuuuucaaccauuugaaacugcaggccgggcauaguggcucacgccuguaaucccaacacuuugggaggccaagguggggggaucgcuugagcucagggguucgagaccagccuggccaacguggcaaaaugcuguuucuacugaaaacacaaaaauuagcugggcaugcacuuguaguccuagcuacuugggagacugagucaugggaauugcuugagcuugaacccgggaggcggagguugccgugagccaagaucaugccacugcacuccagccugagcaacagaguaagguucugucucaaaaaaauaaaauuuuucuuaauuuaaaaaaacaaaaauccaaacaccauucuuagcucauaagccaugcaaaaacagauggcaggccagauuuggcccacaggccauaguuagcuaacccaggaccagagagucauaccacuuucauagcaaaaaggauacacaugguuuguguugacucugaguagggaacuucuccagagggugccaugauacagaaggugggggguguguucccuaauugggggaauggagaagcaucauucuggccucucucaguggccccauaccugcugacucuauuuaggccguggcuugagggugccccccacuugccaaugccuccugccagggaccuggacacugagaacgcugggaaagggcccucuccuuggggacccuggucacacccaauagaucagucacucuucuuccuucuuaccagcugccucuccugagcacacuggaagaaggaccccuguaccaccuuccucgacacccgggccucuucuguucaaaggugccuccuggccaggcaugguggcucacaccuguaaucccagcaguuggggaggcugaggcaggagaauuacuugaagccaggaauucgggaccagccugggcaacauagcaagaccccgucucuacaaaaauaaaaaauaaaaauuaacugacaugguggugcacgccuauagucccagcuacucgggaggcuggggugggaggaucgcuggagaccaggaguuugaggcugcagugagcuaugaucaagccacugcgcuccagccuggguggcagaaugagauucuguaucaaaaaaauaauaauaaaauuaaauuaaaaauaaagaugucccuuccaauccccugacgcacacagcacuccacauguuucuuuucuucccugccucaucacccuuuucaaccuuagauccuaagcuucuugaggcagagacuuccaucuugucugggugcuuagcacauuuucaaauauucucuuagauuuuuuuucuucauuacccauggagcgguugcuuguugccuuuccaacccaaaauagaaauagugguaaacaaaagaagaaaaacauugaacauuuuggaacuaaaauuuuauuacuacuggaaaagucccagauaauaaaaaaacagcugguaaauuagcacucauuuaagcauggucuggggaagaagaaaauuuuaauaacacauuuuucuuccuaauuguuuuuguuuguuuagauuuaugcauucccaaaguggaccuuaaaaucauguugguggcaggaggaagccaguguggucuuugaaauuugcuucagauaauccaucaaggggauggccucauaaacaaaauuauuauuuucucccuaagaugcugacucaugugaaggacuguuuaaaagaugacuuuggcuuugugcccucuccugcagguccuuccauagugacgccccccaaggacaucuggaaugucacuggugcccagguguacuugagcugugaggucaucggaaucccgacaccuguccucaucuggaacaaggucuguggcacagacuuuaagagacauccuaggcugacaagcuucucuugcacugcacaaggaugguaaaacguuaaauccucagccugcuuuguugacugcggcucccgcaaggugaagccuuagggcagucauacaggccccuccccuggauucauggaacaaaaaccagucccugccaugcuuuuguuagcagcauccuagaaucugagaaacuggaagaacaauaaugcugaacaccugaacccaccuucagggugugugugcaccugugguguguguaugugugugcauaugugggugcgagugaaagugugugugucuguguuugcgcccucaguggagacaguauagcauagggguuaaaagcguacguuucucucuuucugucccaaaauaccaccuccaagcccccaccaagcuguuugugauggcaucagucuccucauuuaagacugaacauuuagcugauaauuuagauccugucugcuuggaggcauuauuauuauuuuacugggaggcucggcuaagaagguaaaaggacacaaagcccuguagccuucuccugggagcauggauuauuuuuucagauucccuaagugcugggagauggaugaguacauuuuaagggcacuuggaaguaggauagaaggaaugaggugggaucuauucuccuaaguaccaaggcuguagaaccauaaguuagggacagaggagaccacuccagaacagagcauuaaaaaggaacaagaggaggaauagcaaagaaaaaaaugucuccuuucugaauuuugcuaaaugcuggccccagccccaaguggaaaaagcaugauauucuuuuaauaaaucagcuuugaaaugacuucccaaauggaaaaaaagaaaaaaaaaagugugaggcugggugcaguagcacaugccuguaaucccagcacuuugggaggcugaggcaggaggaucacuugaguccuggaguuugagaccagccugaccaacacagugagacuuccuucuuacaaauaauuuuuuuaauuagcugggcauggugaggcaugccuguggccccagcuacucaggagacuaagguggaagaaccccuugagccaggagauugaggcugcagugagcugugauugccccacugcacucuagccugucucaaaaaaaaaaaaaaaaaaaagagugugaauuccuuagccaggguggcugaguucucugcaagucaggguuucucagccucagcacuauugacauuuggggccagauaauuauuuguugugcgggcugccugugcuuuggaagauguuuagcaguauccccagccucuacccacuauauaacaguagcauucccccauccccccugucgugagaauuaaaagcaucuucagacauugccaaauguccccuaaggguguggagcuggggaauugcccuggacugaaaaccacugcuguuagccucaacucuguucucuaccuuauaaaaguagcauguaauuaucauaaagaugaaauaaaguaaugcaaguaaaaauuacuugauacauaguuagcacucaguagacauuagcuacuguuccuggaaauuuuucccuucaaguggcauuaucuuguauaauuaucuucauauuugaaggacaacaucaucucagcauguauggagaagggaaaagaaaacacuuauuugccaucaacuaacaccucacaauuauaccauacacuuacguuuuugucuuuuuuuuuuuuuuuuuuuuuuugagacauaguuucacucuuauugcccaggcuggagugcaauggcaccaucucggcucaccgcaaccucgccucccggguucaagugauucuucugccucagucucucaaguaguugggauuacaggcacccgccaccacgccuggcuaacuuuguauuuucaguagagacaggguuucuccauguuggucaggcuggucucgaacucccgaccucaggugauacgcccaccuugcccucccaaagugcuaggauuacaggugugagccaccgcgccuggucguuuuuguccuuuuuauacauuuugaauugcugagccucacaacuauccuacgaaaaauaaaaauuaaaaaauuaucaaacucaugcuaccaaaaaaggaacuuaguuuaaguaaaagggcauaaccagacauccauuuuaagcugccuuacuucuccagcaagcucuaagguggaugauagucucccuugacuauuuuguuugcucucugugugaccggagaagcaacuucuagaacuccaggaggacuguggcucccgcagucggagcucuuucuguugcaaguucuaccagcccauuugaaaccagccuaggcaaaacaaaaagcggggcgggauccagccucaagggccccugcauccagguacacacgccaucagaacucuaacucuugacucuuugcucucaauauacuagucucauuuucuucugcuucagaaagcuuccuaugcagugggagauaucaacuccacucacauuuuuauuacagcuuaaagaccccagaggaaagaaagggcuucccuucucccugcugcauugugaaaaucccacgaagggcucaagcccaggucgggucaccugcuaagcucuggcucccccaugcggccggagggaugcggccacugacauuggcaccggcgugaauccgccugguuuguguaaaaucugggaacagguaccagaaaaugccugaggugggggugauggcagaggcaacacuacuauaccauccuuuacagugaagcuucucuuaaaggagcaauaaaauuucaccccgaucaguuauguuuuuaagaggaaggcggagcaagaguaagagcagaaaugcaguccguggauggguuccccuccauccuuacugcaagaacugcaggcguuccucacugcuaauuuggagauugcugguuugcucaggguguggggagguggagaaauaauguuccgaggaauacccaugaaaagcuccguugcaguucucuacaguuuucuagggauacuuacacaaugagaagcgagggucacccaagcguccuggggcaugugaccuuauuggcaaaucuuggcaaagaauaauuucuucaguccuugcucuacccaaucccagcuacaguauucacauaccagaggaauacgucugccucgggaaucuuuucccuuuuaggacuguacagggcagaucccaauagacaaggccucccugagugcuuguccucagggcuagucagaaacaccaaggcaguugaggcuggugugguggcucgcaccuguagucccuagccacucgggaggcugaggugggaggaucgcuugagcucaaaagguggggcugcagugagcuaugauggcaccacugcacuccagccugggcaacagagcaagauccugucucugaaaaaaaaaaccaaaaaacccacuaugucagucaacgagaugggugcugaaguaaagaagugaagaggaaguaggagagaaacaauuuuuucugcagacuuuccagaacaagcaaaacccaacugugaugcucugccgguuuuccucuaccuucauaauguaauuugccacaugcaugacccaaagcaauguuucuuacacugcagaccaugacccaucagugacuccuggaacuaauguagcgaucacaaccaccauguucuuauaaaaaauaaaaaauagaacagaaccuauguuaaggcaucacacuuaccacuuaugaaggugucauuuccuaaaacuuuuguauauuccagauauacgauaguuugguccaugucaaaacuaaggaaacuugggaagucacugaccuaaauaauuaaacaggguauuuguuuucucaucgcuguccuuguaaccagacuguuaagaauacaaacauauuuacuaucauguguguuucaaauccaauuuaagaguagaacaccuuuuuggauagauuauuagaauccucacuuguaaaacaagagaaacugaggcucaaauaaagacagcauguccuucuugcucaaggauucuuagcaacagcagaauuaaugguacaagccuuuucuccaugacacuugagacuacgguggcaauucuuacgguuggcacagccuggcgaguggucuuuacuuuccuuacugguaguaaggaaagcuggcuuuaacaagccccauaccuuucagcaaacuccuagccuagaaagauucgaagggcaauauuuugaaaugggaacgugaacugaaauagccauauuugacuuaacccuuuuaaaucaaagaugaugcucacagcgaaagcaaaacaccuucccaauauuuguuucugagacggagaggcucucuguuuaauucuuuucuugccugaauauuucuucagauuagggcuuccuugaccucuaagaauauuuuuuaaucaaaaauagugaccucuaagguaauaguaauaagcagaaauuauccaaagacguauaaagaaagaguugagaaucuccccccaccuccuccuccugccugagguaaccaaugugaacugcccugguuuguaucuuuccacacucuuuuucauauccaagcauauucaaacauauaucccuacggugaaaugagaauauagugugccaguaaauuauucugaaacucgcuuuucucaacaaauacuucauggacauccguccaagucugcuucucaacagcuacguaauauuccaaguaugaauacuguaauuuauuaaaucaguucuguauuuuuucuguuguuuccaaauuuuuguuaacuuaaaaaaccuacuuuaagcaucaaaguacacauaucauacauacuagugauuguauugcuauaagauagauuccccaacaguuaccuaagucaaaauauuuguuucaguguuaacagacauugucagauuacuuucuaaauagauuguaguaauucacacucccaccagaaauggagaagugccauuucucugcaucuuuacuagcacugaauauuaaccucucuuuuuuaguuuuaauuccaauuuuaacuagaaaacacauauuuauuggccaggcacaguggcucaugccuguaaucccagcacuuugggaggccaaggcaaguggaucacuuaaggucaggaguucgagaccacccuggccaauauggcaaaaccccgucucuacuaaaacuauaaaaauuagccaggcgugguggcacaugccuguaaucccagcuacucgggaagcugaggcaggagaaucacuggaaucccggaggcggaggcagagguugcagugagcugagaucgcaccacugcacuccacccugggugacagagcgagacucugucucaaaaaaaaaagaaaacacauacuuaacaacacuuagaauccccuuacacgaauaagggagaguuugacauauaaaaauuugucauaugaaaauucuuggcacuuuuuucuauguuuucuacaugauguauaaccuuuuauaauuacguaacauuaauuaaaauacgccaugccaacacuugugaaaagaagggaaaaauaaaguauaucuauauugugauuuauguuaaauauuauauuuaacaagauacauuucccuuuccauaguggaucagguuaauuagcauaaaaugcuguuacuaagagcuaugggauuugaggcuuaguugcugagauucaguauuucagugcugcaguguuuauuuucuugcuuuggucacacauaaaacucauaugauucugaaauucaguaaauaaaggucagagucauauuacuugagaccuuggaucaaauuaauacuucuaccaaaauauucuuacaacccauuuuuaaguaacuauuucaaaagcuguauuagcauaaaccguuucugccagcuacuugggaaacuaagggaaaagguaccuauugaguauguuugucuucacagcauuuaugagaaagacauuaaguuacgugguuuucucucacuaauaguggcaaugugggaaaauuccagaaaaaaaaugcaaaaagccaggcuuuccaaaucaugcaagauauuuuuucuagagcaggaauuggccuagaucacaugugguuugcugaaucccaguccuggcaucauaaagcugagaaaauacaguguagguuugaagccgacacaacagcagaguaccaaaaaacacaugguaggagugggauccacaugggaaaagcaacacugagauggaaguuaauaaaguguauauauuuauuuauauauuuauuauauuuauacauacggugucuauauauacacacuauuaucuggucuuuauuaagauuugcuuuauuauagaagaaaaugaaaaggaaacuagcuauuugagguuguaaauccuuucuaauuacaaagguaauaucaauaaaugucagguuggcucuuaaaggagaucugggauggaaugaacaaacaauucguauauccuuuuuuuuuuaaaacucaccauuaucacaaggcuuaaaauauuuguacucuguaacucagcugcuaaauguauauguaucgaggagcuacaagugaauuucauucuuuuguauauuuuccagaguuuauauaauaaaacauuuugccuuuuaaaaugagggcaaaaaggauacuauucaguauuggccuugcaccaaagaaacugaguuucuucugaaucuugacaugacauacacagaaacagucagcaaguuuugucauaaaagaacaaugacagcacauguauuugacagcuguuuuuuuuuuuuuuuuuuugagauggagucucacucuguugcccaggcugcagugcaguggcgcgaucucagcucacugcaaccuccgccuccagguucaagcaauucucccaccuuagccuccagaguagcugggacuacgggugcucgccaacacaaucggcuaauuuuuguguuuuuacuagagacaggguuuugucauguuggucagucuggucucgaacuccuuugauagguguuuuuuaucuuagguguucaguaaaucauuugauuaauucuuagcccucagaauaaaguaaugguauuggcuuuggucucagccuauuuuccauugaugaagcuguugcaggaagagccccaaggucccaagcaucaaaccuagugcugggugacaguucaucaguugaacauggcaugacaggcaaaaggccuggaacugagaagcagaauuuccaagagcaugagugaaugaaugauggugaccaguggcaggaaauuaugaccauguauauuccccaggcaugcagaaaaauacauuaguuuaaaacauguacgcuuagcaggaaacuggcaggaagaaauaaaagaggaucuauauuuuaaaaguauuuaggaaagggaaauaguucagugaaaugcuggguuuacucuguuagaaagucugacauacacuaugugcaauuguagggauguggccacuuccaaguagaugaucugguguacaaaacucaguauuacucuccuuuuguuuuugcagguaaaaaggggucacuauggaguucaaaggacagaacuccugccuggugaccgggacaaccuggccauucagacccgggguggcccagaaaagcaugaaguaacuggcugggugcuggugaguaccaguaccaagagcuggcaagaguuucauucuuagcauuagacauaagcagaccuggcaaaggugccugauguaccgccagccuaaaggugcuugcucuuccacaucuguuuggaauagccuuaccauggagucgcugcuccucuuucagagaaacuaaaggaaaagugcuuuauugcauguuuugaaaacaaccaaugaauuaacaagaacuaguauuuuccuaagaguucaaagcaaaauccucacacggagcugcguggcccaagcauuguuuuaacugauuaucgauuaauaaauaccuuauuuuacuugacccuggauauucauggagaauacuuugaucauauacccuuaucaagguugcccuuaaaccgauaauguguaccuauccaguuuuuaaccuaugcaguaugaucaaaaguuguccaugacauuuccucauaugaauccucagcaaaccaaauaugguaguuaucgaagucuccuaucacaggacuugcacugcuucuagcaguaccuuugcuaugaauccccuggucaucuuaggaaauuuaugaaauaaugaccucacuggaaccacugacaaaagagaagaccaccacagaggaauacuagaucuuuuuucuuucacagguaucuccucuaaguaaggaagaugcuggagaauaugagugccaugcauccaauucccaaggacaggcuucagcaucagcaaaaauuacagugguugaugccuuacaugaaauaccagugaaaaaagguacacaauaaaucucacagccauuuaaaaaugacuaguacauuugcuuuaaaaagaacagaacuaaguaugaaaguaucagacguagcuauugaugaaauucuguaguuagcaacccauaagggcauuaaguaugccauuaaaauguacagcaugagacuccaaaagauuaucuggaugggugacugaacaucguuauuaugacuuagaugcuuuuaccuuaucuaacauguaagagucaaaaucaaacuugccuggaauggcuucuauuucccauagcuuucuaccuaucuacuuggcauuuucccuuuguguugugacuauuaaauuccuauuuaaaagaaaaugauugugggcaauucucgcccuucacuuuugcuuuuaaaagaaaaggccacaaaggagaguauauuggcaaauacccaguucuguucugccuccccuuccuucacugccaaaaagcuuccucugaagaacccauccugugucauagcagugcuacuuuacauuuauauaguucuaugaaacugaugucugaauuggcuuucccuuagacaaaagaacaaaauuuaccgucaccaugugucaaaccauuccacugugcagaucacucagcugugauaugaaaagaaauauuaaguaaagaaguauuuggucagauucucuucagccauaauguguaaugucaggcaaugaaacagaacaguagcuaagagucaagccaugcguuugagucucagcucugcuacuaauuauuccuccacuuuaccuuuugaaggagauccggacuacaaaggaaaggucuuuaaccucucugaaucucauugugaaaugugcucuuccaguucuauaauaagauguaccuuugaugcaucaaccaauacagcaaaauugccuuucauagcuaaaaucauguaacuugaguuccacagagcacuccagcauaucauuuauacaauuacucauauauccuuuauccccauauuuuaacaucuucauuuauuuggaaacacucaacuaccugccaauucaaaagucaaccacauccccauauguaacuaauuuuuaucuuuuuuuuuuuuuaaacaggugaaggugccgagcuauaaaccuccagaauauuauuagucugcaugguuaaaaguagucauggauaacuacauuaccuguucuugccuaauaaguuucuuuuaauccaauccacuaacacuuuaguuauauucacugguuuuacacagagaaauacaaaauaaagaucacacaucaagacuaucuacaaaaauuuauuauauauuuacagaagaaaagcaugcauaucauuaaacaaauaaaauacuuuuuaucacaacacag

SEQ ID NO: 21224 - RNA, 1844 nt, Homo sapiens
cagagcccgggccgcaggcaccuccucgccagcucuuccgcuccucucacagccgccagacccgccugcugagccccauggcccgcgcugcucucuccgccgcccccagcaauccccggcuccugcgaguggcacugcugcuccugcuccugguagccgcuggccggcgcgcagcagguggguaccggcgcccugggguccccgggccggacgcggcugggguaggcacccagcgccgacagccucgcucagucagugagucucuucuucccuaggagcguccguggccacugaacugcgcugccagugcuugcagacccugcagggaauucaccccaagaacauccaaagugugaacgugaagucccccggaccccacugcgcccaaaccgaagucauguaagucccgccccgcgcugccucugccaccgccggggucccagacccuccugcugccccaacccuguccccagcccgaccuccugccucacgagauucccuucccucugcagagccacacucaagaaugggcggaaagcuugccucaauccugcaucccccauaguuaagaaaaucaucgaaaagaugcugaacaggugaguuaugguuuccauguacacaggcgacuggagccguuggucagaaauacuggcaugugcccccuaaaaauaaaaucaggaaaacccagggguuaguugaaggacuagaaauugggauuauuguuuucacaauuaagguuuccuuuacgauaauuacugcucuggugccagaggauauucccaaugccuggcguccccacccugguucuuccuucguuccaaugaauguagguaaaacugccuucauuugaggcccaguaggacaaacagcaacagguucuggcuguuuuuaauccaauaguacaguggagaccaccgccccaccccacccccauuccuaaaagagcaucccaagcuuagaggucccugccacacagcacagcugucauaggcaguagccacuugguugccaggcuggggaaacugcauucggaaaacucuagaggcuggaggagcagggcaggagaagaguguugugcaaucagcuuucccgagcaccuacucagggcacccauuuucucauugcagugacaaauccaacugaccagaagggaggaggaagcucacugguggcuguuccugaaggaggcccugcccuuauaggaacagaagaggaaagagagacacagcugcagaggccaccuggauugugccuaauguguuugagcaucgcuuaggagaagucuucuauuuauuuauuuauucauuaguuuugaagauucuauguuaauauuuuagguguaaaauaauuaaggguaugauuaacucuaccugcacacuguccuauuauauucauucuuuuugaaaugucaaccccaaguuaguucaaucuggauucauauuuaauuugaagguagaauguuuucaaauguucuccagucauuauguuaauauuucugaggagccugcaacaugccagccacugugauagaggcuggcggauccaagcaaauggccaaugagaucauugugaaggcaggggaauguaugugcacaucuguuuuguaacuguuuagaugaaugucaguuguuauuuauugaaaugauuucacaguguguggucaacauuucucauguugaaacuuuaagaacuaaaauguucuaaauaucccuuggacauuuuaugucuuucuuguaaggcauacugccuuguuuaaugguaguuuuacaguguuucuggcuuagaacaaaggggcuuaauuauugauguuuucauagagaauauaaaaauaaagcacuuauaga

SEQ ID NO: 21225 - RNA, 2065 nt, Homo sapiens
ccacgcucuccgccgcccccagcaauccccggcuccugcggguggcgcugcugcuccugcuccugguggccgccagccggcgcgcagcaggugggucccggcgcccugggguccccgggccggacgcggcuggggugggcgccccgcgccgacagccccgcucaaucagcgagucucuucuucccuaggagcgccccuggccacugaacugcgcugccagugcuugcagacccugcagggaauucaccucaagaacauccaaagugugaaggugaagucccccggaccccacugcgcccaaaccgaagucauguaagucucgcccaucgcugccgcugccacugcugggguccccgacucucccgcugccccaaacccuguccucagcccgaccuccugucucacgagauucccuucucucugcagagccacacucaagaaugggcagaaagcuugucucaaccccgcaucgcccaugguuaagaaaaucaucgaaaagaugcugaaaaaguaaguuauaauuuccauguacacaggcgacuggagcuguuggucagaaauacuggcgucugcccccuaaaaaguaaaucaggaaaacccaggguuagcugcaggacugaaaaaauuauuauuuucacaaaguugccauuaagguuauuaaucuguucuggugccagaggauauucccagugcccagggucaccacccagguucuucccuccugccagugaauguagguaaaacugcuuucauguaaggucucauuggaguuugccaguugugcugaaguguuuuccaccuguuaaaaaacacaagcuucauuuccccuaguuccuacugacuuucagaccugaaaagcagacccccugguuuuuuguaaaaguuuaggguugaagugcagagauuucacaauaauauugcacuggguauauaacugguugccaccaccuauuagccaugucacucagagacaauauuauuuaguuuaucugagacucagcaaaacagggaaaauaaugguagcuacaucaugagguugcuuugaggcucaagugaggcccaguaugacaaagagcaauaggcucuggcuguuuuagccaguaaaacaguguagacugccacuccuccaccccacgucacccccauuccuaaaagagcaucccaagccuagagguccuugccacacagcacagcugucacaggcaguacccacuugggugccaggcuggggaaacugcauucagaaaacucuagagccuggggaaacaggacaggagaagacuguugugcagucagcuuuccugagcaccuacucagggcacccauuuucucauuacaguggcaaauccaacugaccagaaggaaggaggaagcuuauugguggcuguuccugaaggaggcccugcccuuacaggaacagaagaggaaagagagacacagcugcagaggccaccuggauugcgccuaauguguuugagcaucacuuaggagaagucuucuauuuauuuauuuauuuauuuauuuguuuguuuuagaagauucuauguuaauauuuuauguguaaaauaagguuaugauugaaucuacuugcacacucucccauuauauuuauuguuuauuuuaggucaaacccaaguuaguucaauccugauucauauuuaauuugaagauagaagguuugcagauauucucuagucauuuguuaauauuucuucgugaugacauaucacaugucagccacugugauagaggcugaggaauccaagaaaauggccagugagaucaaugugacggcagggaaauguaugugugucuauuuuguaacuguaaagaugaaugucaguuguuauuuauugaaaugauuucacaguguguggucaacauuucucauguugaagcuuuaagaacuaaaauguucuaaauaucccuuggacauuuuaugucuuucuuguaaggcauacugccuuguuuaauguuaauuaugcaguguuucccucuguguuagagcagagagguuucgauauuuauugauguuuucacaaagaacaggaaaauaaaauauuua

SEQ ID NO: 21226 - RNA, 133813 nt, Homo sapiens
cggggcugcgccgaggacgcccggggcucgagagcagguagucccguaacaucggggcgccgcgccgggacgcguccccgcccggcuccgccaaauggugagcgcggcgcuggcagcagggcccgcggggugaaggcgcucauggacggaagaccccuggcucuauaagcugaauuauggcagcccagucaagguaagccgugcaccggagaaacuuuucaaacgcguucguggcgaggggagcugaagguugcgggggagggcagggugcggggaaggagacggacaggaagcagcuuugucauugccuucucaucauucccgaggcuguggcuugacuaaaugucagauaaaaagcaguuuggagaacaugcuggacaauuucugcacagcggagagagggauggaguuaaagugaagauuaaaguuagauagcccccuucuucccccagaacuguuauuuuccgggacauuaaguugauuucacuuguccgcccuugcccaaauuuccauuuagauucuuugugcgccuaccccucgguuuucuggauuucuugcuguugucucgaggggaaguuuagaaauacgauuaauguaaaacauaguucaccuuggagagggugggugagaauuugccuggugagugaaaauuuuacugcuagaauguacgauuccacauaaaacggccccgcuuacgugaaucugcugaguaggcaaagaccgggaacgcgccgggguggugaaggggagagaggauaaugaacugcaguugcugucagaggagcgcuauuguaagaaccugaagccccgucuuuccaugguuuguuacuguuuuuguaaugagcguugaagaagagugaugacaaggcauuagugauuauuaugagauccaaacuguucugugcgauuuuauuuuaguuuugacagcaguuggugcuaagggagacuuaggaguuauauauacauucucuuucaacuguguuuugcuagaaagcaguuuggucucacauauuuaaaguaguaggguucuucaagcugauauuugauguagaacagugauuuugggaggucucagaagacuuaacacgucugaagacucagaucauggagagaaauggauguuaaauguucauguuugggcuggaugagacaauguuuuuuuccuacgaaauagaacuuucuaggaaggaaagagcuucucuguauaaaguaccuccuaugugcuaccugcuuuuuauauuucuucuucucaacacagugguuuauccucugcuuccauuuuauugaguuuuaagaaagugguucuuaaucuggggccaaguaguagaacuuggaugagaaacacaaguugugucucuauuuuuguuaaccucuagcugaaauuuaguguuuuuuuuuuuuuuaaguaggacuagagauaaaacuauaguaccaguccuugugauguuaucacaauagaaacuauaugucuuuucauaaucuuaauacaauuguugcagaugucuucaaacaccuuuugugcucuccacucaggaaauuaaggaacugcuuuaucuugcuuaauucaguaguaaagaaaaacacuacuguaccauugauuucuuuuaaauauuuuaauaggugcuugucuauauaaucugguaccuuuguauucuuauguauuuuauuuaauguauuuaaaaacauuuuucugauagugcuguuauugucagacugcuacagagguccauggcagaaaauuaagauuaagauaccuugaucuaagaaguuaguaaaugcugugugacagaucucaguaauauagcgcagggauuuguacccaggugugagagauucaaugccagcgcucuuaaacuaaugauaaaaauaaaaugagacacaagcuaaauuggacacugcugugugccaggcacagcauuaagcagcuuuaauuggauuagcucugacucuucucaggcaccuaaauggguaaguacuuuuauuauccacauuuguuaguugaggaaacugagguccagccuggcuguuucuugccugaggucacaaagguggagcaacgccugacuccagaucugcuuugcacacuuccucccuuaugcuuccucuuuaaugcugaggugagauguuaaagggagcugccaagccucaguauaacaguacaaagaaugauuccugcuaaaauugguuguuuguaauauguaauaauccugaguuaucaguguggugguucaacuugccagcaauuaaaauaggagaauugugcuuauuucugauccucuaccccaccuuccgacaugcccuggaacuaggaacaaagccacaagacuguuaugucuguuguuuucuuagucuguguguugggaguauaucucacauuuuguaaaugugcauuuucuuugguuacaccuggaaugugguccaagcucauucagauaauugugcucugugggagagaagguaaucuuugagauccaaagagaauauauggagaagauucaagauauuuugggauuucagggaaacucuaaagcugggccacguugcccugaguaaugcuaagagaaaccaaaacaucaccugugauguaaaaucucagguagugaaaucuugaccauguacuacuacacauuaguguuuguuugcucuugagacaauuaauuuagaccgacagacucauuguacuuacagauuuguagcucaguguuuaagcacaccaguuucuuuguucauuguuuaguuugauuccugauuuguuauugaugggugauauaugacuaauuuuuuaugcaaauggauuaggcgguguauucccaucccuguaguucacuccuuaagacaagauacugucucccacauuuuagucuccccuacauaagcuagaaguacuuugaauugagagauuaccuaaguauuucuuggcuuguggacuuuuauaaauuaaggcuguguuaaaaccuaagaguaggaaauuuguuuuguggcugauuucuucucuuaaagcuggaagacauuucuugacuaaaaugcaauuaaaugcuuuuaaaauuuagauuuuugggggucauauuuugaaaacaauaaguauuugguuuauuguauuccuagaguugagaaagguggucacugagaaaugucuugucaaagcggauuguaugcugugucugggcucucagauaagugugugcuuucuuuggaaccuauaaacauaacagacacauugaauauauacuuccuuguggaaauugcaacaaacuugcuuucuuugaugugaaauaguuacagaacauggcuuuaguuacuggacucugauggaaagugcauccagacuauuuuauagaaguauaaaaacuagcaacuaguaaaccuaacaguuuauagacauauuuuuuuccugcaagaauuaacagugcuuuauacugaggagugguguugauggauacaguaaaaaggaggacuuugccugauucccaccuccgcuaacccucucauugaagcagaucccugaauucuagaaaggaaaauauacauaccuucaaauacuaucagggauuagccaguuuaaaaaaaucaccugggccgggugugguggcucacgccuguaaucccagcacuuuugggaggccgaggcaggcggaucacgagguuaggagauccagaccacugugaaaccccaucucuacuaaaaauacaaaaaaaaaucagccgggugcgguggcgggcgccuguagucccagcuacgcgggaggcggaggcaggagaauggcgugaaccugggagguggagcuugcagugagcugagaucgcaccacugcacuccagccugggugacagagugagacuccgucucaaaaaaaaaaaaaaaaaaagaaaaaaaaaaucaccugaugccaccugagaaccccuggcccuucuccacccuggggcagggguguaugcaugggaguaggggaguugaacuugcuucuuugggagaguugaaucugguggcugagcacggagcuucucaaaagaaaggauuuauagacaaacugcaguaggaaaguauguucagucaacucucccacaguuuuuaacuuuugaauuugucuaaaauuaaugaagcuuugaaaaaucaauaaagaagcaaagucagauugugcccaagauuuauaugaagcugguuuuugguggaucucuuugacucuagggagggaaaguuuuccauugcaaaaagcaaugcucuuaaacugguauagauccaguuuugcccugcccuaugccccgucucugauuuuugagcuagugauuaccuuggaagaaaauucaugaaugcaaagcagcuuugauuaaaaaugagccauuaucaaagagaauacugugguuuuggaaaguacaguucaaagaagagauuuugggauggaaauaauuuauguaguauuuugauccauugaauauucucacuuuuuccuucuugugacaccauuguaaacaguguccuugacagaagagaaacacaaacaggucucuuaagugauuucuuucuaguucauccugagagcccaguugagcuuccugacucacagucuagagcugcuuccaugauaaagacugaaggagcggugagucauuuuuuaaagucagcugauuuauggggauguuguuguuuuggcaaaacuaacucaagugaucucucgagauuuugcuggauuuuauaccauaccgugaaaagauauuccauagcuggauuuacacucuugaaaaugggguuuuugugcgugcugcaucuaaaaauuuuaaauuucaauuacauucaggaauaaaauauuauggaugagagagaaaucuacuuuuucaucuugguucugucauuuauuucuugugagccuccaaaucuauuuuuuacauaauaccuguaagagagaggaguuauaaagcugguuuguuaacuguugcuuugagguauauauaaacuuaguuuucuguuagcaaacuucuccauuucauuucuuguuuuuuuuuuuuuuuguauaacuauacauauuuuaguagagaugggguuuucaacaucuuggccaggcuggucucgaacuccugacaucagguuucuuuuccaagauaggcaaauaaacuuauucuaauucuguaugugagauauaguggaaauacaauaugcaccucuaggacaaaguuucuuggagacaugcuucuuggcucagaaauagaaacauauagugaggcuaaguauaaucucuuuguugugguugguucaguuacguuuuauugauauagagugaguacauaacuuuuacggguuaaaugauuaccaaucguuuuuacuuaaauguaaaaacugggggagcugaaguaguauuuucugucuccuucagaugguccucaauucauuuuauuaugaauauaaaguguucauuugcucauuugcucaaaauaacacagcagguagaaugcacagugucuugcucaaguacaaauguaucagaugaacuuuagauuuacacuucaggagaaaauauguauaacuuuuggugcuaaugccccagggaacuaaaaguaaagauuaacuuuaaaaccaugcaaauugcugacuuucugugucuuggcagugaucaguguugagaaucccuccccugugcaaacuuuuuccuuuucuuaucuguucacagugaguuaaagcuuaaccugauggccacagagccaacagaccuggcaucuugaaagucuuguucucugcugaaugucuguuuucuuguguuaguuuauuggcuuuguuuuuaauuuaaccagauugaacugcuaucaaguucuuuuuuuuuuuuuuuuuuuuuuuuuugggagacggaguuucgcucuuguugcccaggcuggagugcaauggugcgaucucggcucacagcaaccucugccuccuggguucaagccauucugccucagccuccggaguagcugggaauacaggcaugcuccaccaagcccggcuaauuuuguauuuuuaguagagaugggguuucuccauguuggucaggauggucucgaacuccagaccucaggugauccucccgccucggccucccaaagugcugggauuacaggcgugagccacccuguccggcugaacugcuaucaaguucuuaaggcuauugcugggagcaguaauuuggugacagauuuaauauauuaagagaaaaucccagggguaaacaucuuaucuaaaggaacucaagcagacaaaggguaaaauauuuuuauugacaccuagauugucuuuauuucgguauguuuucaaagggcacucacuguuugacugcauucuaaaaaguaccaagaauuguuuuuccuccgugguggcucauaugggugagggcuuggagaccugcaggccacaugauccuuuauuuuggugggcuggggaagaguuaaggcugugaugaagaucuuaccuuuuuuuuuuuuuuuuuuaaguauugcuuacugcuggauuggcaacuaaacaaauaaaaaguaaaaggcuauuuuaggggcaauauggucauaugagguucaggguucucaaacuugauuagacacaaaaaucaccgugggugcuuguuaguaugcagauucugcucccccucccccagagauucugaauggacagguucuggguggagcucugcugucuguaaggccaggggcgcagguaccaugcuuugugagauggugcaugugugagugagagagaucauauaaaccauguuguaugaugcuauuaaauuuugauaucauauaugcuuauaaauacacauuuuuccccuccuauugaaacagacuggagguugguagagaagguggauaucuacguccauaaaauuuauccuuauauuacaaacuguugguugaaauauccaaaugcgucuguguuaaaaaaaaaauuaaaagauaccaagaagcaauucccaguguuugaucauacagcaccuucccaagaauuguuucuucucaaggagcaggguauuuaauuuacuuuuuuccaugcguugugggcucccuccccaguuagaguuaacugcuaaguaucucucucucuaccacacacagcccaguuuaccagguggcaguuguuuuuguucccagggaaaaguuaaaauggugugaauuggucaguuuuguccaaacuuugugaaaccgaaaugaaaguuuuguuuuuuaagaaaagcuuugccuagggguacugcugaacaaauaauguucaacaagacauuuuaaauggaacuccuacugggaaguaaauguuaaaauuauagcagaugucacuuccuguaacaaaauucaggaaacagucuuugguauguggguguuguaacuuuucaauuuuuggaacuuuccuucaggaaacuguccugucagaagcaaagcagucaauaaaauaugaagcacaacuuaaacuauguuauacaguguaauuaaauuuugauuuggugcauauguuuuuguggucaagacagacccaagauuaucacgugacuuucauccuggauaauguaagucuggauaacuuguuaaauugcuucucccccacuucucccauucugguuacuuuaaaaauacagguguaucugauuuacucuggacuugaauuuauggaaagugguauaaaauuaauuaguucucauuguuuuguacaaaacuaugaaaccuguuuccucccuagcuuugcagaaauuuugucucaauugacaaacugucuaccuuagacauuucuaagauggccuauuuaguaaguugguagcuuugagcuuugauaaaaguuugaguccaugauauuaugguuuaagaaaauuuuuccuuaaaggaaaacagaacguguuauugaguuaauauugcuggguuuuaguuguuguuuauuugcugaaaggauagucauugguauaaaguaagcuaaagcucuguccuuuuauauuuuuucagguaauuuugaccuagcaauuacagcuauaggaauguuuuccuguuacucauuuacagucugugucucccucuccccuccagccuccuuuuagaguuaagacggugcuaacucuccauuuaaaaaaguguguaaaaaauaaacuuuguaccacaggggaaaaauuaggcaguaacauuuacuggcauuagaauagcaaaaggauaaaaugaaaccuaguguauuaccuuaauacauaauugagguuuugcaaccuaaaaauauuggaaagaauuauuaauguuguucagauugucugcuuaucuugugacuugguuuuaguaaaauucaaagugccacuggaacuuaguuuuuguuuuuaaaugggaacuaugcccagaagaugaaaaguccuagguuggcaguuagauugaauuugauaauucugucacugcugauggugugaguuuuuuauuuguucuuacccuuagggcagggaggggccuccucuuaaaaacaccuucauuucuuucuuauuuuagcagucauguuucuuuaaggguaaaguaaaaaucauuagguuuacuuaauucugaguuuaaauuuguaggcuuuauaaaaauucuugacaguuuaugauaagccuagcauaaaacuucguuuucucucugaggucacucguauucuguguugacauccuuaaaguauugguauuauccaugaucuuagaguguuuuaaagaaugaagaagucgggcguggucgcucaugccuguaaucccagcacucugggaggcccaggcaggcggaucaccugaggucaggaguuugagagcagccuggucaacauggugaaaccucgucucuacuaaaaauacaaacauuagcugggcguaguggcaggugccuguaaucccagcuacucgggaggcugaggcaggagaauugcuugaacucgggagguggagguugcaguuagccaagaucaugccguugcacuccagccugggcgaucuuuugguagcuugguguaaaugaccuuuuguggggaaagagggaagaggggaauaguuaaauugaaucgagguacguuccuugucacccagaucuuuuauaucuuuuguuauaucucauuuuauggguauuucuucccagcccaaguuuuuguaaaagugauuuuauucgaggucaggagaucaagaccauccugacuaacacagugaaaccccgucucuacugaaaauacaaaaaaauuagccagacgugguggcgggcgccuguagucccagcuacucgggagacugaggcaggagaauggcauaaaccugggagggcggagcuugcagugagcggagauugcgccacugcacuccagccugggugacagagucagacucugucucaaaaaaaaaaaaaaagugauuuuauugaagucuauuuuauauaucauaaaauucacucaugucaagugacaacucaguaauguuuaguuacuuuacugaauggagcgaccaguuuuagaacauuuuaucccauaccugguaagaucccuccugcccauuuacaguuaaucccgguccccagccccaccaccauaaccuacuuucugucucuguaaauaugccuuuucugggcauuucacauaguggaaucauaaauggaguaugaugguuucuugcaucugacucucuuuacuugcauauguauauauauuuuaaauuuaccagccucagcacauucuggccauacuugaauaauuuuuugagguucaucugugguguaccauguaucagugguucuauccuuuuauuacugaauaguauucuguuaauagaugugauggacagguugucccaauuuuuuaaaaaauugugaauaauguugcugugaacauuuacauacaagacuuuggacauauauauauguguguguguguauguguauauauauguguuuuuuuuuuuuuuuuuuuugguuggauagcugaagguggaauuucuggguccuaugauaguuuuuuguuugacuuuuugagaaaaugccaaacaguuuuucaaacuauaugccuagccuaacuuugaacugaucuaauuuagucaauuucuugcaaauuguuugcuaucuucauaguuauuugggcuaugaaaguagugguucugagaucugaucaauuuugcauuugauuauuagaaaauuauauauuguuuucaauuuauaugugaucuuaaaacaccgcucauuuucccccauauacaguucuuuauuguauuuuguaaauugggcuuuucgaugaagaaauucauaucgaggaauguuuaaagaaagccaaauuaaguuuaaaaugccaaugcaugcugauuauugucaaaguaguaaagaaaacuccaacuccacaacucauaaaccccucaaauagcagaauuuaaauauauuauuuguuaaguagaaauccuuuauuuuauaauugcaaaauggcccuauaaauuguuauuucaaugugcauuuuaaauaaaagcguucgggcaaaaaugcgcuguucucauucacuagagccucacaugcaaagauaaguuaucuaagugaagcgucuggaaauuaucguucagacuuggguccugccuggggaagguggugacuaugugcccucccuugaugguguacuccgacuucaguuaaagauagaucuguugcacaaacaaaaauguuucaugaaaugcucugaaaguaucuuuaggggcaugugugacguuagugaaaaugaaucaucuuuuuagcauucagucguucuauuuaaaaaaaaaaaagcugugaggcucuggcuagaagaugucuucauuucuuccuuuaugagccuuucaaguguucuuucaacuuggagagccucaaugcauuguggcaaguuacugaaaucugcugcucugcauauuaauuuaccugcguaagaauuauaucaguaucaacagcuuuaugaauguggccaauucacacgcauuaaguguuuuucauguuaucuguaaauguauugaguacuucauuguucacuaagagccaaccauuggugugugcagggcucugaguugguuuagauaaauacacugucucccucccuacaaggagcucauaguuuggugggagagacagaaauaagcaaacaaacugacaaauaaaacaagugcaaauuguggaaacacaguggcaaaaaacaggauacugugagggaauaauaggggguggggaauuggucuugguguggggccaggagaaccucugaggaggguuaccugaggcagagaaagagcaagccaugacacagagaaagguaauuguccuucuagaauguacauggaaguaaguggugaugguggugagaaggauggcuuuuuuugagacagaauuuugcuguguuggccacgcuggagugcaguggcaccaucauggcucacugcaaccuccaaggauggcauuuuuaaacagggauaaaaauguuaggaaaugaccgucauguggcaguuucuugaaauaaaaauuugauuguuuuagugguuuguaguucuaccaaaacuuagcccuguuuuuaauuuauuuuaauaaaggcaaagugaguaccauaacaaccuagcuaugaacuuuaaaauagagacuauaguuucuaaaacuuaggcuuaauuggcacauaaauguaaacacauuaaacaaguguugaaaagaaauucgagaggacauuuuucuuugggagccaucaaauaagggaugugguagaauuuagaaaggcccccaggucagugagguacaguuauaaggaagugaagauuuagacaguaaggagggcauuccaccuggcuauuaaauauaaagguuaauuuacaaaacaaccuuuuguaugugugaaggacuguuaugggaaguggggugaaagauggucucuaucucugccaaaaauagaucuugaagagauaaauagcaaagcccaugaaggaaaacacagaagugguguucuuuuuuauauauuuagcaauaggaaauaaucuucugccuuggauaguuuaggaaguagcagaugguuuaaguaccagugauauuaugauuauauauugguuuucguccaugguuccuggcccauaacucccacaguccuuguuagucuuuuguuauaaugguggggcacuuuaggccucaggagacagaaucucucugugaccuucucuuaucuuccuuucacuugcccaaggcaggacucuaaucuaauuguaagucuaaagacuuuuauuccagagaguuccugccccauacucuggaggaaggaaugcuguacagagaggccaagaaaaaucugaacugaaggguguugguugauuuagaucauacccuuuuuguccagucacauuucuacaugguugucaaucuugccuacacuaugaagucuucauaaaaggcccaagaggacugggucuccagagagcuucuggauagcugagcauguggagguuuagggagaguggugugcccagggagggcauggaagcaccacgccccuucccccauaucucaccuuacacaucucuucaucugugugcuuuguaauguccuuuacaauaaaccguuaaacguuaaguagguguuuccuugaguucugugagccacuccagcaaauuaauugaaaccgugggaucccaacuugaaaccagucuaucagaaguucuggagguccagaccugugacuggugucugaaggggucgggggggggcagucuuggggacugagcccucaaccugugggaucugacuccaucuccagguaguuguguagauaguaggaaaaucuccuccucccacguuugaucacagaagucuucuguguugacgauuguugugugagagcagaggaaaaacacagaauuuuuugaaaacagcaccuuuuucucaagggauucuguggcuucuugaaaaaaugugaucacaauaaacuacuguaggaacugaaaguuuuuguccuuuguguaucacagcuauauuuaauuacauaaaguugcuucaaagaucugcauucauuaucaccucaucucuuuuguacuucucuucacaguuauuuucaaaugaauguauugaguuauagaccuuuguggcauaaugauugcuuuuaugaauguuucacgaccauguaagaaagaacguauuugcuuuauuuucagaguccagagauaaaugugguuuuguaucuuauuucuguauucuuauuuugucuguuugaucugccauggacuaagagaugaauaaaagccucauaugaguacacugcuaucuuaaguuucuuugcaaauguugaugccauguuuuuguuuuguuuuguuuuguuucagauggagucuugcucuguugcccaggcuggagugcaguggcgcaauuucggcucacuguaaccuccaccuccuggguucaagggauucuccugccucagccuccugaguagcugggacuacaggcacgugccaacauguccggcuaauuuuuuguauuuuuaguggagacaggguuucacuguguuagccaggauguucucagucuccugaccucaugauccgccugccucagccucucaaaaugcugggauuacaggcgggauuaccaugcccaguaaugccauguuuuugaugcacagguagucaucauuguuaacgucgucuuuucaaauuguccuguuuggcaauauuaguuuuuaauguauucuuccagaagguuucuuugaguauaggugauauuucuuaaaaagauguguaucuuuuaauauauucugcaugcggauuuuauuuugguuuaaggagugauggaagauuucugaacccuuccucucuuccccaagacucaccauucuguucucuauauuuaagcgccaucaucaaauucacuguaccuuuguaugcguuuuaauauaugaucgggcugauugcccuucuuuacccuucugaggugcacucucagaauuuuuguggcuguuuucucauguaauuuuucugagucuucugucaaacaacuuggggccuuguaauaggaugacuuccuaacaaauuuguaaaaccucauccuguuuuucagaaguacuaaaguuuuaaauggauuaccguguucuuuguagauuuucauggaaugggaaaggcuaaaguagagggccagggacuccugagucacucaccagacaccacucauuuaucuuggagacauuagggaaauccuguuugccucaguuuauccagaaguaaaaauguacauuugcucuugucauaaaugaauguauuuuuaauguaacucuguaagaguggaaucauauuucuauaggugauuuacaucuggcuuuaggcagaagcaguguuucacaguaucauuguuucuguggauaguaucccacuuucuggcagacuugauugaaucaguaugccuuggaaauaauagauguaauuuaggcucuuuagaaucuuuuuuuguaguucaguaaaacaaaacuaauuguaaguuaauuguaauuaaaagagaaaugucuuccugaaucucaguaauuugucuaaacauuuucuuuuuguucccuuucaaucuuuuauuuaugcauuaaauuuuuucacauuguugacuuauucuuuauguguguuugauaagugauuuagucaacacauaggggaaaaagggguugggauuacuuuagacuguuaugauuuuugagauugucauuuugaagaggaacagauaaaucuuucacaucuuuaugcuuagaaaugccaugcuagggcgggcgcaguggcacgcgccuguaaucucagcacuuugggaggccgaggccagcggaucaccugaggucaggaguuugagaccagccuagcugacauggugaaacuccaucucuacuaaaaauacaaaaaaauuagccaggcgugguggcgggugccuguaaucccagcuacuugggagacugaggugggagaaugucuugaaccugggaggcagagguuucggugagccgagaucgugccacugcacucuggccugggcgugacacagcgagacuccaucucaaaaaaaaaaaaaaaaaaaaaaaugccaugcuaaaaacacuuuuaaaagucaaaaauagcccaguuaacauugacuaaagcaagguguuauuuuauacauugugcuaggagccaagguaguuaacagagauauuaacacacugacacuuagguuuaguagauguuccagucuguucaugaugcuggugauggaaaguauuacugaacaccauacuuaaaagcuuuacccauucauauuuauuuguaagacugugguagcugaagaaaaacuaguauagcccacaaaauccaaauaaaucaaggaccccucuacgauguuuucuucccgugcuuacagauauauauauauauauauauauauauauauauauauauaucuaucuauaucuaucuguguguauauauaucuguguguguauauauaugugcguguauauauguguguguauauauauguguguguauauauauguguguguauguauaucuguguguauauauauaucuguguguauauauguauauauaucuguguguguguauauauauauaauaucauguguguguauauauauacauaucacguguguguauauauaugcacacacacacacgaauguuagcaaagaacccaagcauugccucaauaaguaacguuagaaucauacauccaagccaaaaucuuuauuuauuuuauuuuuaauuuauuuauuuaauauagauggagucucuguugcccagacuggaguguaguggugugaucauagcuuaccgcagcauuagacuccuggacucaagugauccucuugccucacccucccgaguagcugggacuacaggcaggcacacaccaccaugcccagcuaauuuuuaauuuuuuuuuguagagauggggucuuucuuuguuguucaggcuggucuugaacucaggugauccuaccacuuuggguucucaaagugcugggauuaaagguguaagccacugugcccagcagacugaaaucauuuuauaacugugcuuuucaauguuaucuuaaaauuagcuggggaagaauucuguuuaguuuuuguuuuuuggugucagucucauuuaaaaauugacaaggaaaugaauggauuugugguaacugccuuuuaacuuuguaaauuuuaaccuaauguauguuuaaauuaucagaaauagaaaauucagauacuucuauacuuacugacuuauuauaaaaacugugccuaaacugaaggacagaaccacuuaaauuauucauuuauuugagaagaaauuuucuauuuuaauucaacaaugacuuuuuucacuauauuuucaugguugaacuggcuagaguggguaguuauuucaauagguguuggaaauuaaaaaaaguguagauaguuuccaguuuacugauuuucuuccaaaaauguguuugggacauagaaaauguuuugcagaagcagcaaggaaaaucaugugaugaagguuaggcccuaggcuagagccagaauguuucuuaacuugugccaaaauguccaacauuuggaauaauaauggcaaacggugcaaucacugaaauaaagcaugaaaaccaugcuuaaacaagaggguucguucuauacuuguguuagcuuuuagcuuuaggggguuuuguggauggagaaagaggagugguguaagggaucuuuaagauuacuuggaggagacuggaaaaaauggauucuuuggggcaggggcauuuccacugguaaaccugggcacuuuuaaggacagaggauuauguauaauuuugaucuaugguaauagcagucuuuuauuaagcaauuauuuauugagcauucuguuauguucugaucucugaaccaggaacuuugcaaaaugguaucauuuaaucugcaaggcagagcuuaucacugccauuauacagauaaacugaggcucauggcaagugacggcugauacacagcuucagaucuacuccagacuuacauguaaaugucuccuugcccuucauacauauauccauguggccagugacccaugauuuacugguggagcaaaggaaggcauagaaaauggaauauggguggggugucuguuuaucucuaaacugagcuauaacugaaacaaaaaaagaggaugagaguagggaaacaugguauguguaaaauuccucucagagugaagaaaugugaggucaguguuucccagcguuagccucugggaaguaagugccuuuucuccagcuugguuacugcauggggaauuuggagagagaugguaggguauuuguaacuuggggaacuccagcaauauuugggacaggggauguauguggauggaaccuuuuuguauaaaagaugugaaaucccuuuuacccuucauccuccuuuaggauccugcuuuuuuuugagucagagucuuguucugucuuccgaggcuggaguacaguggcgcuaucuguucacugcaaccucugccuccuggguucaagcaauucuccugccucagccuccugaggcugggauuacaggugcccaccaccacgccuggcuaauuuauuuauuuauuuuuuaguagagauggaguuucaccauguuggccaggcuggucucaagcuccuggacucaagugauccacccgccucggccucccaaaguguugggaucacaggcgugagccacugcgcccagccccgauccugaucccuauccugcuucuuuagaaaaaacugauguuuagaauaaaacauuuuuccaccccuucauuuuuagugugaaaugcaugcaucccuucaccucugcugugagauaccacauuuuaugccauccuugggauccccuuuuuucacaagguucucuuauccugcuccauaggcugccagcucuagugaccaucuauuguguuuaguauugaguuaucucccuuuuuagggaggaaagggauguaaugggagaggcauaggcagaaugcaggaaggggcaccaaagccugugcuccuuugccagcacuuggacuccagcuguguauauucauuaauaaugacucacaguuauugaacacuaggcacugggcucagcacuaugucugcauuaguuaauguaauuauuacaacagcccaaaacuuuuugguacaauucucaucucuauuuuagagaggacgaaacuaaggcuuagagaguguauggcuuguccuguuggcuguaccuggcagugacagcaucucagacgugccggucauaaauguagccauuggcaaagauuucccaugucaguuccuuccguccugcauuauugugguggcugcuaucccaguagagaaguaacacagugacuuugggaauauuucucauucucuacaggggugguucuccacaggggaggagauuuuacccuucccuaucccggggauauuuggcaaugucuggagacagauauggcugucacgccugggaggggggugugcuaccaucaucucagauagaggcuagggaugcugcuaacguccugcaauacacaggacagccccacccuaagaauuaccuggccccaagugucaauaguggagaacucucgcucugcagguuucgccuaguuccuaugcauggggauguuuguguuuccgagagcgucuguacauugucaucagacccuaaaucaugcuggccccaggugucaguuacuugaccuguauuugcuuaggacacaguaugugcaagacacuccugggugcucuguggguuacacagccuuacucuaccccucaccaccauguuuagugaguaaaugauuuacccaaagaaccacaguuaggaaguggcagagccuaggucugaauccuucacuaacuccagagaccaugcuuuuuuuuuuuuuuuuuugcgugguggugcaugccuguaaggcugaggcaggagaauugcuugaacccgggagguggagguugcagugagcugacaccaugccauugcacuccagccugggcaacaagagugaaacucugucucaaaauaaauaaauagguaaauaaauaaaauuaaaaauuugccaugcacacccagcuaauuuuuguacuuuuaguagagaugggguuuugccauguuggccaggcuggucuuugaacccuugacuucaagcgauccuccugccucggccucccaaauugcugggauuacaggugugagccaccaugcccugcugagaccauucccuguacucguuuacugugaugguaaccaaaauguuccaucguguggcauguugcugagccuccucucugccuccuucaguuucaacaaagucguggcaggagacugacaaacagcagucucuguguggggaccuugaguggccauccaguugcucuguaguaggaagugguagggaaguuggaggugaggagggcccguuaguagggaacugaggccagacuucuaaaagagcaaggaaagaauuucgaaugacaugguuccucagcaugucugcagggaggagguuuauugcagcagcauuuagaacuagcucagaggagaaauaaugggcgaagggagauugguacauauaagguaauaccuauuguauuacagauuuacuuauguaaaaugcuuuucuaaaaucugguucucucguauuuuauauaccagauguaacucaaacuagaugaaauagaaccauagacucaauccuuccuaaaagcucaaggcuuucuggcuugguaauuuuguggggaagcacuugcaggaaaaacacuuugaaauaugaagaaggaaaugugauuccggugguuucuuuauaggcccuaaaucaguacaggaagaaauaggacaagaaccagagaagauuaacuuucugaaacuuuacaaacagccuaauucccaaguagagaaaaguauauuuuaaagaaugaauacugggggaggaaaugagggaaggugaauuaagccuucacaguggcugcuaaggagauuacccugaaaacuucccaggugggaaucugaaacuuacuucuacaaauguaugcaugugucucuacuagauugcuuguaguuucccaguagagcaaaaagcagaagccagagaaagauuugaagguguuagguaagugcucuaguuuugcuuggcgugcaugcacggauacacauguaacaugcacacuucugcuauuucaguucugcugacagcugaugaaaucaugugucucacaaguuuaggaccacucuugaguuccuuuccuuccaaagauuugcuauaauauuucauagauaaauuugugcuuccaaauuacuccuuucugcuaaaaucugagauuuaaccagaagccuguaaauacccuagaggagagaggagagucuguuggaaaaauguggggcacacaacgauccuaccacaguguuuugaccaaauuuaauaguuuauucuugugguuauuuuuucuaacauuaugaacauuuucaaacauucagaaaaguuuaaugaauuucacaguaaaaagccuuauucucagauuauaaguacauauuaaauaguccuaauucaaaauccuaaacauuccaaaaucugaaacuuuuuguuguuguugcuguuggguuuuuuuuuuuuuuuuuuuuuuuugaggugagucucacugucgcccagacuggagugcaguggugugaucaaugcaguggcccauugcaaccucugccuccugggguucaagugauucuccugccucagccucccaaguaggugggauuacaggcgugcaccaccaggccuggcuacaaaaucugaaacuuuuugagugaugacaugacacucuaaggaagugcuuauuggagcauuuuauuuuucagauuuuaagauuaguagugcuaaaugccaguguuccaaaauccaaaaaaaagaaaaaaaauugaaacccaaaacacuuaaggucccaagcauuucagauaaagggauacccagucuguauuaacauuuuauuuuacuugcauuaccauauauucaucucuuuguugcuguguccauccauuaauguauuuuuauacuucuuauauaaguugugggagaguauacugucccguaaauagcuuguauaucauuaaaguucaguauuuuuuuuuacguuuuuuuuucuuuugguauaaaaugcagugaaaggcacaaauuuuaaguguacuggcccauuuugacagugcaugcaucuguguaacucauaccccuaguaagauuuggaacuauucuuaagguuauuuuuugguguguaucugggaagaugauuagaagaagaguaaacaaacacguaaccuguuuuauuuuucuuccucucagggugucauuucaauuuuuuaaaaccuguuggaugaguugugugugcuugauaauaccucauuuuguagagauuauuuaaauuccuugaggucucagaccaaagcucuuggauuaagguacguuuuucuucaccuagguugucucuugcugagaauuaaagauaaauuuuuuagaaccagcccuucucacacugaaggaaaguggagacucauguccauuuaagaccuccccauuuuuggguaacaguaaaaugcaugugacagaauauaacuauuacuaaaucauucccugccacucuaggagugcauuuauuagagaaaugcuaggacuauuggauuguguucuuccaguguuaugcuuuugaaguugugggaaggcaggcggauuguccccaaaggaggugcccuuaguugaugucugucauccuacacagguggggucuuuuauuucauggccagggcucucaaaggcuuccuuuuggccacaaugagagaaaucugggggugagugaguguccucccagguaaauuaauggugggucuguaaauaaccaggggccccagacugaaaucgggcagguuguaauuugucagauaccuggaugccuguuaccuguuucuuuuuauucuguuauccucuagcauuugguaaacuuugauauaaauauuguggccguuucugagcuacuuuauuguaagagaauaguugggaaucugugauuaggcuagaguuauaaggggaaacaaggucucccugagugcagguggggcauagagguuuuaaaugggaaggaauaggugauaagaauauguaagagguucacucuaccuccauuugaagacagagguuuaacguuaugaagacugucaaccuguuuccuccuuacacugucagccugacagaugucuuuuuauguacguaaagguauucagauccagcagugcauucucccaccagacuuuugaagaaucaggacauuugaggaacauuaaguucugaccuuuaauagcagccacuggcuuaauucuucauauuuuccaaaaaccacacccgccugcuggaauagauagcacagggaaguuggauggacucccugugccuugggaguucuuacucccagagugucuccuaguguuuccuuuugcugugcugugucccguauauccugucauuuccauuuauuuuauccucaaauuauaaagaauuguaguguuaaguccguuauucacuuuaagaugcagccagaacagugacuggagugguuucauaccucauggguuucccacacuuccaucaacacacacuucacaacaccuuggaggcauugugaaaaggucaagcuuuggagauggggaagaguccugaagauguugggugacauuguacagugaauggaggcugccugcuuggcacacuuuccaucacacaucacauuuugcuaaucuuuuggaauaagggggaaagacauuuaaaugagauaauuagagauaagaauggagauuuuaaucuuuucccugaagucaagaaggcagauaaggagaaauugcugucacugaaagacuguauauuuuacaagaaguuauuucagaagcagucucuauuccuuuaggcuuuaaaugaacuuaaaaaaaaaaaaaucaccccuuguguuucuuacuaauuuagggacuaguccaggggucaacaaaccuuuucugugaaggaccagaugguaaauauuuuaggcuuugcagcccacgcgguuuauguugcaccuacuuagcucugcuguggugggaccaaagcauccauaaacaauacguaagcagaugaggaucacuauguuccaaugaaucuuuauuuacaaaaauagguagcugguccagauuuggcccaugagccauaguuugccaaucccuggacuagcccauccuuuuauuucuugcuaacuuuaaggaacauuuuaaaguugaaauuuaaagauuggccaguguuaaauaugaaugguuaaaaaaauucuccccccuuugccgcuggcagucuuacccuucuuuaauuuuacuuacaagucugaaacacuggucuaagcaugucaggaaauaagcgaacaguuugggggugggaguaugcaacuaaauauucguuuaaaacuuacacugagcuuuuuuuuuuuucuuccccguuccauuucacauuguuaauguuggcucagcaaacagaaugauauguggaagucuugaaaacaguguaaaaucauuugaauuaggagguuaggccagacuucacagcaaagcucuguguaaccagcguccugguacucugugcagacccagugcugagugacucgcauucccaagauugagccucuuuugggcaaugaggagcaaaaggggucugggaauggugaucgguuuuguuugugugaucaucugaggccccaguugagugcauuugcauucuaaacucccacauccacacucgguucauuucccgaaaacugacaguuuuccacgugcacaguaauuugagaucguuguuucaggcugaggaaagcccacaggccguugucugggguggggguaggaggguauugcaggcucugaaagauaauugaggcacuccagaccaguggaguggguggcugcaagacguuaucguccccacagaguaucaggcaugcuuucggacccauccugugagaaaucugaguggaguaagacggaugcaaacacccuauggugaaugaucacuccccuacaaacuuaagugcugucuuggggcggaggccucuuucucucuuggaaacuucugcucaucauucaagauucagcucagaugucccuguucuuaauuaauuaaaucaccccaggcuccuccauuuagaguuccuguuuuucuccuuaguccuuuagcacuuguaaucaaccucuacuaucacucuuagcauauguuuuuuuuuuuuucuuuuguuccuccuccuucauuuguguaucucgcuaaauuguggaaucccucaccuuuuuaucccuaggucuagcacauaagaggaagucaauguuuacuggaaaucaggggcuuuucuguucucauucugugaggcuuacaaccuugaaguacagaaagccauagauaaaugcauuccuguucucaacuuugacguaaauaauauucaaaauacaauucuguuuugaagaaauuauuuuauaaacaggucuuauaaaauauaaauugucacaguguaucuggugguaauguugaauguuuccuuauuguuuacuugcaguggauauauuagugucugcuuuucagagaguagaaauggaaacuuuacagccuuaucaagaacuuaacauuauuaaggacucuaaaaauucucaaguguaugucuuucuuaauuacuugaacucucagauucuaauuuuuagcguuggcugaagguuagagggaugcuuuaagauugauaaauaccuuuuguuuuaugcaagugaacugccuauugguagugauggugaaaagaugauauauucugcauauaaauguugauagcugagccaaaauccagcccaaagaauccugacaagcuuuguaaggcucacaacacggcuuagcagaggucaaaugaagggagacuucugcagaaaaacaaugacuuacuguuuagcuuuaaggagaugccaauuauagcggguaguaggaggugagcugggguuaugaugaaaaugagaauauuuagaaacauguaacuguugcuuguuaccauauaaaauaccaauagauguuuccagcuuucuucuccuauaauaaucucccuguucuuccuacuugaaaugucuguggaaugaaauggaacaaaaugaaacugccucuaguuuuuaugacauuaagcuuucuuucuguagaaacgaguguggcguguguaauuaaauaaccaaagggaaagauaaccaagaucaagauauaaacaaaagcgcugaugguucuuuaaaagcauuuguauggacaacuuauuccuccuuuuuuuguuguugcugucugcuuuguguaauaugcaaauaagguuagguaucugcuuuguaguccauguguuguuugcuaggagccuagaaaaaacuucucaguuguaggaauuuugucucuuuuuaugaauguguccacagcagccuguuuaaaauguaauugacagugguuucuccuuguagcaguuguugauugggggguuggaggauccuugacauuuaauuuuggauauacucucccaugauagaaugagcuugaaguggagaguggaggagcccuacaauuuuuuuuugguuuauucaguaauugaaaaauguguugauggguuccuguguacucaguucaacaauaaauguuucaagcugugugcaggggcucacaccuguaguuccagcauuuuaggaggccaaggcaagaggauugcuugaggccaggaguuugagaccgaccuaggcaacaaagcaagaccccaucucuacaaaaauacuuaaaaauuagcugggcaugauggugcaugccuguagucccagcuacucaggaggcugaggugggaggaucccuugagcccagaaguuggaggcugcagcgagccaugauugugccacugcacugggugauagugagacccugucucaaaaaacaaaacaagaauaaauguuuuuucuuuagagaaauaaauugcaucuugccaguuuccuuaauauccuguuguuccccacuguucuuaucaauacacagacacuuuuccuuucauuuuccaaguguaagccuuuuccuguugcuuuuugcugcugguuagcaagucuaaaugcugagcauuuguucuggcugaagcugugcuugguacauuggcccaguuucaaagguuuuucuuauuguauguggugcaauugguucucuggaaugugugcguuagaaguucagugacugggagggacucuuccuuuuggaaugguaaauccuguccuguguuccaagcuguucuauagaauguaccucauucaguuugguguauguuugggauuuucuggugcuuaaauuaaguaacaguauauucacuuaguacauuugaucucuuaugggcuguagaaguuaguuguuucuuaaaaccaaauuugcuccugaauaauuugagagaagaggugccuuuuaaaaucaccuuggggacguuucagcaguuucuucuugaggcaagaugaauuugggaauaauuuguuuuucuuguuuucugugugggacuugaaaauuugauguuuuaaucaguuuagagaauguucuucauaacugccuguuuuuuuuuaaauguuauuauuaaaugguuaacuucaaaauuuauuuaaaaaaacuauugagucucuggaucuguauguagaguuagaugugcaaaaucucacucaaccaauauucauaugaccugauggguuagugcuggguaaauaggaucaagcgggaaggggugacugaccugcagccacaugcauucuuccuugggaugggugcagggagucagaugaugacggaacagaugagugaguaggcaggaucauuuuagauggggauugaaaggugaagugcuggagagcaccucugguggcggggacuggcugaggagccgauaguuauaaccugagauauuaguggagagagagcgagucuuccucagcuuuaggcacagagcaugcaaacggggauuagcgaugcacagcuugaccugcuccaggcaugaaaaggcagccagucuggcuaguauuccagggaggauagggggaggaaggaugcuagaucucggaagugugcugggaauggggccuuguuggccaggcuucuggauuuuaacuuugaaugcuauagcaaaccuguggagggcuuucagcaguggaaggaccgcuuaauuugccuugcauuuaaaauucucucucuggauccuguauuuucuuguguuguuccccaugauguauuuauagcagcauggagagauuuguuuauuguccaaguuuucauccuagagguagcuuucuaaaauuauucugaaucuguugauuuaaaacuaaauguguauuuucucuaaguguuacccaaacguaguaccuuuucuuuuacuguagagcacuugggguuuuaugacuaauuaauaaguaugguaaacugaagaauaaaacauguaacauuaacugauuaacacgugguguuagcugaggcaacucucuugguccaucuaagaaaggguguugucagccugccuucuagguuugauucauuugauggguaaaagaauuugguaaaaucaguuuuagguaucaaugagucacauuuugucguuagauaauaaauagacuggcagaauucagcagaauucugaaucauuggaaauugaguaaugcuugaauauaauuauuucagucaaagauauguauuaagcaucgcauuuauuaagcgcugugcuggguaaggaacccucggaauagucugugcccuuaaggagaagcucacagucuaauaaggaaaaucuguaggcacacauauauaaagucuaucuaguuuggguaaauauaaacguagacagccuagguaucccagaaauggaggcagggauacugaggaagacuuuugaaaggcaacaguuagagaccaggcagggagaagaucugugcuucccagagccucccugcuccuugugcuugaaggguagaaagugaggcagaacgcaggaagggugcucuuaccugggagggcugaggcuggcagaaguacugcuugaaauacucacccaggaggccuggcaugguggcucacaucuguaaucccagcacuuugggaggccgaggagggcagaucacgaggucaggagaucgagaccauccuggcuaacauggugaaaccccaucucuacuaaaaauaaaaaaaauuagcugggugugguggcgggcgccuguagucccagcuacucaggagguugaggcaggagaaugaugugaacccgggaggcggagcuugcagugagcggagaucgcgccacugcacuccagccucggcgacagagcaagacuccgucccaaggaaaaaaaaaaaauacucaggagcuuuaguccuguaggcaccagggcucccagaaagguuuuagguaggugaauaacaagaucagguuuaugauuuuuagaaaaaucagugacgcagcuuuguggagauggacaacccagaaagaggagccucucggggccacauuccaaaugagaagugaaguccauuuuauuugaauguuggaugcuucauagauuuaauacccaaaacauuuuuuaaaaguuggggaaugaauuaaaggaagaaagcauuaagaaaaagacuuuaagcuugcuugucuacauucuuaguuuguaacuguaggauuuuuaauuuuuguggcugucaugagagacuuucaccagccucauuauuuugcagguaugagaugugguccuucagggucaguugauagugugacaugaguggccugguaaugaggccagcacucugguugauccuaguacagaccagaagagcaggagaagagccaacacguauccacauuucugauuggugccaaaugagcagugccaaugaggcacugugcagcugugcucaccaggggccuuuacaacuaaaggggagacauaaauaacuagucaggugacagacuuuaucucagguuaaaaaaauugguuuaucucuguugccauuguggaggguaauuucuguauauccccuugcuugacugcugguaagcacuugacaucagucucagggacugaauuuucugaaauuugucaguaacaucaauacgcugacauugcauauaacauaaagacauguuuuauuaaccccuagcuguagauugccagacuuuugaggugagaagugauuuuuuuucacuggugugguuuguguaauuguucuauauacgugcuggccuugcucacucaguacuaguuuuuuauuuuuaaaauauguuuggaagaugagaggcuuggugugcugcacaugggaauacauuagcucaucugucuccucucccucugucaugcuacuuuucuguuggagcuauguauguccaaccacacaguuuuccuuacucccuuaaaaaccaauugaugaggaagacaaguucuuguguuuuucuaucuguaagguaaaaaauaccucucaaaauagacuuaugagaucuauuaagagaaacaaaauggguuauauuaacuaccccaguuaagaaacaucagcuacugguguuugaauguuagaacauauucucuaauauggcagcaaguaucugcuuuuuuucucucucuccccucccccauccccccuuuuuuugagacggcuucuugcuccaucgcugaggcuggagugcagggugugaccugggcucgcuguaaccucugccucucaggcucaagugauccucccaucucagcuucccaaguaguugggacuacaggagugugccaccaugcccagcuaauuugagauucugcuuuacgcagauggaucuaaaauuacuugcuaacagucuaagacugaguucagaacccaaaaucaguuuucagagcuucuaaugagaguuacugcaaaaaugauuaacacuccaguauuucuuuauccccagucugauguugcuauaguauaugaggcucuuuuaguuuuuaaucagaacuuuuauacaaauaauagaugcuuucucauugugaaaagaauuuaaaaacaacguuaacaaaaugcuccccaaaccacaucaccacuuaacauucugcacccuaaucccaugcugcuuggugguagguuguuuuuguuuugagauggagucuugcucugucacccaggcuggagugcaguggcgcguucucagcucacugcaaccuccaccuccuggguucaagcaguucuccugagucagccuucugaguagcugggauuacaggcacacaccaccacacccggccaauguuuuguauuuuuaguggagaugggguuucaccauguucgccaggcuagucuugaacuccugaccucaagugaucugcccgccucggccucccaaagugcugagauuacaggcaugaaccacugcucucggcccugcuugguagguuuuugugaaauguauccuuucagaccuuugcuacauauuaauaggcauacagaaguaccuggcaaguucauuuugaaagguaaauuaacaugucucuccuuagaauugaugugacuuuuuagucacguuugcccaaguguagagucguucucaauuuaaaacuugcaggaugcauuuaagauaugcaaaauaucuuacuggcucugaguccuggagaguguuuaugauggguaccaagaauguaaauuucacugucauguaucacccuccuagagaauggcaagaaguuaugugggcaguguuuucaagguugauuuaauuuugcaaaauggggucacauaaaacuuuaaaaauaaauacuauaauaaauuauaauaagacugagccuucuguggcaaacagaagugaguagcagagagugcuaaugcauugagauaauccccugggggcucuuccaggaaaacaacugacaucgugcuguuuugucauuguaguuggcugauauuuuuaauaugaaaucagauuguaagacuuuguuuuaggauuaagucucugauuacuuucuuuauaaauuuuaagaauguuauucauguuaguuauugagagugaaaacccugggacgauuuagcugagugauuuuuauuaugagaaagucucuuacaaauucuuucacauggauggagagacgaaaaaaaucucccuucuuugaagcaacauuuuauccugccuucagacauggagucacuuugauuucucauguuuaaauuguauuuggaagucaaacuaguauugugcuuggagguauguugaugcuuuuucauaaagccaaugugugaaaaauguuucccgcauguuagaugguaggaauaggggaauguggaaacaaaaggccaaaagauggacuuagaaaguugagauguggcuuuuaaaaugaaaaagucacuuacaugguguggaagaacccuagcauccugucuuuuugccucccuguuugugacagaucucuaucucaccauccucuaagcugggauugccgaacuuuuguguuuauuuguugcucuauccuuuguacauucaaaucagaauggcauagugcuucuaaacaguaauaagacuuaauccuuuccagaguuaauguacacuguugauuuuaggauuuucccuuuccuuccugccagaugucuccauccuuaugaagauaaauauauaggagaaaucacacucugucauccaagagagaguuaaaaauuuaaacucgaauucuagagaguuggugacauguaucagaggaaggccuaugugaagugaccagucaagggugauaaauggguagucagcugugcacagccagcccugugggccgugaguugccauggaagcaccgaauggcauucagcaaucccgcaugacuaaccuaguuuagcagcagggcccaugggcuccagccugggagaaggugcuuacagccagaugauaccagagccaacacacugccccacgucucaugcccaacuugggccuuucuguuacuaucuuuuccucauccacauaugcuauuuccuuuuuuagugugaaggaaagagaaaaaggaaucacucucacuaauccuuacagaguugugauuucuuacauuuuaccacaauauuuuaaacacauccaucccuacccccaagaagcauuugaaaagucaguaaaugugcccugacaggccccagcaugggguugacuaaaugacuguauugaggggcugaacaggcagcucugaauuccucaggauuuucaccaccuuucugaaagugagagcauucuggcacguuuuagcuuuccaaagcuucauucaagcucuugugcugaguuaguggauucggucagugaaacgucuguggcacagucccccuuucauggcuugaguguuuauguucugcaggugaguuuucacaugugacugaucucaccaggcacuggacacugaagccugugguucuccccauuucuaguucacuuaacuaaaauacaaauguggaggagguggcuugaugaauucuguagagaucuuuugauacaucagguugaaccucaaagaugguggacaguaguauaugaucugaaggcaagaacuuggcuacugaaaggagaauuauuucccuauuuaaauagauuuuugcagacuuccaguagaacucauggugucuguggaguggucagacuuugcauccuccuucccaggggcacaucagaggcucugaaacaagaauuguaacacaguuuuuauauuuauuuauuuauuuauuuuugagauggagucucgcucuguagcccagguugaagugcaguggcgcgaucucggcucacugcagccgagaucuagcgauucuccugccucagccucccaaguagcugggauuacaagcacgugccacuacgcccgguuaauuuuuguauuuuuaguagagacaggguuucgccaugugggccaggcuggucucaaaccccugacgaccucaggugauccucccaccucggccucccaaagugcugggauuacagaugugagccacugugaccggcccacaguuuuuauaacugaaagagcagcuucaugccauuggccauccuucucucaaagggguccucuguuaggucguuccucaaggacaggccuguguggaucaguuuaaccaaacaucaauuuuguggcucugagaugacccugcuggcggagaugauacuaaauuguugauguguaccuuuuugagacuaaagaaauaugagugguuauaaguuagcacacuuuagcacaccuucuuugucuucacugcuuuauuuaacgcagccugacagcuuugcuagcagaacuguggcugagaguauaagcuuucuugccaggcauuggugaauguucaggucuaccauuugugagcaagucaauccccucacccuuuuuuuuuuuuuuuaauugagacagacuuugacacuuguugcccaggcuggaguacaguggcgcaaucucggcucacagcaacaaccucugccuuccagguucaaacaguucuccugccucagccuccguaguagcugggauuacaggcgccugccaccacacccagcuaauuuuuuguauuuuuaguagagacauaggguuucacuauguuggccaggcuggucucaaacucccaaccucaggcgauccacccuccucagccccccaaagugcugggauuacaggcgugagccaccaugcccugcuuuuuuuuuuuuuuuuuuuuuugagauggagucuugcuuuguuaccuaggcuggagugcaguggcaugaucucggcucagugcaaccucuaccucccggguucaagugauucuccugccucagccuccugaguagcugggauuacaggugugcgccaccacgcccagcuaauauuuuguauuuuuaguagccacaggguuucaccacguuggccaagcuggucucgaacuccugaccucaagugauccgcccaccuuggccucccaaauugcugagauuacaggcgugagccaccccaccuggccgcaagucaaucucugagcuagcuuucguucaguuggaaaaugggguuaauaaucccacucucacaggguuguugugaaaauuaaauagaaaacugaugugauagugccaaaaucaguguugacuaacauguuaagugaugucauuccuuggccaggcugcugcugcuguuaucauugcuuuuguauuuugguaagccccaaaaaggaugugcugucuuuuaccccuggagaucccuuggaaacuuguucaacauacaagccuuggggcccaugucaggccuacugccuuagaaacucuguaggucucugugaucuguguuuugacaaacccuccagcuaacugacucagguuugagaaccucuuagcuaaugcaaaguaccaucuaaaaucagcuaaggagaacuuguaacucacuauauucuauucggaacagugggaaagaauggccaggcugauguugggauacauuuuuccuuaacacaggacuggaaaaaaaaaaagacaccuuuauuaaagugacaguuaacuuauaguuauugaaaggugauuauugacagcugggcgugguggcucacgccuauaaucucaacacuuuaggagacugagguggguggaucacuugaggucaggaguuugagacccguguggccaacuuggugaaacccugucucuacuaaaaauacaaaaauuagccaggcguggugucgggugcaucuaaugcuaucuacucgggaggcugagacaggagaaucacuugaacccaggaggcagagguugcagugagcugagaucacugcacuccagccugggcgacagagcgagacuccaucuggaaaaaaaaaaaaaaaaaaguugcuacagaguuugugaaucauguaggguauuugccgccuccuaaaauucccucauuaaaaaauuuucccaucugccccuuccuugcuuacaccuugguuuaaacagugauguguauaggcucaacaaagguuuacucaugguaugaauaguggguuuauuuuuaaaauuucauauuccuuuaucucaaaauggaaccaagaaaaagaaaauauucacaaaagauuugccugggagcuuuuaacagaucauucccuaagccauugcaaauuugcagcaagaaaccagaaagcuauuuaaugugacuggcaaaacaauuuaguugcaaggagaaaggaggcaacccagagcaggggcucaaagccuaccucuacucugugaacuuccugccucuucggucuuccucugcccugcccaggagcuuuugugaguuccacccaagagggaguuguuggacaguguggggagagcaagugucuuucacaaagccuggaccucauaaaacucauccuaccagugauauccaugaugucuuuuuucaccucacuacuuauagggcuuuuaguugaagggugauggugaaucauaaaaagaaaauuugucucgaaauagguguagaauuacaugucugccgauaaaaucuuaacguggguuuaaaaaaauuuuuuugacacuaaugaaguaaaaccuuaauuaacuagaauccuuaauuuaauaggauuuccucccugugggagaauucuugauuuuagaaucacauaguaauaaaccaguguuaggaauucugugaaagaauggcuuaauuguguucuucugguuauuucuguggcaauuuucaguauuuuggaaugaaaaucuggaaguaugggagaaacccaacugaugcugaaauaaggcuaauacaaggcugaguugauugauuuaaaaauauuuuaguaauguaacuucguuaaaggaaaauugaguguguggaauugaugagaaaauugaggacucugagcagccuguuaguugagguguaacuguucacacccucccuuuuggauccuggacugagaauugccauuuggaguucccuucucugagacaaagguagcauuuauuuagaaggggcggagcucugcccugugaagcggagccuaaggcugugaacacugacuggcuauaggggcucugcuguuuuaaguggcauaucagagaggggagaacucccuugguggugagaauagccaagcagacaagcacaugcccaugguaagcuuuccccacccgcucacccauaggccugucuugacugcugcaaggugcaugcacuggauaguuugggagaauagaagcuuagaugcucagaggaugguugccugcuuagcuccucccugcaaaaacuggcucaaaguggcuauaaaacaaguuugaaggaaaaagugauuuccuaaucagccugcuuacuuggcuucuaugguuauaugcuaauggcauaugaucuuuugaaccaacaagaggaauuaccaaaaugauaaaauaauugaaggaauugagugucaucaaguccagugugcuacugccaacuggaaguaaguuuaacugaaacaggugagacucagacuucauuacagaagauuacacgaccaguuucugguucagcagcuucuucuuuucaguauuuugacuggcauaaauuauuaacuuugugguuuuaagaguucuuuuaaaaucugauauugcaauauccaucaucuaggaaaaguuuuugauacacacaggucuaagaagauaauuuuuucuuucuuucuuucuuuuuuuuuuugagacggagucucgcgcuguugccccggcuggaguacaguggugcgaucucagcucacugcagccuccgccuccuggguucaagcaguucuccugccucagcccccagaguagcuggcacuacaggcgccugcgaccacagccagcuaauuuuuguauuuuuaguagagauaggguucaccauguuggccaggauggucucgaucucuugaccucgugauccaccugccuuggccucccaaagugcugggauuacaggugugagccacugcgccuggccuaaggagauaauuauuuaccacauuguagugaauucagucaggcagcuaauuucucuccauacauccuacucccauagauuaaaaggcuauagaaauacuagauuacuuuuuagaugauuuuuuaaaauaauuuuugcaugugucuuccagaguuaaaucuuuuuuaaauaguuguaaguuuguaaaaauacguaaguguaguggcuguuuuuuaaucuaaaaguauuuaaugauuagcuucuaugcagaguaccaugcuuuagcaccaagagaggugcuaaauuugcgagguucguuucugauggaguucacaugcuaggggagaagggaggaggagagagaacuaauugauguguuagguaagcacauacuugguggauuugaggaagccuuuagagugagugacauuugaaucauuccagagauuugccagaagcugaaaauuaaggaugggggugugugguggagagagaagcaguggaaauuuguggcuggaaugaaagcaucaaagucuaggauaucacugaggaauggggaguagucaggugugacuggaauguagagguaguuuguaagagagucauacuuccuagggaagcuggcucuggaagaauugguuaucuuucaguaaagagagccugguggaaauuagagcaagaggcugccuuacaggguaugcucaggggauggacgugacugacugacugucaaguagaaugcaugugacaggccugcaaggggacaguagauaauuucuagagaguagaucugcgucagauuaugggggaauuuuaaugccaaagcaagaauuuagaguuuauucugcaguaguaaagagccaucaaaugcuuguuauuuuaaaauauggauugugacaugagaaccagggccuuaaaucagguuucuuuucaugagaaggcugaauuaaagggauaagaugugggggaggcagggagaccaguaggcuuuugucaaaggaaauaagagaagucagaagagggcaaagaggccaggaaaggggguggggaagggcgucugacaucagggcuagaauuuccgaagguacugaccgacagccuuaacuagacaaucaaauauuuuccuguuuguucaaacggcauugggagaaaacauucaguagauucccuaggagcaagucugugaagacagaagucauuuuauaguucuuauuucacuuuuuaaucauacauugcgugugagggcugggaagugacccuuggugcugacaaugaggcagguccacuuuugguuuauguguugguuaaaacugcacuacuuuuggucuccaucucugauuuguuucucggugaaugccguuuaaccccuuuagugccagggcugaugauuuaggauacauuuuuauguguuuuaaguagggcagucagauuauaaagcguucuccgucgguagagcugacaucuauaauuggauuuucucauccuugacguuugaaaugagaaauaaaaaucauuuuuugugggguuuacaugccaagacacucccaguagaguaggcugagaaaguaaaugcuguuuugggugccugguaaucuuuuaauuaugaaauaagccuuuugauuuuaaucuuucaaaauguacgcuacugauccaggaaaacggccuuucuaaaguccacauccugcugacuccugcagaugaaaagcuuccaccucuaccccauauuuugcaagcugaaaauaaaaauaucauuaaucuugucucaguuccacugcugccuauaaaaggcuguucaguuuggaaccaguccugagccaugauggagaccauggcccagagugaaugcuuggguuuugggagccaggaccccaggcuggagggucacagccaagugacugaggccucacccuaaggcuggguuaaggaacuuaggcuuucuuuaaaucacagccgucaucacugcuucuucccagaccuguccucaccucccuucucacauguaaguaugccugacaaaacuuggagacugauaaauuuuauuguuuucauucuuuuguggcaucugaaacaguuuguacaaugacgacagaaaccugcuucgaauuagagagaaggaaagacgcaaccaggaagcccaccaagagaaagaggcauuuccugaaaagauuccccuuuuuggagagcccuacaagguauuuacugaacacuagacauugaaguccugauuuaucacaauguugaacccuaugaugaaacaauucaguauaauugaguucgaacaagggucacagcugugaaaauaagauaacuuauucuaacuuauucuagagauuuuugaaaacaaaguaugaaaauucucugaagguuguuagaauuaccaaaguuugugguuuucuuuuguaaugcuagucuucuacaguuaguaauauguauccaugguagucuucucaacaggggaauugaguuaaaauggcacauuaaauucuacaugucguacauuaaguucggaguuuuuuccuuaauaguauuauauaacgugguuuguuaaaugguaguuuuccuuaguuuuuuuucauucucaaauucuccuuuuuuuucagacagcaaaaggugaugagcugucuagucgaauacagaacauguugggaaacuacgaagaagugaaggaguuccuuaguacuaagucucacacucaucgccuggaugcuucugaaaauagguugggaaagccgaaauauccuuuaauuccugacaaagggagcagcauuccauccagcuccuuccacacuaguguccaccaccaguccauucacacuccugcgucuggaccacuuucuguuggcaacauuagccacaauccaaagauggcgcagccaagaacugaaccaaugccaagucuccaugccaaaagcugcggcccaccggacagccagcaccugacccaggaucgccuuggucaggagggguucggcucuagucaucacaagaaaggugaccgaagagcugacggagaccacugugcuucggugacagauucggcuccagagagggagcuuucucccuuaaucucuuugccuuccccaguucccccuuugucaccuauacauuccaaccagcaaacucuuccccggacgcaaggaagcagcaagguucauggcagcagcaauaacaguaaaggcuauugcccagccaaaucucccaaggaccuagcagugaaaguccaugauaaagagaccccucaagacaguuugguggccccugcccagccgccuucucagacauuuccaccucccucccuccccucaaaaaguguugcaaugcagcagaagcccacggcuuauguccggcccauggauggucaagaucaggccccuagugaauccccugaacugaaaccacugccggaggacuaucgacagcagaccuuugaaaaaacagacuugaaagugccugccaaagccaagcucaccaaacugaagaugccuucucagucaguugagguguguggaauuucuuaucuuggggaauuccaauucgaagacggauuugagaugaaaauguccggaggauguggggcaagguggggagguuaguccauggcuuuuggguagggggaauucuuuuuggcuuuaggaucuuguuaauaacccgcgaaaaacucagaucugagauggacgacugauuauagauauugaaaugcaguuugcagaaagguuuagagaaccuuuuuauggagccaaaauuuauauacaguaaaacauagagaucauaagaguacaguuuguguuucaaaaaauagauacaccuauaggauccaaaacccaaucaagagagagaagauuucgguuaccagaaaguuucaggaagguuuucaggugucuuauuuauuguuuugggagacacugggguaacaaugugaacacgaaaaaauuuuuuuugauuaauaccuccucagacccaguuaauuuuuccugggcucuaaaccguaaaaaaguaaaaacaagaugacagagucucuuaauuuuuauuauuuuagaaggacuuguucccuguaaauuguaaggaacuuuauaacuaaaguucuguucuaauauuuuauuauuuaucaccuaaaaaagaagaguggguauacggugacauuucacuugagagugagucacaaauauaauacagaauguuauucaauuauggguuuuaaaaguaacccaaaugcuguacuuuuuaaaaccaagaaaaaaaauauuucuuuuucuacugcauggauaaacagcagcauuguguuugaaugaggagaauuagagcauacauucugucacugaaauuuuaaagugguaccaauuucuccaaaauuaagauuaguagugugaagugaaauguuugaagggaauuuuaaaacuuaucuuuuaauguaaagucuaugguuuaguuacaucuauuguauaaacauucuaauuugcaucuccauugcucaaagacauuuaugccauccagauauguuuuacauaaugccagaaggugaaauuccucaggugggggcgugauuccuaccuggaaagauaaccuuuaucuuccaggaggacaacuuguaacuuucuggugucagcuucugguuuagaagagggagguuggggugccguccucacugagcucuugagcugaguacuuccagaugucuucugaauaccacuuguuuggggaccaaggaaaaauaagaaagaaggaguaaaaccaauggcagaaaugaccaagauggcagaacugcaucucugauccuaacuuaagaagauuuaaugcacugagccauuuauugaacauuuugugcugugauggagguagggguaggcagcugaaugaaggcaaaauaaagugagauccucccuccucaaaacagucacucccccugccuucuaauucaggcaauaaagaacucaaugagaguuucuuucuuucuuuaucaaauaggguuagcuguauguucccaguuuaaaaaaaaaaaaaaaaggggggggggggacaacuuaacauucuuucuaaaaauaacaaaccuaaaaaauugcuuuaaaacaauuuuuagacaaauuagcaaauauuugcauugucuaccaaaugcccaaccauaugcuuaagugcaagauucugugccagagaaaucgguccuugcugcaggacagauuagucuaguauagagaucagccuacacuuaugaaacaauuagagaacaauugaguuuucucucucuggaacgaggugcuuauaaaccuguguaauucagcccuagguuuccuaguagauguuucugggagaggauuccuguuaacuuacuguuuucuuggguggaaauaaguaggcugaguugagauucuucagugucuuaaaaccccuuauauuuaauauguauuuugaacauaggacuauguuaauuggcucuugcauguuuucugaggaacaaaauccuccauacauuuggucauugaagaaugggguuuuuuuuuuggcaccagugcaucugcugucaacaauggaguagaaguaaaccuuucaucugcagccucuguucacagucagcauuuccuuuaaugcggugguucccucuggucucggcccgaguucucaugccaggcagcggcagcugugguaccaacugccugggagccccguggcgcuguuggugagugggaggauggaacugagggggucagacagauggagggcucucggugaccccuuugagggcaaauuaggagccaagagcauggaaugaaggagucgucaauccgggaaguggggaucuuggugcucccuggucagguuuuggauuugauuuugcucuuuuaaugaagaucucauguugcacagacuuagcauuaauuuucuguuuauacacuuagcaaaauggguauuuuugaaaguuuuaaaaauauacuugaauuuuauauuucaaauuuuaauauuucuugugaauccaaggauuauuauucuggugaacccaaggaaaguguagagauguaggaccaaaaauguggaaauuagccccagagcagguaaacuuugaauauaggugagaauauuaccaauagccuggguuauuuuuggguuuggggcagaaggggaagcugucucuugguagagcugggagaagggggugugggaguagcugagugauuuuccuuuauuugcuuaauugguccuaaggcaagucagaggaaauuuucucuuuccuagugcucugagugugaggggauaguuggguuuugugguuuguuucauuucuccccuaccccuuuccacugcuucugugaaauagugauuuuacaaaugaacccaaauuggaaagucacucuuuuuauuuuuugguuuuuauguuccuucauucucuagccaccuaaguguggauucuuuacucccuguccuuuccuuucaccucaugggaaauacuugguuuuauguucuaguugguacuauaaaaacucauagucuucucugggauaagucuuucucagaauuaaaguuuaauucuuccaaagauccuaagggaaaaaauuaucaaaaggucgguuuccgacuagaggccuggaccacaaaaaucugcacuugguuuuucuccgggagugucuguuuuaguuuuacgucaacuggaagaugucuagcagugugaagugaccaaucugaggccaggcccagaacuccgcgaucucacguggaucccguccagcugcagaguugccacaucagagguggaccugcccaauuggaagauugagauuucuuuauaucguucuuuucugucuagagauaacaagugaaagagagagaagccguggcaucucugugagugcucaugcacauggaccccgaggcugggggcauugagauggaacguggagguggggaggugugccuagacacagguuucagauaaaggauuuaugugcuagauaggcuuuuuauugaaaaggagaaguggaauaagcagagauggguauaccaaaucauauacugaauuuagaauguuugaauuuuaaagcuaaagacagcucuuucauuuugcaaauaaggucuuaaaggguaaaguccuucauuuugcaaaaaguuguaguuaauaucagagccagagcuagaacacccaguucuuuugacuugcuguuugguggcagcauugguggcaguggugagauguuuguguuuuugaccagaagaguuguaauuugucacccagaccgaaccuacagcagagccauggaggauacagugaguuucauuuccuguguguuucuuggccucacuuuuaucuuucaucauuccucuuuuucuuuccuuuuucuuuuuuuuuuuuuuaacguacucauucaacaaacugguauuuuguuuguuuuguuuuguuuuuugagacagagucuugcucugucgccaggcuggagugcaauggcgcaaucuuggcucacugcaaccuccaccucccggguucaagcgauccuccugccucagccuuccauguaguuggaacuacaggcaugugccaccaugcccggcuaauuuuuuguguauauauuuuuuuauucgagacgagguuucaccauguuggccaggauggucucaaucucuugacuucaugauccgcccaccucagccucccaaagugcugggauuacaggugugagccacugugcccagcccaacaaacugauauuaacccuccacuguguuccaugcacuguaguagguucuugaugauacagcugagaucaagguagacagaucccuggucucauagaccaucuauucuaauggggggcauugauaauauaguuauaaugaaaucauaggcguugauaagagugccgcaagaaguaaagagggugaugaggaugagaugaaucagaggaggcugacuuaaaaaugguggucagcacaggacccucugaggaggcaccuuucacagagacaccucacauggaggaugaacaugcgucagucaugcagagcucagagacguauuucauuucaggcagaggaaacaaguguaaaggccugaauuuaggaaaaggcauggccuuguuaaucccagcacauugggaggccgaggugggaggaucacuccuggggagcccaggaguucaagaccagccugggcaacauagugagauguuuuaucaaaaaauuaaaaaguuuucccagcuauugggaaaaaauuaaaaguaguuccagcuacucaggaggcugagauaggaggaucacuugagccugagaggcugagguuguagggaguugagauacugccacugaacuccagccugagcgacagugagacccugucucaaccgcucccuccuccccccacaccaccacccaaaauaaacagaaaugaggggaguauggcuagaacacugagagugaggggaggaugugagauggaacuggcgacauaggcaggaguaagaccauggaggcuuuguuggccgugaaaggcauuuggguauuauuugugauugaaaccauuggauaauuuugagcaggggagggacauaucuacuuuuuuuuuuucuuuuuaaaaaacuguaacucuggcuucugggugggaaauggaugagaggggcaaagguggaagcagggagaccaguugggagauaggaaaugauaguggcuugggguaguagccauguauguggauaguagccauguacgugguaugaaguggacaaguucuggaucuguuuggcagggaacugauagggcucugugauugacaggagauaggaguggccugaggugaggggaggcgaggcaucaaacaaggcugguagacuuuuuauuugaaaggcaaggauggugggaugauacuagcuaccgagagggaaaugaccuggaaaacuaagaacucuaguugggucauguauuaagaucauguguucgguuugagaugcuguaauguauccagguagagaugacaaguggcagucauaaacaggagucuaacucugggaaaaugucagaacugaaaauaauuugggauuuguguuuauuuaguagguauuuaaaaccuugggaccgagcauguguaccuaagaauccuuauauggucuuaauuccuccuccagaucagucuggcuuugaguccugauugugacugauuucugcaaagcaauugcucuuuuccuuguggccucuugucacaucauguuaggaacguuuuguugccagaugcuugcauuuaauuuccaagacccaaguguacauucauuguuggaccacuuugauucauugcagcucuuaaauugagccuccuauuuucaauaaacuaccagccuaacaacugcaugaauuaacccacaguggaaaacugugugauagugauucacuuugcauucacauauacaaacauucuuuccuacuuccauauuuaauuuaaaccucaagaagagggacuucccuauuaugagaugaucuaaaccuucaggcgguuuacuucuggauaugccgauggugcacauccugcuccugcaccacucaaaacacauuuaagcagcuuacucucacaaacacaucauguauucagcaauuuuaaccaaaauaucuugaaccccuguugugugccaggccuggugcuggggaugagagguuaaaauggugggcaaaaccagaugguuccaguccucuuggaucuuaacuguccuauuagaaacugacauuagucaaguaaucacucagauccauguauaagaagcuuugacaagugcuauaagggaaacuacaagcuauucuaagagcuauaagaggggauugugacuuagaacuaaggagcugaggaaggcuucucugaggaaguacuauuugaaugagagcugaaggugaguaggaguggcccaagugagggguguuggggcuuaagcagugucaguauuccaggaagaaggaauagcaugugccacuggcuuaugccacaccaugugcagagaccauuagagaauucuucccaggauauaagcccaguaccauagaucaaagggaauuuuucauuuauucugaaacuuggcagcacaucagaaucaccugggaagccugauaaaaauacaaauuguuaaaaauaaaaauucccaggcccuccccuaggggggcugaguuuguucuguagccuggaaaugacaacuguuccggaaaagcuuaugggccacagggagcuacaggggccccucccaguggcucaagaagccccccgacaugugggucucgggcacaaggaucacacugaacugauggauggggcuuucauuccugaguaggacgucagaguagccuugggagaagcacaggagugggauccccaagacucuccuccucuuuuccuccguagcucauguuuuucauuguucugcccccaacauaagguagaagauuaugacacaaucuuaucuagcuuuucagguuccguuuucuaaaaauguuuuauuaugguaacucuagauuccguaagcucgaccucagugagccugggcagaccuacaugaccuaaauguguuaggaaauugauagcagaguaaaguuaucugugugcagaauucccugcugccauggguggugccuggagcagacgacuuccaaaccgcuuguaagaaagcaugaagaauaagucaccugcacuucagaggccaaauuuuaaaccugaaaagaucuaaauauagaaguuuuaaaauagugacaggcagguuuuuuagagcagaagcuguaaaccagcagccugagggcuagguugggccugcagacaaauuauuuuguuuggccuguagggcuuguuuucuuucuuucucccuaccgccccccacacuuuuagccaguauuuacaaacuggagaauuuaggaaaaaaaucauuauuggcugaguagaggcaauuucuggaaccuggcaaucuuuagaguuucucucucucacccgggcuggaaugcaguagcacgaucacagcucacuucagccuugaacuccuggguccaagcagugcccacuuuuccauccugaguagcuaggacugcaggcacauggcagcaugcuuggcugauuuauuuuuauuuuuuguagagacaaggucuugggguguugcccaggcugaaccuggcaaucuuaugaagaaacacuuuaaacucugaaggaaacuuuuuaaguaauauagacacaauauuuuugaaaagcucuuaaauugcuaaaaauuaaugcaaagaauagaauugcuuauaguagcccaagaggaaagcauaaaauugaaacuggaagaacuuuuugggugguauuaauuggaguuguuuuuacuuugugcauuucacuuucuauuccuucucggaaaugccagaaguacauuugguaccaggaugagaaauuccuguuccuccuuguuuucacacuugagauguuuguggaugguuauuggaucccccugagucucuccaguugugccuuugccaagauauagacauucaacucuuuugaaucuucccagacugcaugugcucucccaggcucucacauagccacccgggucauuuuagcucuucucuagauuaacuguguuuuauuuugagccaacugauaaucuucagggacagaaacccagauauuccaaggggaaucuuguugaugacugaguuagugguuugauuuuggcuguuuuggugggggugaccaacacucaugagauauuuaaacaguuccuccuaagagaggauccugguucauguuaacauaauaauuuauuuuuuggucuuguauuucuucucuccaguugccaacagcaauuugacauuauuuuccaagguuaacuuugcauguucacauuucccaagaacucuauaagcagcuauuuuuacauugauuuuguuccuuucuuuaauuguugaaauaacucuauugaugguuuuucccacagaggucuaggguccacacaaacuauuaguuuucucuugaacuucauuucauucccuauuuaaauuuggccuacuuucucucugcauuuuuuuuuuccuaaccccgugguaauuugucaagcccauucuaaucuucuuaaucccuuuggcugaaggguuuugagguuuaauguuuuaaucuagaggccucaguauuuaaguaauuagagguccuauuucuagcucuguccuuuagauaaaucaccuuagguuuuuuauuccaauuuacaaauaauagaacucugaaaacucauauuggacaggaauguggagcuuugaauugaagugcaugaauuaagaaaggaaggcauucuauguuauguauauuucuucgagguauucuuaacaaccccacacuauauuauagauucccuuuuuccuuagagcucaauuuuuaaaauaccccgaagcaaguauuugcuguugcauuuuagaaaaauuuaaaauagaauucuaugguauaauuagaauguauguuacuuccaacauuuuuucaugcucgagaacaugggaacuugugaaaaaauuuuuuccuauuaaauaaucugaacauucuuacaaaauguuuuuuaaaaauaacuuuguuucuuugucauagaaggauucauauuuuuacauucugucaacaaauauuugaacacccauuagauauaaagggagcuaauaggaaagaaagacacaggcacaguaaauuuauuaugacauagcauaaaaauccaaaguguaaucaguaugagcaagguaauacggaacucuucauaauacauugcuggcauaguccccuuguucacuuuaugaugaaaacuauucuaaaugcuuuauaggugcuaacucauuucauauucacgaugaucccaugugguaggguacuguuaccauccuguuuuacugagagauuuagagguacagagagauugguuguccaagcuucuggaggcuuuugccaguggaucugaaauccagacucaaguagucugguuccagaguccacagucuuaaccacaacaccuacauuauauugccuuucaaaauuagaagcuguacauuuuuuuuuuaagaguugacuuuugaagcacuuugcacucuggugaaagguacauccaggcuaaaggcuuaggaagagaaaagacauagaagcaagacacggagggaaaucuagugggaguggcagggccuguggcuccaggagguugggcaugggcagaggagagcaguggggagaugggccugguggcaagauagggccagcuuuugaaauucuuuaguuauuuauugaguaauuuagauaaaaacaagaaucauuaauaaaaggcggagaauuauuuuggcuucauggcaggugguacagcuugggcuuauaauucuguaagacuuugggcaaggaaccuaaccuuccuguguuaccaguuuauucgucuguaaguaaagugggucuaauauacugagguaaucuuugaauuacuuaagacagugccuugugcauaguaugaguuccauacuccuacuauggaacucuugguagugguagaagugaaauuugaacugggccuuaagaaaaagaauuuggacagaggguuaucaaaauggggaauuagugauguuggggaguuaggaagacugaucguauuguuuauugaaauguacuuuagaaaugaaguuggaauuagaucaaguggaccauuaauucccaguuaagaguucuaagugaauaaagccccuaagacuugauuuuaaaguauuaaaaauaaguaaacaaaugaaaagccuagugaaagaaaguauuuccuuagggguuaucaagcuuuuaagaauggguuugccaugguguuaaacccccaccgcugucuucaacauccccccgcccaccauccccaccccugccugauggcuuaguugcucugugagcucacuccugaacagcagcauucccguggcuuggcaaucucugguguaaacaguucacuuuauaaaaauguacgcacucuaaaaucuuguagugcccuuuccccuuuaauuuccaaagcacuuauuuguuucucucuugauuaucacaguaaccuugugaguuaaguauggcaguuggcaggagucaccauuuuacaugccguggaacugagucucuaaauuuaauuuaagcuaguaaauggcagagauggagacaugaaaccuggacccuggcuccuaguuccagcgcuccaucugccacaaaacaugguuucuguggaguaaugauggcuuauguacacuuuuauuuaaagugugcuguuuuuccacauggccuugcuuucauguuggcaucugaugagucaugcaaauauaggguggcacgggugauucaaaugacaggaugaguaaaacucaguuuuggucuucguggccauguggcuugcacugagaccuuuaacuuugcuuccuaccuuucagagaaggaagcaccagguaugaauucucucaguucuuucuaccuacagugccacccccgcccccaaaucauagcagccaccauuugucucuuucuguuuaaucucacagaaggagguguucucaacucccccacucucaaccuuugguuagcuuaaaccuuucccuuauuacucagcucuuucaugauagucuauaguuacauuuaggccuuucccaacugaaagagcaaaacaaacccuucuucacucuugugucuucucuaauuacuacuuucuuguucccuccacagcaaaagcucuggagacagaaguagguaaacacuguuccugcuuccucuccuccccuccccucuacuugcaacccauugcagccugcucugugccuucacgccacugccucugccggcaggagccacuaguggacuguauuggaugaauucgaggaaugcucuuuaaggccuuauccuacuugacaucucuguagcauuugacacuugaccaccaucaccuuaaacacucuccuccccuguugucuggguuuucuucuaccuuuuuguacgugccuuaaucuccuuuggaggcugcuguucccacuccuccuccagggcucuguccucaaccaucuuuucucauucugcagccuuucccuggugaccucauuugcacuuaagauucaacugccguugcucacgaacaccagagugauuuucuagccuaaaacucuuaaaacguauuuugagaucuagguucuguuauccaccugcccacuggacuuuucuaguagguguugcacaggcaucuuaauugaaccugucuaaaauggauuuuuuugugccccccucucccuguaucacuucacacacagaauguucuccuuccuccuggucaucaguucucaauuccuuucugucauauacuccauuguuuugaaagcagcuugauccuauggagauuacuuuauaaacauucauagcuucuccuuuucucugucccucauuuaguauggauuuuuaccgucuuucuugaacuguuacaacuucuuucuaaccucucaucuugcuguuuuccugcuucucaguaugccacauuauuucacaugagugauuugauuaagugaaaaucagaucaagucguacuuuuucaagauccuucaguaccucuccaucaccuucaggacagaaagccagauguguccauuugucuucuugccucuuaccugucucugcagccuugaguucuggcccugcugcugguacugccuuguuccacugcagcccccagacccuuauagaugacuuucugcugugcaccccgcugcccaggcccgaguuucagcacuucucccuugguaucauccugcugcuuuuucuccaggugguaaacauuuugagggcagaagucaauugugucucauaugcuuguuuguccuuuguguuuagcacaggugagaacuggagccaaaugggaacuuugcuacgcugugcucagcuugaggauuucuuacccagcucacucuggucuggagucugaaagauaaucucuuaaaugcuuggcuuaacagaggggugaaguacuggacugaauuuccuauucaggacacuugacugggaaaugggugcaguguucaauaauguuuuugagaaaucauuucaccauuuucuaccuaaguauuaaguaauuuuuggcauuccuacauuaaaaauaaacagccuaauccauucauuaggaauuuuuaguugaguuccagccucauaauuacuguacuuuucagaauugagccuggagauuaaucagauuguuuuaugugcuauaaaaguuggaaguuuuaugcaucugucucauauauaggugcuuucuuuuguauuaaauaagacacuggauuuccuuuagcauguguguguguauauauacuucuuaaaaguaaugcauauaauaaaacugcuguuaaucuagaaaaggauuugcaauuuuaaauauuuugcuauugaaggaaucacuuuuuugggaaugagucauccaaauggguagggcauacacucuucuagaccacaacgguaucauuaacugguauccuaguaacuuaagaauuauugggccaggcacgguggcugacgccuguaaucccagcauuuugggaggcugaggcggguggaucaccugaggucaggaguucgagaccagccuaaccaacaaggugaaaccccaucucuacuaaaaauacaaaaauuagccagguaugguggcaggcgccuguacucccggcuucuggggaggcugagacaggagaauugcuugaaccugggaggcggagguugcagugagccgagaucacgccacugcacuccagccuggcgagagugagacucugucucaaaaaaaaaaaaaaaaaaaaaaaaaaaaaaaacacaaaaaaacaacaacaaaaaaacggaauuauugacccugaaauugccugacuggcaaccugggcuuaauuuucuaguagauuaauggucuugcacuaaaggauaaaaccgguaccgaggucuuuuaucucccuuauauucgcucaggauucuagugaacuaguugcuaagacaagggaaaacacuggucuguuguucugaaccuaauugagucuuuuauuauguuaugacucaccuguaguucagauuuauuucauucaagucauguaaaauaacuacacugugguuuguuuugcuuacuugguucguguuucuagugaucugucaggcugaguaugcccauccgcuaaaguaugcccauggcuuuggcaggagcuugugcagcagagaggagaccacagcaguaaagggaagaggcugccucauuccauggccccuccaggcugaggaccuauucagaaucucuguauggaaacugaagauauccauaguaccuuaaacugggccauguuuagcacaacaggagauucuucucuuaaaaaugaaugcaucucucaaucucuuacucccuuguucucccacuugugagagaaggaagcauuaaaaccaacacuggggcguggcugcccacagagcgucagagacuguuauauuaauuuaguugccaacaucuaaaaauuaguaccuucacauugaaaucuggauuuuauuuuuuguguuaaaaaugggaagaauuggcaacauacagucuuacagcgcaauccuguuaggcagggugcaugugcugucuugucccagaccuaacuaggcccuugauaucaccugcuugaucccuguaacuguuaauguucucuccgucaauucaagcauuucuuuaucuguaugauuauuccucacuuugagcagacccaagacaugagaauccagacaugcaaaagaccuaucuuuucaguaagguaaugucaucaugaaauguccuuaaaaaaaugugauugauuucucaaacuuuugaaaggaauuagguaaaguagaauaaacuuugcuuuuuuugacccucuauccaaacauagagauguuuuccuacaagucuuuaaauguaugauucaggcauucauucauucauucauacggaaaacaaaauacuaacaagguuagucuaauuaacuuuuuucuuuuuagacggcuguucccaaaacuguggaacauggauucuuauccuccuuguuuuaguuuuccuguaugagugaugagaaaauggauaauuaucuuagucuagugaugcugccauaacaaaagaccuuagacuggguaauuuauaaacaauagacauuuauuucucgcaguuuuagagauugggacguccaagaucaaggugcuaacagauugagugucugauaaggacuugcuuucugccuccaagaugguguaucuugcuacguccucauguggcagaagagauggaagagacuugcucccucaaaccccuuuauacaggcacugaucccauccaugagggcagcgagcccucaugaccuaagcaccucccgguagcccugccucuuaauauuaucaccuugggauuuaaguccaacauaggaacuuuggagagacacauucagaccacagcaggaguuaucgaugcuuuuuucagcuguaaaauauauguuuuuuuuccaaaagaguuugaauuauagcacuuaaaugguggugcuguuuacaauaccaaguccaauagcauauccuuuaauaccuuuuauuuuaaauuacuuauuuuuauagccaguaauaggaagccuguuuuaaacauucaucagcauacaaaaguuuguuucuuucuuuugauuuuagcaauauuaaucacuuaguuagauagaaaacucauguguucuguaggguacagguggguacuuauuuauaacuaguggugaauaaguauauaauacagcauguuauucauuggaugguaaagacuggauguuguuggaaggaaggaagauauauuuuaagguuuuguuuuuggaaauaauuagaugaggcuuuuaggcauuauauauagguagugguuaaaagcauggauuugggauuaaggaagacuuggguuugaaucuuguuuuuaccuucucgaggccguuauaagacaagaaaacuacuuaaccuguucaagucucaauuucuuuucuguaaaauagcaaugguagacaguucuuuguaaggagauagguuuaaguaagaaaauguauguuaaaccuuuauaucgaugucuggcauauaguaaguauguaauagcugcuguaucuacaucauaauuauagcaguuauuuuaacguugucuaaauguauaagcauaguagauucaccucuuuuuuuuuuuuuuuuuuuuuuuuuuuugagacagaguuuugcucuuguugcccaggcuggagugcaauggcaugaucuuggcucacugcaaccuccaccucccagguucaagcgauucuccugccucagccuucccaaguagcugggauaauaagcaugcaccaccaauccuggcuaauuuuguauuuuuagcaggaugggguuucuccgugugggugaggcuguucucgaacucccagccucaggugauccgcccaccucggccucccaaagugcugggauugcaggcgugagccaccgcgcccggccagauccaccucuuuaccuuggcuuagaaucugaaauuguggaaguuuuaauaguuuugaauauuauggcuuuaagaaaauaugagugggaaauaauguuucuaauggacagagcuauggaguuagaaugcauggguucauucuacuucacauuuaaaugggacaguauuuccugagcuagagggcuguugugagaauuaaaugggauauguuugccugacauuuaguauauugugagauauaccaccuuuccuugacauauuguguuaguaaaagaaaauuuaugcuguaggaaaauuguauauuauccaucuucaaguagucuguauagauguuacagcugugccuagaagucagcagaaucccaagaaauaucuuuguguuuuagguugguuugcugguguuucacaguuguugugaugaaguaaugaaacucugugucauggauuuaauuuuagucaaguuuuuaaauguuacacuuuuucaauaagagacuugaauagauauuuuaugcccuaauaaaguacugaauacuugcuguaguuucaggauuccagaauugcauuaguugugagaaguauauggggcaagggcuaguguguaaagggcuuuuugagccccgucacauuugagcauugugacaaauagaaaaaauuauaguacugaacugaacacugauguauaaaguguuaauucugugaccugggucacaaauuuaguaaggaaagguguaagauuaaacauauuuucauggaaucucugaagguuccugaauccaauauagaagauaggcaacauuuguauugacugauagaguaagaugguuuuacaggguaggaagcuggaaugucccaagauauucauucaguuuuugguucacauaguauugaugaguauauaaacuucuuuaaaauaguauggaggccaggcacaguggcucacgccuguaaucccaacacuuugggaagccgaggcaggaggauuccucgagcccaggaguuugagaccaaccuggacaacauggugagacugucucuacaaaacauuuuaaaaauuagcggcugggcacgguggcucaugucuauaaucucagcacuuugggaggcugagguggguggaucaucugaggucaggaauucgagaccagccugggcaacagggugaaacccugucucuacuaaaaaugcaaaaauuagccaggcaugguggugggugccuguaauccucaggaggcugaggaaggagaauugcuugaacccaggaagcggagguugcaguaaagucgagaucgcgucauugcacuccagccugggcaacaagagugaaauuccgucucaaaagaaaaaaaaaaaaaagccggguguuguggcaugcaccugcggucccagcugcucaggaggcugagguaggaggaucacuugagcacaggaaguguaggcugcagugagcuguguucgugccacugcacuccagccuggcugacagacucugucacaagaaaaaauaauauaguguggggacaccaaccuuuauuuuaugugucuuaauguggugcauuagucugcuuucacacugcugauaaagacauaccugagacugggcaauuuacaaaggaaagagguuuaguggagaacucacaguuccacauggaagccucacagucaugcggaaggcaaggaggagcaggucacgucuacgugaguggcggcaaagagagagguugugcagggaaacuccuguuuuuaaaaccaucagaucucaugagacucacuguuacaagaacagcacgggaaagaccugcccccaugaucgaauuaccucccaccagcucccucccacaacacaugggaauucaagaugagauuuggguggggacacagccaaaucaugucaugugaauuaggaagaaauauaaaccagcauaucaaacaaaccuaggguuucacaaauauugcuuaggaugaggugagguuaaaaaaaaaaaaagugaguugaucauaaacugaucuaaaaaaauaguacaaguaguauuaugacgcagugccgcuaucaaaguaguauagaaaugaccgaaguuugggaaaaacuguuuuggacuguccucauaucauggaggaaagacugguuaaagauggggcagugucagaagaaaaauaaguuuuaggccggagguaauuuuaaacauuuucuugccuuaccagcggauggcuuccuugugcuuaaagaacuuaaacaguugagaauuaaauuuugcccauuauuuuuccccccccuuucucugugcaaccucucugccccuuaauaaauguuuuugguacugacuacugcugcuccugcuaauaccauccuguagaaauuuuucuugagugaggaauaguuuuuagaaggcuuuuaugaugauaacuuuuaaauuuauuuuuaacuaugccagcagguuauuagauauauagguucaaaggagauugaggcuggagucuguucaaacauuuucagaggugaagaugacacaggguucauggagauuuccuucaugguaccagaacagggcaggguuucacugcaugauaauacccauguuuccauugcuuguagaccuaaucauuuuuacuuauugauuggcacugugggccaagaucgugacauccauccuaauaagcaggucucaucaaaagccuuagaauggagaaaauuuuaauaaugcuuuauuaguugguuaaguaagcccugauguuuggcuuucuagugaccggucauugcccugcagacucuguaaugggacaguuuggcuggguguagggggucaugccaggcugaggugggaggauuacuguaggccaggaguuuugagacuagccuaggcaacauagaccgccccccaucccuauaaauauuuaacaauuagcugagcauaauggugugugugcuuguagucuuagcugcugaggaggcugaggugagaggaucacuucagcucaagagcuugagguuacagugagcuauaugauugcaccagugaacuccagccugggcaacacagugagacccugucucaaaacaaaaacaaaaacaaaaacagguagggagagacaaggagaaggguaguacugacauggccugucuuuacuuuccccucucagcccuggaacucuccacagggaaagguuuuuuguuccuucuucuugucuaauaaauggcuugacuugagggguaucuuggaggcauucucaacccaacccugaagguuuaucagcacuuuccugguggacagcaccucagccucugcccuggcuccuuucauccucauccccuagagccaggaucccagcauuuacaaauuaagauguuucucccacauuaauuaauucagaauuuauuagaaacauacugcagacacaaaggucaaguacacgacggcuucuucagagcugaagagucugcagcuguuuacgauuauaucagaggaggagauguaaucaaagauuguacuauacaauuauuaaaaguuacagaauuuguuacuguuuaucauucccuuuccccuuucagaggacauuuucacagagauucaugaaauaaaaguuugguuaaugacagaagugggaaaccuuaguaggauggaagaaaagaaagaaagacugaggcuuuugugccaugguaagaugguaaaacaauaaaaauaacaucugcauuuuauugagaacauacucuguguguacaggcacuguguuuaagccguuuccaugcaacaagcuuaauaguuggagaaucuugcucauaagcaccuacccugcacagccagaaccacuauggauaacuucuacaaacaucuccugagauuuuugagaauuccuguuugcaaagucugcugaaguuguucccauaaacugcaauaaaguguaacuucacgagaauuacuguauguaucccuugaguggugagugauggacuacagugagaaguggauucuaggguguuggauucacauuuguggcuaaccaagauuacaaauucaugcauguucuggaauuucaggggcauugcuaaaugcacagagucaggggccugcuggauguguuuuuaguggcaauaaguauuacccagucuuuucugcugcuguaagcuuucagauagagacuugagagcaaaaaggucagcuuacccuuuguaguuggaacucaguuccuguagaauuucuuuggaaacauguguuucuaauaugucagaauugguuuagcuuaagcuaaaaagaaaauuauagccugauuuguuuaaaggaacaaaaaugucuacaugccacaguuuggaugcacagagcaugguucaaugcucaguagacuuuuaugcuuuuuauuacucggauuuuuauuucucuaucagugugcuagauaaaaaguaaaguuuuauggguaguauucuaguucuacauagaaguuuuauuucucauauaguuuuuucuuauauguaaaauuacauguuaugagcuacuuuaauauuaacaaguaaccucaguaaaauacuaaagugacuguuaugggauaaauaacgaaacuuaggaaacuuaggaucauuuguuuugaaauacauaauacuggaauuacugaauuuuucccucuagaguuuuaaaauucccauugccaguggaguggggguggggaugugugcacguguguauuguuauuuuuguuccugagauugggcuauaauguaagcaugaaaauugccccccccccacuccaugaauaaauugccuuuauaucuuaucuuacuaaugauaugcauuuacacauaaugccuugugauagaauuaauucuaaaggaaauuguuaacuagaugagauuuuucagacacugccuauuaggcagguuuuaauaggaacucccacugguggcuuaacuauuuugcuugugugcuaucaucuacuuuaaaucccauagauuuuuccaucagccuugaaaacaaagguuaaacuauuuuugggucuucacauccugguuuugcagggagacgggagguauggaggcauugcccauuucauaaagcuguauguuuuugaacuacgcacauggugcuuugcacgaaucaaaacugccaaagggacagauguugccaauuucaaauguacagggggaaggcaaauauugcuaagcaacgguguacuugagagagcauuuuuaggagcagagccaggggaguuaugccugggagcacucacugcuucuuauggcucaguacaagggaagagauucaaaguucuuuccuguaagggccgccauugcagccgccagcacacgagacagugaccuaguggcaccgauuagggcuggcaaggggaugugugaaaacaggaaagcuuuuuugccaugugggaaggcaguaagacauguucacagaggugagugccccacaguguacagcugccccacaguaaguaugcagcagcuggagguucagguggggaggauggaggguagggaaauaagugagaggugaggccacaagagaaaguugaugugucuuguuucucuucccccuucucuucuuuucuuuugccccccuguguuaggggcuaacauggaagaagagaaggaucaaaaugaccucugugguuuagugcaugaccuuauaaacaagguaaauaagcuugccagccauagguauucgucccuucccauguccccucccucuguauaaacuugauagguaauagacagguggcgugguguguguggccucuuuuuuuuuuuuuuuuuuuuuuggcuaccacuagaggcuuggaauaccucuugagauuugcaugguuguuaguuuagauuauggauucauucucucccucccucuccuucuguccccaucuccucucuuuucugucucucccucccucccucuccccuucucccucucucucccuauccucuuccucccucccucucgucucucuuccuugcuuucucuuuccucucuccaucuuuucucuccucuccccuccucuuucucuccccuccucuuucucuccccuuucccucuccucucucuccucucucccucuccuaucaucucucccuccuuucccuucccuuuccccccacuuccucccuuccuuuuuucucuucuccuuccccuccuuucuuucauuuuacugaaauaauggugagagugacaguagagaaaauauaacuuggaguuuuguaucuggagaaaaucacagcauauucuuggcaauauauuugaaagaaauucaaaacauaaguauuaaauaagguauuccuuaucacucaggauuuuuuuuuuuuuuuuuuuugagacggagucucacucuguugcccaggcuggaguauagugugggaucucagcucacugcaaccuuuucccccaacccuguucaagcaauucuccugccucagccuccugaguagcugggauuacaggcgugugccacaacgccugacuaauuuuuuguuguugguuuuguuuuuauuuuuguuuugagauggagucucgcuuagucaccaggcuggagugcaguggcaggaucucagcucacugcaaccccugccucccggguucaagugauuguccugcgucagccuccugaguagcugggauuacaggccugcgccaccacaccacgcuaauuuuuguauuuuuaguagaaacgggguuucaccauguuggcgaggcuagucucaaucuccugaccuugugauccaccugucucggccucccgaagugcugggaguagaggcgugagccacugcacccagaccuaauuuuuguauuuuuaguagagacuggguuucaccauguugaccaggcuggucucgaacuccugaccuugugauccaccugccucggccucccaaaaugcugggauuacaggcgugagccaccaugcucagccuuuucuucaucuuucaaacucuggacuugaauuucuggaucacuuagcaaauguuuauggcuuuuaaaaaucuuccugaaguaaagcuaaaaacugaaaauauuggcagcuucucagccuaaauaugauguaugugugcguaugcauuuaugcaugugcaugcacacuccauccaagauguuauuuguuguuucucauaagaaacuuacaauuuaagucaaauuuaaaagauggugggugcuucuacccaaguuuuaacauauaaacaguauuaauuuucaccagucuaggaaaauuucaaaauaauuuuccuucaauacagacagguguacuagagaaauuucaguguacuucuagcuuuaugguucucauuaauuuauucagcauaguuugugaucugucuauauuuguaggggguguaaauuuaugugaugaaaagcuaauaggcgaggacgauaguguuuccacuuuuuacuccccaggagacaggaauuguuuaagguuagcuauagugaguccgcuuaagucaacgccaagacaacugagaaacuggcgaaaaagcagugagaaaggaagaagaacccccaauuuuuucuuugauugauuugaauguaggcuaguuauaccuuuuuggcuguuuuuaguaagaacuauguuauaaaaugaauuggaggaccuguuaccaccagacuuaggagguaguaguuuuccagugacuuuuaauuucccuaccagucuuuuuuuuuuuuuuuuuaaauacaggguucuagguuaguguaggaaaaaaaacugguguauuuuauuccacaagaagcuuuugguaaauuauuuauuaaggaaacaacuguuggacauugagauggcuuuuaaagauuuaccuagaagagauaauaaaacagauaaaacugaucugcucaggggccugucuucagucuuuucaggcucguuuacugugguguucaugccagcgcagccugguagacaguguugcuguggcuguagaaauaacacugcucauuuuuauggaggauauugcuguaugccaguuaaagaaauucaaguugaaagaccuuuaaauuuuuuuuaauaauacacuuccuuccccacccccaagcugucaccaugauuaugaugccaggaaagcagugcgguggcuccaggauuguucucccaugggcugugugccagguggaugaaguagucaggagggccacaguuggguuuauguacaaccuagauaucaucuacuugugcugguugacccuccauuuucuaaaggcaauuuccaaagggaguugcuuuuguuguuacuauuagaacgguugccuuuuuuccauaugaucucuucucugucacuuagguucuguauucuauauagaaaaguauggagggaaagggaagaaucaggaaagauagugaaugcaagaauauuggggguuaugaugugguuaaguuagauugugccucaaaacacugaaaagauuggaguuucgggucaggagcucuggauuaaaggccaacgggaaucuuuuaaacuucuugguugugugugugugucggugugugaagucagaggcagacgaugagagaaauaaauugagauggagagaaaauaauaugaaugcuuagaagauuuuaaauucagggcugggcgugguggcucacgccuguaaucccagcacuuugggaggccgaggugggcggaucacgaagucaggagaucuagaccauccuggcuaacacggugaagacccgucucuacuaaaaauacaaaaaauuagcugggccugguggcgggcgccuguagucccagcuacucaggagucugaggcaggagaauggcgugaacccgggaggcggagcuugcagugagccaagaucacaccacugcacuccagccugggcaacagagcgagacuccgucucaaaaaaaaaaaaaaaaaaaauuuaaauucagaaggcauuaagaggacauuuauuuuuuaaacgauuuucuccuuggcacuuauuaaauaccuauuuaaaauaaauucaagaauaacuuuuauauaucuagucugccccuuguauuuauuuauuauuuauuuuuauauuuauauuuuugagauggaguuuugcucugucucucaggcuggagugcaguggcacgaucucagcucacggcagccuccgccuccuagguucagcaauucuccugcuucagccuccccaguagcugggauuacacgcuugcaccacccaccaccacgccuggcugauuuuuuuuguauuuuuaguagagaugggauuucaccauguuggccaggcuggucacaaacuacugaccucaagugaucugccugcccucggucuuccaaggugcugggauuacaggcgugagccaguguacccagccucuuguguuuauuuaaaaagaaauacuggcguuugucgaaugauggagucuuauuuucaaacuuuuguauuaaauauauuuucgcuuucaccagaucaguaaaucaguguaucagaugagucuugcuggaagucugauguaguuuguguauaguuuuagaccaaauuuauaugcagagauaacgcaggaaaagauaauuaagucuaucuaagauucagugggauuaguaagccuuaaaaaaaaaaaaagaccaaaucuguuuauugauagguuauagaaaagcaaaauacuuccuuaaauuaggcacuuuuugauaggcuuaaauaaaugauguauaacuguucaugauguucugauauuaaaugaauuguacauucccaggaugaccuugagcccuuuuucuagacccuaguaauuaaccugauugcucauuacccagcauuaaagccaaaaaaaaaaaaaaaaaaaaaaaaaaaaaaaaaagcgggggcggaggauuuacuuguucagaauuaagaugucaaggacaaggucgucuuuauuugccuucucucuuuugcguuuguuauagugucaguaauccccaggguguuuggggcucagauugcuuccucagaguauauaugccucuagccuaccacuucaauaauuuucuguccuuuuuucccccguuuuuuuuguguuuuguuuuuaaauaacgaugccaggagacagaaaaccaacaccuacuccagaagaggcuguugagauuacugcuggaauaagcccaggauaaaaucuuuauguccuuucagacaaagcguggauuaaauaguuuaucugacucauaugacugcaguuucuuucggccucauccagaaacugauacaaaguuguuuuuuucuucuuccuuuuucuggugcuucuauaaucuuagcuuaugcucagcugugaaaaaaguaaauguccaggcaggcacucucugcaacauagaauuaaacaugcuuccugaacauuguuugcacuuucauuugacagagagcagaaauacagguuuauguauccauaaauccugucaugguugacaaaguaauuuaauaguguuuugacucagaaccauccguuaauacgauuugagagacagaguagagugcucgugugugugugcacgugcgugugugcauguguguguaggacuggauggggugggugcagggcaggaagcaugugacagaacaccaccacgcugcaguuucacacccucccugcagcaauagguuuuaacugaaaagcuacuacucaugcuuugcaaauugauagucccacugaaaaaaaaaaaauuaaauucuuccgaaaaacacucugagguuuucgugagcagaauugguuguagaaggggaaauagaucauauagcuuaggccauuugaaaggacuugucaguugacuauugcuggaauggaaccagugucuagacuuguucuuugugaugccuuuaaaaaaaaaaaaaucagugccuuuuaaccauucuuacuuaaucauucauggcugcugugcccacaaugggcuucauggggccucauguggucuuucaucaaaggcacaguguuuuaaagucuuagaccauuggggauucugauuccccuuauuacguggugaaugguaaugguucauagucaauaguuaggaaguuggugaauaacugagauuagacauuuacugucaaacagugguaaguuuuuuacauuuguuuuucauucagguacuuuguuguuaagugaguuuaaaccuaucccagcacacccuacuuauuuuaacuuuugcacuguuaguugacauauugucauaauauguacugaaaacauuucugcguauaaaacaucaacacugaauuguaccuuuuauauguacuguuucaugugacuauacaggaccuugcaaacaucaaaaauuauauuguaugugaucucaggauauauaaugguaacaaaaucagugaauccagcauuguuacugcuucucucauuauuugcauauucuuaucaagugaguguuuacaauuauacauguggacaacaaccacucauuguuuucauuuuuauuuaagccgggucuuaagaacuggaauccuugguuucauaauuaaaagaggcccucuuuguagagaucaaaacaaaauuuccagaauguuuuaaguagcucaguuaaugcagauugagccucuacaaauuuuauaugcuuuagaaaaauaucuuuaugaugccaauuaugcagauuaccucacugguauaaucaaaaugaccaacuggaaagaaacaauaaguuuucuaauuauucauauuaaucuuuaaagaacugcuauuuuaaaauacuucuucccauuggguuuuauaaguuucagugaugucuuaggauuuaguggguuuuuuuagcuuguuuuugcuuuaguugaugaaagauaagguaauaucauuugcuuaugaaagagcaauuuaccuaaagguaaauuuaaaaaaaucaaauauauaaauaugugugcauauauucacuuauauguacacauauauacacacguauucaauauguuauauauauaucuccuaucuacacgauauauuaggcucucauuuauuaaaugaacuggggugccagcacaucucuaacaugaucuuccaguguuuauccuggaguauuauuucuucaucuucuaucucaaggaagcguacguacauccuuucuuuacccaaacaugcugccugauauaccuacccuccccaaccugacguucugauguuacugucauaucugaaauuuugcauucugagaaauuuauguccccaaacugcauuuaggcaacuacucuuauaggugaaaacaucugauuaggugguagugguugauggauuauagucacaagauaauacuucuuuaaaauuugaagacuucugcaucuuaaaaauaucacuguucugugaaguugucuggaguuuuaccaauaugagcugacauauauugcuucccaggaaagagauuggaaauucaccauaaaacucuaauuacuuuuugguuaucuuauguaucugaauuuuguuugagaugucaugacaugacaaaaucgaguauucauuuuauaaauauuaaaugagucuagaauuaugcuaaggccuugugaggaaugcagagauuacuaaacccuaguuccugcuugugggaagccugucuggaggagaaagauuagaacacuaaggguuacaauccagaguugaaugugauuggagagucaagggagggaagacuuccagaaaagggcagccagugguugugaugcacuacccccuucuucuagguucccccaauaggaguagaauuccuuguucguuucauaauaaauuuuuguugggagauaacuguaggugaccuagagauuccucauuauuuuaaaauaaucuuuuuuauccaccuuauuucuccucucccugaaaaaucuguuuagagaacuauagagauucugcaguuagggagauucugcaguuagccucauuuguguuagucuucacauguggcaggcaguuugacguuaaaaagagucagggaacaugaaaguaauuuuuugcuacauauuagagcuuaucacuuuuaaggaauauccaaaaccuuuccauuauuuaaagauaucugggauuagaugaaguguagcuaauaauucuuaagggaggauuuaacaguuaaaguugguuuugcaacuuaauguaauaauacuuuauuuuuaggaaagcuguucagagcaccuuauuccuuguuuuguaauccaucaccccuccauccauauuaaucuuuagcauggcuguuuuuuguuguuguuuuccuuguuuuaauuuggacuauaacugugcucauauaucuguccagugauuuaaaaaaauguuuauccuaaaauucuggguauacagauagauggguaguugcccauagggcaugaugcuucugaaaguagaauuacugcuggucccuuugaacguuuuccagcugaaguaggcacacccaggcaguaugagcauguucuuggaacaggcuuagcuauuuauguaauuuacucugugucuauagaacacaauuuuaugacaaaccuuguucagccaggccuuuuagucuccuccucuaaucugucucuuagaaaugaugauuauggugucuucauauaaaugcauguauuuauuuguauggaauuaguuuuaacaugcauugucuuauuucuuccucaaaacaacccuguaagauuauguucauuucaaaugugucuucucacuauguaaguaugacuaacaaaaaggagagcgagaauaaaaaacuucucuuucaauaacuuucuagucuaguuuggaaaguucgugaaguuuagcaagugaacacugggccaggccuucagagcaaguccuguggcaacucgaguuccauuagggaaggcugacuggaaaucuguuuuguuuuguuuuuuuuacaaaaauucaguguggcguguauuacguagggugugcccagagcaccaagguguaagcuggggacaguuuaacauagguguguguucagaguaagguaaguuacauagaggaaggcuaauagaaaauuuagcuguacuucgagaacaggcuuuugaucccuauuuauuucaaucuaauauuuguguuuuuaguaaugaauagguaauaggucagaauuuaaaagguuaaaaaaaggauauacauugaaaaucuucccccuauuccuucccccagccuccauuccccagccuuccuuucuggaaguaauugauguuaggacuuucuuguguaucauucccagugguauuuuaugcauaguaagcaacuccauauauauguuuucuucucauugauacuuucuucauuuauagaaaugcuggcauauaaugcaucuuuuuuuaaaaauuuauucuucuaaacaauguaucuuggagauuaccccaaaucaaugcaaaaagagcauccuuauucuuuguuguaguugcguagcauuuauuucuuucuagguggcauguaccauaguuuucauagucaguuaccuguagauacacauuuagauuguuuccaguaucuugcuauuugcaaacuaggcugaagugaauaacuuuguacauauuuuuuuuguacauguaggaggcagugcuaaagguuagagaagugucuguguaauuagaauuugcugacuauugccaaauuaauguccuuaaagguuguagcacuuaauccuccuaccaaucaugggauuugagugccuauuuccccaugucuaucucauagauggaguauuguuaaucuuguggcuguuugccaaucuacgugugaaaaguaguuucucaguaguuguaauguuuccagggagaaaacaaugcaaaacaauuaucuuuuugucucuuuuauguuuauuuacauguaguuuaguuuguuaauuaagguguugcuuuauaauucaggcagccugcaucuucuuaagugucuaaagccauaagagaaacuuaguuucaaauucugaguuccgggacugaaaacaugccagccauuguuuaugggguugccucuguguggcuggcacccugugauucagugaggguucuggcccuaacuuccauggaacauauuaucuagagggaguagagaggaugcaauaacagagaauguacggauaguuacgggagcaucugcaagagaaccuggacaguuuugggaguaagggagcaucagggauguuuuccaaaagaugucuuucaucugcaaccugaagcuuuaguaggaauuaucccugacacagauggaagagagaagagggcuccagaucggggcaagaaaagugugacuuaucuaacuagcgaguuggggguagaugagcagcaaauagugaagacugaacaguaauccaaaagguggugacacauuugaagaaaaauagcuuggacauuuauuuuacucucuuaaaaauuaaacuuuggauagauaaccuauugggauuuuuuuuuuaagcugucaugcuguuaaagaaugccuugauaauguuggcaccgccuguuauuccauauaucagugccuuuugaugguuuugaaaguguguuuuauuagauauguuuuaauaugaaaacauauuugaccuucauaccaacccugagaagugguuagguuugguaauacuauaccuucucacaaugaggaaauagucccaaagaggaugaaucuuauccaagauucagcgccagucuucagcagagccagaucuagaauccaagaucuuuuggcuucccucgucagcacauugccuuugugcucucucuauuuccugguuagugauaaguaagccuuuuugagaauagcauuguuauaaaaaugccgcucuguugaaacuugagagacuuaaaacacaauauugcaagagccucccagucucaguggcauguuucuucagccagcucuuuuuagcuuauuaaaacaaacugucaugcuuagaagacauucacucacauauuuuauuuugguaucagugcguuuccuuacaguuacacaaugucauuccaggaggagugagaaaucaggccacggccagcauugcugccuuuucugguccgaagcacugguaguaggaagaggcaguuaaaugugaauaccaaaaugcuucuuuguagaagcaaaggaaaaacguagcucuugaaaaaauguuuuagguuaugcauaggacaacuggaaucacacacccuccuaaaaugcuaauauauuuguuucuugcagcaguguugagguuuuuagaaaacugguauaacaguauucugagccagcucagcugcuucagagcuuuuguguguccuugcauagacaacuuaauuucucuaggauucagucuccucguuuuauuuuuaaaauuauuuuauuuguaaauaccucaucguggacuccaaaagcaugucuccucguuuuaaaaacuggcauaauaccuaccacaaagguugaugugagaauuaaauagagcuuuauacagaauucccucaggcauuuuuaaguuuauguaauagggauguaucuuacaguugauggguacauuuaguguagucccccuaccucccaagcuaauaauggugcgucguacaauugaugguaccaaauugaggugauaauaacauagaaagaguuuaaugcaacgugaaguacaaaaugcauucaauaaguagcugcuaucauuuuuuuaaaaauuaaauauggcugcuuguuaaggccauaucccaggaggaaaguguggucucugcugggagguuggucuacauacaggaagccagaugugugagauggcucuagauaggcagaaggggagagcucgugcccucuaggaaccuauuaauagauaucaagggugggaaaaggcaguguuuuguggucauguuaaagucagugucuauaccauugaggaaagagcuagccagagaaggacuuacaaacuagauuuucuugauucaugcaacuaucauagaaauguuuauuguugcuuuuugucauuuuguguucuuuaaggacguuguacauugaaugucuucagccuuaucucaguuguggcuuagagagagcuggccaggaccaauuguuuauucuuugaccaugguguuaaagggagagucuggcuccuuuuaguaggaguagcaguauuuggcuggagacccuauugggagaguggauuuuaggaaagggguuaagagccaggugcagugucacacaccuguaguuccagcuacucucugaaggcugagguaggaggaugacuugagcccaggccagccugggcaccauagcaagaccccaucucuguaaaagaaggggauuaggggauuaggauguaacgguuuaacugcuccccuuuuggaaaaccuccuuccaguggcaugcuuggaggugccaaguugcacuuuaugagacgaggcagccuguccuuguagaucuuucccuguaaacaaauccaaaagaucugucuuguaguuuaagugucucuaauuaggguggcgagaagagugaagaugugagucucagguagauggaacauaaaaugaucucauacuaugcaaacuuuucaguagccucucuuuuaaauguagguuuacaauguguuuugguauacacaaaaguauuuagggauaaagggacauuaacucucuaacuuacucuuaaacaguucaaaauguaggugagcagaagagaaaaauauaaagcaaauguaaaaugcuaacauuugggaaaucuggguaaaagguaugugggaaauccuccuacuggcuuuuguaguuuuucucuaaugaaaugaauuuuuuuuuuuuuuuuuuuuuuuuuuugagacagagucucacucggucucccaggcuggacuacaguggcccaaucucugcucacugcaagcuccgccucccagguucacacgacucuccugccucagccucccuaguagcugggacuacaggcauccgccaccacgccuggcuaauuuuuuguauuuuuaguagagaugggguuucaccguguuagccaggauggucucuuaucucuugaccuccugauccaccugccucagccucccaaagugcugggauuacaggcgugagccacugcgcccggccguaugaaaugauuuuuaaagaaaaaaguauguauguugaacaucuuuccaugcaaacaccuauguuuauguuauuaaaucugcaugccauaccauuguacggaugcacuguaaaggcaguuagcuagaugcauguuguuugccauuugcucauuuccaauuauuugccaugggaaacagugcuuuguggagaucccuaaauaugauaugcccucauauauuuggaaugaaaucacuguuccccuuugaaacaccuucacucccauaauggacuugacaggaagauuaacaguaaauuaaccaacuaaugcuugaaucuaagaccuuauuuagaauuuuaaauggguuaaauggugacuauuaguaucuggauaaggucaauguugcuaaucuaaaauaagcucucaaaauuucuucaguccugguucauccaacauaacaaaacucuuggggaaaaaaaacauuucggcgacaugaaacaucuuggcaaagugucuacugcuugaguaauuauggagaucagaaagaagucuuucagucucuugaaggguguggcuuuuugaaaucacuguguuggaaacaacggacaaaucuuuucugccuucuuuuaaaaugugcuucacuauuuuuaaugguugccaaauauuuugauuggauuccuagucucauuccagcaacacguaggaugaggggaauauuuuuuccagacucagcacagucaugugcuuguucuauugauucaccuucgacuuuuaauuguuauuuuucuaaugauccauguaaauugaaaucguagaauaguauuacauuuacccucauguaaaaacagcauuucuguaucuuaaguuugugcuaaaauagagcacaaauguuugguccaguuuuuagguguuucuuaaugguuuuaaaaacaaaaaggccugguuguuugcauguguaaugcuagagaugauuccaguggauccugccagauguaagggacacccuugauucucuuugguuauaccugacuucaagacucuuuccaggaaauuuacauguuuuaaaaacagacugcaucugaauuuuuuuuuaauuuuuaaauuuuauuuuuaaauuuuugucuguuuugaaacuggguuacgagacuggcuaauuuuuguauuuuugguagagaugggguuuugccaugaugcccaggcugcucucagacuccugggcucaggcaaucugcccgccucggccucccaaagugcugggauuacaggugugagccagcacaccuggccuacaucugaauuuugacauuagauucaauuacaggacggugugaauguuuguaugcucuauuuccuuuuucuucauccauggagugaauuggaaugagggaaaugguagauuaauaaacccuagauugcaaauuagcaaccaguucuauauuaaauuacacauaaauuagaaccaagaacaggaaagaaccccuugccaucuguucucuagcugcgagguagguauuaaauggaccaaaaagagcagaguuuuaugcauagcaguggcaguaaugggaaagucauauguuguauaguacuugcuguacugugcccaugaugccuggcucaugaauugacacagagcaaguugcuauuccauugaaaaccauauguuccaugucucuaguucagaaaaaauaauugauuuuaauuuaacuuugccuacuuucuuugcucuuaaaaauauguagacuguaaaaugucauucccuaggcacugucugguggugauaccagcagcagcaauaaucauuauuuguuuagcuggguauuaggaagagguagaaauaguagaucuuuccucuaagacaauaauuaaucuccucuacccuuacagucuuucucugaaaaaaacuuugugugcgucuguguauguauauaugcauguauguauaaagugaaaugcugacuuuaagugagauauuuuuaacuuuaaaaugaauuuuggcaggcuagcauauaaaaauaaugaagaguuauccuugauuggacuuagcuccuuacuuucgacccacuaauguguucagaugaucaucaucuuugucuucauuuaauguggcuuauugguuagcuguugcuaugagguagcugacuguggcaccuauucuaaucuuauuuuguacaucucuuauucccuagguuuacuaauauacuaauuuucuuuaauaaagaaauuuuagaaacuuuuaaccugagggucaacaguuagucugccauugucuccaucauuacuguguuuccccacaagauucaguuagauuaaucucucuggucuuauuucauccaaauguaaaguuguuguuguuuuauauauauacagccagagugcaguggcaugaucuuggcucacugcagccuccaccucccuggcucaugugauccuccugccucuaccuccugaguagcugggaucacaggcaugcaccaccaugcauggcuaauuuuuauauugcuuuugguagaaaugggguuuugccauguugcccaggcuucaaauguaaaguucuuaauacuuagcuaguagaagguaagccuugagaugaguauugcugcauuaauacagucauccaccaguaccaucacucuugacucugguuugcuaaccuuuuauuuuuugcuuuucacuuucagcagaccuacuccaaugaaguccauuguguugaagagauucugaaggugaguucacuguuaaucuuucucauuugaagaaauauuuaaguagguaggcguacauccauuuacuuucacuuuaaagaacaguugccauuggcugggugcgguggcucaugccuguaauccuagcacuuugggaggccaaggugggcggauugcuugagcuccggaguucacgaccagccuggacaacauagcaaaaccccguaucuacuaagaaaaauacaaaaaauuagccaggagugguggcacaugccuguagucccagcuacucaggaggcugagucaggccuccugaacucgauugaacccgagagguggaggcugcugugagcugagaucacgccacugcacuccagccugggcaacagaguugaaacuaugucuccaauaaauaaauaaauaaauaaauaaauaaauaaauaaauaaauaaauaaauaaaaaauaaagaacaguuguuguucccaaaccccuuuuaaccauuucucccccacucaucuccaaaggcaaaaauaaaccagaauaguaacagaaguagucuuggaacguaauugaauucucuaccagauuuuauuaauuaaauugaagucuacaaacugcaagacauuuggaccagauuuuuauggcaucucucguuaaguuuuucugguuguccauaaaggcccaggagaguugcucacuucccagagaggaaacuuccuguauugaugugugggaggcaccagugguuaaacagugcuugauuuauaccucuuggcguucuguaggugauaccuaauaccuauggccucauacauacagccuuuucuucagugagacgaugaaauuuuaaaggaaugaaagaaaaauagugggaaguagauggucaucuuuagacuuaccuugaaggauuacuuuuugcuuuuguuuauugaaacuaugccaugaacauuugugcuuccacaaauaugucauugaauacauuacccacuuguucaauuuuucuuguacaaggaugacagauuccuucuagaacuuaauuccaggggaaaaauguuaacuuuccucaugaacuggcauucuuucuuuuuaucagagaagaauuauauauaauguuucccauuuugccuuuaauuuccaggaaacccagagcuuaauuuuaaugcucagguacaguaauuguaaaaacugaggguuuuguguauuuuuuaucccucuucuguggccuuuaauuugcuucuaggucaauuuuaaugauauucuugucuuuuacuguaggguuucugacuuuuuucuucuuuuuuuuuuuuaauuaguagagagauguauauaauaaaugugacuguuaauuugaaucacuauugcucauauuuucucaaaauacauuuacucaauuuuaguuuuuuaacuuuucauuuuaaaguauuaagugauggugguacuaaaaccaguaauuaaguauauugguuauuuccucacuugugaaauuuuugacaguaguaguaucuaaccaguuguuuggaaaacagcuuguuuuuguuucacagucuuuugucccauuuuguaguuaggguuuucugagaaagaaagaaccucuagagaaacauaccuuuuuuuuuuuuuuugagacagagucucucucugucgcucaggcugggcgugaccuuggccacugcaaucuccaccuccuggguucaagcgauucuugugccucagccacccaaguagccgggauuacaggugugcgccaguacgcccugcuaauuuuuguauuuuuaguagagacgguguuucaccaucuuggccaggcuggucucaaaugccugaccucaagugauccacccgccucagccccucaaaguguugggauuacaggcgugagccaccguaccuggcugagaaacauacuuugaacugcuaacagugaggaauuuuugucaaccagcauguaagauuaaauaaguuaccucgauuacauuuuuuaucauccuuuuccucuucuguuucugaaauuuguugguaugguaagucguaaacauacuaaggaauuuaauuauauacuguggccuuggcauuuccucugaaauugugcguuauuuguucuaucauuauuucagaaguaaaugcaacagugcagguuuguugucuucugcauaugucagaugcuccucuuagguuucgguguguguugaaauaagacaugucacauccuuuauuuaggaauggugguauuacagcaccagacaagcaucuuuaauugaaggaacccauccguccuccuucccuucccacccaggaucacguuagugaauccuugcuuaccucgaaaugcuugagagagagugguuaauguauaaaucaugcccauuuaugauuuggaaaucauaacuugggaaagcaaacagaaggacguccaggacugaacaggccauaggccuuuucauauuggagucugccccuucucuucugucugugaccucaguuaaguuauaggucgcugcugggcuuugguuuccucauugguaaaaugaaggcccugggcuagcggaugaucuccaggguccauuccagcucuuacucuugacgcugacccagaugcuacuuuccuuugccucccgguucccguucucaucuuguaccagcaauuuauuaagauugccaggaauccaaacacaaaucuuucugaugggugauagaggcaguaaguaguuuccuaacagagaaaaucaaucauagaagauaauguuugguucucuggggucaguauuuaagggggaaguguuguaaugaaggggaagugguggcccauaacuccagcaggcuaauggaguaagaagauagcagacauacacuguuaguuuucagggaauggucaugcacuagggucuagaaagggcaacaugcccuuggugggugcauggagacaccucagauuuucuacuuacaggcaagccuggccuccacaguaucuugggggauuaaugugguaccagcaagcauuaccucagugcagcauuuccaugaugcuaguacaaugagugguagcacuauuuauauguucauuuguuuauucaacaaauacuuguuaagccuccacagcacuaggauguuguagugaauaagacagagugcuugcuuucauggagaucagaguagggaagagaaauacauaguguuggguguugauggugcugugaauaaugcaacaggccaguaaacagaaggcuaggcagagggaagaacugguggaaaauccucgaggugguaucaaguugguguauuagaggaacaauuagaacuagacagugucuccagagcaggaugagcaaggagaaaaagacaguagcuguggggccuggagggccagggcugacguaggucccagugauuugucucuguucaugugacaagucauuguuaagguaggaagugaaaucauggccuugugagucuuucugagcagccucuucuccuuaauaauggccccaguucucuuaagucccucuaguaagcuaggcauguagggaaguauauaaauccuuucagacuaccagggaaccacuuaggguuugaaagaauuuauguacuuuccaacugccugauuuaauagcugggacagccuuaggcauuuggugacuaaaagucauagauaccauugagauuccaaauaaauuauugaaaaacauaagggugauguuuucagauaccuucucaauuaauuauuacauguuuuuguguuguaacauuauaaugguucugugccuuaaaguauuaccaaguaaauaaaacagcaggaagcucucuuuggugcaguauugaaauucuuuuaaaacuggacuuuuaauuaaaaguuguaaugcuuuuaauuuauuaagugccuucugugcaguauucauucaguacgguacauaaaguacucuuacaauacuuugaaaauaagugguucuaguuuaccucuuagugagcauugaggauuaggguucagaugacuuacuuaggcugacauggcugguaaggauuggaguuaggauucaaucugggucuuuggcuauagccauuauucuuuccaguauauuuuaggaaagaucuccuguuguguccugaacaaagcagauggccagucaguaaacaagggcacgaguucacuuuuaacaaaaauuaagaaagccggcaucacuuacauuacucgucacugugcgaggucgcugcugucucuccugaggcugugguaacccacagagcugcaauggggaagggcaacgggagaccugcacauagguuggaaguggaaguacuugcuacagugccaucuccagcuguugcaaggaucaaauggcauuuuuguggagauagguuagccaggacuuagaaaagaaugaggcguuagaauacaucauguguuauacagguggaguaauauagcaugcuguggggucgcagauugcugguagaguuguaugucaauuuuuuuuuuuguuguugagacggagucucgcccugucacccaggcuggagugcaauggugcgauccccgcucacugcaaccuccaccugccagguucaagccauucuccugccaaguagcugggauuacaggcauguaccaccaugcccggcucauuuuuguauuuuuguauuuauuuauuuauuuuugagacggaguuucauucuuguugcccaggcuggagugcaauggcacgaucucggcucacugcaaccucagccucccgaguagcugggauuacaggcaugcacacccaaacccagcuaauuuuguauuuuuaguagauaugggguuuuuccauguuggucaggcuggucuugaacucccgaucucaggugauccaccugccuuggccuccaaaagcugggauuacaggugugagcugcugcgcccggccgcaugucgaguauuaagccaguuugccgggcaggucugacacaugugggaaccaccuuugacuuccugggguaccuugacucaaucauuuuggaccucaguuuuuuucaaucuguagauguugggguuguaguuaauggucuccaaugccauuuuggccuuuuagaaaaguguguuuguguguguauguguauuugcaauuugacacaucuuuuuucugacauaccuguuuucaacaaguauuuuuagaaaaauuugugaauguguuuagaagaauucaugucaagauacauauaucaauuguaaguuuuagaaaucuuuccuucaacugagaaaauuguaaaaauuaagcuucucaauggaaaagaaagguaauuuuaagcuccucuccuucaaaaaaguucuuauuugcuaauaguguguaucagggaagggucaaauccauuaaaacucucccaaguggaacaagugaccugaauuacuuguuugcuuaagucaaacaggaaaguucuucuuccuuugaacugaaauaauuccaggaaaugcaguaaagaagcugagggagaaagaaugcaucgaggagagacugcuuuuccagcccaaccugucaccuacagucuucacagcuccacaagcucuggcaguaccuguuacguacaguuuaugugcuugauaauauucaggguguuaaauucauucacguucuauaccuugauugucuucuacaaacuggcguuuuuuaguuuuuuauguuggagagcuuuaacuuuucaacauagcccacugaaauaggaguuguuuuuuuuaaguacaugaaauaacuuuuaagauuguacuugccauuuaugaucaauccauucuacauuaaguucaaaauguuaaguagcaaugaauguucuauuuauaauuuacuuuuucuucccuuuccaaauaucuuuccaggaaaugacccauucauggccgccuccuuugacagcaauacauacgccuaguacagcugagccauccaaguuuccuuucccuacaaagguaauuccuuaaaaguauggcaggcauugcauccaccuuagugaaaagcguaaggcauugcugugaggcagauugauaaaguauuacuuguucaaaucuuuggaaaugagguuaaaauuaugauuaauuuagcuucuacagugcuucagaaugcuuucaaacauuuauucugcaacuuagaacauccuagauuuucauaaagcuuuauaauuuauaaaaagcauucaggauuuuccaauacguucucucauuugaggauccuuacuuuagagaugggagaacagaggggcagggaaauugagugugugauuucucguucagaauuagauauaugcacauacaucuuacauaucucacacucccuacauuuucuugaguuuaaugugaucaguuacacuagugcugguuuaauaacaagcaaauaaacugcugacuuguguguuucuguuacaguauuuaugaacaaugcguuaaaacacugccauucuccuuuuuuuuaauuuauacuuuuggauaaccuucaaaauguagaaauagcaccuucagaucuguguuuuguucaaucugauaugcauguucauuguuuuauauacauaauacauauauugagagagugagagagcuauuccuuuccaugauacuguugugaaaaguaguucuaggccagguaugguggcucaugccuguauucccaguacuuugggaggccgagguggguggaucacuugaguccaggaguuuaagaccagccugggcaauguggcaaaacuuugucucuccaaaaaaauacaaaaacuagccaggugugguggcaugcaccuguagucccagcuacuugggaggcugaggugggagaaucacuugagcccaggagguugaggcugcagugagcuguaauuaagccacuacacuccagccuagacaacggugagaccccgucucucuaccaccaaaaaaaaaaaaaaaaaaaaaaagguucuaucuacaaaaacucaaauuugcuacuuuauauauuuacuuauuuucuaauaauuuuuaaaauguaacucauggaccgggcaugguggcuuaugcuuguaaucccaggacuuugggaggcugaggcggguggaucacgaggucaggagaucaagaccauccuggccaacauggugaaacaccgucucuacuaaaaauacaaaaauuagcugggugugguggcgggcaccuguagucccagcuacuggagaggcugaggcagaagaaucgcuugaaccugggaggcagagguugcagugagccgagauugcaccacugcacuccagccugggguaacaaagcgagacuccgucucaaaaacaaaaaacaaaacaaaaaaaacagugacucauuauugcuuguuuuaaauuaaagcacuaagcucuguaaaaauaucuuugugcaacaacaaaggaaaaauaaacucuaggaaagaagagaagcaaugaaagcuaaaauuagguuaaucaauauuuucaacuuaugcaugaaaaaaguuugaauagauggauagcugcaagucauaaugaaauaauuauagaaucugugauggguaguauggguauucucuacacuguuuccauuuuucuagauauuugaaaguuucauaagacuauccuuuuaauacuaaaagcucaacgguuuucucuuuaacuuuauaagccuuaaucuuuuaauaauuagauauuuuuauuuucuuucuaggacucucagcaugucaguucuguaacccaaaaccaaaguaaguaaauuugaaacugcuuauuggauuggagaacaaagcauagcuuuuacuguuuaacguaaaaacauuaguaaaaaaugccccagcagagaugaggccuuccuauguugaaagaauaggaaaggagaacaaauauaaaacuauucuuuaugugggauuuaaaauuguugaccaggcgcaguggcucaugccuguaaucccagcacuuugggaguccaaggcaguuggaucgcuugagccuaggaguugaagaccagccugggcaacauggugaaacccugucucuacaaaauuagaaaaauuagcugggcuuggagucaugugccuguggucccagcuacuugggaggcugaggugggaggaucacuugagccuaggaaguagagguugcagugagccaagauuguggcacugcacuccagccugggagacagcacagauccugucucaaacaaacaaaaaccaaaauaagauuguugcaaagaguuaauaaagauguuuuagugaaauacuaaacaaaugcagugugguauuacugacacauaguagcuguaccaaaugugacucucacagcuaggaauuguauacaacaguagauuggagugugucauucuuguguuuuaaaaaacaaaacuaagaaauuuuuauaaggaauaugacauacaguuugucuagccccacuauauuuguuugccauguaauucuuuuucagccugaggguuaaaucugcccugcagcuaguuuuuguaaauaaaguuuuauugggacauagcugcacccauuuaucuaguauucuacaaaguauagcacaaaaaaccuaaaauauuuauugucuggccucuguagauaaaauuugcuguucccugcuguagagauacugaauaagaucuugcaaagaagucauaacuaaaauuuccccaaaaugcagauaaauaaacccgacuauauugcuacaguauuguaugaguagcuagguaaaauuaacugaaauggauggcugcuugggaagauugggaaaucuuuuuucuccacaucuuggcagcuagcccagaccaguggagugugcacaggucugaaggcagaacaccagcucagccgugggugggguugcuaugcaccacucugcccccaccuucggucugcuuggguugcuggucaugcagguggcaugucuuucacgggguugcucaugguuuguuuuauugcuaacucaugguuuagaaagaaccuuuaguccauuaaaccauuugauuuccccuuuuagcaaaauauaguugaagaugaacugauaagcacuuucuuggccagggauggaucauccucuugcccuaugcaguaaugugggucaauuccuuguuacucugaugagaaauuguccaacauuggugggucuccuggagguccuggcucaccagcugcuuacccccacaucuuuuaugcugcugucacuuuauucugcuauuccggcagccuuauuuaucuuugugagaaugugaccugaaaaagagggaucuaguuuguugcauguaggaugaagaggauggugggguauggauggauauagcuuucagugaagagaagacaaacauuucuuaaaguaugcccagcaagucaacucugauuucuucaacacuugaucuuaugguacugguacauagguuuuagagucucuggagaggggagguagggggauuuuacuuggaugcccuaguguuauauguccacaauugcaaaacccagacccuguggaauuuagaacccaggcaagaugaucguguggagucccugugaauggucugaagaggaggggccucugccccucucguuuggagucuugguccuagcuuucuagacagaggggaggccauuugaaaauaucauauaagagcugcugccaccaugagggcaaagugacuaauugcaaauaugcaagggucuccacaugacauuugugggaaaugucauucagcccugccuaaaagguacccauguuucuuuuucacuuccaauucuguuucaggucccuauuaccucaugucuagacaaaugcagcugccuccacacguaacauuuccugcucccuucuaaguuaugccagguagcacuaccagaguaauccuucugaggaaucacugugucauguuccuguuuagaucauugaugugucucauagcccagcaaauacagucauaacuucccauccuggccuucagagcccucugaaaucugcuuccgccuguuucagugcuguccagcacagauucugcaccucagcccugcccuuuccaaacucagacccucuucuucuuguuuguucccacuguccucucucucuugccagcaucacucugccagaaucuuggcuguccuuugugauacaauucauuuuguucuuucuuuaauuugcugccuuugguauuaccaagagagcaaccauucugugauuucccagggcaguuaauuuauguauugacuuguguacuuaaucucacagugccuuggauuauagauauuuauggacccguuucaugucccucagucaacagugagcucucugaggacagggccaaaugccuuaaacauguugguaucuaugagguagucuauaaauagcugcugaaugaaugaauugcagguggggaguugaauaaugaagggacaggugggauggagagcaccuaggacagagcugucuaaagagagugauaacaaaucacuaauaucuuuguaaagucacaugggacccagggcgcugggagcauagcccuggcagagugcuuccaugugggccuccaccccugucaaggacagggaggucuuccaacagguagguaaguuccuggcgucauagguaggguaugcugcaagcaaugauuuucaguguuuuuggccuauugagagguuuuugauucugaaccaagcauucucucuagaaguaacauaaaugucaucuuauaaugcuaagauuguaccaagugcaguguguuuagguaaaaacuggggaccgacauaaaagaacucacaacuaaggaucuuguaaauaugugucauugugcugcuuugauguuucucucccccacagaacaauaugauacaucuucaaaaacucacucaaauucucagcaaggaacgucaucguaagugaaaugcuuuuuguguauuaaaauuuuguaguaugaaauuguaaugucucaugucaaugcauugcuuagauuuuucugccuuuauguaaugacauuaauaagacugcugcauucuaaagggaagaaagggcccacauuaauuuuuuuugcuuguuuguuugagauggggucuuaacucuguugcccaggugggagugcaguggcaugaucucggcucacugcaaucucugccucccgggcucaagcgauucucaugcgucagccuccugaguaguugggacuacaggugcccaccaccaugccugacuaauuuuuguauuuuuaguguagagaggguuucaccauauuggccaggcuagucucgaacuccugaccucaagugauccgccugccucagccucccaaaguguugggauuacaggcguaagccacugcaccuggccuaauauuuggauuaagucccccuguugaaggucuauguaccauuggagaguuugguaaaaggucuucuugagggggaaaaaggguuuuugagccauuauuuacauuuuaacucugggaauagaaggccuuugcuuuuaagaugucauucuuuaauagcuuuagcuguuagaaacaaguuuugggggaugugcacaauugaagauuuuccgcccuuuuuuggccuaauuuacuaauaaagagcuaaucuuauugcccagcuauucuuuauuaaggccaguaaguccagaaauauuuuggguuaugggaacguuuuagacugcauauuaaagauuuuuaaauuggcauuuugacccaauuugucauuucuugaugguauugaacucuuacuacuuuacuuucauaugacaggagcuggucauagggacuaagugaggaggccuuccuccaguaucugaucugucacuaacucuguguugcuagucucaggauuucagguggcccaggaguuuaagcuccaacuuuccuuuaguuuuaggcacaauauuuguuccauguauuuuggaagguggggauugcuauggauuauuuaaaaaacuauauauugagcuggagagguuauuuuaucuccucgccaugacuaaaugugggucuggguuaaguguuuguuucccaagugccaauuccuuaauguacuuugugaaaugaagggaaaaggaacaagaagacgagguguuuuuguuuuuuuggucugaaagauggguuuugugcaugugguaagaauguauuuuauuugugauacugguagaugaugagguuuuuguuuuuguuguuuuuaaugccuuuugcugggaaaguaaaauguuaccuuuuguuauucccuuuuuuuuuuuuuuuuuuuuuuggagacagggucuugcucugucacccaggcuggaguacagaggacuacagacuacagggacacacccggcuuuuuuuuuuuuuuuuuuuuugguagagguggggucucccuuuguugcccaggcuggucuccaaguccugggcuaaagcaguucuccugccucagccucccaaagugcugagauuacagaugugagcuuccacacuuagccucuuuuuuucuuuuucuuuuucuuuuuggagacaagguugcuuuguugccuagguuggagugcaguggcucuucacaaacccaaauagcacacugcagccucaaacuucugggcucaaauaauucuuuaccucagccuccugaguagcuaggacuacaggcacaggcuacuaugaugcccggcuccccuucccuuuugccuuucaccuuuucuuuuuuuccuuuuuaauuuuuacauauuuauguuuuaacauauuuuuagagacagggucucacuauguugcccaggcuugucuuaaaacugcugggcucaagugauccuccugccgcagcuuccugaguaacuggauuaccagcacacaccaccacacuuccuuuauguuuuuggaaauuuuacuggcugcuaaauucuaagacuguagacucacugacauggauuacauuuaaggaaggaggagguuuguuaaaccaguugauggcugguaaggaguagaaucugcagaucaaggaccacaacuguaagaauucuguagaagcucuguaaucuccccaggguuuuacaccagguauuucuuugugaugguugguugucaagcccuguagaccauaaaaggcccugaccauugucuuuggggcagccaggaagggacguuaaagccuggguaucccaacugacuguaagcauagaggggaggagcucucccaggaguagaguggguggagcaauugcaccgaaguuggguagugacugugucucucgccuguggauagaggaagaaaggcagcugggucugaucuacgccugacagguagccucagacugagcaggcaaaagucacacccuaccacuccaauuuccaucagcuuucagacuuucagagacagaccauuccugugaugacacugcucagugaaaugagugguuuucuugauagcaguguuaaaccacucaaaucagaggugccugaaaguagcuaacaaguauaucuugugacacguaguguuugcuuuauaaaaacuauuaauuuaguacauauaaaauuaucuaggaaagaauauuugugaugauccuaauagauuuacagaagguagaaguaggaccuaguggaagggaggagagguaagaguaacacagaagagaagugauacugaggccgaguagauaaugaggguuguguggacuuggugauuaugugggggguagacguggugguauugauaagugccagaaugaaauguauccuugggaaaaaggaaugacuuuuaugaacucacuuuuaauggagauuagaagaaaguggugucccaaauuaauuggcaaauugcaguuguuucagauuuuguguggcaaaucucuuagugcucgcggguugauuugaucuauugucagcauuaggcuucuuugacaugcaguuaagcuauuugaguggcacauagagugcuggggagauauucuaaugcauuuugaauaucagaaaaaaauuauuaauugcagggucauuuacacuuugauuuaaaaaaccaaucuaggucuuaaugcuuuuucuuucagaguuaugaggacuugggaauccuuagacaaguggaauaggacauauaagaguauaaaagagaggcccaguaguaaaggauaagcuugcgaguggucuguauuaacucagauaugguuaggggguagcaacgugguagaaggauguaguugugaaauuaaauguaaugguucagcauguaguuugagauguaguuauuucucaaauaauuccuucuguaaaguucuguagguaacugauuagcuaggauguuagugcaauuugccccuaaguuuaagagagaguguauuuguuuaagggcucuugguuuuggaauccucuuccuuuccaaggcuuagaucugugaagugcugaggacaaaguauaaaguauuuccuuuuucuguacaguaacugugaccuucauauaauuguggacaauucuuuuucugugcagccagauuuaguuuacuggugucagugcauuugucagccucugaaagaggacaaaaauguuaauauuuuagaaacuaaaaaagcaauuuauuuguauauucuagcuaacuuguuucuuccccuaccccaaaauugccaaguccuuacaaaaaggugcccuccauuauuuuucuuguuuuuggccucugaaaucaacacuuacuuaaaauaagagacagaaauuagucauuauagcaauuugaaauauuuauuacuuauguggaagguuucuuuugaagugagggagauaucuggaugugaaggcugagauugggauugucccucgaguuggaugagaaagacuguugccaaguuaguaaagacuggggugagucugauaccuuuucaaaugagcccgaguuuucaacuuuuacucaaaacauuguuggcuuuuaaauauuuugguaaagagcaagggaagacucauucuguuuauuguaauauaaaauugucacaucaggauguaaguagugucagcugaaauguucuagaauuaaguccaaagacaugcuuuacuuguagcauauuuaaaucaugcuuagccuaaggaaauuaaauuuuuccuuguuuucaaauauuagcuuauaccguuugaaccuggauauuucaauggcaggucuaacugagaguacaauuugcugauaaauauuauggaagugguagaaaucugccccauguguaaagcuuagaacuugacauugaaguaauaucuacaucccuuauucacaguucuuccgcuucccaaaaacaaggaacaaacauuugugcugguuauuuguacauuuguagaucugcauuaagccuucaccaucauagaacauuuauuaaaauguuuuucacuaaguguugaucucacuuuuuauuuuccuuuuuugagacagggucucauucugucacccaggcuggagugcaguggggugaccucgguuacugcaaccuccaccuucuggguucaagcaauccucccaccuuagccucucgaguagcugggacuauaggcacacaccaccauaccuggcuaauuuuuguauuuuuaguagagacgggguuucgccguuuggcccaggcuugucuugaacuccuggacucaggcagucugcccaccuuggccucccaaagugcuuggauuacaggcgugagccacugugcccggcccccacaugcugugugcuuggugcugcuuuagguacuuggagaaacuguggucaauaagacaaaauauuuuguaacaaacuguagguggcauauaauacagagcaagggaugugacagugacaggguugagaggaauucuuuggauaguaguuacacuucagggaaaagagggguccagaaaggucucccagagagggugacauuugauaagagaaaggcagagacuauuugccaccuugaaaggggcuugacagauuaugcuguaggcuuugaaagcuuuugaaaaccugagggagucuuuuuuuaagugauuacuuugaaagagcucauuugcauauauaaaaccuggauuuggggagcccuuaagggucccuuuaagugucauuuuacaucauaacugcuaauuuacuacaauaagugacccuaggcuaauuuaaacguagauugaaagauugaauaaaauauauuuuaauuugcuaggaaucuuagccuuaaggguaguuaguguauuuuacccucucugugggaugcugggcuguuaaaccaacaaggugugguccacuuucacaagcauauuaacauuccugccuccuagcaagggccuccaagaaccuccauaaccuauccccuaccacggccugucccugacacacauguccauuuuccauucuggcaggcuuggccucccugcucuuuuugguguugugaugacucuccccacaagacuugcauugugcucucucccuccuuucagcugugaccugggguggccuuuaucaguaguuuucccuaacuacccuguauaaaagagugaccucuagccauccuuucucuuuuauccuuuucccuccacaagcuuguuacccauugagaaaugguguauuuuaguugucuuccuccucuagacuagcggggauauuuuucggcucagaguuguagccauagggucuagagcagugccuggcacauaguaagugcucagaauaaaugcagaaggaaagauucuacacgauaaacuugauugaauaccuauauacaguauuuaauagacaugguuuagaguaauauuuuagauuuuguuucuguuaaaaguauaucauucuuuuaccuugucauacuuacugauuuaaucuacugauuuaacuucagauuuucccucauuuacacucuugugauuuuucucauuuccuuauuugacaucagauaaucuucacuucguccauggaguuuaaauaaucuuuuauaacuccagcaccauuuuuaucauaucaaccauuaaccucuuucacuagaguuaaucauguagagucaguuuccccucuaucuuguuaccccauaauuccuguggaaaguuucccaugaacuugaauucugccuucuaacuauugucaccauuuggagauuuccuauuauauguugugucacaacugcuggagaucuaccuuuucacuuuuucaucucuucuucguuuagccugcuucguaauuuguaaccucccaccaucucuuagaaugcacgggcaguccuuauuucuggcauacaucaagaaaggaaucagagccugauugcuuugaaaaugccaggauucuacggccaggcucacaccuguaaucccaacacuuugggaggcugaaaugagaggacugcuugagccugggaguuugagaccagccugugcauauaguaagaccucgucucuacaaaagauuucuuuaaaaaauugccaagcaugguggcacaaaccuuuggucccagcuacucaggaggcuuaaguaggagggucacuugaaccuggacggcgaagaguuugcagugagccauaauggugccacugcacuccagcaugggcgacagagugagaccuugucugaaaaagaaaaaaaaaaauccugggauucuggaugugcucuggagcccagccucuuucuccugccuugugugccauugcccauccuauccccggaucaguuucagauuugugagauucuauaaguuuacacauucucacauacuuguuagugguucccgaaaaguguuacuuuucuuauuauuuuuagcacaccugauaccauggcugugacuuacuaauuuuaaguaacuacuaugagcacuuacucuuucucaaagugaucuuaagaaauguuaagccaagaaauaagguuauguaaauacuuuuugggucugaauugagauguuacaaaauauuggcagugaaagcuuugggcaagcccaguacuaagaaauggaaaauaaauggcgacuugucuuuaugucuucacacaguagcaaucggguugacucacugcagcgugucugccagaaccuguauguggcucuuuaagcuuugcuagaacagcugccugaaaaagcaguuguacaaaggguuuugagaauuguuuguuaccuguaagcaaaaaguuuaccuaaccaaauguaaaaugugauuaaaucuacauguaaagaguugcuuuaccugagcgauuuggcuucuuuugaacagugucaaaguagguaauacgguuguauauguuuugaaauaacugccuugacuuggcauuuggaaaugaaacuuguuauuugaccaguuaaaguauauaagguuuaaaaguuaauuugucuucauaagggaaacauaacauauugaguuccaauaggaaaguaguuuuauuuuaaaucaaagucucucucuugguggguucuggaauuuagauuuaauuccaucaguuggguuuucuaaccauuguguaauacauuggccagaacaaggggaucuugggcaugucagguggcuguuuuccucauccuuagaaugugaagggauggucaaaagccaccacacaggauuguaaugauaagcagugucuguucugaucacauagugggcacagcuacaugauacuguuauucaacaaagggguccuauucauucagccugcuguuuuaggauaccuaccaguuucuagacagaauauaaaaggugaaaaugauuugauccuaauuaaaaaaaaauuuauaggugagaaagaagaagcauauccauugagcuuucuguucucuugaccuaggcuuuauugccgugacugagacugggucuaagagauuuggauucucuugucauggggacagaggugcucacccaggugugcuguaguucaucuccucauuuuucacauucaacgacugauucuucacauauaguaugugcuuggcuucaaauacaguuugugggacaggcagaggaccuuagccucuuaaauuuaaaagaaauuuaaauuccuuuaaaauuuguccuuaggccuaaaaauccuucaccugucaucaaacugucuucagcuacauagauuuucuguuuaaaaaaaauucuaauggcauucaugauuaauuuucuauauuagcauaacuuaguuaugacuuguaacuuaaaaaaaguagauguuguacauguuuuuuaaucaaaaacuuuagaaaaaaauuuuuuucuugcugccauuuucuccuccaauaauagcaugcuaguuuacguugagauacccaccucuggugauacaguaaaucaggcuuucuggaauaguuugugguuacucuuggcugugccagcagacacuaguaauacacauaucugcugauucucaugugagauauguuuauucuuuaucaaauaaauuauacucacaaauuuuuauuaaguaaaauacuuuauguauaaaucccaauacaucccaaaugagggaggagagguuuuguuugaccauacugguuuaucauuucugaguguuucuuuggagacagcuuuugcaaucuuccuucagagaucacaguccguacucuuuagguuuggaauagguuuuguaucuguaggcuuauuuuguuacuaucuauguaauucucugcagggaaaauuuuuagaaucugggacagcauuuucauggugccuguuuauccugaagaggaaguggagccaaaagucagaacuuucucuaacuuucugacuuacuuuaggagaguauauucuuggaaguuagauguuugguagcuagaagagaaaguuacagaauuuuuaauccugugcucaaaacaggaaaugugguuggauuacaugaucauugauguuacaggaauuaaggcaaaucaguuuuauucaaaacaaaccuaguaacuaagaaagaggucaguuuuuuguuuuguugugguuggugacuaaugcugaauacacuuugccagauuuuuuucugguuguauuauacuuuacauuuauuucaaagauacaucuuuuaucuuuuguuuguguauaacucagcccagccaccauuuagcaauaaaccuguugagugacuuuuuuuguauaccauuacguugcuaacugacaaguccuaugacugaaggcuauauuuucuagccuugaaaaaauaugaauuuagcugugcaggguggcucacgccuguaaccccagcaguuuaggaggcugaggugggcagaccacuugaacccggagcucuagaccagccuaggcagcauaguaagaccucaucucuacaaaaacacaaaaauuagccgggcaugguggccugugccuguagucccaacuauucgggaggcugaggcaagaggauugccugagcccaggaggcagagguugcaguaagccaagaucacaccuggguaacagagugagacccugucucaaaaagaaauaaaaauaugaauuuagcuucuguuagauaaauauugagcaagaucuacauuuacaaguugcuaacaguuuucauuuuauuuagaaacuuaucccaguauguuuuuaguacauuuaugaaaguuguuucuuggcagaauuaccaccucauguaggcggucauuuacgaaacagccaaguuucguucauuuucauuagaaaacauagugauuuuuaccaggauuuccaaagacaccaugccugcuuucuucagugguagauauggcuuugcaguaaaaauuguugaucagauuuuugaauagguguuuuuggaaauacugaaggauuuuaaccucaaauaauuugccgguggaguuuuuaaaauuugacaacacauguacagauugacaaauguuugcuuuuuacuauuuagguucaccauaagccagaaugccuacagauacauuaauccaaguuugaggaaauuuuuuuuuuuuuccucacugaaacaauagcaauaagguuaaacauaauguguagacaaucgaguuuguauuacuguucuucccauugaucaguguucacauaggcaaaagagaauaauuuauugucaaaaauaaagcucacuauuaauaauguccuuuagacagaaauguaaaguaacugcacuguugggugauguuugccuugauagcaucauacaucuuacuguguauuuaauucuaauguugaacuuuuuaugugccuggcacuguucugagugcuuuacaaauauucauucauucaacuuuaauucauuuaauggcuaacuacuuuaguucaguuagagcuuauggaagaaaguaauugaguauauuauguaucccuccccauuuguuuuguuugcauggacccugacuucacugauuaggagugaaggacuuuagucucagggcucgcaacgaauccuugucuugugguaguucugcuucaguguuguagcaugugaaagagucuguuuugagaugguaagaggcuugcacuuaacugguuucuguguuauaauuguauaauuauaauuguauucguacauuguaauuguauaauuguaaaacuuaacauuuucaggaagucacagccuuuaauaaauaaagaaaacuuacacauauccucucucuuuguuuaauuaggcauauuuucuauuuacaugcuagaaaaguuguuagaaaucauuucacauucauucuucucugugucccugcccauuccagcaugcucgaagacgaccuucagcucagugacagugaggacagugacagugaacaaguaaguguugcacagccuguaauaccaggaguccuuuuaaauacaucuaacagaucugagcugcuuguucuaaccuguuuuuuguucuuuuccuggucuuucuuccccuuauugugaaugccuagaccccagagaagccucccuccucaucugcaccuccaagguaccguguggguuucuccccaucuguacagaauguuugcaauuuuuuaccaaaugggaaaaauaaagccuuauuuaguacuuucacauuuuuugucaugggaaggagcugaaggaucacaguaaaaggaaaguaccuguuuaauauuuuggaagcuuaaaucagccauagggagguuguuaacccuauagaagcgagagccccacacucaucuacaucaucaguauagauguuaaagauuuuuaagaguuuacaggcugggcgugcuagcucacgccuguaaucccagcacuuugggaggcugaggugggcagaucacuugaggucaggaguucgagaccagccuggccaacauggugaaacccugucucuacuaaaaauacaaaaauuagccaggcaugguggcgcaugccuguagucccagcuacucggcaggcugagccaggagaaucgcuugaacccaggagauggaggcugcagugagcugaaaucgugccacugcacuccagcuugggugacagagcgagacucugucucaaaaaaggaguuuacaaacaagcuuaaaauacaauuuaucaucaguauuagguaaucaauauuugaaaaguuaaacugacgagcccaguguuuuaauggagguaacagauuugcuguuuucaauaaagcucaguuauuuccagaacuucuuuuccauuaugccuguuuucuuaguuacaugaauuuucauauuguuucagcugcuuuucaaaaugaccagcaguacauuuuagugugaugggaaauggaauaagccagccauacuuuaggaaaugugaugauuuaauuuuugaaaauaugaacuauuugaacuucuuuuauaauacuuuccucugguaauaugccagguaccugccuuucauggacaaaguuauuuuacucacuugagaugugcucauccacucagagacgacauuagcaauaaaaucuuguccauuaugcaggggauguuacaguuaauguggaggaagcccaugugauuaugugcacucuuacagauucauaagguuugcuuguucaauuauaucuuauuuuguucaguaauuucugguggguuaugaugacucauaaaacaugacaagguagccuaacuucuaaaaguggaggaaaaggaaaaagaagagaccaagcggggguacaaauuugaggcaggaguaacauugagaguguauccccuuuugcucaucacuggcuuacgcucuucagcugccauggagacagggccaccaacugggugcagcauuucugugaggaaauuauauagugguaucguguguguuuuaaaguuaccucaacuagugauuuuguuauuguuuaauaauuuuuauucuaauauguguuauuuaugaaucuauuuugaaaauauuuuagguagauuugaaaucuguccagauuauaguuaaugacuuauugcuuuaauuaauaccaucuagggugaagcuuuaagauuauauaugcuuugaaauuauauaugugucuagcagugugaucaauguguuuucuuacuaacuuagauuuauugccccauucuuaaaauuuggaguagauaaucucuacuuugucugacauuuggggaugaucccuaagccacuuacgaagaaugguccguuuuguaguucuuccaggaagugugagugguugguuacuuuugaguucaccuugcaaaggaacaccauuuauauuuaguggucuuuggcuaccacccaguucuuguuuagagaauauagggagauuuuaacuuacuggcuuuucuuacagaaauuaauuugauuugguuauguguaacagagaccagcaaacuuaaaaggaucagauaguaaauauuuuaggcuuugugggccauauaugucucuauugcagcuguucaaaucugccauugcagcauaaaagcaaacauaguacauuaaaaaaauggguaugggugucuuccaauaagacuuuauuuagaaaagcaggcagccagccuaggcaaugguuuaccaacccuugauaugaagcacccagcaucuaacuuaaauuuuggaucacuugacauauucuucaggaguaaaauuucacaggcuucucuuuuaugcauuuaucuggcaaucaguuuucagagguuuuugcuuuucuauuaaacuacuuugggccucucucaguuggaugacaugauaguuuagcaguguaucuaauaccaaggcccgcccuuuugaguagcaggaaaaugggcaagggagaaagaagaaauccaccuuguaucgugccuucuaauuuuaucuuuugguugcuuugcagugcuccacagucccuuccagaaccaguggcaucagcacauuccagcagugcagagucagaaagcaccagugacucagacaguuccucagacucagagagcgagagcaguucaagugacagcgaagaaaaugagccccuagaaaccccagcuccggagguaccguguucccccucgagauggccaccuuagauggcagcauucuguccuuugaaguuagagucagugcugugggccaggacugaccaugagacugagucauucugucccauggggcaaugcuuuccugcuccuaugcugucuagagccaucuguuucuauuuauuugcuucuuaccaaauauuuaauaaaggagaguugggagagaggucuucucuccccuguugaaaaugauaggucuucucugucauugcuagugguguuuugaagaucaacucauuaagacuguuugcacaccauuuucuuuucccuucuuuuagaaagaaaacuugguuucaguaggcugcuauuuuaauauuaaugagaauucuucgugaaauuuuagaaaugcaugaauuaaagcaaaaggagacugccugauuuagcaaagggcaggaaugugaacuagaaauaagucaucaggaguucuauuuucgaaucacuaaaagccaugcauuaaauugauggcaaagugauuuugucaggguucuguuucuugcuccuuucugucccauguaaaacagggacgaugguguuugcuugucacccacccucaggagaauauuguaaagacaaacugauaagacugaaaaucuuaggcacuaaauaaaucuagaggauuuaugcuauuuacuggauuguugagcacaagaaauuguuaguaacaucuaacaggguugccaaauaaccucaaaauuuggguagcauuguaaaaguuaugguggggaaagaaauuaaugaaaagggaaggcaugcuuuucuuuuuggugaaugaaaccagcccacaucgagaaaauuauuccauguauuuaauaagggaaugccaggaaaugaagcuuucuaauuaggaaagcauuaaaaagccuucuguauuugucucuguuuagaaagcaaagcaguuccaauggggcauuaacugaauacaucuggagcuaauguagggagacuuaagggucuugucugagggugagggaggcugagaaaauaacuggcugucauuuucuguuagaugcgaaucuaugucuggcgcagaaaauaagagcuugauauguuuuggaguggacagacaugcaucaguauuaacugcacuugaagugccuuucagauuuuagaaacuacacuguguuucuggggcucuuuguuuccuuauaugauacuaauugcuauugaaauaauuuuucuaugccucagggaaaaggauacugaauaugcugugcagacaaauuguguuuauaagaucuuugcuuuauguuucaccuuauucuuaagaaaaaucuucaugcuaguuagauuacugacaucgaaaagauaauuaacauuuaauucaaauaaaauggaaauguuacagauuuggcugaauaauugaaacuugauagucuggcguuuguaguaaugagacauagauauauuuuauugcuugagaaguuacuggaauagagugaaaccucuguaaaauaaauggucccauccugccuuaucuuuuaaaaucacuuuaauaaaaaaggcuaguauuguuauguauugcagauccaggcuuggggacaguauguguuauauacugaggcuuauccuccugggaauauuuuaucuuuguuuagauuuuaaguuuugaauuuuuccuaaaguauuuaacuacaucucuuuccuuuuacaauaaauaccugcauuauuauaaauuucugguguuguuucagaguaacagaaauuccauaauaagcuguacauacagauauuaaugagaauucuuuuucauuaauauugcauaaucaguacuguaaauuauggaauuuucacucuuaacuuucucacuccuuuuuuuuauuuuuuuuuaacuuucucuuuucuuugucuuaauuuuuguggguauguaauaguuguauauaugagugcgugacauauuuugauacagccauauaaugcauaauaaucacaucagaguaagugggguacccaucaccucaagcauuuauucuuuguauuacaaacaauucaguuauacuuuuucaguuauuuuaaaauguaaauuaaaguauuauugacuacagucacccuguugugcuggcaaauacuagaucuuguucugguuuuuuuguuuuguuuuguuuuguuuuguuuuguuuuguuuuguuuuguugguaccgauuaaccauccccccacccccuacuacccuuccaauccucugguaaccauccuucuacucucuaucuccaugaguucaauuguuugaauuuuuuagcucccacaaauuaguguguaucuuccauuuuuuuaaugcucuuuuuaaaaaaaaauuuugcacucauauuccccauagcuauguaguguuacuaaaagaguaaaucuauauugugcauaauaauaagcucaaaacuucuuaauucaaaaucauaauucauucucaaauauacuaacuuuugccaauuuauuaaaacaccuaauaaaaaauaauuauauccuuuuuuuccuauuuccaauuugcaguauuuggauugcaccagcacugggagggcagauugggggugggaugaggagacgcagaggaagaaaugaaaguccaaacuuugauccucuaaacaaagauaaaauauucccaggauauuugaaagucuuaaaaccuuggcacuuuuaucuacuuaaacuuuauuuuuuuuuuuuuauuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuuuuuuuuuuuaguagagacgggguuucaccguguuagccaggauggucucgaucuccugaccucgugauccgcccgccucggccucccaaagugcugggauuacaggcgugagccaccgcgcccggccuuacuuaaacuuuauuuuuaaaaauauuuuauuuucauuuuuauuuauuuuuauugagauggagucucacucugucacccagacuggagugcaguggugugaucucggcucacugcaaccucugccucccggguucaagugauucuccugccucagccuccugaguagcugggacuacagguacgugccacuaagucuggcuaauuuuuguauuuuuaguagagacgggguuucaccauguuggccaggcuggucuugaacuccugaccucaagugauccacccaccucggccucccaaagugcugggauuacaggugugagccacugcgcccagccuaaaaaauauuuuuaaucaaucccuuaugaaaacauuuuuuccaucacaacacccaaauaauguaucaaauuauauccauuucacaacuuaauauuggguauacaggauugccccuaccuguuccccuugucuggcacaacuacucaauuuuacccucaaauugggacauaggccuuccuuuggaacauuuuuaggacuguaguggaagaauauauuuuauuucuguaaucaggacguuccuuuagggacuacuaaaugcaucucaguacuguccuguuuugaggguugggggggaaaccagauguuauuuauacugggaaugacuucccuuuuggguucacacauaaauagucuucuaaagagcaugucagggauuggggugcaguuguagauauagccaguggguaagauauguccauaccuuuccugaggaagggugugaaggcuuugugccugaugugauuggcaagugauguaucucacuaccuugucccaucaguuaaccacuuauguaaccacacccugaagucuccaggaaaucauguuugacaaguggguauugugugcuaaucuuuucucuacucuuaaccauucugcguucuuagaauauugaauacggauuuagauuacaugugacaaaaugccugccacauaauagugguuuccuucuucccucccucucugcccuuaaauucagaugacagcaugaguauacaguugacauaagcgaaggaagccguaaggaagauaauguuaucauaagcagcaguaugggguaaacagaaagaaaaaaggaauuauguagucaucuuacuguccaaagaauguucuugccugguuuuuuaaguuucuuaguucuguucuguuagucacacuaaacccaaacuaucuaccugauccuuuuauuaccuaaccuuuuccuggccaaaaagccuuuaugucauagccacauauuuugcaucauggauuuccauguuuuauggaguugaauuauuugggauguuccacucgggaaaauugucagcagucuuucuuccccuuaaaaccuuuccaucuaccggaguguucuccuuaucuauaaucuaagcaaauaaaucugaagugggaugucuuucaacuaauuuucugaugcauuauguguaugacuuauuucuacaaaccaccuccccgaguggaucuuuaaauaaauuaguauuuuucuuaagauaaggacauaaggacagcgauguauagucuuuaaaauaaauguaacuaucacucacucuguuagacacuaauauuuuucuauaugauaugaaauucauggguauaguaauccaccuagcagaauacucauauaucucaugcacccacuauaugcaagauagaguaguggaacuuggagacacaagagucuccgucauucuuuuaauaaggucuaacagccgagcuggagagacguggugggaugcaacagcaguuaauuuaucaacaaagguugaacuaauaguuaagguaacgagccaggaaccuauguuuuuaugccacgcaauuguacauucucauugccccugacgguaugccucccuuuguaucuuagaaacauaggugcuguuucagaccagguugcuuauaaugagagauuugauguaugaccuuuuuuuuuugagaccaaugugucacucugucaccuaagcuggagugcacauggcucaccgcagccucaaacuccugggcucaacaauccccaccuuagccuucugaguagcugggaccacaggcacgugccaccucuccuggcuaauuuuuuaguuuuuuguagcaaugagguauugcuauguugcccaggcuggucuugaacuccugggcuuaaacaauucuccugucuuggccucccaaagcugggauuauaggccugaaucaccguauuggucgaauguuugacuuuuaaagaguucacgugggauuaaugcuuggcuaaugugacccagcugacuuuaucaagguauaaaaauugcaaaucacuguauacuauaugugauaugauaacuuugucauguauaaauguuuacuacauaauguuuuuaaguaaaugagagaaaugggccuguuauucuagugcuuuggaagacugaggcaggaggaucacuugaggccaggaguuugaggcugcagugagcuauuaucaugccacugcacuccagccugggcgacagauugagacccugucacacacaaaaaagagaaaugaucucaucuugaauaaaagucaucuuuaguugaaaaauaugucaaaaaaaggauaaaaugugagcccacuaaaaauuuauucauuagcugccuucugcaaauacuugaugaaaugauuuuuuacucauuuccuccuauuauuccuuaauagaguaguucacaaaacaaaaugugucaauucuguuuaaauuauacuauaauuaccauuagaauauauuauaaagauuucucagcaguuggcaauugccuguugauuaauauuugcuauuaccaaauuucuaaaucccacaaaaaagugaagguugcuuuaagaguuaauuguuauagaacuuauaacuugaggaggaugaccggaaccuaaauucuggguuuggaaguauuugcuccucugcaggacaguguuguauaauugggugacuaacacaaaagaauaauuugucaucaauggucaguuaacacuuuucuuucuuuccuuauuuuuagccugagccuccaacaacaaacaaauggcagcuggacaacuggcugaccaaagucagccagccagcugcgccaccagagggccccaggagcacagagcccccacggcggcacccagagaguaagggcagcagcgacagugccacgagucaggagcauucugaauccaaagauccucccccuaaaagcuccagcaaagccccccgggccccacccgaagccccccaccccggaaagaggagcugucagaagucuccggcacagcaggagcccccacaaaggcaaaccguuggaaccaaacaacccaaaaaaccugucaaggccucugcccgggcagguucacggaccagccugcagggggaaagggagccagggcuucuucccuauggcucccgagaccagacuuccaaagacaagcccaaggugaagacgaaaggacggccccgggccgcagcaagcaacgaacccaagccagcagugccccccuccagugagaagaagaagcacaagagcucccucccugcccccucuaaggcucucucaggcccagaacccgcgaaggacaauguggaggacaggaccccugagcacuuugcucuuguuccccugacugagagccagggcccaccccacaguggcagcggcagcaggacuaguggcugccgccaagccguggugguccaggaggacagccgcaaagacagacucccauugccuuugagagacaccaagcugcucucaccgcucagggacacuccucccccacaaagcuugauggugaagaucacccuagaccugcucucucggauaccccagccucccgggaaggggagccgccagaggaaagcagaagauaaacagccgcccgcagggaagaagcacagcucugagaagaggagcucagacagcucaagcaaguuggccaaaaagagaaaggugaguguggggagacugcccugacuccagcguggaccauccuugcuguuggccuggcgguaucuuugaucggccuuugauuuaggcccaguugaguugucucacaagucuuugcuuugauucgcuguagccuuugcaucuucuuccagcauuaccugucuggacuuugcuucucauucugcagaugggcauuaacacguguuauguccuuccaucggucuugcuaguuugaaaaaaggugaggcagucauuaaaaacaauagcuucuuuuaggauaauguagcaucuagggccgcccccaacccaccucuuuuuuuuuuuuuuuuccaaagacaggcccuugcucuguugccaggcuggagugcaguggugcgaucuuggcucacugcagccccuaccucuggggugaaacgauccuccuaccucagccuccugaguagcugggaccacaggugugugccaccacacccggcuaauuuuuguauuuuuuuuguagaggugggguuuugccauguuggccaggcugcucuugaacaucugagcucaaguuauccacccgccucugccucugccucccaaagugaugggauuacaggccuaagacacgaugcccagccucauuuucauuuauucuuguaacuggcauuuaccaccugacccauuagguuuugccuuaguaguugagaucugaucugaauugaaauguuaauucauauucugaauuauuaaaagaacggcucuauacaaauuuuacucucauaguaggaucuuuuauaccaauaucacauccauauuuuaacgcaugaccauacaacaccucuuuacaguuacuaacaugugguuagugucucauugaguaauauaggcugauaauggcacguugcaaaguguugaccauaucauuuuauuuauuauaauuuuggaagauucuuuuggauacagaauggacagaguaacaaaauugcugcauuauuuaagauugucuguuacuugaacaugccacuguuuuagacaggcuccuuccuuuuauuuugaaucacuugaguuccuguucuguuuguugcuuuuucaugaugaugaaagauuagugaguuuuuccccaguagcauucccaagccaacuugcccaagaaucagagacaaagucacaagaagggccaacucucuccugcugagaaggaauaaaauuuuuaacacucuuguaaguaugugaaaaacuucuuacucagcuguggaaguugagcuaagaauaacaaaggaaaaaaagauuaugaagccugcugucaugucugagauuugacugauuaauccagugcguuaaaaauauaacacgacuuuaccgaauaguaaagggcgacugcuuucuucagaaccuccuugcagcagacuaaaggauguguauugccgccauguuugcagcaggcaaguugagugggaugggauccagugcuaguaagugcucugucucagcuagaagagggcauauuuucaugccagaaacuucuuuaaacuuuuuguaugggauggggugggguguguguguguguguaugugugugaaagguacaaaacuuuauggagaaaauugugauggaccugguuaggaaaaagauaccugcagcugauacaccugggaaaacuucaggaacacacucagguagcucccuguccugguaaaucucucaccugucucccagcugcuguggucuuguguggucuccagugcugaccgucugcauuagcuggaguggggacagguacucacuucugaaaggauuaccuaccagguggcaauguuagaacccggaggaucccccagagagcucaguccaguucauaccccagugcaaaucuagaagugcagcuuguggcucuagaaagggaaacuuucagcucucacuguugacugugggaacugugcccucuauaagccguucccagguuuuggcugagcaccucuugggcagcuuauuuaucuuucuguuuagagcaugcagaaauagugaucccuucaucuuaaucgagugcaugauuucuuuaaagcgcugucaagcugcugagagaucuggccuggggaacagucugccuccgugguacugucaggauugaugucugacccacugguuccaaaccccggcuacacauuacauucaccugguagccuuuagcacugaugacgggaauccccaacccccauugguauuuuaaaaauuccucugguaauccuagugccuaucagggcuggaaaccacugaagcagagccguacugcagggcccaagagcauacaaagcuaguuauuuggauccaaaguuggucaagugugcaguguuuagacaucaugaucuaggcaaacagaauuccuggccugaaauaugucacuaguuagaaacauuagaagcuuucagguaaauaaauauaaaaaaccagucaaccguauucuuauuucuucgucagagaaucaugugucguuugguuuaacuuccugcuggauucuggaugggaguuguugaacauauuaaucucauuauuuucuguagaggacagguuguccccccuuccucauuagcgcccugacugcuuguuagggcucucugccucuggcccugugaccagcacgguugcuccagcaggcagcagugugugggccugcucuccauggcagagacagggcugugaagcuuggguacugcucacauuuggauaaugaagauauuuuucauuguguucauuuuaaaugugaacauuagaaaaaacucugagcauauagucagaggaauagaagaacuugcuugauccuucacauuagugguauuuaguguuuuuauuuaaaggccucuuagagucugucccucucuuggcacaaaauuuagccaaauauuuucuuucagaagauuuacagauccuugaauccacuucagacuuaaaaguguaugaagaugaucauaaagaguuaaugauggcuaacagcugugaugaagccauuagacauggcaccuauagaaaugcacacguuuuuuuacuacucuacaacaguggguaaggaacaaugcaugaggaaaaguagagaaaacugugaggguaaauacgcaugaccucacgucguguucuuuacauaaacuacugaauuucaucagucugauuacaguuuagauuuucuaauaccaacuuauguuuucuuuuaaaauuuuuuuauuuuuagcuuagagacuauucuguuaauuacuuauuuuuuagagacagggucucgcucuguugcccaggcuggaaugcaguggcauagcucaccaaccucaaacuccugggcucaggugacccuccugccucagccuccaggcacaugccacuguacccagcuaauuuauuuuuuguagagaugggguuucacuuuguugcccaggcuggucuugagcucugggccuccagcaauccuaccucagccucccaaagcaguggcauuacugguugaggguaguugucuagcuccuugguguuuugaacaaagaauuggacaaaaugcacaaaaaaccaaggcagugaaagcagagauuuauuuuaaaugaaaguaugcuccacagggugggagccggcugaagcaagaggcucaggaacacugguucuucugggguuuauaugccuucuagagguuucccauugguuucccauugguucacucuagugguccacgacuagucugauugguuguaggggggaccaaucagaguuacuuucauuuuccacacagaaaaaggagggguuauaucuuauauccagucagggugggugggccuuagguucccugccuccagacccuauucuccugccucacugggguuacaggcaugagucaccaugccuggccuauguuuucuucuucagaauucuuaaaccaagcuuauuuuuuuccagauuuggaagaaaaguugaacucaagaaccacaauauauacaguaauacacaaccaggccagugcaauugggagcccucuaaaaauguaccuggcugggcacaguggcucacacuuguaaucccugcccuuugagaggcugaggcggguggauugcuugagcccaggaguucaagaccagccugggcaacucugugagacacugucucugaaaaaaaaaaauuaggcacaguagcgcaugccugaggucccagcuacucgggaagcuguggugggaggaucacuugagcccaggaguuaaagguugcagggagcugugauugagucacugcacuccagcaugggcaacagaguaagacccugucucuaaaaaaagaaaaauaaacacguaacgugcauagagcuacaugugugagccuugcauuguucuaggagcucauagagauaauuccucacuucauucagucaucuuacagauuccuuucaaaugaaggauagucugucuuaauugucauuuagaugaauaacugaauaaggaggugcauucauucaaaucuuuuuuacuuuuucuaaauaaucgcuuugcugaccaagacacuucaacuuuuuugggaaagacauuccagugcuaucauuuaugcguuuugaagagugaggaagggaaguuaugauguguaguaggaaaaugcaguuuuauugcagggagugauugguucaguccuucccuuccauccaagaucugacugucuuuucuuggguuauugcuccagaucagcaccccuaguuaucguucaaaaugaaagcucaucccuucugauugacuaaggccacuuacaucuaaauuucuucgugccuguuaguuacccugaggagagcaccacaaccauaugcaugugauagcuuaggcuguucugaaucaugcguucccucaccaaagagaaaaacaaguggaugaauuucccuuuucuguagcacucaccccagugaacauaaccugucugcacagcaagucccugggccugaucuugguacaaacuugaauuggugucccuugugucuuuuucauauugaaucuccuuccgaggcgaaucacagggaagucccugaauuuccccaaagacugcuucuccaguuuucuguguugcaugugcuaccaagcucauuugcuuccuuuuggaagaggauaauagagccuuagaauuuaggugcggaaagaaccuuaguggucccuugaucagcugccaccuuuuauagaugagauccaaaaaggcacuaacauggcuugacugcugaguaaaaauagaucugcagcucaggcaugcugccuccucccagucccgugagcuuuccucuuuuucacauguguuuucuccguacaagugucuguugggaggauucucaagaggcgcacaaggucggcguacuggcucuggcgcugccggugaauaaggugguuaccgcgucagccccggcuugguuccuccacggcccccaccacugccacucagugcccacacacauuccuacuccacuuuagcuacuccugcagaugcucccaucuuccuucacagccaaacuccugguucacuacaucuuuccaucugcuagaaucucuauggcaccaaauaagugucaguucuggaaaaagccaccuuuucccugcuuccuacaagugucugcuuggugagcuggcugcacggcagcgcagccugccgagaggcuuucccugacggaaacugacuuggccccuugcaagcccaugucuuccuuuuauggccuucacucuugcccugugcuccacuguggguggagcagcaucuggcagagaugaucagggcugccugacccaacagguuaagaaaagcaaacaagucugugaggaccaauucgucagccggcagccucccuuuguggaaggugaggcaccauccuugagacaacuaaccuaguagaaaaagaauuucugaaacccagaccuuaagccagauucccugaaguggggaugaccuggggauaaaccacagggcaaagggacuccuuuuuccuccugaagagagaguaucaccucaucugaauggcuucuugacccagaaaaaucuaaagaacagcaugccuccuguuuuacggcaggucuuguucuuggaauuuuggucugcauuucugcucacccaauauugcauggcucccauguuaaugacccuuuccuacauccauccacuuaaaguuguaaugcaguccugcauccagugcccucagcugugucccugagcuguuaagcugaauuucugugccaacugacaaauaccgagugccuacucuggggaagccucuguggcuguuccagacagaagaugacaaaguucuaagugcauaguguacaaaaaaccacuaacuucaugcccgcuggcuugaucucaacaguuaagcaaaaucagcagaaggggacuuuugcuuuauuuaguuugauggcuuccuuucuaccagcuuauagaauauuaucugcuucuagguugcuaaauaucaauauaaagcauauuauuccaguaagugccaaugcaguuguuagaugcuggcgcugaaguuagugcucacugcauucucucuuguuggcugucuacuugagucaccgauuggcacagccagagcuauaaccagucugugaggauugauuugcccugacuuguaucuucauguguggucuauaaggucugccagauuggcuuauagucacaaccagcauguccuaagcaaaaugaaacuauaugaacaaaaaucagcucucauuucacugcuagacuuugguguuuucuuuaagaaguagccuuguuaaugcuuaguuuugccuugggggccuuaaugugucauuaacugccuggaaauaccuuucauuuaaaaaaguauacuuuaguaccuaauguucaauuuaguaucgaucuggauauuuuagcaaauuuugacuuuucaaagacaaaguuucugucuuguaauguuucuugggccggcuauacugccuuucaucuaaaacucacuacaguucacugggccguuugguaacaggguaaccugggcauaauuaggugcuugauugacaagagaguuaccaguaccagaagucagguucuauuuuaaccccaucauuuccaauugauuguuuuucucuccaccauuauucacugucucucaaguguuagcacucugaguuguugaacggagguuuguaugcugcgcagagcccugucgcaaugccccagcaagcuucuuguuggcauguggccacucuaaauugugcuccaggaucugcuauggguccaugcuugcaggagaaacagcuguguagaauuuccuauugcauuucauuuguggguuuagaacucgguugcuuauuucauauugucucccuuuucaguccuucaagguacauuuuuccaacuucucuaaugaauuauuacauuucugaguagcugauauguuuuuaucuuaucuaagcaguauauuuauaauuccuucuuugcauuggcuaaucugauuaguaguucagaacccaauuuucagauugucuauagcaaacugugaagaacugugcugucaaguagaaauagaauauaagccacauauguaauuuaaacuuuucuaauaccacauuaaaaacuauaaaaggggaggaaauggaaaauuaguaaaaaaaaaaaaaaaaaaaaaaaaauucuuuuugagacagucucauucugaugcccaggcuggagugcaguggcgcaaucucagcucacugcacccuccaccuccuggguucuagugauucuuggccucagcuuccugaguagcugggacuacaggcacgcaccaccacacucgacuaauuuuuauguuuuuaguagagauggaguuucacaauguuggccagacuggucuugaacuccugaccucaagucauccauccaccuuggccucccaaagugcugggauuacaggcaugagccaccgcgcccagccuaacauuuuaauaauuauaucuaauccaguauaccuaaaagauuacuuuaaucaacucccaaaauauguaagucuguuauacaucaguaaaaaaaucaauauaaaaauauuacauucucuuuuuucuacuaagucauuucagacuaacaccauucaaguucaggugcucccuagauguggcuguggcugcagcugccagaugguagcaugcaggacagugagaacugauagccucccgaggguacgagccuucacuuggccuuaauuuauuucuuccuccuguauuuucccuucuuaacauucucacuugugcacaugccgcaagauuaaaaacagguaucuuuguaagccacucugaaggaagccguuuugaaacaagacacugcauaaaugaauaaaagugucuuuuccaaaggagccugugaagggcuggauggaugugcagaugcaggcacacugauuuguaggaugccaggagaagggaauuuuguuuuuuuucuguuuucuauuauuuuguguggagccaggcugcuuauuggugucugggcagauuuggagccuacacaucuuaaauuauucauuuuucuuaaacucgggaggagaggaagacacaggaaaacugggaccucccacaguuaauuugaaguuuuuuauuuuuuaagagaggauuucagguuuguuagggauuguccuaaauugacuggugucccagauuucuaacuuggugaccugacacuuaggaaguuucguucuaaaugcacaugagaauuaauugaagggucucacccaucacuuaccugccaccugcuagacaguaugugggcuuccuccugaacccagagccaugggaaggaggccgucagggagucugcaugucagacuccuuagaaagcugguguaugugcuaacaagugaggcacaagaaugcaagaaagacuuucaucguggaagaauucuguguuguuuuagugauuaaauguauuuagcacuuuaguugguauaaauggaugcuuugaagguacuuaaauucuuuuuucuuuuuuuuaacccuacuuucaagcuaccaaguuagagauacuuaaauucaauagugacagauucccuuuuccuuacucccacuaaaauauuuacagucuuuucaggguuuuuugaaaaauaaaaacauguuucuguauauggagagauauaaagacaguauuaaaaaaauugaaucaguggaggggaaaaaauguuagcuagaaucccagagcaauuguuucuauuguuguuauauaucuuuguaguccuuucuguaaaauacacgggauuuuguagacgguuuccuuucaacauuguacuuauuuuucaguagaaaauaaaguaagcuuuaaguaguccauuuugaauuuuauacaaacaauaaacuaguggguuuaaguggaugguucuuucgaaagaaguuggaggaaaccucauaaaaaaucaucucuguauuauuugauguaaauaugcauguuuuguggauucuuuucuauuuagaaaaacaucaguggucuauugaagucuacuuacuggcauugucuguuacuuuaggcaucuucguuuucuugcaugggaggaauuguuuuucuucgugcaaaaaaaucugucucaauagaaauuauaucaaaucuacauuguccccugcccacuccccaucacacucacacacagacacacaugguaaguacuaagaagguugcugugcguacagagaugucuccaaagguuccuuuacccucuuugccuuuucuauauuuucuuuucuguuuugucuguacaauuauguugguaauaauuugcuuugcugauuauacuguaauagggugaagcagaaagagacugugauaacaagaaaaucagacuggagaaggaaaucaaaucacagucaucuucaucuucauccucccacaaagaaucuucuaaaacaaagugaguauagagauuagcaaccaccuaaucuacggugaucaacacuucuugggucuugacauagcaaagaaauuuuucuucugcacuagaaucaguggauuaauaaacucaagcucauuuggacaauguaauaaguuuguuuuucuuucuugcauccaugaggaccuuacaggaauuaacaauucauguggcagcaaauuuagauuuaucagaaacauuuucacuauggacaauuucuuuagacaucuggauuuuuuuuuucccugagggaaaguaagaaagguacccuuauuucuacuuugcagaauuggaaacaaacacacagagaaaaugacuuguccaaagucagagaauucuuacuguguguuggagccagcauuuggacuccgggagccuguguucagugcuccuucuuuuagagaugacugagaaucugucagaccacucagugucuguuguugggaagagggguggcaggugagaagugguagugccaggaagacguaaauauaacaagcagcuauuauuuacugugauuuacucaagaaauugcuucaaaaaauguauuggcaaaaacaagugcauagugucaccgugugggaaccgacagagauggggaaggcucagauguggaggguguguguccacucgucuucuugucagggaaaggcaccgguugggaagcagcugaagcaggcguucggaaugguuggggaaagucaggaccacuggcagacucugcaagcuuagaaacuauacagcuucauuuaucacuaauggguagggcuagauuuuugaaaugccucaaaaagucccugaaauuuggccuguuuacacaguuucaugcuuugugauacccuacucuuuugugccagcagccaguuuguaacuaaacaacgaagccgcuugauguguacuuugccuccucuuaguuuuacgugauguuucacuccaggcccuccaggcccuccucacaguccucaaagaaggaaaugcuccccccgccacccguguccucguccucccagaagccagccaagccugcacuuaagaggucaaggcgggaagcagacaccuguggccaggacccucccaaaagugccagcaguaccaagagcaaccacaaagacucuuccauucccaagcagagaagaguagaggggaagggcuccagaagcuccucggagcacaaggugagcaggggcggcggucacucuguaagaugggaugcauugcuguaccuuuacguucccaaagaagacaaguugcuagugauggcacuucagaacuguccauugcuuuuaaugaggcaacuguuuguguuuaaaaugcuacuuuuuggagggagaguaaaagguauuaauaauacacaaagauuuaggugucgauuuauucuucuuacagugauuucagaggugaaaaaucaaaauagauuuuugugcuaguuuuuguuaggguguuuuacaguaagaaauaguuacccuguguaguccugcuuugaauguuugaucucagauacuuucauucuugguuauaguggggaaaaaaugauccacuuucucaaauaaaaguucuucucuuccuguuaaucuggguggaguggagugguguguuuggauugacuaagagaaaguguuauguguggcuuugugaguucucugaucucuuggacauucuagucuuuuugaguccccaguacaaucagaaccaccgcuucaguugaaucuguagcugaggaaguguuuagccaggguagauugugcauuguuugauuuacucuuuuuugaaacuacuauuucgggcuauuuaagagggaugguacuuuuaggacaguggucuuaaauguuagaguguaaucuguauauugauuuuuuuuuugaaggguucuuccggagauacugcaaauccuuuuccagugccuucuuugccaaaugguaacucuaaaccagggaagccucaagugaaguuugacaaguaagacuucagaugauuucuucuugcucuguuuuguuuuguuuugcuucccccccccaccaagauagagucucacucugucacccaggcuggaguguaguggcaugaucuuggcucacugcaaccuccaccucccggguucaagugauucuccugccucagccucccaaguaguugggacuacaggcaugagccaucaugccuggcuaacuuuuuuuguauuuuuaguagagacggguuucaucauguuggucaggcuggucucgaacuccugaccucaaaugauccgccugccucggccucccaaagugcugggauuacaggcgugagccacugcacccagccacuucuugcucuuucuuccuccauuuccuccuccccuccuuauuuccacuucuccuucuuuguuuacccucucuccuccccuugcuguccucccauccuuuuucacucuuggucuuaucuugcccuagucuaguaauuuuuggcucauaugaccugucccugguuuuuccucuuuuucagacaacaagcagaccuucacaugagggaggcaaaaaagaugaagcagaaagcagaguuaaugguuaguauuggcccuuuaucucuuugguagaauguuuucugauaguaaaaaaaauuuuugguagucuccauucugcuguauuccauaucacucagcguaugugcgguggaaggagggggugcagcaggcgcaggagaaaggaguguaugggcccuaccauuggccacaacauaugcacgcagcaaaaucaggaccuuaaugauuaagggguaggugguucuuaguggugguauuuucuuuggcuccauugauucagucugaucaugggcagauauacaaaggaccuagucacaaguuuuguaucuaaguaagucaaaguuaaucuaccugcuggugauuuaaugcauaggugccuuuuuauuccacugcaucaauucuuuggaugugaaaaaugagcccugcuguugaaacucagucaacguguguucacucuaaaacauuucacaaggcaggaagccuguuuacauuccaaaauuaucuuaaagccuucagaggcugaccugaaggaagaguugagcuaggcuauuagaugagauuuuaagaugaagguaaugauuauacuguugguaaacaugcuuuaaaaacaugaauucucuuuaccuauuggcuuuuggacuuucuaaaagguggugguuuuguaguuaauuguguacauaauuaugcuuuuacaucacuacugcaauaaugagauaauguuugcccuuugucauauuuagauauccaagacucuggggcuuuugcuuauguagugaguuccuaaaccuaaauccccacaaaugcaaaaaugcaaaaaccucccuggaaagccauauguugaacuuugguacacagaggaagggcaugaguugccuuuuuugguucacaugcaaaccuaacuacacauuucagacacccacaggggucugaaucagauugauucaugguggcccagcccgcaagauccuggccuggugcucuucaacccuaaucugcagaccuguaucucuucucagacucuuucaucagauacccuugcauuaggcaaaauguugauuccuuaccaugcucaauucuguaagauagucaaagacaagccucucuagcccuguuccuaaaacugcgcuguaccagggugaccuaagucaauuaagaaucugagauugugccaagcagugguuucagcagcuuccauuuuuccaagauuauuacuggaacuguaugaaucuuuggaguuuuggaaagaguaaauauuucgcacugucagccaguuaucuaaaacuuaucuugacauuggauacuuucaguacuaagauuucucguuauucaaaggaguaauauucauacucuagggaacuuuguuuuuaaucuauucauaugcauacauucuuucuccuuaccuaaggugacuguacaucccagugugccaggacaguccugguuuaugccuguuucaucccaguuugauaaauaauuauaucccauuucacucuuaaaauaugccagcuuggacaguaagccccuguggcccacccacuccauaauauucucccuuaauagcauaauguuucaaagaugugcaguugguguuccaaauaguuaccuauccaacugaguagaaagggauguauuucuucucuacguuaucuucaacugaugagugaugagggaaacuacuuuaacaauguuucaggagauacauggaaucacagaaauauggacguuauuggccuuaugauauacuuaucuaaaggaaauggauauugacaaauugcuacacaguauuguaguuuaguuuauuucuagccuaaagccaauauuaacuuuggaaaucccaugaaagagaugguguugaauaaguauauuuggagaauucaguuccaucagugaagcaaaccggucaugccaaauacugcugauuaauuggggaauacucauuugauuuuuguucugucacuaaucugagccucgguucucuagagaaaguauuuuuugauuaaguuaccuuuuaaaauaaaaaauguuagaauaauugaauauucugaaauauacauguauacuacauguguauauguauagcagccuaguucauucugcuacugguaaaacaugagaacaguaugcacuaaagucauucuguugucagcucacugggagaagcguuguuucugcccuguguagagugcagcagcaugccuaaguagcaugacagcccauaccgcucucauugcugacgugucuccagcuccuuguauuccacuuacaucuuuacuauuuucuuucuuucuuuuuuucuuuuucuuuuuuuuuuuugagccagagucuugcucugccacccaggcuggagugcaauggcaugaucucggcucaccguaaccucugccucccauauucaagcgacucuccugccucagccucccaaguagcugggauuacaggccugcuaccacaccuggcuaauuuuuauauuuucaguagagaugggauuuugccguguuggccaggcuggucucaaaauccugaccucaagugauccacucaccucagccucccaaagugcugggauuacaggcgugagccaccaugcccggccccuauuuucauucuuuccuuuugaacauaucaaauacaaagcagaaauuacaaaugcuaaucaguugcucucaaggucuucaugggcaguacauacgccacauguagagagaaagacaguugcaucacacugucaucagcugcacuugccauaugccacuuagaagcgugcugugugacaaaguguguauucaggguguagggugaccaccaauaucugauuuuguucauauuucuacauucccuuuaagggacucugaaauguuaccccuguuggccucggaggaugguuuugugcacuaaagcagaugucaaaggagguuaaucuauugggcuguaaaaugcauauaacaauuauuguuggcuauuaugucuaacaugcucauaaaccaugaugaguguuuucuuuuuaauaaacuucagcacgcacaaagaaauaugcgucugcauuacuccagacauguggaauaaucuguuucucaaggaaguuauagaaugaguaauuugacacuaauaacaaggagacuauguacuuacugccuuaguuugcguaugugcuuucauaaggcuuugagagcauggucuuaauacgggaucauuuucuuuuuccuaaugaauuuuugcuaaaauaguuuucagcaggucauagcugacaggcuuugguuaucauuuuuaguucauucauccucacacuucucccuggccauaauuaaacuaagacaguggaggaaagucacacuaaagaaugugggugagaaacuaaaucaagguuugucuucagccuaacaaugaccauguucuucuccugcagacggacaggguuggaaaggcuuuuaaguaccuggaagccgucuuguccuucauugagugcggaauugccacagagucugaaagccagucauccaagucagcuuacucugucuacucagaaacuguagaucucauuaaguaagugccgagucauugugcuuuccucuuaaguccuuuucuuuccucaccuuuauuguuuuaauccauuugaaccuuagugugaagauggcucaauaaaggggagccuuaaaaaaguuauuggucuaagaacuaguguuuguccugaaguugcguucuagaugaagugcuagcacagaauaacuggguccaacugcaucauuuugcuaagugcgccaagaagugccaaagcuuugagggagauugguuuuuccaguuuagcuuuuuuaugaaguguccucuccucucaguuuaagccuuuguuuacuuaccuacauuucaacaggggacucaguaaggacacaacuucacuugguuucaagagguagacaagccacacaagagacguguacucaccuaguuuucucaauggccuggauuguugcucuaaagccuuggguuuuuaaauuuuuuuccugugaugcucucaucucuucuucaggaaaagucaauauaaaauggaaacaagcauaguaaguuguauuugugucugccuuuguuuaaaaccugauguacuuuuauauuuuccuauagauucauaaugucauuaaaauccuucucagaugccacagcgccaacacaagagaaaauauuugcuguuuuauggugcguauuuuccuuugucuaaauaguacuaaauuuguuuuugcaucuguugauguuacaaaaagauucugaaauuuguuuucuuaaugugaaaauuaugaaaagcaagucaguacuuuggucaaaagguuaaucccucacugauaguaauucuuauaaaaugguaucugcugccauuuuucugauggcuugguaaaugcuuuggucuugugauauaaauuauauccuuguguuuucuaccagcauuuacuuuugggauaguaugaacagagcaguaagauacuuuacauacuaacucacacaggugaggcaaacccgguguguucauuaggcuauaaaagguuagauggcugcuuuucuguaguaugauagucacgugcaguuucacuucugucuuuguucauagcaugcguugccaguccauuuugaacauggcgauguuucguuguaaaaaagacauagcaauaaaguauucucguacucuuaauaaacacuucgagaguucuuccaaagucgcccaggcaccuucuccaugcauugcaagguaacucuaagucuaauauaaauaauuuccagaauugagucauuucuuuauuuacuucuugcuuuugcaaccauuuguaugcuuacauaugucacuuugccuuuucaaaaauuguuggcuucaucuguuugcugguugcuccuaaauuuaaauuauuagcauauuucuaccuuuuugagaaauaguuauaaaucaagguuuuugcugauuggaaaacauaaaaagguaauugcaaagaauauagaauugaaauuuuugagcuuugagguuuuuguuuguuucuuuguuuguuuguuuuuugagacagagucuugcucugucucccaggcuggaaugcagugcugcaaucuuggcuuacugcaaccuccaccucccagguucaagcgauucuccugccucagccucccgaguagcugggauuacaggccugugccaccaccaugcccagcuaauuuuuguauuuuuaguagagaugggguuucaccacauuggccagauugguaucgaacuugucaccucaaaugaucugccugccuuggccucccaaagugcggggaugccacaggcgugagccaccgcaccuggccgagcuuugaggaucuuuagauaagccuaagaacacaaaacaagaggcggagccaacagaaccagagccagaguccuuucucucucuguauguauggacauagcuucuuggcauuucaguaaacaagaaauuuccagagccauaugccacaccagcaauacuaagaaugaaaaugauuaucuuuagcaaaauuuuuuuccccauuuugugaacuaaaauuguucauguaugcuguaaguuauuagaaaaaaagaauccuuguacaaguguuuuuaaagugaagcuggaauuuucuucccuguaguccuugccuaguauuuuuuaauuuggucauacuccuugugaaguuccuaguucugauaagcuuugcuauuuuaagaauaucacuuacacgacugcccuauuucuagcacauucaaaagaagagacucccauauggccucucuuaaaaaagaaaguccugauuaagaagcaacuucguauuaccucugaagauuuucauggcugcugcauugagauauuauucuaagcuaauagauugucaaucacauuauuuacauaacuccuucaaucauuuguccauccaguauauacugagcaccuucuucauaccaagccuuguuuuagguacuggggauacagcagacaagaaccacugcccucauggagcuuucacucuacuccuugcaaauguacauucugcuagguccgugcagcccaaacggcagguguaacaucaugaggcuacugccgcugaaccaucaucuuuccauuuuauauucauuaacucuuuuuuauuuaguccacauugagucacauguuaacuugcagguccagauauucagccaagaguggaguaaagaggagauagagucuucugaugcaugauacuuaauauuaguucauucauuggcucagcaaguauuuaucaggagccuacuucuagcaccuauugugcuaagugcuaguaaugcaaaaauuagugagacauuauuucugcuguggcccaggaaaaggaauaaacaguagauaaauguaagaaaagagagauguucaagugguggcagaaaggaagcugugauauauccaggguauccacagugucuaaaagaaugcaugguacagagcaggugcucaguuaguguuuacugaguggaugaaaggaugaaauacaggugggugcacacacauaccuacauaugcauacauuacauacauagaguauugucuuacuaggagauuccaggcagaggaaguagacuaugcgaauggcaugggaaagcauauuuggaauacagauuagcccagcagggugucucguugaccuuguaggagugacuuuagcagugguuaucauuuuggcagguguauagugaaacuuugugucuuggacuguaguuccagacacguaaaucugugauccaggggucuacuggugacugacugaucaguuaucucuucucuuccaccucccagaagcacaggcacaccauccccucuuuccccaaugccuucuccugccagcuccguagggucccagucaagugcuggcaguguggggagcagugggguggcugccacuaucagcaccccagucaccauccagaauaugacaucuuccuaugucaccaucacaucccauguucuuaccgccuuugaccuuugggaacaggccgaggcccucacgaggaagaauaaagguaaauaaauggcuuuguggugguaauuacugggguguuuggauugggaggaauaaacauugguuuauauuuuauaaguucaguuucuuggagaaaagggaauguguagcuguuuuacuuuaauuauauuuucucuauucugccucaaaaccuaguugcgguuguuccuugagcacuguggcauggagcugaguuucuguggcuagaucuuagcaaaaccaaaauacaaguggcuuuagcgccuugccccuucugaagcucugcugucauuacuucagccugagcugaaaugcuagcugaaaggcagggcaaaugaagaagaggagccacuggcuguuccuaggcccagcacauuggagauacaaaguagcauaacccaaauaccgagauuauuuguuuuuaguauauguuaagaaagauaguagcuaugguacgagagauacagcguaguaaacauuauugagacuuguuuggggaagaagacccuuggagaaaugcaagguucaggagaguuggagccagcuggcuguaacuacuuacuuucgacauagagccucuuagggccuuaucugucuuaucaaacugauaaugcuuuuaacuuuuuuuuuucauuaaugcauccuuugaggcaaagguauaaauuugguguuuuccaagugccagccauugugcuaagcauuauggauucagcucuaaagcaaaccugguugguagucuaguggagaauuagcaagcaauuacaguagauugugauuuuuuugaugugauuaagugcagaauauuguggggaccuaccuucuggaaccuugaauuuuuguuuccauuuuaauuuuugugugugcuuguguauuuacuuguuuuuguuuuguuuuguuuuuuuugcagaauucuuugcucggcucagcacaaaugugugcaccuuggcccucaacagcaguuugguggaccuggugcacuauacacgacaggguuuucagcagcuacaagaauuaaccaaaacaccuuaauggagccccagguugauucaaugccuugggaacuauuuuugcacauuggaagccucaaaaacaguccagacauuuguuucaucaggacaccaaacucuaaaaaagaagcaccacgagauggccaggacauuuguccacuuaaacucucaacaacagugugaucauugguuggacacugugguuaugcagaagcagagaugaggaggcuggccccagagaugaucuugcccuuccuaacuaaaggacagaagugcaauuuagcuuaaauggguguaugaauggucuagaaacauuucuauuuuuuuuuuaaaccagcaggauacaaguugcaaaugaaaugaggagaaacaguuucaacucugaaagugaauuucacgucaucucaguagccacgcuaguccauucccagaaggaaauuuuuuuuuuuaacaaugacuuuugguaaaggguuuuguggaugauuuuuuuucuuuugaguuuugggagaaauauuuguuuaguaacuucuaauggccaucuguaaaccauaaguaaugaaggacuccacugugccccacuuucugccaaugaacaguggcuugauaauaccaaguauuguuguaauuuauaaaauugaaggcaacccccgcuccugccgcccccaaucuccccauugccuagagcgcugcacauugaccccagcucugacuucucauuacugugcugaaagucagcccacgucggagcggugaggaggagccacagcacauggggugccaccucgaggucugcacaggaggacuuggcgcugccauuuccuaccccugccauuucccaccccugcuucagcgaaagggacucucuaacagggcagucacuguugacucuauucugaauuuccucccuuggggaagaagggaaccaacauuuauaccugaccagauggcuaaagugcuuuuaaaguuuuguuuaaguagagcuggaauuugaggugcugaucuguggucuacaguuaugugguaacucauguuguccagccaacucagaguuucgucagugaacaagaaacaugaaaucugcuucuuagagaggcuauauuuuucugcuacaaauauuuuauauuuauagcaaaacuagacuuucagaguccuugauugucuaggggaaguuaacucccugagaggauguagagauuuggggugguugauuagacuuuugaaaaacucaucaccacaugccuucacuccagaguguucucagcuagauuugauuugguugaggaggaacuguggcccuccguaaguuauugccauaguguaugcauuaaaccaaguccauuuugaaugaccuaaaaugaaguaacacaaucagaaaucccaugugcccauaagcacagauuuuucuuuuucauugaaacuuuaaagguuauuauuggaaacauuacuuugagugcaguguuuuuaaaagccaauucuuuuuuaucccuuuuagaaguagaauuugcacacuuacuacaauugaggagugucaucucuauaacuuuuucuccgccuuugucccauucugccccuguacauguuuccuaccaagcauguuucacauuuuccuauuaguggaggagggagaaccauauuuauuuauaaugaagacaucuaagaucccuaugaugaaugcaggaacucucuugguaguuuguaaauacacaaagggaugugucgagggaugggagcgaugcuuaucucucacagugugaguggucugugugaggcuguuccuucaguuucuucuccagacuguucuuugguugucacuaagucagaggucuggucccucauguuuaggugaaagccagagaaugacagcuguagucauaucugagcauaagaccuugaugugugauuccugaugaccgguuucauuuauucauguuauaaagcaaagcccugguccuuuuuaaacuacuaguuuuaaaaaccuguguuaaaugaacaguaauugccugguagguuugguguguguguagcauuguguguccaucuguuauauguaaaggacaaggcaccagaaucaggcuuuauuucgauauugaagauguuauuuaacaucuuucuuuuuuccuuacucccuuagccauccccuccccuuuuguccuaucauucccuagaacaagccaccugucaauugugaaggguuguguucuuuauggcagguucuaugcagauugugccagagcaugugcguguucuguuggcaagccacagugcucccuugacugaagacauuuccagguagauuucucagccagcucuaaaacagauugcuuuuucaguggccuuacucuuuguggguuuuuuuuuuuuucucugaacuugauauaaagauuuuauuugucccuugaaaaaguaacaaaugugcauagaucaauuuguacuacuuuggucauuggauauuucugauccuuauugcauuguaccuaaaggagaguaacuaaugguaaccuuuuuaauagaguaugugaaagguaguggcugaugaauccuuaacguucauagggucuuuuugcuguuacgguuguauauagaggucugaaggauuuuuaaaaugauuugcacuuuuucacugcaugcuuacaauucccaaaggcaaaaucuguacugagguagaucauuugaaagggcuagauuauaaaauuaagccuuagaguauggaaaguucuuauaacaauaauaguacacacuucagaguaagacaaaugcaaagcaucuuaaggagugaaaauagaguguaaaucuugccuuuggcacuacaaggugugugugugugugugugugugugugugugucuuuaguaggaaauggaagaacacuguuuuauuuuuuaaaguguuuaauguuucuguccuuucugugaauuauugaauuuaagagcccugcuaaauaaugaaaaaacacuuuacuaaaauuuaucaaauuauacuggguucggauugugaaaacauuggccaccuaguagcaguggugaggagugggagggcccagcaagcauuuaucagaaauagaaucacaauaggaggagaauuugacugucugauauuaugauuugauuacaauacugaaugggaaaaguaucuaauauuuuguaacaaaaagaccuucauauuaucuguuuugaccaaaauauguagcuauuucccuuacacagauuggaccgcacuuaucucccuuguccuguauccuuuaauuucaggucucaggauguuuagaaagcuaaaacccccuaccccuuucuggcugaaaacuugccuuauuugguaucuuacacauuaauguuacuagcaucaggagcuuacuguuuuauuaugauucaucuucaguaauuuuuagaagcaagaagaaagccauuguguccucuacaauuaacaaaacuuaucucugauauacaaagggauauaaauauauacacuuaaauagagaaaaagagguugauugaauugugccuuugagugaacccaguuuuuaaauaccgcuguguuuguuucgccauggcuucagggaugcuacauggcucuugcaccuuuuacuccucugcuuuaugaaguuugaguuguauuugugcaucuuaaaguagguugaggcuugaggcugggcuuucggguuuuuuuguuuuuuguuuuguuuuguuuuguuuuguuuucuuguacuuaaaccugcuugcuuccuaccacagauucuuuauuuucccaaacacuacaaaaaaacuuuuaaaacuuugccauuucaucuguuuacacucuuugccacugauuagcaguauuuaaaucuugcaagaauauuuugugcuuucuuuagaaacacaagaguauagauuuuucucacugaaaagugagaguuacgcauugcagccaugaagggaugcuaggaucaauuauggcaguaccuuuuuuccccuccuguucuugagccaguugucucuuuuguuuugggucccacuuaggauuaauggauguaagguauuuuccugugccuuuauuuugugucauucuauuggaaggagguguaacggcagaauagcaucguguuggggguuuuccuucaaacacugcaagugauauugccaccaugugaaccucaaauaugcaauccaguuguguugguuucucggugacuuggaguguucaucucuucaugaauugugagcacugaccauguucuucaguucuuaauuauggugaguugacaaauaccaacuacugcuuuucuuuagguggcuauaaauuucuuacugucaggaggaaaugacauuauauucuguuccacugaacgucagagaucagcaggcacuguacuggguagagaagugccuauacuucucuaccuaagagggcaggagggaaacccuacagcuccuugugagccuauauauuaguauaucggccuggagaggacaagggaauaagaccacucauagugaggcuggccaagcugcacuggucggaccaggcaguggcugaccuaaggaagacaacuugcuuugcuuaaaaguagauuuuuuaagcaaugcuuaacacaggcagcauucaccuuuguucaggccaucgacauguauuguuaaaauuacugcauaucccccucagauaucaaguauacacuguucauguugggguuguguguguguauguguguauguacgcacgcaugugucccaaaucuuguuuuaauuuuuuuuuucugaaugugaucauguuuuggaugauaccugagcaggguugccuuuuuuuuauuuauuaccauuauauauuauauuauauuauauuauauauuuuuugcuuucuuauaacuuuggaggaaagucaaaucuugguauuauuaaaauuguuuuaaaaaggaguaaauuuuccaguugauaaaugaaaaucacuggccuauguuuaauaaguuuuucuuuaauuacuguggaauaacgugccagcuaucaucaacacaaugauuuuguacauaggguagggaagcagugaugcucucaaugggaagaugugcaacacaaauuaaggggaacuccauguauuuuaccuacuucagcaauggaacugcaacuuggggcuuugugaauaaaauuuagcugccuuguauagucguuugaaagaauaugugaucugugagagaauuauaguuuuuuuuuagaagaaaaaucugcaaaagaucuuuccaaagacaaugugccacagaucuuuuguucucuguaaugaggauuaauugcuguuuaaacaaaaauguaauuguucaucuuuaaauucuuuccuuuucauaagaggaucaagcuguaaaaaaacaaaaaaauuaauaaaaauuucgagaaaucauuggg

SEQ ID NO: 21227 - RNA, 7621 nt, Homo sapiens
cagcagcagcaggaggaggcagagcacagcaucgucgggaccagacucgucucaggccaguugcagccuucucagccaaacgccgaccaagguacagcuucaguuugcuacuggguugugcauucagcugaauuucauggggaaguccaaauucuaaggaaaaauauuuuuaauuguaaugcuguuaaacagacuuaaauuuucuagccuuuuuaauaagcagauuagauacauugcaggucuccuggaacaaaggugucuagauauuuugaaugccaaucaaauuuaaaacuuaaaaauacuuccacuggguccucaaaagaacggaaaccaccgaugcuaaucagaaaauaguaaaauuaaauuccccuuuggaauaauuauaccuauauaauuuucagugggugacugugcaggaauuuaaaagaaaagggaucuuuuaugcuaauuaaaccaauuacaaugcuauuuuuuaaaugauguaucucacuuuuaaggggaagaaaacccuuucugaauaugccacugcuaaauuuagcuguuaaaauauucaccaagauaccuguaugacacuguguaggcuuauuauuacaaauagaaaagcuguuggcuauuuucaauguuuuccuuugaauuucaaauuuuuagaacaucuuacuuaaauaacaaauuucagagauaguuugauuucaccuaaguagcaccuacuugauaauuaagcuaaaagucacauuuaaaguacauguuggaaaaauggauaaagcaaauuuuuuucauuuuuuucugugaguuuuuucuucucuaaaaaauauucccauacuagcuuauuaauauaauuaaguuacuguugaucuguuuguagguuuagagagcuagauauauaagguaguaaugguauaauuucuggaacucuaaauuuuaaaguugaauaaauacagacuugcaaaauuucccuuucccuugccuaauagugaaagauggauaauagguggcaauauaaauauuaacuugaaagacuauaauacuaaaaagaaaaggcaucucuaagaaguagaaaagauucuauagaaaauauauuuuauuugugaucauuuuguaaugugguaguauaaaaagguaucacuguuguaaccuaugaagaugucagcuauuccuuaugaaauauuuugcaggaaaacucacuaccaugagaauugcagugauuugcuuuugccuccuaggcaucaccugugccauaccagugaguacaguugcaucuuaaagaaaauuccugaaaauaacugaauugugugcuuccaugugcuaggaggacauucuuguaaucuuucuucaucuuuucuguuucuaagguuaaacaggcugauucuggaaguucugaggaaaagcagguaagcaucuuuuauguuuuuauauaguuaaaucauuuacucaauuauggcgagaggugcaagaaacguauuugcugcgauauuacuuaucuucucagucaaauccauugguuuacaaguauugauugacugccugcuaugaaucuaggccaguaccaagcacaguauaguuuuuaauaaauauaaguuuauaaaaccaacccagauauuuuaaauauaauaauaucuaggcauguaugaugaguuaucgcauguaagauaaguuauaugaaguugugugacuuuuuuuccauuaguccacauacugaucuaaaagcagaaaauuccagcuuuugcuuuguuuaguggauugcuaaguuuaaaauucacauuggauauuagucagaacuguuuguaugaccauaauauucacaauauugucugagauauuagcugagaagcccauugugaaaagaaagucuaugugugcuguuuguaucuauugugauugucagcugauguuagaucacauuuucuaaccaaacauaagaccaaccaaacucuuuauuauaauuauuugaccagcacuaaagauguaccuaccccuccacaacagaugaaacugugccagccaaacaacaaaugggcauuguccccagaagcuuggacaaaaaggcacacagaguucaauuccaguugaacagaauaaaggccaaaauagagcugccuugggggucacugcaauuagacugcuuaaugaagacauuaaaagaaguauucuguguucguuuguguguggaggggugugugugucuguuuuucaacugauuugaaaauacagguguugaauccuaauaauaaaccagaaaaauuaacaucuccagagaagauagaggucauacuauuugaggcaagaauuagcgucuuuuuaauaaacgaaaauauggcaaagaugcauuuuagaaggcacguggagcuauaacaauuuaagaaauacgugaagagcucaaggcucagccuucuagaaucccagaaacuuaaagcuaguaaaaaauuggggaagucucuaaggauauaugccugaaaauacacacugguuaucugugaguguuaggauuacugggugguuuuuagucuauucauuuugcuuaccuuuauuuucuucauauuaguuuuuaaaaauuauaaauguaacuuauacauccauucucucugagccuguauuacaugugucaugagaauagauagauagauaugaaaaagugaagagaaaaacucugaacucaucuggucucacuguuuuuccgccuucuuuuuuuuuuuuuuuuuuuuuuuuugagacggagucucgcuccgucgcccaggcuggagugcaguggugugaucucggcucacugcaagcuccgccucccagguucaccccauucuccugaguagcugggacuacaggcgcccgccaccacgcccggauaauuuuuuguauuuuuaguagagacgggguuucaccguguuagccaggauggucuccaucuccugaccucgugauccacccuccuuggccucccaaagugcugggauuacaggcgugagccacugcgcccggcuguuuuuucaucuucuuaaagcaaggaaccccuucuuucagcaaaaccuuucggagaagcccaauacuaagcuccucugguuagagccagccaugagagaaacuccaaguacuucugacugguucucucucuacucauccaccccuuagguggcugcagaaggaacucugugcaacccccagaguucucauucucagugacagggaaauguaaugauuggcccuggaugauucagcagaucagaugauacuuacucagagcaauuuccacuccuuugcaguagcauauuaucaguauuuuccagauaaauaacuuggcuaaagaaaaauccauuucauuuacaucuuuggcaccuuacagcaauagaacuuuugugcaaugauuuuaauauuauauuucuacauuggcugauaagauacauauggcuauugagcacucaaaaugugggcuagugcaacugaggaacugaauuuuuaucuucuuuuuuuuuuuuuuuuuuuuugagauggagucuugcucugucacccaggcuggagugcaguggcgcaaucuuggcucacugcaagcucugccuccuggguucacgccauucucuugccucagccuccccaguagcuggggguacaggugccugccaccacgcccggcuauuuuuuuuuauuuuuauuuuuuuuaguagaaacgggguuucacuguguuagccaggauguucucgaucuccugaccucgugauccgccugccucggccucccaaagugcugggauuacaggggugagccaccgugccuagccauuucauuuuaauuaacuuaaauuuaaauagcuccaugugguuagaggauacugaauuagcacagucuuagagaguuccuucuuguuccauggacuggacacaaugaagauuaacaguaauuaaggucacuucugguuuagaugugcuuuaucugagaggaaaauucagccagcaaacauacaaaaagaaagcacagugugaaguucgguguuaagagcuaguuugccugcguuugaacccugccuggcucugccauuuccuaccacuuaacugcacuguggcugaguuuucugaucuguaaggugggaauaauaaugauaccuaucucauaggggaaugaaaggaucaaaugaguucauauuuguaaagcaauuugaaagagugccuagcccacaguaagugcuacauaagaguuuguuaaaugaaucugcaaaaaaaaaaaaauuacaaaaagguaccuaaggguccgggugacuauaugcuuccaucaagacuagugaagaaugguuguuuuuuccauucaucccuacauuucuuuuuuuaauaaugauaaacaugcaacuuuuuuguagcuuuacaacaaauacccagaugcuguggccacauggcuaaacccugacccaucucagaagcagaaucuccuagccccacagguauuuuuaaacuucucauaauuaaacuacagugaugaaagauagccacacucaggccauuugggcugcucagaugaauccugccugccugcuggcaaacaugugcuuaggacauugacugaucugccauguuggcuucucucuguguuaagccauccacagaugaggcugaaaaauaaaaacugcuuuggauuaaaaagguuaacuuuugaauaaaaaagcuaggcaugugugaugcgcacuaacacgugccauuccuucuucagaaugcuguguccucugaagaaaccaaugacuuuaaacaagagguaaguucucauuuucaaucagaggcccaucaugccuugaagagaugaaagaaggcauugccuggauucucuucugaugaaauuucauuagcaaguuuuccagcuaauuggcagucuaaaacuugcucauaaauaaaacauguauuuacuaaauaucagaaauacuagguuuccucggauaaguuuagcauuacagaagauguuuauuaaugccuguuauuugaaacauuaaucugcuugcaauuuauuuaagguauuuuguagauaucuaauaucuaauaagcaucuaauuaaugcauaucaaagcuaagauuuugccuuuaggaaaguuuucuuuccuaauaaaauaguuuauuugacaacuauucuuuuuauuaggaucauucauauauuugcuaagcaaagaguaaauuuauuuuccuuaagauucaauuugaauauacuaagaauauuaaagcaaguuagauaaauuacccaauauauuugucaauuugaaauuugauagacauuaguuguuuaauucaaugggcaguuuugagcugcaguuuauacacacaugcauaacagagucaccuuucaauuauccauguuaauaggaaagugguuauagauuuuaguacacacauuaaaauauggauacucuucucuuuugauaaaucucauuucaaauaaaaaaaccagucucauaauuauguaucuguaucuauuacaucauugaauuuaguaaauaauguuuaauauguauaaggaaaaacaauguuauugacaugaagauuauacucacauauuuggcuugaaaauaucuauaaaaauaauuucuguugcaaaguaagaaauguucuucagaauguuauuaaucccuguguuaaaagagaaauuggaagaugcucacuuuagcuccuaaaagccaugguauguacugugaaugcaaagauucugaaacuaaauaaaaagaaagauaguaaaagacuaaugugcuauaaaggcuaagggaaaauaaaaacccauauauuaauuuucccggccaucuuaauuuucagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccagguaaauccuuuaacagacacaccugaugguucugacuagcgcucaagucuaggaaaccacaguuugcauauucauucauucauucauccauucauucauccauucagcaagaauucauucauauucuacuuuaugaccauugaauacaaaucuuuuucugcuuggcgguuuuuguaagucuacauaauuucucucuagauuugauucucaaacacaauucuacuuuuugaaauccuggaucacuuauuuucagauuaaaauaaauggaaaacaccaauuauuuaaaaaaaauaauggucauguuuugaaguuaaauaccuaagaggaauuguaguugcaaauuacacugaauccuuagucacagaaucuggauuugacauagccuugccguuuacuauucucuuuacuuuuuaacuaacaauucacuuccucuuuauguagguuucaauauaaugaaaccuaccucauagguuucauuacauauguaagugauguaguuauuaaacuaaaugagaugacauaugugaaaggccuugguaaaguacuauacaaaguaacaugcuaguauuauuucagccagauuuagacaauuuuuaguauaagaugaccuaaaagcuagagaguggaaaaggauuaccauauucccaucccuagccguucauauaauuauucuucauuugugccgugauucaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaaua

SEQ ID NO: 21228 - RNA, 7621 nt, Homo sapiens
uauuacauucaagauaaaagauuuauucacaccacaaaaagauaaucacaacaaaauauacacuaacuuaaaaaacaaaagauuauagugacauaaaauguuauauucucuuuuuaaguggguaaaaguauuuuguuugcuucuacauaaauuucuauucaugagagaauaacaaauauuaaaauacagugauaguuugcauuucuucuauagaaugaacauagacauaacccugaagcuuuuaguuuacagggaguuuccaugaagccacaaacuaaacuaauuaucaaacacauuaguuauuuccagacucaaauagauacacauucaaccaauaaacugagaaagaagcauuucauguucucuuucauuuugcuauaaagcauuuuuucuuuugacuaaaugcaaagugagaaauuguauuuuuucuccuuuuaauugaccucagaagaugcacuaucuaauucaugagaaauacgaaauuucagguguuuaucuucuuccuuacuuuuggggucuacaaccagcauaucuucauggcugugaaauucauggcuguggaauucacggcugacuuuggaaaguuccugacuaucaaucacaucggaaugcucauugcucucaucauuggcuuuccgcuuauauaaucuggacugcuuguggcuguggguuucagcacucuggucauccagcugacucguuucauaacuguccuucccacggcugucccaaucagaaggcgcguucagguccugggcaacggggauggccuuguaugcaccauucaacuccucgcuuuccaugugugaggugauguccucgucuguagcaucaggguacugaaucacggcacaaaugaagaauaauuauaugaacggcuagggaugggaauaugguaauccuuuuccacucucuagcuuuuaggucaucuuauacuaaaaauugucuaaaucuggcugaaauaauacuagcauguuacuuuguauaguacuuuaccaaggccuuucacauaugucaucucauuuaguuuaauaacuacaucacuuacauauguaaugaaaccuaugagguagguuucauuauauugaaaccuacauaaagaggaagugaauuguuaguuaaaaaguaaagagaauaguaaacggcaaggcuaugucaaauccagauucugugacuaaggauucaguguaauuugcaacuacaauuccucuuagguauuuaacuucaaaacaugaccauuauuuuuuuuaaauaauugguguuuuccauuuauuuuaaucugaaaauaagugauccaggauuucaaaaaguagaauuguguuugagaaucaaaucuagagagaaauuauguagacuuacaaaaaccgccaagcagaaaaagauuuguauucaauggucauaaaguagaauaugaaugaauucuugcugaauggaugaaugaauggaugaaugaaugaaugaauaugcaaacugugguuuccuagacuugagcgcuagucagaaccaucaggugugucuguuaaaggauuuaccuggaugucaggucugcgaaacuucuuagauuuugaccucaguccauaaaccacacuaucaccucggccaucauaugugucuacuguggggacaacuggagugaaaacuucgguugcuggcagguccgugggaaaaucagugaccaguucaucagauucaucagaauggugagacucaucagacuggugagaaucaucagugucaucuacaucaucagagucguucgagucaauggaguccuggcuguccacauggucaucaucaucuucaucauccauaucauccauguggucauggcuuucguuggacuuacuuggaagggucugaaaauuaagauggccgggaaaauuaauauauggguuuuuauuuucccuuagccuuuauagcacauuagucuuuuacuaucuuucuuuuuauuuaguuucagaaucuuugcauucacaguacauaccauggcuuuuaggagcuaaagugagcaucuuccaauuucucuuuuaacacagggauuaauaacauucugaagaacauuucuuacuuugcaacagaaauuauuuuuauagauauuuucaagccaaauaugugaguauaaucuucaugucaauaacauuguuuuuccuuauacauauuaaacauuauuuacuaaauucaaugauguaauagauacagauacauaauuaugagacugguuuuuuuauuugaaaugagauuuaucaaaagagaagaguauccauauuuuaauguguguacuaaaaucuauaaccacuuuccuauuaacauggauaauugaaaggugacucuguuaugcauguguguauaaacugcagcucaaaacugcccauugaauuaaacaacuaaugucuaucaaauuucaaauugacaaauauauuggguaauuuaucuaacuugcuuuaauauucuuaguauauucaaauugaaucuuaaggaaaauaaauuuacucuuugcuuagcaaauauaugaaugauccuaauaaaaagaauaguugucaaauaaacuauuuuauuaggaaagaaaacuuuccuaaaggcaaaaucuuagcuuugauaugcauuaauuagaugcuuauuagauauuagauaucuacaaaauaccuuaaauaaauugcaagcagauuaauguuucaaauaacaggcauuaauaaacaucuucuguaaugcuaaacuuauccgaggaaaccuaguauuucugauauuuaguaaauacauguuuuauuuaugagcaaguuuuagacugccaauuagcuggaaaacuugcuaaugaaauuucaucagaagagaauccaggcaaugccuucuuucaucucuucaaggcaugaugggccucugauugaaaaugagaacuuaccucuuguuuaaagucauugguuucuucagaggacacagcauucugaagaaggaauggcacguguuagugcgcaucacacaugccuagcuuuuuuauucaaaaguuaaccuuuuuaauccaaagcaguuuuuauuuuucagccucaucuguggauggcuuaacacagagagaagccaacauggcagaucagucaauguccuaagcacauguuugccagcaggcaggcaggauucaucugagcagcccaaauggccugaguguggcuaucuuucaucacuguaguuuaauuaugagaaguuuaaaaauaccuguggggcuaggagauucugcuucugagaugggucaggguuuagccauguggccacagcaucuggguauuuguuguaaagcuacaaaaaaguugcauguuuaucauuauuaaaaaaagaaauguagggaugaauggaaaaaacaaccauucuucacuagucuugauggaagcauauagucacccggacccuuagguaccuuuuuguaauuuuuuuuuuuuugcagauucauuuaacaaacucuuauguagcacuuacugugggcuaggcacucuuucaaauugcuuuacaaauaugaacucauuugauccuuucauuccccuaugagauagguaucauuauuauucccaccuuacagaucagaaaacucagccacagugcaguuaagugguaggaaauggcagagccaggcaggguucaaacgcaggcaaacuagcucuuaacaccgaacuucacacugugcuuucuuuuuguauguuugcuggcugaauuuuccucucagauaaagcacaucuaaaccagaagugaccuuaauuacuguuaaucuucauuguguccaguccauggaacaagaaggaacucucuaagacugugcuaauucaguauccucuaaccacauggagcuauuuaaauuuaaguuaauuaaaaugaaauggcuaggcacgguggcucaccccuguaaucccagcacuuugggaggccgaggcaggcggaucacgaggucaggagaucgagaacauccuggcuaacacagugaaaccccguuucuacuaaaaaaaauaaaaauaaaaaaaaauagccgggcgugguggcaggcaccuguacccccagcuacuggggaggcugaggcaagagaauggcgugaacccaggaggcagagcuugcagugagccaagauugcgccacugcacuccagccugggugacagagcaagacuccaucucaaaaaaaaaaaaaaaaaaaaagaagauaaaaauucaguuccucaguugcacuagcccacauuuugagugcucaauagccauauguaucuuaucagccaauguagaaauauaauauuaaaaucauugcacaaaaguucuauugcuguaaggugccaaagauguaaaugaaauggauuuuucuuuagccaaguuauuuaucuggaaaauacugauaauaugcuacugcaaaggaguggaaauugcucugaguaaguaucaucugaucugcugaaucauccagggccaaucauuacauuucccugucacugagaaugagaacucuggggguugcacagaguuccuucugcagccaccuaagggguggaugaguagagagagaaccagucagaaguacuuggaguuucucucauggcuggcucuaaccagaggagcuuaguauugggcuucuccgaaagguuuugcugaaagaagggguuccuugcuuuaagaagaugaaaaaacagccgggcgcaguggcucacgccuguaaucccagcacuuugggaggccaaggaggguggaucacgaggucaggagauggagaccauccuggcuaacacggugaaaccccgucucuacuaaaaauacaaaaaauuauccgggcgugguggcgggcgccuguagucccagcuacucaggagaauggggugaaccugggaggcggagcuugcagugagccgagaucacaccacugcacuccagccugggcgacggagcgagacuccgucucaaaaaaaaaaaaaaaaaaaaaaaaagaaggcggaaaaacagugagaccagaugaguucagaguuuuucucuucacuuuuucauaucuaucuaucuauucucaugacacauguaauacaggcucagagagaauggauguauaaguuacauuuauaauuuuuaaaaacuaauaugaagaaaauaaagguaagcaaaaugaauagacuaaaaaccacccaguaauccuaacacucacagauaaccaguguguauuuucaggcauauauccuuagagacuuccccaauuuuuuacuagcuuuaaguuucugggauucuagaaggcugagccuugagcucuucacguauuucuuaaauuguuauagcuccacgugccuucuaaaaugcaucuuugccauauuuucguuuauuaaaaagacgcuaauucuugccucaaauaguaugaccucuaucuucucuggagauguuaauuuuucugguuuauuauuaggauucaacaccuguauuuucaaaucaguugaaaaacagacacacacaccccuccacacacaaacgaacacagaauacuucuuuuaaugucuucauuaagcagucuaauugcagugacccccaaggcagcucuauuuuggccuuuauucuguucaacuggaauugaacucugugugccuuuuuguccaagcuucuggggacaaugcccauuuguuguuuggcuggcacaguuucaucuguuguggagggguagguacaucuuuagugcuggucaaauaauuauaauaaagaguuugguuggucuuauguuugguuagaaaaugugaucuaacaucagcugacaaucacaauagauacaaacagcacacauagacuuucuuuucacaaugggcuucucagcuaauaucucagacaauauugugaauauuauggucauacaaacaguucugacuaauauccaaugugaauuuuaaacuuagcaauccacuaaacaaagcaaaagcuggaauuuucugcuuuuagaucaguauguggacuaauggaaaaaaagucacacaacuucauauaacuuaucuuacaugcgauaacucaucauacaugccuagauauuauuauauuuaaaauaucuggguugguuuuauaaacuuauauuuauuaaaaacuauacugugcuugguacuggccuagauucauagcaggcagucaaucaauacuuguaaaccaauggauuugacugagaagauaaguaauaucgcagcaaauacguuucuugcaccucucgccauaauugaguaaaugauuuaacuauauaaaaacauaaaagaugcuuaccugcuuuuccucagaacuuccagaaucagccuguuuaaccuuagaaacagaaaagaugaagaaagauuacaagaauguccuccuagcacauggaagcacacaauucaguuauuuucaggaauuuucuuuaagaugcaacuguacucacugguauggcacaggugaugccuaggaggcaaaagcaaaucacugcaauucucaugguagugaguuuuccugcaaaauauuucauaaggaauagcugacaucuucauagguuacaacagugauaccuuuuuauacuaccacauuacaaaaugaucacaaauaaaauauauuuucuauagaaucuuuucuacuucuuagagaugccuuuucuuuuuaguauuauagucuuucaaguuaauauuuauauugccaccuauuauccaucuuucacuauuaggcaagggaaagggaaauuuugcaagucuguauuuauucaacuuuaaaauuuagaguuccagaaauuauaccauuacuaccuuauauaucuagcucucuaaaccuacaaacagaucaacaguaacuuaauuauauuaauaagcuaguaugggaauauuuuuuagagaagaaaaaacucacagaaaaaaaugaaaaaaauuugcuuuauccauuuuuccaacauguacuuuaaaugugacuuuuagcuuaauuaucaaguaggugcuacuuaggugaaaucaaacuaucucugaaauuuguuauuuaaguaagauguucuaaaaauuugaaauucaaaggaaaacauugaaaauagccaacagcuuuucuauuuguaauaauaagccuacacagugucauacagguaucuuggugaauauuuuaacagcuaaauuuagcaguggcauauucagaaaggguuuucuuccccuuaaaagugagauacaucauuuaaaaaauagcauuguaauugguuuaauuagcauaaaagaucccuuuucuuuuaaauuccugcacagucacccacugaaaauuauauagguauaauuauuccaaaggggaauuuaauuuuacuauuuucugauuagcaucggugguuuccguucuuuugaggacccaguggaaguauuuuuaaguuuuaaauuugauuggcauucaaaauaucuagacaccuuuguuccaggagaccugcaauguaucuaaucugcuuauuaaaaaggcuagaaaauuuaagucuguuuaacagcauuacaauuaaaaauauuuuuccuuagaauuuggacuuccccaugaaauucagcugaaugcacaacccaguagcaaacugaagcuguaccuuggucggcguuuggcugagaaggcugcaacuggccugagacgagucuggucccgacgaugcugugcucugccuccuccugcugcugcug

SEQ ID NO: 21229 - RNA, 1710 nt, Homo sapiens
agugacaggugguugcuuugaacuuuauuugagaaaaacagaagauaaauguaucaaaagaacacacagguggcgggggaggcacagccaguggcggcagcaggggugggcauccgggcuaaggcuuuacuuggcggcagucucaucggauuuugcagcuucugggcccccaagcugggcccgcgacucgaaggugacugggauggugaucucguuggacugcguggcuagcuugggcaugggggccuccacggucagugugcccucaggggacagggaggaggaaacuugggugggguccacaccggggggcagccuggacgugcagagaggaaaggcaagcguuacauuacacaccgggugggucccugugcccucuucccugaccccacccccacgccacccacccaccccgaccuggcgccaggacucacguguauuuccgcgugaagcaccgggagauguagccaugcucguccugccgcuccucgugcuugccuuuggggggaagagggaaaucagacugcgggggaggggacugccuuucggccccgcuaggccagaggccccaccuccugcuuggaagcagccaggacugcaggcugguagggauuaacagaggggguuggggaugggggcgugcccgccggucugggcucucagaaacuuccggaaaguucuucgauucagaguuuugggaggaacggagcagggcgcggagcuggggagugagcaguacgcaggcgcacuuggagccgcgcacacgcccacucagcggcuagaaacuggcaccgcgccagggaacuccccgcuuaucuggggauggggcugugggugggaaggggacucuguagaaaagcgcauuuucucucuucaucgaugaucuuuaaaaaaauuuuuguuugcuuuuuuuuuguaauggcgcggggucggggcgggggggcgcgucucgcuauguugcccaggcuagucuugaacuccuggccucaagcgauccucccgucucggccucccaaagcgcugggauuacagagcagaaagcgcccuuagaagcgacccgcacucccaauuccugagcaagggaaucaggaguccuguuuuucccggugcugggccaacguuuaacuccccaggcccccgggacccccguuucaaccgcacgcccccggcccugcccgcccugcuagccuccuccucuccccugcaggagcaggggggcucaccggugaucuccaccacgccauccuuggucuugaccgucagcucguccggggcgaagugguugacauccagggacacgcgccagcgguccgcagugugccggaucuccgagaccccgcugcugaguugccggcugagcgcgcggcuguaggcgggcgcggccacugcggggcucucgauggcggcggggggcagggggcgcacguagccuggccagcugcugccgccuaaccacugcgaccacuccuccggcagccggggcagcccgaaggccuggucgaagaggcggcuaugcggguaccagucgcggaaggggucccagcuggggccccgcaggagcgagaaggggacgcggcgcucggucaugcuggcugacucugcucuggacgucugcucagaaaagugcggggcgcugggcucggcugcgcuuuuaugcuccuccagucggguauuuuuagcaggcgguguuugaggucucuauuaauggca

SEQ ID NO: 21230 - RNA, 13386 nt, Homo sapiens
gggauuuggcgccccccuccucggugcaaccuauauaaggcucacagucugcgcuccugguacacgcgcuucaacuucgguuggugugugucgaagaaaccugacugcgcccugaggagaacagcggagaagguccaccgagccuggcgaaagguccgcugagcgggcugucguccggagccacuccgggcugcggagcacccaguggagaccgcgccuggcucaggugugggaccccauccuuccugucuucgcagaggaguccucgcguggugaguaugcggugaggacguuuuuuuuuuaaagaucacguucauuccccgugcuuaucgggagcugcgggagauggaguagcaccccagaaugucuccacgcaaaacuugucacgccuucacuggcuguaccccaaaacaaauggggaaaccaagccuuaaaggcuuggguuuccaggaccaaguccagauacgggcuguagacagagaugagcugcggacagugaugagcugcagacggucaggagcuauagaucgauuugcaauuugcucuucaaaugcgcuaccaagugccaugcuuuacaaacagauaagcgcuucaaaugcgcuacaaacuggcgcuucagaugcgcuacaagcacgcuucacgcgggcgacaaacugaugggagcuacaacuggcgcuucauugcgcuauaaacugaugggcgcuuuaugugccacaaacugacggaugggcgcuucaguggcgcuacaauccagaacgaggagcagcgauauaggagcugcagacagaaaacugaauugcgcuuuacaugcgcugcaaaaucugagcugcagaagaguagcacuacaaaaaacgcuacaaaaacgaugcgauuagccagcccgacaacagcgcuucauugcgcugcgaggcacaugaacugcagagguacaugagcugcggaacaauucacaccuaagaugcacuacaaagugguaagagcugcagagguacaggagcugcagaccguuugcgcuacaaauaaagcagccguagugggacaugagcugcggaguacaauuccucuguuuucuuggagcaggaccccacccuuucaccuuuuggaauggcucccacucuauuuuucugcaggacgguucucgcaugauggugcugguagacaaaauggagccccgggcaaaaauuaguguuuaacauucugcccacaccauucccgcuauagcaguggaguggaggggcacugauuggaguggaaaugggaaucuuuuggugauggcagagcaggcugccugccuacuugugcuugauugaaguggcgguguaguugugguggcgcgaaucagcguccagcaacaguuuguggaaacuguggguuugcugaguauggcgggggaauuggaucuguggauugcucuugcugcaugaaaugaaucuggcuuuggugacuggugggagggguuugggaggggggauucuggcggcggggggggggggugugcagauacucugcagcccuguagcagccagucucaggccugccccgcccauccuagugugccuucucugcggugcuuagcgccuccuccuacagcgccuccucagagcgcgccuccccugcagcgcgccuucccagagcgcgccuucuagaugcggccuccucaggccccuccucccagcuccuuagcgccugccugcccaggccccaccucucucuggccaccucauucugaggugagcugcucaggccccgccucuuccaggcccgccuuuucuguggugagcugcccaggcccugccucucccgggcccaccuacucugaggugaacuguccaggccccgccucucccggggccgcccccucugaggugaacugcccaggccccaccucuccugggcccgccuccucugaggugaacugcccaggccccgccucuccugggcccgccuccucugaggugaacugcccagaccccaccucuccugggcccgccuccucugaggugaacugcccaggccccgccucuccugggcccgccuccucugaggugaacugcccaggccccgccucuccugggcccgccuccucugaugugagcucacccagaucccaccuccccaggcccgccuccucuuagguagccugcucaggccccgccucuccaaggcuuggccccucccuaagccugccucugccgggcuggccuauagucccaccucccucagagccggcuagcacacaugcgcagugugaacccucagccccucccuucaggcgccgguccucugcaccugcgcaccuuccuugccugagcccuggcuguacagccccgccccccugcgguuucucugcuguguugguuuugcuuuuuggcuacuagagucuaauagaauaauaaauaaaacaauuaacaauaauaauuauaacuggaauuuaugagcacuuuuaauauguucuuugcauauauucaauaacauaaucccacaauuuaaacuccugauaguggcuuaugaagggaccuuguaaacugacauggcuggugccucuaaaggcaauuuagccaaauguuuuuacugcaaaugaaaaccaaaacuuaacaauuuauuuuuaaaaacuuuaaaaauauuuucacauuuaagguuuuuuuagaggcacuaguggaccuuugggaaucggauguuuugguggauacaaaauuggugcuguugguuuggccucugagugaggauaaggcuuuuauuugcgugccuaugaagcuggguguuuuccuugaaucucuaggugauuaacccuagccuauuugccuauguauaauaaauugugccugcacaugguaggcauucauuaaauauguguuaaaugaccagaguaaauugguuuauucagugucuugcuuggugucuguaggucucuucugauuugcuccuuuccuauggugcuuugcuguccuggguugccuuguuugcguuaucucucacauuuaacagaauaaaaaaaaaguguauguguuuuuaaacuccaaugauauaagcuguaauuauaauacaaagcaacuaaauuaauuuuaauuauuccaaauaauuagcuuuuuucauaaaaagcuaguuauuccaaauauuagcuuuuuucaugaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaauuuaaauuuggggcaaguguauuauuaaugguacauauuguauuaaaguuuguguaauguaauauaaaguggccacauuacaaaauauagguuguuucagcuugcaaaauuaaacaacuguauaaaacaaauuuauaacugauugcuaguaagagguaccauguaagaauuguguuuccagcugaaugaagaaauuuuaaaaccugguuccauauauuacaaaucaugagccaggacuuugguaggggaggaauugggggcuuuggcucccaaaaaucucugucacauacccccuccccaccacaaguacacaaucuauggaaaauuugugcuuaucauaauuacagcuuuaaguaauuuucccuucucuuuggauauuguauauuugcauauugaagagguucaaaacaacaguaauaacaugcauauuaagagaauuugcauuucauaaauaguacaagauaguacuaaaaaauuggacauuugaaaauaugaagcaacuaagaguugcuuaaugagaugucauuuccuaacaggauguucauuuaugguuuuuggcuacuauugcucuuugguguguuuguggaauagaaauuauuccaagcuauugugaagagucaauaauuaaccaaauguauuuauuuccuaaaaagacuaaaacugaaauuauuaucauguaaagauggcaucuguccuaggcaacuuggcuuuaugcaguuuguccuuucaguuuucaggaaugagaccucuugaccccuccccuccaaugcagccccuacuaagggggaguuuaaggagccauacauaguucuauaauucaaaucaaguaaacaugcuucuugucccagguuaacuugugcugccucagucgcuguuuaaacauuuuuauacgcacuguuaaccugccugcccauuacccuauuacuuuuaauggauaaacuacuguucccugggcaguugucucuuuuaacgucccacccuaaacuugccaacccucauaugaaggccucaggcuuguuauuggcaaaggucagaagucuuaagcuagugaccuugcaggcuaaaguaggccuugaauuuguuugaccaggaacuaaauuaaaaaauaaaaaagaaugaaaugucugguggcaggggggcagggguggggagggugguaagggggagggcaugcacccccaaguuccauuguugcagccccucccaucuuaacucuggucucuuuucacuuuucaacuaccuuccuuauauaccaaagguauuugaauuuuuaacucuuauugaucuuuuauuucccuaaaccauguaguaauuauuugcugauuuccuaauguauuguuauuucugucccaucacuguuuuuugcagauaauaaaaccaucagaccugggcuucaauaaagccccacuuaguggccgugauugacaaguggucaggcugcaccaggccaugcugugaaugcucuuuaggaagucuugucucaagguuuugaagauauuaaugucuagaugacaaaagugguaccuuagucaccuuacuuaugguuauuaguuguucauuaaugggacaugaaaacuccuaauuuaauaaggaaaaauugcauuauguugugauguuauauugucagggucagcaauacaauugucuuuaaggaguuggaaaugauacugaaugucacggguuaugauguguuuauuguguuuucuaauuuuuucuaaacuugaauauuuuaucuugaaugucaauuauuuguuguuuuuauagccuaaguuacuaaaguaauuaaguagugggguuaaaacuguuaaaaugucacacuacucccugucucuuaaagacccugcuugcuguauagccacuccuuggagaggcuacaccaacugcaaaggacacagggauaguaucuguggguggugacauuggggcaugggagguaccuaaagaguuuaggaguuggagaggaaggagcauuucuuuacagccaggggcugggcaucauguuuaauuaccacuuuuuuuuuuucuuguacucuauugguugaaaauaguaacuauuuuucaccuaacuucucuaauuaccaacuguguaucuuuuuggccuuauucuauguaauuuauuuggcguccauuuuugcagguaaaucacauagugaguauccagagaggaccaacuuauguauuuaaacuuuuguuuauuuaaaaguuuuauaaacuuucuuuaaaaguuuuaaacuuuuuaaaucaaaguuuuuuaaacuuuuuuaaacuuuuacauauuauguuuuaaacuuuuuauauauuuaaauuuuccaaauaugggacuugagauuauuaauaaaauuuaaaauaauuaaaucauucuaaaugcauuuaacuguauuuucaggaaguacacaggcagacacugugucaggauuuuuaugugugugauugucauuacacucauaauuagaaugcuuaaacacacacccuacccccaccuccccacacacauccacucacccccuaggagugcagcccugucccaccuuaacauuacaaaccuucauuuggggcuaugcugacaaaucuucauuaaaaacuauggauuacaaacugguaaacugcaagacaaauaaggccuugaauuuguuugaccaacacaguauuuuuaaaaaaguaaaugucuuuaggugggaaaugcaugcccauguugcuauaguugcagccccucccucuuuuaaucccacucuuuuuacacagauagucaccuuucuauuuucuaauuaauaacuuuguucauaucagcuaaccauuguugaauacucacuacauaauuuaccugcacuauuuaauuaaguccucauaauuaguuugagguauacuauuauugggcuucuuugaaugucccauuuuauagcuuuuccuaggaggcaucaauuauuauuucuugaaugacugcauaaugacaaaggaaacugacauacacauauugcugcuuagugccauuucugucccauagagaauuuucuuuggggauuuaaauuauggucagaaaaguaauuuaggcaguccugugguuuuugugguggugguuguuugauuugauaaccaguuaccuucucgguggcaguggaauaggguugugacaguuggccagaguacccuccugcccacagggcugaugaauacaugcauugugauuuuaauacucccuucuugcuuuaaugagauucuauuaguugcaguauuaacuauuuuuggccuggcuucuuuaauaacaaaaguuauuauuuuggcuuuaauuugcauaauugauuuuguauccauguuugccuugaaguuucuugcuguguuugaauacaaaacuacuuguuuagaggguuucaacauucuuuuauaguuuauaaagguaagcaugcuguugauaauguauuguugaaucauaaugaacagguggccuuugaggaagacaaggucauuugaacaucaaaaaguacuuugcuuuuuguuauauauggugcugauuacuaacuuucucuugagaguuuauuuucuuuguucacuaauuauuaauguaagcacguagagcaagggauaauuuaaauaccaaauccuuugugucugcuuuugcugcuuugaauguauaaguuggauuuauacauacauuuaucuuuauuuacagaaauaagcggguuuugaaaacaaaaaaaagaaggaguggaagagggggccaggauccaggccuccauccccacagaagugaagcuacagcugggaggucuccucccaccccaaccgucacccugggucccgacugcccaccuccuccuccucccccuccccccaacaacaacaacaacaacaacuccaagcacaccggccauaagagugcguguguccccaacaugaccgaacgaagaagggacgagcucucugaagagaucaacaacuuaagagagaaggucaugaagcagucggaggagaacaacaaccugcagagccaggugcagaagcucacagaggagaacaccacccuucgagagcaaguggaacccaccccugaggaugaggaugaugacaucgagcuccgcggugcugcagcagcugcugccccacccccuccaauagaggaagagugcccagaagaccucccagagaaguucgauggcaacccagacaugcuggcuccuuucauggcccagugccagaucuucauggaaaagagcaccagggauuucucaguugaucguguccgugucugcuucgugacaagcaugaugaccggccgugcugcccguugggccucagcaaagcuggagcgcucccacuaccugaugcacaacuacccagcuuucaugauggaaaugaagcaugucuuugaagacccucagaggcgagagguugccaaacgcaagaucagacgccugcgccaaggcauggggucugucaucgacuacuccaaugcuuuccagaugauugcccaggaccuggauuggaacgagccugcgcugauugaccaguaccacgagggccucagcgaccacauucaggaggagcucucccaccucgaggucgccaagucgcugucugcucugauugggcagugcauucacauugagagaaggcuggccagggcugcugcagcucgcaagccacgcucgccaccccgggcgcugguguugccucacauugcaagccaccaccagguagauccaaccgagccggugggaggugcccgcaugcgccugacgcaggaagaaaaagaaagacgcagaaagcugaaccugugccucuacuguggaacaggaggucacuacgcugacaauuguccugccaaggccucaaagucuucgccggcgggaaacuccccggccccgcuguagagggaccuucagcgaccgggccagaaauaauaagguccccacaagaugaugccucaucuccacacuugcaagugaugcuccagauucaucuuccgggcagacacacccuguucguccgagccaugaucgauucuggugcuucuggcaacuucauugaucacgaauauguugcucaaaauggaauuccucuaagaaucaaggacuggccaauacuuguggaagcaauugaugggcgccccauagcaucgggcccaguuguccacgaaacucacgaccugauaguugaccugggagaucaccgagaggugcugucauuugaugugacucagucuccauucuucccugucguccuagggguucgcuggcugagcacacaugaucccaauaucacauggagcacucgaucuaucgucuuugauucugaauacugccgcuaccacugccggauguauucuccaauaccaccaucgcucccaccaccagcaccacaaccgccacucuauuauccaguagauggauacagaguuuaccaaccagugagguauuacuauguccagaauguguacacuccaguagaugagcacgucuacccagaucaccgccugguugacccucacauagaaaugauaccuggagcacacaguauucccaguggacauguguauucacuguccgaaccugaaauggcagcucuucgagauuuuguggcaagaaauguaaaagaugggcuaauuacuccaacgauugcaccuaauggagcccaaguucuccaggugaagaggggguggaaacugcaaguuucuuaugauugccgagcuccaaacaauuuuacuauccagaaucaguauccucgccuaucuauuccaaauuuagaagaccaagcacaccuggcaacguacacugaauucguaccucaaauaccuggauaccaaacauaccccacauaugccgcguacccgaccuacccaguaggauucgccugguacccagugggacgagacggacaaggaagaucacuauauguaccugugaugaucacuuggaauccacacugguaccgccagccuccgguaccacaguacccgccgccacagccgccgccuccaccaccaccaccgccgccgccuccaucuuacaguacccuguaaauaccugucauguccuucaggaucucugcccucaaaauuuauuccuguucagcuucucaaucagugacugugugcuaaauuuuaggcuacuguaucuucaggccaccugaggcacauccucucugaaacggcuauggaagguuagggccacucuggacuggcacacauccuaaagcaccaaaagaccuucaacauuuucugagagcaacagaguauuugccaauaaaugaucucucauuuuuccaccuugacugccaaucuaacuaaaauaauuaauaaguuuacuuuccagccaguccuggaagucuggguuuuaccugccaaaaccuccaucaccaucuaaauuauaggcugccaaauuugcuguuuaacauuuacagagaagcugauacaaacgcaggaaaugcugauuucuuuauggagggggagacgaggaggaggaggacaugacuuuucuugcgguuucgguacccucuuuuuaaaucacuggaggacugaggccuuauuaaggaagccaaaauuaucggugcaguguggaaaggcuuccgugauccucucgcugcacccuuagaaacuucaccgucuucaaacuccauuuccaugguucuguuaauucucaaggagcagcaacucgacugguucucccaggagcaggaaaaacccuugugacaugaaacaucucaggccugaaaagaaagugcucucucagauggacucuugcauguuaagacuaugucuucacaucauggugcaaaucacauguacccaaugacuccggcuuugacacaacaccuuaccaucaucaugccaugauggcuuccacaaagcauuaaaccugguaaccagagauuacugguggcuccagcguuguuagauguucaugaaaugugaccaccucucaaucaccuuugagggcuaaagaguagcacaucaaaaggacuccaaaaucccauacccaacucuuaagagauuuguccugguacuucagaaagaauuuucaugaguguucuuaauuggcuggaaaagcaccagcugacguuuuggaagaaucuauccaugugucugccuccauaugcaucugggcauuucaucuucaguccccucauuagacuguagcauuaggauguguggagagaggagaaaugauuuagcacccagauucacacuccuaugccuggaagggggacaucuuugaagaagaggaauuagggcuguggacacugucuugaggauguggacuuccuuagugagcuccacauuacuugaugguaaccacuucaaaaggaucagaauccacguaaugaaaaaggucccucuagaggauggagcugaugugaagcugccaauggaugaaaagccucagaaagcaacucaaaggacucaaagcaacggacaacacaagaguugucuucagcccagugacaccucugauguccccuggaagcuuugugcuaaccugggacugccugacuuccuuuagccuggucccuugcuacuaccuugaacuguuuuaucuaaccucucuuuuucuguuuaauucuuugcuacugccauugacccugcugcaggauuugugucauuuuccugccugguugcugagacuccauuuugcugccacacacagagauguaagaggcaggcuuuaauugccaaagcacaguuugagcaguagaaaacaacaugguguauaucucaaauugccugacaugaagaggagucuaacggugaaguuucacuuuucaucagcaucaucuuucacauguucauuaucaucugcucuuauucuugcauguuuaaacacuuaaaauuuuuaguauaauuuuuaguguguuuugaaguggugacuaggcuuucaaaaacuuccauugaauuacaaagcacuauccaguucuuauuguuaaacuaaguaaaaaugauaaguaacauaguguaaaauauuccuuuacugugaacuucuuacaaugcugugaaugagaggcuccucagaacuggagcauuuguauaauaauucauccuguucaucuucaauuuuaacaucauauauaauuucaauucuaucaauugggccuuuaaaaaucauauaaaaggauauaaaauuugaaaagagaaaccuaauuggcuauuuaauccaaaacaacuuuuuuuuuccuucaauggaaucagaaagcuugucaaucacucauguguuuuagaguaauuacuuuuaaaauggugcauuugugcuucugaacuauuuugaagagucacuucuguuuaccucaaguaucaauucauccuccauacauuugaauucaaguuguuuuuuugucaaauuuacaguugucaauugaucuucaagcugcagggugccuagaaaugggccguugucuguagcccuggcaugugcacacggacauuugccaccacugcaagcaaaagucuggagaaguucaccaacgacaagaacgauuagggaaaauaugcugcuguggguuaacaacucagaaagucccugauccacauuuggcuguuuacuaaagcuugugauuaacuuuuuggcaguguguacuaugcucuauugcuauauaugcuaucuauaaauguagauguuaaggauaaguaauucuaaauuuauuauucuauaguuuugaaguuugguuaaguuuccuuucacucaauugauuuauuuuguuguuaaucaaauuuauguuaauuggauccuuuaaauuuuuuuuggcauuuuccaacaaaaauggcuuuauucauaagaaaggaaaaaaaucaauggaauuugauaucuaaagaaguuagaaagggagcaaaauaaaaaacauaaaggagauagaugaauuaguaagcaaaucaguagucgaguuuuucaaacuggcaaaauuaauuaauugacuuuuagcccaaauuuacauuguuaauuaaaucaagaaggaagaagaucuaagagcucccauugauaggcaagccuagagagaacuagcuaaauuuaucaugcuaggauauugaaacacagaaaguuuacauacauuuaugaagggucaauuuaguuuggacagugagguauuugucuuaguggaaaaaaggagaauuagucugaucaaaucgugaaguaauacagugaacuugcaggugcacaaaauaagagggccacaucuauauggugcagucuggaauucuguuuaaguuuguagguaccucuuggacuucugaauugauccaguugucauccaccacagacaucucacaucagauacagacaguuccaagauugacaacagagaacaaccugcuggaaagaccugggcagaaauggagagcccugcgggaaccaugcuacauuuucaucuaaagagagaaugcacaucugaugagacugaaaguucuuuguuguuuuagauuguagaaugguauugaauuggucuguggaaaauugcauugcuuuuauuucuuuguguaaucaaguuuaaguaauaggggauauauaaucauaagcauuuuagggugggagggacuauuaaguaauuuuaagugggugggguuauuuagaauguuagaauaauauuauguauuagauaucgcuauaaguggacaugcguacuuacuuguaacccuuuacccuauaauugcuauccuuaaagauuucaaauaaacucggagggaacugcagggagaccaacuuauuuagagcgaauuggacauggauaaaaaccccagugggagaaaguucaaaggugauuagauuaauaauuuaauagaggaugagugaccucugauaaauuacugcuagaaugaacuugucaaugauggaugguaaauuuucauggaaguuauaaaagugauaaauaaaaacccuugcuuuuaccccugucaguagcccuccuccuaccacugaaccccauugccccuaccccuccuucuaacuuuauugcuguauucucuucacucuauauuucucucuauuugcuaauauugcauugcuguuacaauaaaaauucaauaaagauuuagugguuaagugcaa

SEQ ID NO: 21231 - RNA, 4416 nt, Homo sapiens
ucauggucgaaauaauuuuauuuauccagaauauacaguuuaauuccucuaucuacacuuauuuacauggcuaaaauaacauugaaaaaagucuuuugaaaaguugaggucauagauuucaaggcaccauugaaaguguccacaguugcgcaaaaaaaguccucuguaaaaaaagggggggucuuuugaaaugcaauaacuuacaugcaaaaaaaagcuuuacacaugaaucuuuuucaguuuuccgaacuuccccauaugaauuccuuucuuuaugauuuucuagaacagcaaaacacaguagucccaaaaaagagaguaagagagagcagcccaucuaauagagugucccggaggccagcgccagcgggugcuguaaggagcccggcggcggcaggugggaauugauugagcuggcugcacuuguguaccaggaugcagaguucuccagguagcuggacgcuggggacugguuggaggucggagggugggcaugagggugguggcugagcgagcgggacgagcccuggggcucccacaccgcuggagacugcggcgaguuacacgccauugggucgcuggagcugggacugugcuccgggggcaucuccccguuuuucaugaucuucuugaucuuggaucuuuuguucugaaaccagauuuucaccugaguuggggaacaaaggcacacguuaccgggacacucagaggucgcccgcgccuuccccggggcggcgacuggaggcaucuucggaccucugggcggcccagcccugccuggcgucuccccgccgcuugcggccuaccgccaagaagcuaugccuuaggcaaaccauggagcucuggccccagagggcgcccuggccggcucggggcgccccggcccagcgaggccacgaccccaaggcuugucuuuuguuugggcugggggugggggacgccagcgcggcgggugugcgcccgaguguccucggcggcggcgcgccucguguaagccugcgcaggacgcgcggaacgcggcgaaggucuccaaaacaaucgcgcgagcccggcggggaaggggcguggggcgggcuacgcgcgccuguggucagaaaaaggagcgagcucccaaccucccguccuacucccuucacucccucugcagcucagagaggccagaaucugacugcagcucuuggcggcgacucgaacauucuuuaugcuuccguaggccccagcuggguuggaggaguaaaaggaaugggacaauccaggaagacuucucacguacaauagcgccccccaccucgcgacccuucgguggccguggccugaagcucccguaggcucagggcacgacccuucaguuucuccgcuccaggcgacguucucagccuuuucuuagccugagaccaccgcgagaacaccaggccuugcucacccccgaggaggcucuacauuguuaagaaaaccagauagcugcucugggcugccuaggccgcccuagaaauaacccuccgcuugcuuucaacccgcgaaauuggccccacagcuccggaggcccgcuacggggugggggcggggggcgcgguuagugggagguaucuccagaccgcugaugaauaccauccccaccgucucaaggccugacucaccgaguuaaagcauaggggcugaugucuuugggucuguuaguuucucacggguacugucaaaacagcuccagucccaucgagacugaaccgcgcgacccaaccagacgugcagcucaggcaggucuagugcauggcagcgccguauuuaccuguguuugugucaaucccagcgaggcggccagcucggcgcguuccggcaaggcgagguacugagucuucugaaaccuucucuguaaugcggccagcugaaagcuggaauaaauaguccuggguuuacgaacuuucuuugguuugccauucaccauucucaccucgggcucggucacuucuuucucuaaauaaucaaaacagacucaguuaaagcuugucaccagacaaugccccuuuugcggaagggccucaaauagaguccuagaguuucuuaccacucagucuucauucuuugcccauaucaccaccaccuuugcuuuucaggaccgcgauaaauaugcaccuaccccaaauauggaaaagcgggauagccucugauuaauuccuacucuguucauucagauaguuugugcaaagcgcuuccuacaacacugcuuucuccuuggcaucugggauucagcucuugcggucguugcuucuucucccggacuuguuuuuacgcccacccugugcuccuccgcguuuccgccccuccccaggcuucaagaacaccagccccuccccaggcuucaaggagguggcccugggccgugacccuacuucugucggcgucuguucgggcgcccgcagaagccagacucuugggcagggaagacgcuaaccgaggucuccaaaguucaaagacccacaagcaaacugcuccuucacuucagcagcaagcggucggggccgccgcagacagagggucgauuaugcaacccccauaaucucgcugcagaucugcgagggcacagaugugucugguuucuuuuacaaauagacuuaauauguucuuggcaaaaaaaaaaaaaaaaaaaagaaaucuuccacuuaugcacggaauacagagagagugaaagaaacguagacaccucaacccggggcucucuuuuaaaguucagcaagagucacacacugagaaggaaccgguggugggguguuuucguaggaaaggggcggcaggucaggaugagauucucacugucaugaguauggguuugggcgggagggggagggauugccaaacgcguguuguacaaaccugcccuggggcuacaacuccccuuccucaaaacuaccaccccucuggaacugacggagaaccucuccagggugugugugugugugugugugugugugugugugugugucaaguuccagggagaaguguggaggaugagggcuguggucucaauucugccagaguaggggaugcuaauauuagcaggauuauuaaugugcuggugggaagagaucaaaccuuaccaauaaaaccucuccgccgagccucaugccuuucucuuaccgcccaagcucacuaacccucuuaaacucucuaaguaaguuucaaagcggacgaaaaaggaggacggaaagacaaauugugggcgccuauggagacagaaaaaaaaaucuauccuacaacgugaccccucagcaacccuccuccaccuuuaaauggcuuuuuguuuuuggaaaugccuggauaaaccgcaaaacucucggcgcgcucuucucuggcuggcuacaacuccuuaacccccccacccccacccagcgugcucagggcacccgcaccgugcuagcuuguggcggcucucaaacuaauccugacugaguuuuugaggcagccuucuauucccacucgcaccaacccagcacgcuuaccaaaauucccaaguaaccuucucuuuguuacgcaaacgccaggagcugcuugauucuuucuucucuccaccccuauccccuuuccagccuagccggcuuccuggccgggcaagcugggaauucagcgacugaagggccuuggaaggugccggaggggagagacgcuaguucgaaccuccacagggcucuccuacuaaaaaucccuaaaaugcuggcccgagaaacucucuuuguuggagggucugaguccuacucccuucugccgcgugcgcccccacugccgugaaccgcugugacccccaaucuaccaccccaucucgcgcccccagcguccuagucgcccuguaucugcccagccuucccccuguccauguaccuggcugguugguggcgcuugggacgcgguuguaggcgccgccguacuggugguaggagcuagcguagcuauagucggcauaagcuuuggcuggguagcucccggcggagccguucacgccgugauacugauacugguagggguugagagcuuugccauaggaagccgagguaggagagcaguagccgugcggggcuccccccguagggcuguaguagucagaaucgguagcugaagacucgggcaaaguuggcgauuccugagacggauggugcauagcugcggacgucuggaacggagcuuggaagucgccggaucggaugcuggggacccuucugucaaacacuccugucaucgcucacgggcggcggcagcggcuguccuugcuguuguggcggcggcagcugcccuaguuggcuguggggcugcucuggucuaagcagacauggcugugggagcgagggaggaggaggaagaggaggaggagagaaggaggaggcggcggccgcggcgaggaggagacugggagucgugaagucucugucu

SEQ ID NO: 21232 - RNA, 24906 nt, Homo sapiens
gcgagcuagagcaacaaaggagccgggucgccggcggggagaguucggggggcugcggcgcgcuggggcgaagguggcugcugggccgcgggcuggcgcgggggcggagccggagcugcacucgcacccccggcccgcgucuggccucccucgcggggcggggagguggcuuuaauggugggagagggaauggggcuggggauugggggcccaggggucuccuagggcugaagacaacuuggauugcgaggcuagggcuuggggagucgugcaucccguuccgggccuccgcagcccaacaugggccccggguuccaaaguuugcgaaguugggcgccgaggggccggggcgcgcggagcguccgggggggcccgggcccggauucucugggcgcacaggucgccugagccgccuccgcggccgccgaggucgugcguguggccggggggcuccgaggagcaggcgggggcgccggggcuuuugcugaguuggcgggguuggccauggccgcugcccgcccagcgcgggggccggagcucccgcuccuggggcugcugcugcugcugcugcugggggacccgggccggggggcggccucgagcgggaacgcgaccgggccugggccucggagcgcgggcgggagcgcgaggaggagcgcggcggugacuggcccuccgccgccgcugagccacugcggccgggcugcccccugcgagccgcugcgcuacaacgugugccugggcucggugcugcccuacggggccaccuccacacugcuggccggagacucggacucccaggaggaagcgcacggcaagcucgugcucuggucggguaagugcggcggagccgggucuggggggcgggaggugccgcgguaagaugggggcacccuuggaaagaacaggcucaggccugaguuuuggagagggcggggacagcacccgggagaguuggagggacagaucccgaaacuuugggggcagguuacgugcaggaugggacccucggucaugggaaaaggagggcaaggaaguugacgaagcgggucacaaagggccugagcuggugggugagcaaaggauggcggggaugaggggcccgugaggagguggcucuaagccacgggaaaagacauuuuguaagaagaggagaugcuccaccuauucuggaagcagggugccgggggauucaaggagguguugaagacccuggggaaauuggaguuggagaggaaaaggggagggaugacggaggaagagguuuagacauuuggagggaaggguagggggacaugaucgagugaaguuuugaaggaaaagaaaccucccuagugaugaauuauuaaaagguaaccagaaaguucuggaaaucuugauuugggagacaggaaugaagccuagagaacugugaucuugucuggcuuucacgggagauuucauucaguuugugcaucugaaaaaccggcccucugacgcaugcaggagguuaugaaggaauaagaccuuucuaacaguuauuuguguuuucuuuggaaauuugguuaccgaggcuggucagggcuguggaaggacgcuuaagucuggaguguugagagccuguggacacuuccauggugguuugaagucccaaagcccccucacuggaguggcagagucugaaaaacugcacacugaacccaaauguccuuccuuagcaguguggaguauacucucccccaccugucacuuuucuagaugaggcuuggagggugcugaggaagggagcuggccuuaucagcccucgcuucuagccaguaugauucuaaaacuguccugggaaaaagaaaagaaaaccaggagccaggagcagaacugggagccucccucuuuugacagggcugggguaccccaucucuuagcucugcccagggggcuggugaggacccuaauguagggaguguauguaggccgccugucauugacaaguucucggccuuugucagauguuggacaaggccauaagguuccuggcuuggugcagaugcuggaggaggaacuuggaggaugguauccaugguacccaugaggaagagcugcauccuuuuuggggaucagguucuaaagucagcacagcacauuagacagaaaucauguguaaacaacaguggcuuugaaaacucugcagauuaccauaguguaagguggaugugguuuugcauauacacuucuuuuacgauguuugcauacauguguuacauguauacucauauauaagaauggguauacauagaagauaaaauaauuguaauuuuaaaguuacauucaugcaaaagacugaaauaauaauaauaauaauaaaaagaacaccaaagugagauuaagcaagauugcuuugagcaccacccaaaaugagacuugaguuuaggagccagcuguguggaaaguccaaaucucucagcacuagaaucucacccaguucugaguugcucaugcugucagaggauaaucuuucugucccucucuuuauugauugugcaaggacccaugguuuaauuuucccaaguuaaaugcauguuugauguugccucuguguaguuaccaucagaucaaggaggaaggguaugaaccucuuuccagcccauacucuugagagcagcugcugagcagacagaaguaguuuaagcuggaacauguaucaauuaguaccaucugcagguugugcagguugaaaucucacuaucugugccuuuuggcagggcaggguccuacagagaugccagcacugagcccagcaccguuaguuccauuaguucacuaugaguucuucucugccaccaaccaccaucccucagcucauuccuguuuccauauguguucugguugcacucuuucugcuugggacuugcaaguagggcagaagcagguguuggcuugagcuggguaaugaguagguagagugaacccaagccucgugugagaaucacagccaggucagcugguagccucuggcaagugauuuaucaugucccgaguuaaugaucuugauuuugcauuagacagggucaguguuaccuggcucuuagggguguuuuugugggugaaggaugaaggugaucuagguugucuucaucgguaaacucuugaauguaggaacugggucuucacuuuuuuucaaagccugugaguacugaguacacagccaugcuucuauucaugcauucaguuauguauugaauguuugcuguaugucacaugcugcgcauguaaggaugaagaauacagauaugauccucugucaucaagaagacaggcuggacauggugcucacaccugugaucucagcacuuugggaggccgaggcgggaagauugcucaauaccaggaguuuaagaccagccugagaccuugccucuaaaaaaaaaaaaggaagacagauaauucaacaggcuuuggaaauaccugugaaagguacuguggcauuuuaggguacugaaaaagcauaaaggacccaaggaacaucccagaagaacuggcauuuaacccauaacuugacacauaagcaggaauugccuggccgagggagaguugagguuugaagggauaggaagaggaaauagcauguacaaagguguagagguaggagggcuuggugcuuugaaagaaaguauaagaguugcaguagaacuggaucaaagcgugugagggguggaauugugagagauaagaccuaaagaauuagaaaauaaagggauuuauaccucauauuaaguuuggauguuauccaggggaugauaaggagccauugaaagauuuuaagcaagggagagauguaauugucuuugcauuuuagcuggaucucuuuggguauggugugaagaagccauaggagcagggaaagccuggagccuggcuucuugaccaggggauguugaaguagcccaaguaagagacgauggcgguugggacuggguagcaggacagagggagugggcagaucccacuaacuuucagagguagugcucauagggcacugaugaguuagauguggagccucagugagcaggaggccucggguuucaggcuuggauggaagguggugccauucccuuucacuaagauagagaaugcuagaggaagaagaaguuuaggcaggagguguggcuuugauuuuggccgugugaauuagagaugcucauuggacaucuauguggagauucucagcagaucuggaaauaggaauugcuggagagagguggccacugugugcuuccuuggcccugacuacugaggcuuuggaaggaugccauugacugaggaaguuuauagcucagguugguccaauuucuaggucuguauagaccucaggucuuuccucugucuuucaucucucuggccucaggcuucuucagucacuuagcaucucuccccuuuacagcuggaaaugccuccucccgggcauuccaagcugaccagacaaacauaauguccaggccgugguccaccuuaggccaaaccugguuuaguaaguggggcaaaaaagcagagaggccugcagcuggcaguggcgauaggucccugagagccagcacguagccuccuuaaccacugcugugcucugugugguacauaaguguguggcccugucaccuugcccacuugcagguaaguaggagagagacaaaggcugggaggaauuucuuguuugccucucacacauugaauugagggcugagaggaggaauguuuuuggugaugguggguuauuuucagggacggaucaggaagaauuuccuuagagcuauuuccaaacuuggcugguaaucagagucaguuaaaaagauauauauggccgggcgcgguggcucacgccugcaaucccagcacuuugggaggccgaggugggcggaucacgaggucaggagaucgagaccaucccggcaaacagggugaaaccccgucucuacuaaaaauacaaaaaaauuaguugggcaugguggcgggugccuguagucccagcugcuugggaggcugaggcaggagaauggcgggaacccgggaggcagagcuugcaguaagccgagaucacgccacugcacuccagccugggcgacagaccgagacuccaucucaaaaaaaaaaaaaaaaaaaaaaaaaaaauauauauauauauauauauauauauauauauguauaggcugggugcaguggcucacaccuguaaucuuagcacuuugggagguugaggcaggaggauuucuugaagccaggaguucgagaccagccugggcaacaaagugagaccccaucucuaaaaaaaaaaauuagccgggcauguuggcacacaccuguggucccagcuacacuggaggcugaggcaaaaggaucgcuugaacccaagagguugaggcugcagugagccauccucacaccacugcccuccagacugggcaacagagcaagacccugucucaaaaauacauacauacauauagauauguguguauguauacacacacacacauauauguauagugaaaauguaaaauacagaaaaacauacauggaccuaagucuuuuuuaaaaaaaaauuaucuuuaauuaauuauuugagaaauggggucuugcuguguugcccaggcuggagugcaguggcuauucagaggcucacucauugugcgcauggugcuuauggugccuggaauagcuggcacuacaggcauguguucugugccagcucaagucuucaauuuugcuucagaucuuuaacuuuuuaauugugaaauauaacuguaugcagaaaacugcauaaaacacaaagguacugaauaacaaauaauuauaaagugacaucugggucaauaacuagaccacagucagaccccugaagcucccucugugucuugucuagucacaucccccuccccuugcucaagagguuuucaguaaucacauccuuuuuuucucuaugguuuuaccuccuaguuuuggaauccauaagcaguauauuucagcuuugcauguuuuugaacucuguucaaauggaauuuguacaaaauaauaugcugugcauauuauuucuugcuucuuuuacuuuauaucauuauguaagauucauccauguuauugcagcuuauuucuuuuuugcuuguuuauuuguuuguuuuuguuuuuuugagacagucucacucugucaccuaggcuagagugcaguggcgcgaucucggcucacuacaccuccaccuccuggguucaaacgauucuccugccuccgccucccagguagcugggaccauaggugcacgccaccaggccuggcuaauuuuuguauuuuuuaguagagacaggguuuugccauguuggucaggcuggccucaaacuccugacuucaggugagccacccgccucauacugcagcuuauuucuucauugcugaauaauauuccauuauaugaguauacccccaguuguuuacccauuuuauugucaucucaaguuuuugcccauugcaaauaacauugcugugaguagucuuuuauguauauccuaguacaacuggcacaaguuccuucagguauaugcugaagaaguagaauugcuagauaauaaggcacgcauacuuuaggcuuuugccaaaccauuuuucaaagugguuguacuaacuuauacucccacuagcuaguagaaagucaacacugguucacaugauucccaacauuugguauuaucagccuuuuacauuuuugccaaucuaguggcuauauuguggcauauauuugugguuuuaauuugcacuucccugauuacuaguaaaguuaaaugccuuuuuaaaugcuuacuggccuuuaggguuucugcuuuugggaagugucuguucaaaucuuugacauauuuuuccauaggggcuaucugucauuuuuguaagauuuguaggaguucuuuauauaugcuagauaugaguuuauaggauuacaaaggaaaucaauuauauugacauaauaguuaucaaauauaaaaaugcaaguaugugggcuuauuuauuuauacaauaaauaagaucuggugcagguguaauaacaacuauaauaucaaagugauuauaagcauugacauuauuucaagauaucugcaacaaaaauaucugguuuccacuugugacaacgccacagguacuauuaacauuauguacugugggccaggcgugguggcucacaccuguaaucccagcacuuugggaggucaaggugggcagaucacgaggucaggaagucgagaccauccuggcuaacacggugaaaccccaucucuacuaaaaauacaaaaaauuagccgggcgcgguggugggcgccuguagucccagcuacucgggaggcugaggcaggaaaauggugugaacccaggaggcggagcuugcagugagccgagaucgugccacugcacuccagccugggugacagagugagacucccucucaaaaaaaaaaaaaagaaaagaaaaaaaaaacaaaaaaaaauuauguacugcgauguguugcuuacauucauaauuggaggaagggccaaauuuuaguuagguguaauuuuuuucccauugaaauucauggaccucugaauuuuuccaagaauccuuugugaaccauaggguaagaauguuacuuacagaauaucacuaucuaguagagagucugagcuauucuugauuguguguguguguguguguguguguguguuuuaauagagacaggguuugacccuauugucccggcuggucuugaacuccugggcucaagugauccuccugccuuggccucccaaaaugcuccuuuguguuuuaauauaaaaauacuuggugauuuuuuauugggauugcauugacuauauagauuaacuuggaaaaaaaaagagacaucuuuacaauacugagucuuccaaacauugaacauuuauauauuucuauuuagaucuuucauuuucucaauauucugcacagauuuaaauacuuauuauuuguuagacauuccuagguacuugauauuuuugaugcuguuguaaaugaugccuuuaacauuuauuucacuuuguuuguugcugacauauagaaauaaaacuggcugggcacgguggcucacaccuguaaucccagcacuucgggaggccaaggcagggggaucacgaggucaggagauugagaccguccuggcuaacauggugaaacuccaucucuacuaaaaauacaaaaaguuagucgggcaugguggcgggcgccuguagucccagcuacucaggaggcugaggcaggagaauggcgugaaccugggaggcggagcuugcaaugagcccagauugugccacugcacuccagccugggcaauacagugagacaccgucucaaaaaaaaaaaaaaaaaagaaauaaaauugaugccuuuaacauuuauuucacuuuguugcugauauauagaaauaaaauugauugugaauucaguaaacuugcuaaauuuauucuauacacauagucauauaauuugugaguaaugaguuuuguuucuuucuuuccaagucuuauaccuuuuauuuauccuuauugcuuuacugaaggcuuccaguacauuguuaaauagacaaaacaucuuaauucuugacuuuucuggauucuaaaaagaaagcuuuuucuacccuucaccauuaaauuugauguuugguauagguuuuuuauaguuaauuacauuuuaucagauuaagaacguugucucuuauuucaaauuugccaauuauucuuuugaucauagauggauguugaauuuuaucaacuuuuuuuuuuggagacgaagugucacugucaccgaggcuggagugcagugaugcgaucucagcucacugcaaccucugccuccuggguucaagcgauucuccugccucagccucccaaguaucugggacuacaggcgcaugccaccacgcccggcuaauuuuuuguauuuuuaguagagacgggguuucaccguguuagccaggucaauuuccugaccgugugauccgcccgccucagccucccaaagugcuaggauuacaggugugagccacugcgcccggcugaauuuuaucaacuuuuuuuugcauccauugagaugaucauaugauuuuuuucuccuuuaaccuguuaauguaguaaauugcauugauugaauuuucuaauauuaaaccagccuuagaacagugauacucaacuugacuagucaucagaaucacacaaauaaaaagucuuuuuaaaagucuagaucagccaggcgcgguaacacccguauuccuguuucucuuuuuguuucauauuuuauuaaaauaaaagaaguaaaauaauacugauaaagcugauauccccucucuuucucguuucaguuucauauccuucuuuucucuuuggaaagcuuccccauccuaguaauuuguguauuucuuuauuuuguuuuuaagcucaaguuuuguuuuuguuuuuguuuuuguuuuuuuguagagaugggguuuggccauauugcccagguuggucucgaacuccugaacuuaagugauccacccaccuugggccucccaaaaugcuaggauuauaggcgugagccaccauguccagccuuaagcuuaauuacuuuuaaaaaauagguuauacauguacauggcacagaauucaaaaggaacaaguuaaguccuacuucugcaucuagcuacccauuuuuccucugcagaaguaaccaccaacacugguuuuuguguccuuuuggaaauauccaacaucuguccagauguagaugugcucucagucucuccucuaccgcccaaccaguaccaugcucuauagacugcucuccacucaacugaguccauguaacaugacaacauuggacaucauuccauuucaaugcacauccugucaugcaccccagaaggagauuuugguuaacaauggaccacaugugaugguguucccuuaagauuauaauaccacauuuuuacuguagccuuucaauguuuagauauguuuagauacacugauacucaccguuguguuacaguugccugcaguauucaguauagcaacaugcuguacagguuugcagccuagaagccauagguuauacuguaucagcuaggugugcaguaggcuauaccauccagguuuguguaaguacacucugauguucacacaaagaugacauugccugaugacacauuucacagaagauauccucauuguuaagcaacaugugacuauaucucaacccugaauaguguucuauuauaaugguguacauuauuuuacuugguuggucuccuauugauggauauggauucaagcuguuucuacuuuuuugcuauugcaaaacagugcugcaaugaauaaucuauauuaucuuugugaacaugugaaguagaaguacuaguauaaaauuuugguagauaaugccaaagugaucuccacaaguguuuacuaauuuuuauuccuaccaacaaauauaaaagugccaguuuaucccuacacucuuuauaguacgguauuuucuuuucuuuuuuuuuuuuuuuuugagauagaguuuuguucugucacccagacuggagugcaauggcgaucucggcucacugcaacauccgccuccuggauucaagcaauucuccugccucagccucccaagaagcugggauuacaggcgcccaccaccacaccuagcuaauguuuguaguuuuuuaguagagacggguuuucaccauguuggccaggcuuguguagaacuccugaccucaggugguccaccugccucggccucccaaacuguugggauuacaggcgugagccaccaccaugcucagccuucuuuauguuuuuaaaggccauuaaauggccuugaguccaggaguucaagaccagccugagcaacauggugaaaccuugucucuacagaaaaauacaaaaauucaccaggugugguggugugagccuguagucuuugcuacucaggagguugaggugggaggauuaacugaaccuggggagcugaaggcugcagugagccgugauuaugccacuguacuccagccugggcaacagugugagacccuaucucaaaaaauaaaaaaauaaaaaaaacauaaagagauguucgaccucacucuuaauaauacaaauguggaauaaacuacaacgaaauauucuuuuuuuaaacuuuuauacuuuuuaucacagugauaaagaucaaaacauuugaaaaugugaucuguuauuugucuuucgccugugugucuauagaauuaugcaauuuuuacugauuuggaggagcuuugugcauauaaggaaauuagcucuugugauaaguauugaaaauacauuuuuucaguaucuuacuuuucuuaugauuuuuguaucgauuuuucugaagucuuuuguuuaaaucuuuuauuucaugauguguaggcuuugugucauuucagaaggccuucuccacuccaagguuuaaaaaaucauuuccuggccaggcgugguggcucacgccguaaucccacuuugggagaccgaggcggguggaucacgaggucaggagaucgagaccauccuggcuaacacggugaacccccgucucuacuaaaaauacaaaaaaaaaauuagccgggugugguggcgggcgccuguaaucccagcuacucgggaggcugaggcaggagaauggcgugaacccaggaggcggagcucgcagugagccgagaucacauuacugcacuccagccugggcgacagagcaagacuccaucucaaaaaaaaaaaucauuucccaucuuuucuucuaaaacuuuaauuuuuagaaaaacaauguaguuauuuuuuuauccaucuggacuuuuauguaagaaaugggguaaagcuccaccuuauuuuuuccccagauaauuucuuaguuguccuugaagauguauuuaauaaucucucuuuuuccuggggaguuuuauuuuuaagguaugaaacaauauucacaaugagggaaaaaaaggaaaacaaauuagacauuuuuaaaaccugauuguuaccacagauauaaaaagauugagaaaaauuacaguuuuuuuuuuguuguuguuuguuuguuuguuuuaaugagucuugcuguaucacccaggcuggaguacacugucgugaucuugacucacugcaaccuccaccuccuguguucaagcaauucuucugccucagccucccaaguagcugggacuacaggcguggaccaccacgccugguuaauuuuuauauuuuuuaguagagacaggguuucaccauguuggccaggcuggucucaaacucccgaccucaagugaucugccugccucagccucucaaagugcugggauuacaggcaugagcuaccgcaccuggcugacacaaccuuuauuuuuuuuauuuuucgagacggggccuugcucugucgccuaggcuggagugcaguggugccaucuccgcuuacugcaaccucugccuccuggguucaagugauucuccugccucagccuccugaguagcugggauuacaggcaugugccaccacauccagcuaauuuuuguauuuuuaguagagacaggguuucaccauguuggccaggcuggucucggacuccugaccuugugauccacccgccucggccucccaaguucugggauuacagguuugagccaccaugcccagccgacacaaccuuuuuauuaacugccugauguuucucuaaagcauuuuacuccagagagguccccccauuuuaaauauauugugcaauaaaaguaaacauccaguaaaauugacuuuuucuuguacaguucuaaguuuagacaaacacauagacuuauguaaccagccaccacauugaauucaagauagagaaucguccuuuaacccccauauauucucucaugcuacuauuuuguaggcaaauccugcccucaccccaaucccuggcacccacugcucuguuuucugcaaguaccuauguacucagaauuucuggugacuguuuuuggguuuuuuguuuuuuauuuuuuuguuuuugaggcagagucucauucuuuugcccaggcuggagugcaguggcgccaucucagcccaccgcaaccuccaccuccuagguucaagcaauucuguugccucagccucccgaguagcugggauuacaggcauguaccaccacgaccggcuaauuuuuguauuuuuaguagagacgggguuucaccuuguuggccaggcuggucuugaacuccuagccucaggugaucugcccgccuuugccucccaaagugcugggauuacaggugugagccacugcgccuggccaacuggugacugaauugagucaagugggaacuguugccugaggacauugcuucuuaacuggcaggaacuugcucugcacccuggaauauacucugaaggcugggagcagucagaggccucagacaaauaaucauaagaguuaacauuuccugagcgcuuacuacaugacagguacugugccaagggcauuuaaagcauuauaucacuuuucacagcaguuccaugagguaaaucuaucauccccauuuuacagaugaggcaacugaggcuaaagauaaaguacuuugcccaagaucauacagccaggaaagaguggagccaagauuuggacccaggcugggcaguugccaugcacaugccccuuaccucucuacuauguugccuucccccgaaaagagugguuaccugucucuaccacccccagccuggaaaugugaccggcacccauguuggcucucacauccucauauucucuccuaaugcaacuucuugcuugggaaauagauauugcugaagcaggguugauucaggaagggcuucugugaugggcagggcggaggacuaggcuggggacgggugcugggagauugccgccuguuucugucuugcugacaacauuuuuccccucuccgcacuggacagagccucuucuguuccucuccaucugacuuccugcuuccuccucuggcuuuggagugccuggcuccucugacuaccucuucuuaagcccccaucucuucucucucacuccgcuugguaagaggaacaaggguucuggggucugggcaaagggaaacaucuccuggcucuagcaaaugggccccgugagaguugggugcaccccugaaaagguaaauccaccccggggagcucuaccagaggcauuaccacucccuagcagggcaucuggaaguggcaguuauuuucuuaaaacuuaaaugauaguaagcauacagaauagcgcacagaucaugagcuugguuuccacaaggugaauacacucauguaaccaguaucagaucaggagauagaauauucccaacaucccauguaaccaguaccagaucaagaaguaaaacauucccagcagcccagagguuccucuccaggcucccuucuagucaccgucccuagaguagagggcuggggcauuuuuguuugucacaaucacuucuggguucuacuggcauugaguuggcagagucuagugucugcaaugcaugggacaguccuaugguauaaagaacuguccugcccagaugcacuguugagaaacacuguaccugccaggucugaccagugaugggcugcaguguggcaaaggccuggaggacaggggugaagcugcgucugugggucagagugaggaggggccuucacugcaaugcuguugccacccccaggccuccggaaugccccccgcugcugggcagugauccagccccugcugugugccguauacaugcccaagugugagaaugaccggguggagcugcccagccguacccucugccaggccacccgaggccccugugccaucguggagagggagcggggcuggccugacuuccugcgcugcacuccugaccgcuucccugaaggcugcacggugagugcucugugagacaagguccaggcucucuggguugggcaggaccggguauagggcaggguccaguggggagcaggggagcccagagcuuugucuccuggagacccugagccuacagccauggggucaacaggacacaaacucaaacugcagcucacuggcuggauccgucuauuagggauucucuauuuauuuaucaaugaucacauguucagcaaaauguuuugagcacuggcuguuggguguugugguguuacgggcaucacggaugacaggagccuaucaggaaguuucucauguauguugggaguuaaggcgcgagcgugugaaacagcuagagccaccaagacaggggacgugagcuaguucuggguggugcaggagaggucuucaaugaaaauaauaacaguaauaaugaugguaauaauacuaauuaguccuguuuacuauaugccaaaugccauuauaauaagcucaugccuguaaucccagcacuuugggaggucgaggugggcagaucaccugaagucaggaguuccagaccagccuggccaacguggcaaaacccugucucuacuaaaaauacaaacauaagccugaugucauggugugcgccuguagucccagcuacucgggaggcugagacacgagaaucgcuugaacccgggagguggaaguugcagugagcugagaucgugccacugaacuccagccugggcuacagagugagacucugucucaaaauaaauaaauaaauaaauaggcuggccagacacaguggcucaugccuguuauccccaccacuuuggaaggcugaggcggguggaucacuugaugaggucagaaguucaagaccagccugaccaacauggugaaacuccgucucuacuaaaaauacaaaaaauuagccagacaugguggugggcaccuguauucucagcuacuugggaggcugaggcaguagaaucgcuugaacccgggagguggagguugcagugagccaagauugugccauugcacugcagccugggcgacagagccagacucugucucucucuuucuauauauauaauauauguuuauucauuuaacccuuaaaccauaccauaagguaaguacuaccaucuuagaaauggggaaacuggccgggcgcaguggcucacgccuguaaucccagcacuuugggaggccgagguggguggaucaugaggucaggaguucaagaccagccuggccaaccuggugaaaccccgucuaaaauacaaaauuuagccgggugugguggugggcgccuguagucccagcuacucgggagucugaggcaggagaauugcccgggaggcagagguugcagugagcugagaucacgccacugcacuccagccugggcgacagagcgagacugucuaaaaaaagaaagaaaaaaagaaagaaagaaguggggaaacugagguacagagaggccaaauaauuugccaagccagcccugggauucagguccuggaaguguaucuccagccacccugccaugcuaccuagauaccuuucccuaaacaagaggcucgucccugagcugccuugacaccgucuuuucccaucccuggugccagaaugaggugcagaacaucaaguucaacaguucaggccagugcgaagugcccuugguucggacagacaaccccaagagcugguacgaggacguggagggcugcggcauccagugccagaacccgcucuucacagaggcugagcaccaggacaugcacagcuacaucgcggccuucggggccgucacgggccucugcacgcucuucacccuggucagccgcgggagggcaggcccggggggcccucagccuggaacgugggaagagagccagagggaaggggggcaaagaggucuugguggggguccccagggaagggucaugaucagaagggucuggggcucaguuaagggugucugugucagcagaauaacccuaaccucacagaauggcccacuucucucuucuaggccacauucguggcugacuggcggaacucgaaucgcuacccugcuguuauucucuucuacgucaaugcgugcuucuuugugggcagcauuggcuggcuggcccaguucauggauggugcccgccgagagaucgucugccgugcagauggcaccaugaggcuuggggagcccacguaggugucuuggggacccagaggugaagguacagggaggaaggcugaagugugcguuuaccccaaagggagcaggugcguguaaaaccgagauccagggcaggaucuggcucugcccuacugcauacugcaugcaagaucuccaguguuaggaucuuaguuucagaaucaggaccuucaugguuuguaucugcucaaaggggcggcuccuagagccuccucagaucugaccuggguccugucuccaagcccugacuucugggaaccuccagaccucagcagcugagggucugggcacaggguggggagaccagguagagggaguacagagugaccgccucaagugacaccucaccucucugcacagcuccaaugagacucuguccugcgucaucaucuuugucaucguguacuacgcccugauggcuggugugguuugguuugugguccucaccuaugccuggcacacuuccuucaaagcccugggcaccaccuaccagccucucucgggcaagaccuccuacuuccaccugcucaccuggucacuccccuuuguccucacuguggcaauccuugcuguggcgcagguauagugacugguaggaacgggagaccuggauggggugaguuugagggagggggccaguaacccaccuucugucccaccccuuccugcugcagguggauggggacucugugagugggauuuguuuugugggcuacaagaacuaccgauaccgugcgggcuucgugcuggccccaaucggccuggugcucaucgugggaggcuacuuccucauccgaggugagugaagaccaggccaggaccaguugggcaacaaaauauacugggcacuugcugccaguacugggagcugccagcacggcugcccccaugcugaaaccccagcuagcuccuauagggccuucacacaguagaaggugacccucuaggcagacgaaacaccgugagcacuugcugcgggacagcaccuuuguacuggccagaaaaauccaucccucucuccagggccuuggcccagggcucacagcuuguuuuuuuuguuuguuuuuguuuuugagacagagucuagcucuguugcccaggcuggagugcaguggcacaaucuuggcucacugcaaccuucgccuccuggguucaagugauucuccugccucacccucccccauagcuaaaauuacaggcaugcaccaccacgucuggcuaauuuuuguauuuuuaguagagacgggguuucaccauguuagccaggcuggucuugaacuccugaccuaaagugauccaccaccucagccucccaaagugcggagauuacaggcaugagccacagugcccagccucacagcuuguuagguggaguugggucaggauccagccccagucagcuccuggccggugcacuugugugaugaacacccugaguaaccuacucugcccacuuggaccaaccuaggucguuugguuaucugugugcacauuaauucgauauguacugucaaucuucuggagcuugguuuucaucuucuuucuguccccggcacacacagcucucacagcaugcguggaauuaguggucccuaacuuuccugucucaugcugccaucccauaguaagccucagcaucuauuuagcucauuguuguuggguuuucuuuguaaaccucaguuuccucacccugaacugccagccuucuguucagucaccucuuuccccucuuuuuggcauagugucuggcccucugauuugugcuucguuaucaugcuguccuaguaugguaaucacuagccacauguguugaacuaguccagccugggugcggcggcucacuccuguaaucccaguacuuugggaggcugagacggacggaucacuugagcucagaguucgagaccagccugaacaacauagugaaaccccaucucuacaaaaaauacaaaaguugccugggcaggguggcacaugccugugguccuagcuaugugagaggcugaggugggaggcuugcuugagcccaggagguugaggcugcagugagccaugaucuugccacugcacuccagccugagugacagagugagacccugucuccaaagaaaacaagacaacaacaaaaagaaacaaguccaaauugagauguguuguaaaaugugaaauacacacuguauuaaaaaaaaaacuuagugggaaaaaaauguaaaauaucucauuaauaauuuguuacauggauuacauguugaaaugauuuuauuuugaauauauuagguuuguaaaauauauugauauuaguuuugcuuguuucuuuuaacuuuuuuuaaguggccacuagaaauuugccauauguauguggcucacauauuucuaugggaaggccggcaugguggcucacaccuguaaucccagcacuuugggaggccgaggugggcagaucaccugaguucaggaguucaagaccauccuggccaacauggugaaaccccaucuuuacaaaaauacaaaaauuagccggcgugaugguaggugccugugaucccagcugcuugggaggcugaggcaggagaauugcuugaaccugggaggcggaguuuacaaugagccgagaucacgccauugcacuccagccugggcgacaggguuccaucucaaaaaaaaaauuauauggauagcgcuguucuugagucuguuuuaugucuuucccaucagaacagcuuugaucugcccccuucuucaggggcagcugggccacgaccgaggcucccucuucucaagugucugucuaggcucugcccuggucuucucaccauuucuccagugucucuagcuccccagguuuucauuuagcacagggguaaucagacuugggacuccagagccuuaggacccuccucccacucacccauccuucccagcagggcagccucaccccugcuaaugucugaggucccccuucuguucaggagucaugacucuguucuccaucaagagcaaccaccccgggcugcugagugagaaggcugccagcaagaucaacgagaccaugcugcgccugggugaguggccccgggggacuucggucugagguccuggccagcccaacacugcacccuccuggggcuaugcgaccggcaggaugcaguaagucagugggacaaguuagccauagggacaaggacaagggguguguguaggugguagugguaguggcagcucaaaagaagggggucuacucggggggaagaauucagucaaguucaugccgggacugguuccuccugcccacuacgucccacguggucccucccacaguugcuucaagugcccuucuuauuuuauuuuagagaaagcaguucuuggacugagcccagcaugaguucaccccagccccagcugggugaacuuugaggcccaguggggcagacucucuccuccccacugcugcugcgggacugggcuugguaacguccuguccugccccuguccuccacaggcauuuuuggcuuccuggccuuuggcuuugugcucauuaccuucagcugccacuucuacgacuucuucaaccaggcugagugggagcgcagcuuccgggacuaugugcugugagugaggggcauggaggcggcagugcugggagcuggagccaaggccauaaagacacccaccuccacccaccgggcagcagggauuugccaggucccugcugcagacagcagauucaauggauggugucugggugcauaaggcaucagucuccguaguuucucaaacguggcaaacaaccuucgcaucccuucucaccucugcccuucccucuccacccccuugguugcccagcuggugcaugugugacuguuaagcagccaguucagcuucgucuucucugacugacacuaaguugcccucuaauucugugugcucuccugcagagccugcuuuagauccuggcacaggacuaguuaccucucugugauagguuaaugaccugcuaauguuggcuaguuuuugccugugcuuuuuugugucauaaugaggauggauuggagagaguaagacauugcuacugcugagagaagcgcaguacccacuguuacaaggacagucgcuaaaauggaugcuaguccaagcccugacugcuucaggcucuuccguaaagguuccggcuuccagucugggaugcuuuaaaccacagugaugccugagucucugccccagagauucaauuuaauugucuagggugggucccaggcaucaguagcuauuaaaagcuccccaguugauucuaaugagcacccaggguugagaucagugcuguggagcuuagcccuuucuaaaguuuuuggauugauugucugagucuacccaguagacucagaaaaccccaccuguagucccagcuacuugggaggcugaagcaggagauugccugagcccaggaguuggaagcugcaguggguugugaucacgccaccgcacucuagccugggugacagagcaagauccuaucucaaaaaaagagagaggaaaagaaaggaaagccucaccugucuacguucccucacuguagaugucaggccaaugugaccaucgggcugcccaccaagcagcccaucccugacugugagaucaagaaucgcccgagccuucugguggagaagaucaaccuguuugccauguuuggaacuggcaucgccaugagcaccugggucuggaccaaggccacgcugcucaucuggaggcguaccuggugcaggugggcauggcagccagccccuccugcccugcccgccucacccucagccuugggaccccaucuuuagguuuugucggguccugccucuagcacagccuuggucagugguucaccgcugcccccugguggcaccuucuguccuuggguggccugaugccugggccugggccugggccaagggcagagccagcugccaucaccuuuuaagagcggagugauuggagggcugggcacacaggagcucugcauucuggccccacuucuuugcagagaaggccucuacuccugaguccuugaaggacuugaggcccuugggagccuccuucucuggaaagaauggcaucgcuggcccuucccaagauuugaugggaaguggcagcuucuucacgcuccuucccuaucccuucugcucucagguugacugggcagagugacgaugagccaaagcggaucaagaagagcaagaugauugccaaggccuucucuaagcggcacgagcuccugcagaacccaggccaggagcuguccuucagcaugcacacugugucccacgacgggcccgugggugagccucaccccuccucuaccggagccgccuggccccgcgcugcccaugugcuagucucucccagccugcugggggcacacagauuauuuggaagaccgacugugaggagcaaggcgcucccuccaucgcucacacacccauucuucccccggccccuccuacccucuggggggcucuccccucucuguuucugccccugggucugcuugccggugcuuggguuccaagaagacuccccucccucucccuucucauaaauucuccaguugcucucccugggcaagaguaagucaggguuccaagaacuggauuucuggccuccaguuaggcccuuuggggacgugaggcccuucucuucagauucugaagggguagagaucaccgugguuacagggugagcuuucucuggugagcaggagggacuggcugugggaagaugaauggcacugacuaugggaggcacugccagggaccgggaagucacuauuccuucuccuuuccuuccuuccauucccacagcgggcuuggccuuugaccucaaugagcccucagcugaugucuccucugccugggcccagcaugucaccaagaugguggcucggagaggagccauacugccccaggauauuucugucaccccuguggcaacuccagguaugagaguucaagcuucuggaggaagguggggggagcacagaggcugggggcuucugggacuggaguacaggggcugucggaggaggaggaagaggaaggaaaggccccagaggaucugaagaguggggcugaggcucuaagagucuagagaccugggccccagaacuaacagguuaagugcucccaggggagcggggguggcauggacagagccagggccccaggcucguguugucucuccuccugucagugcccccagaggaacaagccaaccuguggcugguugaggcagagaucuccccagagcugcagaagcgccugggccggaagaagaagaggaggaagaggaagaaggaggugugcccgcuggcgccgcccccugagcuucaccccccugccccugcccccaguaccauuccucgacugccucagcugccccggcagaaaugccugguggcugcaggugccuggggagcuggggacucuugccgacagggagcguggacccuggucuccaacccauucugcccagagcccagucccccucaggauccauuucugcccagugcaccggcccccguggcaugggcucauggccgccgacagggccuggggccuauucacucccgcaccaaccugauggacacagaacucauggaugcagacucggacuucugagccugcagagcaggaccugggacaggaaagagaggaaccaauaccuucaaggcucuucuuccucaccgagcaugcuucccuaggaucccgucuuccagagaaccugugggcugacugcccuccgaagagaguucuggaugucuggcucaaagcagcaggacugugggaaagagccuaacaucuccauggggaggccucaccccagggacagggcccuggagcucaggguccuuguuucugcccugccagcugcagccugguuggcagcaucugcuccaucggggcaggggguaugcagagcuugugguggggcaggaacgguggaggcagaggugacaguucccagagugggcuuugguggccagggaggcagccuagccuaugucuggcagaugagggcuggcugccguuuucugggcugaugggugcccuuuccuggcagucucaguccaaaaguguugacugugucauuaguccuuugucuaaguagggccagggcaccguauuccucucccagguguuuguggggcuggaaggaccugcucccacaggggccauguccucucuuaauagguggcacuaccccaaacccaucuuuuguucuccuauauccuccuucuucuguuccauuucaguucaguuucagcggugccaaccucuuugcguuuccuuuuuguugaugaggacccagagcugcugcacacacucaccucuaacccccuccccucgcugcugggccccaucuccacaggagagacugguucagcucuagggccucagucuggagugggauaggagcagugagugacaaagccucugaaagaugcaucaucucuuccucacacccauuuagugggggauggguccucuagacuugaggggcuacccugggaagcugccguagcuucagccaggcaagaaagcuuccuucaaccugcauagccggugggugaggagauucccaccuuccauagccuccaaacauguucccaaggccccacuuucaagaaucagacagcaggaagccauagaugcuggcuggguuccagguuauggggagaagaaauacagucaauaaaagguuuuuguauaaacucuuggu

SEQ ID NO: 21233 - RNA, 25232 nt, Homo sapiens
uggggcggccgggccugcgcuggggacggcucuggggacugcggccggcgccgggaccuggaggggacgcuggggccgaagcagcaugugacaccgaccaggugggugcccuccucccgucucggcccugggcucccggcggcuguggagcccggcggagguggggcagggacaggaaggaagaggaagccaggccuuucccagggaucagcccccgcuggguccggggcgcaggcuccggaaaugggggggcugggcccgcaggcagggcucgggguguguggcugaggacccugguggggaagaggagaggaacuagaggaaauguuguugccuacaaguuugcuuccggucgggucccgccuaggaaaugggcacccugcccccagacguuccccgggccaauaaucagggcucuuucuucaaaguaggcgcccuggggaaagcuaagccauaucagaaggaauaacugagauucccuuucuaggcuguuccuuaccuggagagguuuuaucggcuccuuuuccuuaaccaggccggggccuuuccuuauguaucuccauagguauuugcauacugugugagucuauguguagcuucucuccguguuaaccaaagcuccguaaccuggaacagugaauccugcccugccccucaccccaguucccuacauauggggagccuccuaaagcuugaugugaaucacaacguugcauucuuagcaagguggaaagaaguuauuuagaguugggggcugagguaggcguuggggugcuagaaugcggacgcagagcucuagaaccccugagcaucuuuugcaguugccuuccggcaagacuaccggaggagagccaguugugauacuacgucauuuccagaucucagucccuuucuucccuuccuggaucuuggguuccaaagacagauuugcccuccugucuaccuagaagugaacucuggccaggacucuugucugguugagagagaagggugugucaaacagaugagagagggugguuuuccuuucgagcuuccucccuagcuugcuccccuacugcacuccacugucuggccuugcaucuugggccuaauccagaggucccagcuccagcuaaaaagcucuugauguggccucugucucagacgucuuguuuuauccacauuuggagcaugaagaaguuccuggcauaggccuuagcaaaaugggugucauuuguuaaccaaucugugggccuaaaagugaagccauggcuagugaaggaguccuggggagcugggaagaugggaugagggcgugucaguucugggugagacugauaugcaggaggaauguaugucaugguccuaguggggaggagagagaaaucaggaggagugcaaaggaaucccucucaucaacagaauauagugauucucaauagagagaagaguguucauauauuagagguccugagaguguaucagugcccuuaacgcggucugucugagguuccguggccacguuacacguggugucugugggauagacaggaauacgucauuuguggugucuggagaggucagucgcuaugugguauggacaggaauggagucacucguagggucuuggguucaacgggagcagcauuacucaagugucagugguguagacaaacaggugaccaacagcucuaguguagacaggggcugggucacucacagugucuguggaguaagcaggagccgaucacuuauagugccugcaagguagacuggaacaaagucacccucaaggucuguguuaauacacaaacacgucacucacacuaauguuaucuguguguaugccaccaggaccacagaugagauuguagaguguaagucagcauugacacuaauaauguucuuauauaaacuaucuggucuauaaggcaguuggugugacauuuucagacauuagagaauagauaaauguguauuacagcuuucacuggcauggugggacuuuccugcaauggauagaacacacacuguaguagucagugguccagaaagcuaccccuguuuugauaucuuuguaguauugagggcagugaugucaaacagugaauaaaguuauauaucuauguggugaucuuauuuuaaccucaauauuauuuuagugauuuguaagucagaauauuugaaaucaaccuugcuagaaaauccaggaagcaugguccucaaaaauauauauauggcacugagucucaguucaaagauuuggcaguuugauuggggagggguuguauccuugaaauacaguguuguuucuagugacuagaaauagacaagagcuaagguguuggggggggcucuagggaagauagugagcucugucacacauuauguuaaagggaugacuugaagcuuugccucucaagaagucacacgugggugagguuauguggaugcagaaugucuguggucugaagcaaggccguauccccauaaucccaugcccuggcuuugccuguacacagauaaacagugauuauucacccucaguggagaaggagaugaggauguuugcacucuaacguaaugagcauugcaaaaaacucucuccugaugccuuuacgugaguaagaccaugauuuacagauuuccuuucacuuugucacauuuuagcuuugucaugccugauugcaacgggaucacugagauaggaucaaguauagggaacgugggguauguucucccuuugcgguaacugguggcugagcaggugaccacugauauuuccaaaugaaaaaagacaguuagaaacggugucaaugggcuugcagaggcaggcaugcacugugccacuagauuggaacagaaaauguccagguagcacaugguauuuauagauauacccuagauauggcagaaacacacuuuuauuuagaggcuacuuguuuugaagacgugaugguguauauggaggagagggccugaaccaugcagauguaagugaggagagacuacagguuuagucccauggucuccuuaggccaaguuucagaaagugucuuaaaguaagcaaguauauuauucgaugugugguugagagaacagggccacaucacagaaucacccauagggauuauaguauuuuguacuuaagggcuagacauagggagccaaucgcauauggugucaguuaacuggaaaaggacauaaaaguccuucugccuguguacaauuaugucagacauaucucuuugccccauauagaugguaucucugucucugggauggccagaaucuugucacauacuacucugcagugugcuagggaccugccuguuugguuaugucaggcucuauugcaagaguuuguaaggauggcucaguguguguguguguguguguguguguguguguguguguguguguacacacacaguggcuaagcaggacaguauucugagcaggugaguuuucaguuuaagccuggaccagacaagaaaggugcacggucaggugcagcauuggguccauagaauucuggggucuucucuggacugauggccugccagcuuucuuucaguaggaccucuaagugcuuacaggagacuuaagucaagcgacuuugcuucagguuugcccauaccauuugcuuaggagauuugagcaagggucuagggucuuugaccuuuaguuucuucaucuguaaauugagcaguuucugugugucucugaagguccuuccggcuuuaugaauccuguguuucucucuuacacuuauucucugucucucaggucaacaguauuuaccacagccaccauuucuaugacccuuaaagauagcaguguacauuuuuauguuaccuuauuuaaucuuuacuagaacugugaaggaauccuuuuaucuccuuuuuaaagauaagaaaauggauguucaaauaaauuuaaugguuucuacaauugucuuaaaaccagcaaagauaccagagaggcacaaccaaacacugauccacacucuucuaacucuauauucuuccgucauucauucauacgauacaucuuuguugagggccaacuaggcuucaggcagaggggguuauauggcaguguuugucccuucauggugcucauaaucuagccuggaaaauagacauuaaauaugacaugacaagugcaagguguguuugaggagaagcaaaggauucucuguugcaaaagaggauuccaggcagaggagcagugucuacaaaggccuacaggugagagacacagagagaagugagcuaaagacacugaaagccagugggagaggggggggaugggggcagggacagauggugacaggugaauaggcugcuagagaagaaggcagagccagguugugcagggaguauaacccaugcugaagauuuagauuucaucucaagagcauucagaggcugcugaagaaucuaagcuagaacuggugcuuuugaagcucacuuaggugcuguauggagaaaggacuggaauagcgugaaauggguggaggccagugcccaagcuguggccgggugcaguggcccgggcgagacgguagcagcaugcaccaguggagagggaugggauagaaguggacagucuuaagggauauuuagcagacgaggucaauagcacauggugauugauuagauauggggaaucugggccaggagggaaacaagaauuuuauuuuauuuuaauuaauuaauuuauuuauuuagagacagagucucacucugucaccuaggcuggagagcagugaugugaucuuggcucacugcagccucugccuccugggcucaagggauccucccaggaucccucuccugccucagccucccgaguagcuggaacuacaggcacgugccaccaugcuccacuaauuuuuguauuuuuuguggagacaggguuucaccagguuguccaggcuggucucaaacuccuagauucaagcaaucaaccugccucagccucccagagugucaggauuauauacauaaagugcauugggaaacucaguuuuucaucuguaaaaugggcagaauaaugguacccaucuuauacgaugacucuuagauguauggcacauacauauuuaaagaagcauuucauuauuuuuaaugacauguaugcaggaaaaccuuaguguuucagaaugaaaaauaagaaaaauuaauuuguuguguauagagcucuaaauguuuaaaguucuguguaaacuguuaaucaugauuuuaggaaaaggugggcauauuccauugaaguaaaaggaucacauuuuauucugaccugaauuuuauucuuuaugugaaaaauauuuauuaaacacugaguauaggccacuauuaggcuaaguauggauaauucagcaagucauaguucuuaaucucauaaauuuuacuaucuauugguugcaauagaggguaacucaaaauacacacaucauuauauaauuauaauuguauaaaugcuacaaaggaaaaguaaagagaauuauaguugguaagugcuacaaagagggguacaauuuaaccuaguuaaaagaucaggggaggccaggugugguggcuuacgccuauaaucacaacacuucgggaggccgaggcggguggauaacgaggucaggagauugagaccauccuggccagaauggugaaaccccgucucuacuaaaaguacaaaaauuagcugggugugguggcacacaccuauagucccagcuacucgggaggcugaggcaggagaauggcuugaacccggagauggagguugcaaugacccaagauugcaccacggcacuccagccugggugacagagcaagacuccaucucaaaaaaaaaaaaaaagaaaagaaaaaaaaaaaaagacuggaggaaacugaagggguaaaaccaggaaaauguaauaccacaaguaacaagagaguauuucuaaccucaguacugucaaauacugacaagaaccacccaaaaugaagauccauaaggucuucuuuggaauuaacaacaugucgauuguagggaauauuggcagaaugccgcuaucaaagcucaguuggaggcaggugggaugugagaguaugaagacagcagauaagagcaacuccuucuagucauuugaaagaugagaagaaugugggaaugcuuccauaccccagggguuguucagcagggauguugaagguaugagugcacaguguuccuggggaagcaggcaagaaaugacagagcauggaaaggagggauacgucuuuuccugacugagggcggaagauagaaagaguggaaauacagguugcuuuggaucgcaagaaauugaggugagagaaacccaguuccaucaguuucuauuuucuuugcaaaauaggagaugagguguucugcuggaagugagaagaaaggcaggaaggucgaaaucaaaagacaggaaggucaaaagaauuaaugagaagaguucauauggauacugaggccaaggggagaguaaggugaugcagaaagcacccuucuguggucuuccuucaaggugguaaugugucuaguucaacacuaauccaauaaggcuguuaucaucccacuuuacaacagcugccucuagaauuggaaacaaaacuguuaguuacaaugcuguaguagacacuauggaaaacagaaagaugaguaaacuccaaacccucuguaaagaagaugaaaccauagcaccucacacauuggcuaucauagccuggccuauuuuaacugauguccacagcuuaagaggaagacccucuccugacacugcuucucuggccuaauagaucugaggugugucccuugcugugucuggggguuauaugaggaugagucacuccuaguguccgaagaguagacagggagagacagaagaugacauaauggagucuagagagaacugacaacugggagcuucugggcacucucugacaaugguccucugcuauaauuuaauuguucauuaugaccuguuucccucacaagaccacagucuccaugacgacaagaucuuuaucucauucacuacugaaugccccacacuuaacagggucgcuaggaaaauauuuaugaaauaaauacaucaaugacaaguuuuuuagaggcuauugcuuauuuuguugagaaccuguugucucaaagaaugacccuaaauggaaccaaauaaaugcaucacucuucuuuuuuauggucucuuccucugauagguaaaagcagaguuguuagaaacauuugucuuugauuccuccuuaggauucagcccugauggaggcugaggaggcccagcguggagccucuccucccaucucugccauagaggaauucagcauuaucccugaggcucccaugaggagcagccaggucucugccuuggggcuugaagcucaagaagaugaggacccauccuauaaguggagagaggaacacagacucucagcaacucagcagagugaguuaagggaugugugugacuaugcgauugagacgaugcccucuuuucccaaggaagguucugcagauguggagcccaaucaggaaagccuuguggcugaggccugugacacuccggaacacugggaggcaguaccccagagccuagcaggccgacaagcaaggacucuagcucccccagagcucugggccugccccauucagagugagcaucuagacauggccccauuuuccagugaccugggaagcgaagaagaggagguggaauuuuggccaggacuuacuucuuugacauugggaucuggacaggcagaagaagaagaggaaaccucuucagauaacucuggucagaccagauauuauucucccugcgaagagcauccugcagagaccaaccagaaugaaggcucugaaagugggacuaucaggcagggggaagagcugccaccugaggagcugcaggaaagucaagggcucuugcauccccaggagguccaaguucuggaggagcagggacagcaggaagcaggauuucggggggaaggaacucugagggaggauguuugugccgaugggcuauuaggggaggaacagaugauagagcagguuaaugaugaaaagggagaacagaagcaaaaacaggaacagguacaagaugugaugcuugggagacaaggagaaagaauggggcucacuggggagccagagggucugaaugacggugagugggagcaggaggauauggagaggaaggcucagggucagggagguccagaacagggagaagagaggaagagggagcugcaggugccagaagagaauagggcggacucucaggacgaaaagagucaaaccuuuuugggaaaaucagaggaaguaacuggaaagcaagaagaucaugguauaaaggagaaaggggugccagucagcgggcaggaggcgaaagagccagagaguugggaugggggcaggcugggggcagugggaagagcgaggagcagggaagaggagaaugagcaucaugggccuucaaugcccgcucugauagccccugaggacucuccucacugugaccuguuuccaggugccucauaucucaugacucagauucccgggacucagacagaguccagggcugaggaacugucccccgcagcucugucucccucgcuagagcccaucaggugcucucaccagcccauuucucuacugggcuccuuuuugacugaggagucaccugacaaggaaauagaucaaaacagccagcaagaggaauccaggcugaggaagggaacaguguccagccaagggacugagguggucuuugccagugcaucugugacuccuccaaggacaccagauucagcuccucccaguccugcugaagccuaccccaucacaccugccucgguaucugccaggcccccaguugccuuucccaggagggaaaccucuugugcugcacgugcuccagaaacugccagugccccucucucaauggaugacccaucucccugugggacuucugagaugugcccggcugcccucuauggcuuccccuccaccgggaccagcccuccgaggcccccagccaacuccacaggcaccguccagcacuuacggagugacuccuucccugguucucacaggacagagcagacuccagaccuggugggaauguugcuuuccuacucccacucagagcugccccagaggccccccaaaccugccaucuacagcucugugaccccaagaagggacagaaggagugguagggacuacagcaccguuucagcauccccuacugccuuauccacgcugaagcaggacucucaagaauccaucucaaaucuagagagacccagcaguccucccagcauccagcccugggucuccccacauaauccagccuuugccacagagucucccgccuacgguucuuccccauccuuugucuccauggaggaugugaggauccacgaaccucugcccccuccucccccacagaggagggacacccaucccuccgugguggagacagauggccaugcucguguagugguucccacgcugaagcagcauagccacccuccuccauuggcccuagguucagggcugcaugccccccauaaaggcccacuuccccaagccucugaccccgcuguggccaggcagcaccgaccucugccaucuaccccagacagcucccaccaugcucaggccacccccagguggagauacaacaagccgcuacccccuaccccugauuugccgcagccccaccuuccucccauuucugcuccugguagcucaaggaucuacaggccucuacccccacuacccaucauagacccucccaccgaaccacccccauugcccccaaaguccagggggaggagcaggagcacucggggaggacauaugaacucagggggucaugccaaaacaagaccugcuugucaagacuggacagucccccucccugccucugcuggacgcaccuccuggcccccggccacagcuagaucaacagagucuuucacuuccaccagcaggaguaagagcgaaguguccccuggcauggcuuucagcaacaugacaaacuuccuaugccccucuuccccuaccacucccuggacuccggagcuccagggacccaccucuaaggaugaagcaggggucucagaacacccugaggccccugcgagagaaccuuugagaaggacaaccccucagcaaggagccaguggcccagggaggucaccugugggccaagcaaggcagccagaaaaacccagccaucugcaccuggagaaggcguccagcuggccccacaggcgggacucagggaggccaccaggggacagcaguggacaggcuguggcuccuagugagggggccaacaagcacaagggcuggagccggcagggccugcgcagaccuuccaucuugccugagggcucuucaggugagcaagaaccgggaccacagugacacaucagaccaagcuuuucccagcucuucccaccucaucccaucuucugucccuaggguuccuaacauucucucugcuggcuucgcucacaugugugccuaaccucaacacagagagagccccgaagugcccuccaagcuccuugggaugcucuuccuucuucuuccccucuaucucccugucucucccucaaccagcaccuucuuuggaugucccaagguuauuuuggacucccuucuacucuucaguuacagucccugcuugcucuccuccuggggaguagaaaaggccuucuguacuugucccagucccauccugacccguggcucgggacgucacugguacugaucucuuucacgcucucugcuuugccacuuucuucccucccaguuucccaauaaagcccauuuucccuucuggaccccugcaucuccugcucuagaucuucuuuggcucucucuaucccucugaaaucucaguuaucuuccccauuuccacuuuuagauucaagagguccagccguggagaaacauccgggacccucagacacuguuguuuuucgguaagucacccucuccccuaacagccacacuguacucucuucacuugggauacugagaguccccuagugaggauuucaguugauaaggguucugagaccccgaauggcucauuccuguuucuucuugguguaaggaggagaagagagagaugccgggaugccagcuuagggagauugucuuuaucuaccucauucggucagccgagccuacgagucauccaucuucccaagcccuauggcugugaacuaaaccccacaaaagcuccauguuagcccaagugggucaaguugcaacucugugccucuccgggggauuuggucuugacaucccagcacacaucccagaggcuagagacuuugucccccacagucaccuggggugcucugugucuaauggccaguagguaccccagagcccuucuuuacuccacagggagaaaaaaccaaaggaggugaugggaggcuuuucaagacgcugcuccaaacucaucaacuccugugaguaccuugaaguggaacuauagaaccaggugggcauucugcccagcacuggagaggggcuuguggaugucagcagugggguggggaugucccuagcgagaaggcauugcagaagaucuguuucccugccuccgcucaccgucccuucuuccugcuucucuuccuucccaugcuucuuugcccugcagcccagcugcuuuaccaggaguauagugauguuguccugaauaaggagauccagagccagcagcggcuggagagccuguccgagacacccgggccuagcucuccgcggcagccucggaaggcccuggucuccuccgagucguaccugcagcggcucuccauggccuccagcggcucccucuggcaggaaauccccguggugcgcaacagcaccgugcugcucuccaugacccaugaagaccaaaagcugcaagagguacugggcaggccacgguggggagggggcuacagaaaagaugacaaggucuuguuugcuagcauccuucucuccugcucaccacugccaccaagagucggcuguccccaccacacaggcgcguguacaugccacagcugugggucauguccauucugaagaaguugaauuguuuucuggauuucaccaccuccccuuucauccucaccuccucaugccauaggccacuugcuccuaccugauguuggucugggcuauacaugguggccauugccucugaauuuguguggaggaauguggaguuaaucccaucaucacugcuguuucaggguagaggaaagcuucccuguucaaccaggguuucaggcuacacuacaguuuuccucuuuagccaaggcacauuccggggcucuuuguugggucccuugaagagggcccuuugcagcuguccugugguccaucaaucuaacaggggccuuagagugaucaucagucccugcuugauuguuacucccaacagcaagacugaacuagaggcuguuugucugauucuaagcuauuaccauuaguaaguuuuacauggagagcgccucuuauuaauuugucugaaauaugggguaaaaccuuucuucccagaaagacaguauggaacaauggaauagaauaauguuuaagaaauuagguucuggaagaaaugaccuggauaugaaaaccacuuuuuuuuaaaauuauuaauuuauuagagacagggucuugcucugucacucaggcuggaguacagugguacaaucauuguucacugcagccucaaccuccugggcucgagcaauccucccgccucagccucccaaguagcuaggacuacagguaugugccacuaugccuagcuaauuuuuuaauuuuuugaaaagauggugucucacuauguugcccaguugucucgagcuccugggcugaagcaauacucccgccucggccucccaaagugcuggaauuacaggcaugagccacugagcccagccccagagcccacuuuaauauuuccaauuuaccuuuggccaaaugacauuuguaaaacugagauacaaacaguuacugcaaggaucaagaaacaugaaugccugguacauaguaauuucucaaaaaauguugacuuuucauuuuaaguaagccagaccuagguuugaaacaugacuucaccauuugcuagcuuaggcagccuuauaacaucacuaaaucucaguuuccucacuugcaaauugaggauaauaaugccuaccuuucaggguugcugaaugguuuaaaugaaauaaugcauaucuaauuuagcaguaauauuugauguauaguuugauaaauauuagugccguacucucugccuuucagaggcagggaggaguaaaauuugggccaggaggacuuauggacagacaaugcuuuuaccaagucagagagagaauacauuuuuagacuuugcaaaguucagacuugagagcccuguuguggcugcaaauuuuuaagcacagagaagauauuuagaaaauaacucaucuuccccauauuuguugaccaaacagugggagaugacacgaguucuagcucucuuuuaccaacuccagcaugcugggaaguccagcaggacuccuauuccagcccuggucucauguuugugagaagaaagggcuuuacauuucuaucucuuaaacacacauauucauuuuauaaaguaguaccucugggguucacaaagugcuuucacaggcuccauuucuuucaacuguugcaucuuccacagugagaugggggucacuauauccacauaaaaggacacgaaaagugagauucagagagguuaaaugagccacccaaagucagucguguagugaauguuagagcaaggaugcaaaugagccuucagugucccuguucaggguuguuguaugggagggucaucuggcugugucauuggucauccaagucaucaccagggugugucuccuuucucuuuucuauccaggcaucucucuugaggccacaugcuuggaugaaaagcaugaggagcccagcuagaggcacggucaugagucauagcgcccccugcuggaaccuccagacaaguucucacaugcugggcaugcauuaaaccacagcugcgccaucuuguucucagauauccugcuucugucuccugcuucucgcgccaucuuguucucagauauccggcuucugucuccugcuucucaucuguccucaaaccucaaacugagcucaucaccuucauccccuaaaucuaugccuuuucaaaguucucuggcucaguaaaugacuccaucauucacccaggugcccgacucaaaaagcuuuugcugugaguacaaaacauuagcuuugaaccuuccuucucuuugaggccccauuucuagcaaauaauccaacccuuccaauucuaccucauaaauaauuauaaaauuaaucuacuucucuucagcuccauggcuauucagaccuucaucucucauguggaauuauuacaacaguuucuuaacauggauggcuuuugcuucuuuucaucuuuucuucucauucugcuuagaaauaacuuuaugaaaaacaggcugggcgcagcggcucacaccuguaaucccagcacuuugggaagccgaggcggguggaucaacugaggucaggagcuugagaacagccuggccaguauggugaaacccugucucuacuaaaaauacaaaaauuagcugggcgugguggugcaugccugucaucccagcuacucaggaggcugaggcaggaaaauggcuugaaccugggaugcggagguugcagugggcugagaucgugccacugcacuccagccugggugacagagcaagacuccaucucaauuccaaaaaauaaaaaaaaauaacuuuauauaaaacaaauguggucaaguuauucuccuauguaaagccuguuuucauugucccauugucuuaaguccaaacaauuuuacauuguuuacauuacccuucaggccuccucgacugcugcagcuucaucucuggccacuacugcuguacacuugguucaaaaaaugcucaauuuauuuaguuuaguuaguuuguuuguuuguuuugagaugggguuucacucugucaccaggcugaagugcaguggugcaaucugggaucacugcaaccucaccucccaggcacaagcaauccuuccgccucagccucucaaauagcugggacuacaugugcacgccaucacauccggcuaauuuuuguauuuuuuguagagacagggucucucuacgucgcccagccugguccugaacucccagacucaagugaugcacccaccucagccucccaaaguguugggauuacaggcgugagccacugcacccagucuauuuagcuuuuuuaauauaaauuucauuguguauauuaaagauauacaacaugauguuaugggcuacauauaaauaguaacagaauuacccuagugaagcaaauuaacauauccaucucacuuuguuacucauuuuuuguucuuguuuuuguuauuuagauuucuugaaagcauauuuuucuuuuauaccuuugaaggccuguaccuguacccuagauuaaauccuacucaaaugcucuuccccuccccgcagaucaacuuagguucuggugugacugugaaccauaaaaggaucuugcucacugcucuauccccaaaacauuacacaguggcuggcauauuccaggggguaaauaaaauccuuaauuaaucuuccucaucuccaaccuccuaggucaaauuugagcugauugugucagaggccuccuaccugcgcagucuaaacauagcuguggaucauuuccaacuuucaacuucacuccgggccacacuuuccaaccaggagcaccaauggcucuucucucguuuacaggaugugcgagacgucagcgccacgugagacuccccuucuccuaaauaccacucacucagccucacuguuguuaggcuuuaaauguuccguuauuuuuuuccccucuuagaaacccuuucauuuucacaguuaugggaagaaauugggccucaguuucuuccaugauucccgaugguuauaggaagaagaauggcaagaagaggagagggucuguggguggauagauccauuaauggauaaguaaaugagcaaugcuuccuggguugagguuuuggauuacuguggucaugcacugcauuggagaugagguggaaaaaccaucuaaagaucagaaaaccugaacagggucaaaagaagaaugagaaauggaauauuagaauaaaaguguuaaaucaggcucaaacucaggacaguuuuggagcgaauucuagugcauagcaaggagcacagagcagagagucaauagaaguuauuggcuaauggagugaagaagucaccagcucaguguacaccaggggccagucagcuguuuagcugagguccagaagucucaugagacucguuuaaauccuguacagguuccuuucagaccuggaagagaacuuugagaacaauaucuucuccuuccaaguaugugacguaguccugaaccacgccccagacuuccgccgggucuaccugccuuaugucaccaaccagaccuaucaggaacgcaccuuccagagccugaugugagacucaucccccauuuaauccccauguaggcccugaggugaccaugcaccaguccccagcccagagggcuaucccaagagcacacuuuccccauuccgcccucuguauugguuaccccagcaucacaucugagcgcccuguacaucagcucccaccgcucuuucccagcccacagauacuccacugaccucccuuccccgcaccuucacugcaucccccauugcuccccauauccccccuccccuaaggcucacucuccgugcaggaauagcaacagcaauuuccgggaggucuuggagaagcuggagagcgaccccgucugccagcgccuuucccucaaguccuuucugauucugcccuuccaacgcaucacccgccucaaacugcugcuccagguagggcagaugcuaccuugauccucuccccuuaacucaaagggaugcccucaggaagacccacaacaaaggaccaaccauucuucugccagguguccacauccugucucccugcugcccacugccugcuugcuuggaaauauuugcugcuaaaauguggucccugggcuucuccauucaccagcccccaaucauuucuuccuguuucccauuucuuccucccaucucacuccugccuacugucuguucaauagaacauucugaagagaacacagccuggcuccucggaggaggcagaggccacgaaggcacaccacgcccuggagcagguaggcagccaccaccuccacucugacccucuguguguucuucucagagaggucuuucccaccuaggcccaugacuccagggagcaugggaggugggacccuguugggagagcucagccaccucccugcauccgccaaacuuccaaacauacacaccccacggccaccucucccacgccgagcacacuccacaucaagggacugugcccucuccaccaucacccccccauucagucucacuuuuacucaguucaggaauguucugccaagucauacaaaguugccuaggacuugugcuugauacugccugcccaauuccagccugggaaaaaugacugaggcugucauaaccuauuuccagauugcuugcaagggacucaaaggucaaagccucuaacacagugcccuuccccuuuccucacucucugcaccccuagcugauccgggacugcaauaacaauguccagaguaugcgacggacagaggaacuaaucuaccugagccagaagauugaguuugagugcaaagugagucggucccaugcaccccaucccugcccaugaacucccuuaacauguccugcagaucacccccuaaccuggaaccaccuugcucacauuauccccagccccuccccucauuucugcccaccuucuauucuguccuauuucugggaggccuacuugggucuccaagacauacugcuaagugaaaugaugaagguaaagaauuguguguauauuauaucaccuuugguauaaaagugggaggauacaaaucuauacaggugucugcuugugugugcauaaggaaacucuggaaggagaacaagaaaaaaaggaacagugguuaccugaggacaaggggggugcauuugagaaaugggcaaaugagagagaacuuuucaggaugagccuuuauaaaagaauguuuuggugcuugauucauuuauuacuuuaucaaaucucuuucuagucuaaucaaacccacauaagauuggauccaaauuuagagccagcaucccucauugaaauacaaaucuaaaauagacauuccacauucaaauuccaacuuagaacagauacuaucuuuuuuuuuuuuuugacagagucucacucugucgccccaggcuagagugcaguggugcgaucuuggcucacugcaaccuccaccucccagguucaagcgauucucaugccuuggccucccgaguagcugggauuccaggucugcaccaccaugucuggcuaauuuuaguauuuuuaguagagaugggguuucaccauguuggccaagcugaucuccaacucguagccucaagugauccacccaccucugccuuccaaagugcugggauuauaggcgugagccaccacgcucgugcuuagaacacauacuaucuuuacacuccugaaaaagaaggaaaaucccuuauucacauacuaagcauagaccacacccucaucuuuaaccaaauuccagcuccaagacgccccaccuaguucuucucacccccauguuugauuccagcugcucacauaucucugguauaaaaaauggaauugauaccagaccugccucuaauauuuuauuuuaaccucuaagacacauauaguguucacugacuuguuccaucacauacccugauuggacucuuccaucccuccuucaguucaggcuucuagggcagagcugucccacacacucacuauccugaguuggaccauaggcaucuucuauuuaccugagcauacaaccaugggagccacacaccaguggacagugguaguuagaggguucagagagaaagagaaucuaagugauggguuaugagccagaaggcagauguggaagagaugcuuguucaaguggaacuugcauggaaguggcauggggaggagggugggacugggagcaaaccucaugcuucucccaucugugacacugccuucucucucuuccucugcccuguagauauucccgcucauuucucagucacgcuggcuggugaaaaguggggagcugacagccuuggaguucagugcuuccccagggcuacgaaggaagcugaacacgcguccaguccaccugcaccucuucaaugacugucugcugcugucucggccccgagagucagugacuggaguggcaggccagggcacaagaggggaaggggaugaggaaagaggggggucugaaagggagagagaagggucauguuccuagaagagcccuucucaauggcuuaacccauagagcccaggucauagccuagagaagagaaaaacaagcccaaagcaaaaaggggaucccaucaaacuguaucaugagaccacauagcaggacauguaauaugguauagacacagagcaaaauguagcaaauuagcuuaucacauucucacaugagucuauuuguggcuucuuuggacuggccucaaccugcuauucuagagauacuuagcuaauuccagagcuuaagucucuggucuuaagguucuugggaaauguauauaaauuccaucucuucaccucuuuaaagugguaauguauccacugcacuaggugugugguuugccagacuaggacaaaucccugaggacccuggagcuaccaucuugggagcaaguuaggaccaucuuaugguuuuugugggaauuugcaggcuguagauguagggauuucgaacccaagguuaugaggguaggugaaguauggaaacucuagaaucagguugaaaagauuuguauuuugcagggguagccgauuccugguauuugaccaugcucccuucuccuccauucggggggaaaagugugaaaugaagcuacauggaccucacaaaaaccuguuccgacucuuucugcggcagaacacucagggcgcccaggccgaguuccucuuccgcacggagacucagugagauggggcugggcagaggagcugggggugggggaagaugggcagccgagaaaagaagugagaccaaggcagaaaauguguccagaagacagccacagccucauuuagcccauucuggacuggggaccaccauagagaaauucagacuccuaaaacuaauggauaacuugcaggagauuggggugggagaggguacaaagucaccaccgaggcuuagcaucuauuuuauacucuuuacucaagagggacaaggucuguguaguaucagaaaggagaaggacugguauggagugagcaaggaauuggaauacugguaucugugagcacaugccuccaugccugaggcagaaacccuucuaugccccagcuggugggcacagaugugaauaagacaagugcugggugacuuuuacuuucugugcucccaucuuccaaaccaguccucuauugaccagaaauccauaguguugagaaugcugauuugcucauguuuucaauaauaauaaaauaaaauacauucacacagacauacauuuuugagaguauuaauaguaccuauaaaaucuggaacacagugccugcaauaaugaacauguaaaagccuguagcuguuauugcuauuauaaaagauauaugaacagucauuuaaaaguuugacguaucuaaguguuugaggaucccuauguuguagacacuuuuucaguuuugucccuuggaagauacuucagagugggaccgauaacaccuguucucauuuauugaacagaaggacuaguaucggaguuugugugcaaaacagcacauaagucaaauaaucaggugcagaugcauguuguugguuuggugcuuugggcacugugccuggaacaguaauaguccauucccaguuaccuaggcacaacugggcacagaggcuaacagaaugcagaaaccuucagaugauuacaaaccuaagcuuggauuacaccgugcaacaacaacaaauaaaacaguagacauaucucccugaucuaauuauuauuaugaaacaaugaucaucucugagauaguuaguugaagggagauaggcaagcgagugucaagaaucaugccaaaugauggagggaaucuaaacugaaaugaacacuucgcuuagcacaauuuccaaaacagaaaaucuccagacuuuaugacuaaugaacauuacgccccaacuuggaagauaugagaagccauuaggaggauaauucuggaaagagaagaggaaaaguaaagugugacaagacacauucacauauaguucaagauugugucauguuuccaaccaaaaagaguccuauauaguguuugauagaagucauggaacuagauaaguccuucccacagucuuuugccauccccauccuuggcccuccuccuacacccccacaauugaugcuaugacccugcuuuguuuucucagaagugaaaagcuucgguggaucucagccuuggccaugccaagagaggaguuggaccuucuggaguguuacagugagugagggucuaagagggagagaaaagaaagcagggucagaugucaccuuuggauacaggaguuuaaagggcugggugggaacucuaggcuuucauuuauugauauuccguaaaaugucaggguggaagauuggccucuagagcuuaaaaaccugaaauauaucgccuaaaacugcucaucacuauggcagucccccuuccccauacauucccuuccuugggcaauaguuugcucuuuuuaaaaauauuuguccccuuaagucuaagcugacauuauuuugccuagauuuuaccugcuugaaggucuuguugggguaggggaagaaagccugacggugguagaaggugugcaggaggauagcaccccagaucuaucuugaccacaccuaagaggaugaccugaggucaccuaccccaggcuucugggugcccauggggagccacaggcacacacacauuauguaugugucuguguucacaccaagacuggacuucuuaugccucucaugucagccccacaguuguccuccagcaaagauucccuaauuuaaauccagagagaaucugaccucaacccuggaccuuuagugacugaaaagaacaaacaacuacaaggaacccugggaaugaaguaggagagccguguaguaacugaacgcuguuaacuugcucacugugcacuccaucugcuggcuucaguuccccagugggugaggagggcaggagcauucuuccuccuucauuuugaccuugugaauggcagauggggaggaucuugagaaagcaaauaguaaugcaguauuccauuuauuuuacaagagaaucaaggcaguguaguaacaaaaaagagccauaaacccacauaugauggaauacugauaggugaagcauucucugaggcuuguuuucuugagcuucagaucuauggacaugucuccugguucucaaaaacauagaaauagagaaaucuugaauguccucaagauucaucugaucaaccuugaucaauaaccaucuugaucacugauagaugaguaaacugaagcuccagggcuuucagucucuggcuuaggucaaaccugggacaccacuaguuaagucuuucuugguuccacaucugguacugggaagaaaaugaagaauaagacacagacucagauuuuauaauccaguuggagaggcaaaacacguccauguagcaguuaaauaagggauaaaugccuuggcaugaacaagcagucuuaaaagaguucagaacccauugaagacuagagucagggacgguuucagagggaagaugggucauuagcuggaucucagguauuugagaugaucacauguauuucucaacccgucuccucuggagaaguggaauuuuugguccauuucauuucugguaugucuauuucuuuauuaaccauuuucaaauuuccucuuuugucugugacuuucaacagcccaaaucugucucuaucucaaguccucccacgccaccccccuccaagucccugucuguguuccaauccccugccucuccuaaccucucuucacacucuucucuuccaaagacuccccccagguacagugccuucgagccuacaagccccgagagaaugaugaauuggcacuggagaaagccgacguggugauggugacucagcagagcagugacgguaagcgggagcaugcgugagcagcaggccaggcacugcaggcagggcagugcugggaguguguucacuuccugcagcugccaugacaaaguaccauggacuggguggcuuauggcaacagaaaugcauucucucacaguucuggaggcaagaagucccaaaucaaggugugggcagagccacgcgucuuuugaaaccuguagggaagauccuuccguaccuuuuccagucugguagccccagcuguuccuuggcuuguggcagcaucccuccaaucucugccucugucuuccuguggcuagcugccuuccugugucuguguccaaguuuuccuccuuuauuuuuuuauuuuauguauuauuauuauuuuugagacagagucuugcucuguugcccaggcuggagugcaguggcgcaaucuuggcucacugcaacuuccaacuccuggguucaagugauucuccugucucagucucccaaguagcugcgugagccaccacaccuggcuaauuuuuguauuuuuaguagagaugggguuucaccauauuggucaggcuggucuugaacuccugaccucaagcaguccacccaccucggccucccaaagugcugggauuacaggcgugagccaccacgcccagcccaaguuuuccuccuuuauauagacaccuguuauacuggauuaauggccaccuuacuccaguaugacaucaucuuaacuuuauuaauuauauuuguggcaaccucauuccccauaaggucacauuuugagguauagaggauuagaacaucaacauaaauguuaggagggacacgaugcaaccauaacaguggugaaggcucaggaauggacagcuguagacuuggccacacccagggccgccauguuaggacacuuggaggcuggguuuaugcuggaggcuccccaguucacucagccugaggauucagaaaacucuccaggaaggugauccagagaagcuaucgugagccuuucccagguaauucuucccacucacccugugcccacaggcuggcuggagggcgugaggcucucagacggggagcgaggcugguuuccugugcagcagguggaguucauuuccaacccagagguccgugcacagaaccugaaggaagcucaucgagucaagacugccaaacuacagcugguggaacagcaagccuaagucuucucugagaggaguuucgugagcugaagaacaagcugcucauggcaagggcuggccccagaacccugcaagagaggccuucuguggauggagaacuaggccuucucaaagcucaaggacaaaauccagcuaacccagucccucggcccaggccuccuuucgugcuuugugcuuggugggggggauuucgagggacuuugcacuggacucugggaaccuuucaucauuaaaaaaagggggaccauuggggccugagccaaggaacuuuccuucuacugccuuauagugcuuaaacauucuccgccuccagggugcagauucagagcuggccagaguuucagugauagccguauguuaaacagaaucucaccucagucuccuggagggagauguuuaagagggguuaacacaucagaugggagggucagcccggugaccucuaagguaucuucuaaccuagaaauucaccauaauuauggugcaaggucagugugucucugagaucuaugucuguugguggcaaugugagggugauacucucucacucuaauaaacuuggcacuucuccgagua

SEQ ID NO: 21234 - RNA, 25232 nt, Homo sapiens
uacucggagaagugccaaguuuauuagagugagagaguaucacccucacauugccaccaacagacauagaucucagagacacacugaccuugcaccauaauuauggugaauuucuagguuagaagauaccuuagaggucaccgggcugacccucccaucugauguguuaaccccucuuaaacaucucccuccaggagacugaggugagauucuguuuaacauacggcuaucacugaaacucuggccagcucugaaucugcacccuggaggcggagaauguuuaagcacuauaaggcaguagaaggaaaguuccuuggcucaggccccaauggucccccuuuuuuuaaugaugaaagguucccagaguccagugcaaagucccucgaaaucccccccaccaagcacaaagcacgaaaggaggccugggccgagggacuggguuagcuggauuuuguccuugagcuuugagaaggccuaguucuccauccacagaaggccucucuugcaggguucuggggccagcccuugccaugagcagcuuguucuucagcucacgaaacuccucucagagaagacuuaggcuugcuguuccaccagcuguaguuuggcagucuugacucgaugagcuuccuucagguucugugcacggaccucuggguuggaaaugaacuccaccugcugcacaggaaaccagccucgcuccccgucugagagccucacgcccuccagccagccugugggcacagggugagugggaagaauuaccugggaaaggcucacgauagcuucucuggaucaccuuccuggagaguuuucugaauccucaggcugagugaacuggggagccuccagcauaaacccagccuccaaguguccuaacauggcggcccuggguguggccaagucuacagcuguccauuccugagccuucaccacuguuaugguugcaucgugucccuccuaacauuuauguugauguucuaauccucuauaccucaaaaugugaccuuauggggaaugagguugccacaaauauaauuaauaaaguuaagaugaugucauacuggaguaagguggccauuaauccaguauaacaggugucuauauaaaggaggaaaacuugggcugggcgugguggcucacgccuguaaucccagcacuuugggaggccgagguggguggacugcuugaggucaggaguucaagaccagccugaccaauauggugaaaccccaucucuacuaaaaauacaaaaauuagccaggugugguggcucacgcagcuacuugggagacugagacaggagaaucacuugaacccaggaguuggaaguugcagugagccaagauugcgccacugcacuccagccugggcaacagagcaagacucugucucaaaaauaauaauaauacauaaaauaaaaaaauaaaggaggaaaacuuggacacagacacaggaaggcagcuagccacaggaagacagaggcagagauuggagggaugcugccacaagccaaggaacagcuggggcuaccagacuggaaaagguacggaaggaucuucccuacagguuucaaaagacgcguggcucugcccacaccuugauuugggacuucuugccuccagaacugugagagaaugcauuucuguugccauaagccacccaguccaugguacuuugucauggcagcugcaggaagugaacacacucccagcacugcccugccugcagugccuggccugcugcucacgcaugcucccgcuuaccgucacugcucugcugagucaccaucaccacgucggcuuucuccagugccaauucaucauucucucggggcuuguaggcucgaaggcacuguaccuggggggagucuuuggaagagaagagugugaagagagguuaggagaggcaggggauuggaacacagacagggacuuggagggggguggcgugggaggacuugagauagagacagauuugggcuguugaaagucacagacaaaagaggaaauuugaaaaugguuaauaaagaaauagacauaccagaaaugaaauggaccaaaaauuccacuucuccagaggagacggguugagaaauacaugugaucaucucaaauaccugagauccagcuaaugacccaucuucccucugaaaccgucccugacucuagucuucaauggguucugaacucuuuuaagacugcuuguucaugccaaggcauuuaucccuuauuuaacugcuacauggacguguuuugccucuccaacuggauuauaaaaucugagucugugucuuauucuucauuuucuucccaguaccagauguggaaccaagaaagacuuaacuaguggugucccagguuugaccuaagccagagacugaaagcccuggagcuucaguuuacucaucuaucagugaucaagaugguuauugaucaagguugaucagaugaaucuugaggacauucaagauuucucuauuucuauguuuuugagaaccaggagacauguccauagaucugaagcucaagaaaacaagccucagagaaugcuucaccuaucaguauuccaucauauguggguuuauggcucuuuuuuguuacuacacugccuugauucucuuguaaaauaaauggaauacugcauuacuauuugcuuucucaagauccuccccaucugccauucacaaggucaaaaugaaggaggaagaaugcuccugcccuccucacccacuggggaacugaagccagcagauggagugcacagugagcaaguuaacagcguucaguuacuacacggcucuccuacuucauucccaggguuccuuguaguuguuuguucuuuucagucacuaaagguccaggguugaggucagauucucucuggauuuaaauuagggaaucuuugcuggaggacaacuguggggcugacaugagaggcauaagaaguccagucuuggugugaacacagacacauacauaaugugugugugccuguggcuccccaugggcacccagaagccugggguaggugaccucaggucauccucuuagguguggucaagauagaucuggggugcuauccuccugcacaccuucuaccaccgucaggcuuucuuccccuaccccaacaagaccuucaagcagguaaaaucuaggcaaaauaaugucagcuuagacuuaaggggacaaauauuuuuaaaaagagcaaacuauugcccaaggaagggaauguauggggaagggggacugccauagugaugagcaguuuuaggcgauauauuucagguuuuuaagcucuagaggccaaucuuccacccugacauuuuacggaauaucaauaaaugaaagccuagaguucccacccagcccuuuaaacuccuguauccaaaggugacaucugacccugcuuucuuuucucucccucuuagacccucacucacuguaacacuccagaagguccaacuccucucuuggcauggccaaggcugagauccaccgaagcuuuucacuucugagaaaacaaagcagggucauagcaucaauuguggggguguaggaggagggccaaggauggggauggcaaaagacugugggaaggacuuaucuaguuccaugacuucuaucaaacacuauauaggacucuuuuugguuggaaacaugacacaaucuugaacuauaugugaaugugucuugucacacuuuacuuuuccucuucucuuuccagaauuauccuccuaauggcuucucauaucuuccaaguuggggcguaauguucauuagucauaaagucuggagauuuucuguuuuggaaauugugcuaagcgaaguguucauuucaguuuagauucccuccaucauuuggcaugauucuugacacucgcuugccuaucucccuucaacuaacuaucucagagaugaucauuguuucauaauaauaauuagaucagggagauaugucuacuguuuuauuuguuguuguugcacgguguaauccaagcuuagguuuguaaucaucugaagguuucugcauucuguuagccucugugcccaguugugccuagguaacugggaauggacuauuacuguuccaggcacagugcccaaagcaccaaaccaacaacaugcaucugcaccugauuauuugacuuaugugcuguuuugcacacaaacuccgauacuaguccuucuguucaauaaaugagaacagguguuaucggucccacucugaaguaucuuccaagggacaaaacugaaaaagugucuacaacauagggauccucaaacacuuagauacgucaaacuuuuaaaugacuguucauauaucuuuuauaauagcaauaacagcuacaggcuuuuacauguucauuauugcaggcacuguguuccagauuuuauagguacuauuaauacucucaaaaauguaugucugugugaauguauuuuauuuuauuauuauugaaaacaugagcaaaucagcauucucaacacuauggauuucuggucaauagaggacugguuuggaagaugggagcacagaaaguaaaagucacccagcacuugucuuauucacaucugugcccaccagcuggggcauagaaggguuucugccucaggcauggaggcaugugcucacagauaccaguauuccaauuccuugcucacuccauaccaguccuucuccuuucugauacuacacagaccuugucccucuugaguaaagaguauaaaauagaugcuaagccucgguggugacuuuguacccucucccaccccaaucuccugcaaguuauccauuaguuuuaggagucugaauuucucuauggugguccccaguccagaaugggcuaaaugaggcuguggcugucuucuggacacauuuucugccuuggucucacuucuuuucucggcugcccaucuucccccacccccagcuccucugcccagccccaucucacugagucuccgugcggaagaggaacucggccugggcgcccugaguguucugccgcagaaagagucggaacagguuuuugugagguccauguagcuucauuucacacuuuuccccccgaauggaggagaagggagcauggucaaauaccaggaaucggcuaccccugcaaaauacaaaucuuuucaaccugauucuagaguuuccauacuucaccuacccucauaaccuuggguucgaaaucccuacaucuacagccugcaaauucccacaaaaaccauaagaugguccuaacuugcucccaagaugguagcuccaggguccucagggauuuguccuagucuggcaaaccacacaccuagugcaguggauacauuaccacuuuaaagaggugaagagauggaauuuauauacauuucccaagaaccuuaagaccagagacuuaagcucuggaauuagcuaaguaucucuagaauagcagguugaggccaguccaaagaagccacaaauagacucaugugagaaugugauaagcuaauuugcuacauuuugcucugugucuauaccauauuacauguccugcuauguggucucaugauacaguuugaugggauccccuuuuugcuuugggcuuguuuuucucuucucuaggcuaugaccugggcucuauggguuaagccauugagaagggcucuucuaggaacaugacccuucucucucccuuucagaccccccucuuuccucauccccuuccccucuugugcccuggccugccacuccagucacugacucucggggccgagacagcagcagacagucauugaagaggugcagguggacuggacgcguguucagcuuccuucguagcccuggggaagcacugaacuccaaggcugucagcuccccacuuuucaccagccagcgugacugagaaaugagcgggaauaucuacagggcagaggaagagagagaaggcagugucacagaugggagaagcaugagguuugcucccagucccacccuccuccccaugccacuuccaugcaaguuccacuugaacaagcaucucuuccacaucugccuucuggcucauaacccaucacuuagauucucuuucucucugaacccucuaacuaccacuguccacugguguguggcucccaugguuguaugcucagguaaauagaagaugccuaugguccaacucaggauagugagugugugggacagcucugcccuagaagccugaacugaaggagggauggaagaguccaaucaggguaugugauggaacaagucagugaacacuauaugugucuuagagguuaaaauaaaauauuagaggcaggucugguaucaauuccauuuuuuauaccagagauaugugagcagcuggaaucaaacaugggggugagaagaacuagguggggcgucuuggagcuggaauuugguuaaagaugaggguguggucuaugcuuaguaugugaauaagggauuuuccuucuuuuucaggaguguaaagauaguauguguucuaagcacgagcgugguggcucacgccuauaaucccagcacuuuggaaggcagagguggguggaucacuugaggcuacgaguuggagaucagcuuggccaacauggugaaaccccaucucuacuaaaaauacuaaaauuagccagacaugguggugcagaccuggaaucccagcuacucgggaggccaaggcaugagaaucgcuugaaccugggagguggagguugcagugagccaagaucgcaccacugcacucuagccuggggcgacagagugagacucugucaaaaaaaaaaaaaagauaguaucuguucuaaguuggaauuugaauguggaaugucuauuuuagauuuguauuucaaugagggaugcuggcucuaaauuuggauccaaucuuauguggguuugauuagacuagaaagagauuugauaaaguaauaaaugaaucaagcaccaaaacauucuuuuauaaaggcucauccugaaaaguucucucucauuugcccauuucucaaaugcaccccccuuguccucagguaaccacuguuccuuuuuuucuuguucuccuuccagaguuuccuuaugcacacacaagcagacaccuguauagauuuguauccucccacuuuuauaccaaaggugauauaauauacacacaauucuuuaccuucaucauuucacuuagcaguaugucuuggagacccaaguaggccucccagaaauaggacagaauagaaggugggcagaaaugaggggaggggcuggggauaaugugagcaaggugguuccagguuagggggugaucugcaggacauguuaagggaguucaugggcagggauggggugcaugggaccgacucacuuugcacucaaacucaaucuucuggcucagguagauuaguuccucuguccgucgcauacucuggacauuguuauugcagucccggaucagcuaggggugcagagagugaggaaaggggaagggcacuguguuagaggcuuugaccuuugagucccuugcaagcaaucuggaaauagguuaugacagccucagucauuuuucccaggcuggaauugggcaggcaguaucaagcacaaguccuaggcaacuuuguaugacuuggcagaacauuccugaacugaguaaaagugagacugaaugggggggugaugguggagagggcacagucccuugauguggagugugcucggcgugggagagguggccgugggguguguauguuuggaaguuuggcggaugcagggagguggcugagcucucccaacagggucccaccucccaugcucccuggagucaugggccuaggugggaaagaccucucugagaagaacacacagagggucagaguggaggugguggcugccuaccugcuccagggcguggugugccuucguggccucugccuccuccgaggagccaggcuguguucucuucagaauguucuauugaacagacaguaggcaggagugagaugggaggaagaaaugggaaacaggaagaaaugauugggggcuggugaauggagaagcccagggaccacauuuuagcagcaaauauuuccaagcaagcaggcagugggcagcagggagacaggauguggacaccuggcagaagaaugguugguccuuuguugugggucuuccugagggcaucccuuugaguuaaggggagaggaucaagguagcaucugcccuaccuggagcagcaguuugaggcgggugaugcguuggaagggcagaaucagaaaggacuugagggaaaggcgcuggcagacggggucgcucuccagcuucuccaagaccucccggaaauugcuguugcuauuccugcacggagagugagccuuaggggaggggggauauggggagcaaugggggaugcagugaaggugcggggaagggaggucaguggaguaucugugggcugggaaagagcggugggagcugauguacagggcgcucagaugugaugcugggguaaccaauacagagggcggaauggggaaagugugcucuugggauagcccucugggcuggggacuggugcauggucaccucagggccuacauggggauuaaaugggggaugagucucacaucaggcucuggaaggugcguuccugauaggucugguuggugacauaaggcagguagacccggcggaagucuggggcgugguucaggacuacgucacauacuuggaaggagaagauauuguucucaaaguucucuuccaggucugaaaggaaccuguacaggauuuaaacgagucucaugagacuucuggaccucagcuaaacagcugacuggccccugguguacacugagcuggugacuucuucacuccauuagccaauaacuucuauugacucucugcucugugcuccuugcuaugcacuagaauucgcuccaaaacuguccugaguuugagccugauuuaacacuuuuauucuaauauuccauuucucauucuucuuuugacccuguucagguuuucugaucuuuagaugguuuuuccaccucaucuccaaugcagugcaugaccacaguaauccaaaaccucaacccaggaagcauugcucauuuacuuauccauuaauggaucuauccacccacagacccucuccucuucuugccauucuucuuccuauaaccaucgggaaucauggaagaaacugaggcccaauuucuucccauaacugugaaaaugaaaggguuucuaagaggggaaaaaaauaacggaacauuuaaagccuaacaacagugaggcugagugagugguauuuaggagaaggggagucucacguggcgcugacgucucgcacauccuguaaacgagagaagagccauuggugcuccugguuggaaaguguggcccggagugaaguugaaaguuggaaaugauccacagcuauguuuagacugcgcagguaggaggccucugacacaaucagcucaaauuugaccuaggagguuggagaugaggaagauuaauuaaggauuuuauuuacccccuggaauaugccagccacuguguaauguuuuggggauagagcagugagcaagauccuuuuaugguucacagucacaccagaaccuaaguugaucugcggggaggggaagagcauuugaguaggauuuaaucuaggguacagguacaggccuucaaagguauaaaagaaaaauaugcuuucaagaaaucuaaauaacaaaaacaagaacaaaaaaugaguaacaaagugagauggauauguuaauuugcuucacuaggguaauucuguuacuauuuauauguagcccauaacaucauguuguauaucuuuaauauacacaaugaaauuuauauuaaaaaagcuaaauagacugggugcaguggcucacgccuguaaucccaacacuuugggaggcugaggugggugcaucacuugagucugggaguucaggaccaggcugggcgacguagagagacccugucucuacaaaaaauacaaaaauuagccggaugugauggcgugcacauguagucccagcuauuugagaggcugaggcggaaggauugcuugugccugggaggugagguugcagugaucccagauugcaccacugcacuucagccuggugacagagugaaaccccaucucaaaacaaacaaacaaacuaacuaaacuaaauaaauugagcauuuuuugaaccaaguguacagcaguaguggccagagaugaagcugcagcagucgaggaggccugaaggguaauguaaacaauguaaaauuguuuggacuuaagacaaugggacaaugaaaacaggcuuuacauaggagaauaacuugaccacauuuguuuuauauaaaguuauuuuuuuuuauuuuuuggaauugagauggagucuugcucugucacccaggcuggagugcaguggcacgaucucagcccacugcaaccuccgcaucccagguucaagccauuuuccugccucagccuccugaguagcugggaugacaggcaugcaccaccacgcccagcuaauuuuuguauuuuuaguagagacaggguuucaccauacuggccaggcuguucucaagcuccugaccucaguugauccacccgccucggcuucccaaagugcugggauuacaggugugagccgcugcgcccagccuguuuuucauaaaguuauuucuaagcagaaugagaagaaaagaugaaaagaagcaaaagccauccauguuaagaaacuguuguaauaauuccacaugagagaugaaggucugaauagccauggagcugaagagaaguagauuaauuuuauaauuauuuaugagguagaauuggaaggguuggauuauuugcuagaaauggggccucaaagagaaggaagguucaaagcuaauguuuuguacucacagcaaaagcuuuuugagucgggcaccugggugaaugauggagucauuuacugagccagagaacuuugaaaaggcauagauuuaggggaugaaggugaugagcucaguuugagguuugaggacagaugagaagcaggagacagaagccggauaucugagaacaagauggcgcgagaagcaggagacagaagcaggauaucugagaacaagauggcgcagcugugguuuaaugcaugcccagcaugugagaacuugucuggagguuccagcagggggcgcuaugacucaugaccgugccucuagcugggcuccucaugcuuuucauccaagcauguggccucaagagagaugccuggauagaaaagagaaaggagacacacccuggugaugacuuggaugaccaaugacacagccagaugacccucccauacaacaacccugaacagggacacugaaggcucauuugcauccuugcucuaacauucacuacacgacugacuuuggguggcucauuuaaccucucugaaucucacuuuucguguccuuuuauguggauauagugacccccaucucacuguggaagaugcaacaguugaaagaaauggagccugugaaagcacuuugugaaccccagagguacuacuuuauaaaaugaauauguguguuuaagagauagaaauguaaagcccuuucuucucacaaacaugagaccagggcuggaauaggaguccugcuggacuucccagcaugcuggaguugguaaaagagagcuagaacucgugucaucucccacuguuuggucaacaaauauggggaagaugaguuauuuucuaaauaucuucucugugcuuaaaaauuugcagccacaacagggcucucaagucugaacuuugcaaagucuaaaaauguauucucucucugacuugguaaaagcauugucuguccauaaguccuccuggcccaaauuuuacuccucccugccucugaaaggcagagaguacggcacuaauauuuaucaaacuauacaucaaauauuacugcuaaauuagauaugcauuauuucauuuaaaccauucagcaacccugaaagguaggcauuauuauccucaauuugcaagugaggaaacugagauuuagugauguuauaaggcugccuaagcuagcaaauggugaagucauguuucaaaccuaggucuggcuuacuuaaaaugaaaagucaacauuuuuugagaaauuacuauguaccaggcauucauguuucuugauccuugcaguaacuguuuguaucucaguuuuacaaaugucauuuggccaaagguaaauuggaaauauuaaagugggcucuggggcugggcucaguggcucaugccuguaauuccagcacuuugggaggccgaggcgggaguauugcuucagcccaggagcucgagacaacugggcaacauagugagacaccaucuuuucaaaaaauuaaaaaauuagcuaggcauaguggcacauaccuguaguccuagcuacuugggaggcugaggcgggaggauugcucgagcccaggagguugaggcugcagugaacaaugauuguaccacuguacuccagccugagugacagagcaagacccugucucuaauaaauuaauaauuuuaaaaaaaagugguuuucauauccaggucauuucuuccagaaccuaauuucuuaaacauuauucuauuccauuguuccauacugucuuucugggaagaaagguuuuaccccauauuucagacaaauuaauaagaggcgcucuccauguaaaacuuacuaaugguaauagcuuagaaucagacaaacagccucuaguucagucuugcuguugggaguaacaaucaagcagggacugaugaucacucuaaggccccuguuagauugauggaccacaggacagcugcaaagggcccucuucaagggacccaacaaagagccccggaaugugccuuggcuaaagaggaaaacuguaguguagccugaaacccugguugaacagggaagcuuuccucuacccugaaacagcagugaugaugggauuaacuccacauuccuccacacaaauucagaggcaauggccaccauguauagcccagaccaacaucagguaggagcaaguggccuauggcaugaggaggugaggaugaaaggggagguggugaaauccagaaaacaauucaacuucuucagaauggacaugacccacagcuguggcauguacacgcgccugugugguggggacagccgacucuugguggcaguggugagcaggagagaaggaugcuagcaaacaagaccuugucaucuuuucuguagcccccuccccaccguggccugcccaguaccucuugcagcuuuuggucuucaugggucauggagagcagcacggugcuguugcgcaccacggggauuuccugccagagggagccgcuggaggccauggagagccgcugcagguacgacucggaggagaccagggccuuccgaggcugccgcggagagcuaggcccgggugucucggacaggcucuccagccgcugcuggcucuggaucuccuuauucaggacaacaucacuauacuccugguaaagcagcugggcugcagggcaaagaagcaugggaaggaagagaagcaggaagaagggacggugagcggaggcagggaaacagaucuucugcaaugccuucucgcuagggacauccccaccccacugcugacauccacaagccccucuccagugcugggcagaaugcccaccugguucuauaguuccacuucaagguacucacaggaguugaugaguuuggagcagcgucuugaaaagccucccaucaccuccuuugguuuuuucucccuguggaguaaagaagggcucugggguaccuacuggccauuagacacagagcaccccaggugacugugggggacaaagucucuagccucugggaugugugcugggaugucaagaccaaaucccccggagaggcacagaguugcaacuugacccacuugggcuaacauggagcuuuugugggguuuaguucacagccauagggcuugggaagauggaugacucguaggcucggcugaccgaaugagguagauaaagacaaucucccuaagcuggcaucccggcaucucucucuucuccuccuuacaccaagaagaaacaggaaugagccauucggggucucagaacccuuaucaacugaaauccucacuaggggacucucaguaucccaagugaagagaguacaguguggcuguuaggggagagggugacuuaccgaaaaacaacagugucugagggucccggauguuucuccacggcuggaccucuugaaucuaaaaguggaaauggggaagauaacugagauuucagagggauagagagagccaaagaagaucuagagcaggagaugcagggguccagaagggaaaaugggcuuuauugggaaacugggagggaagaaaguggcaaagcagagagcgugaaagagaucaguaccagugacgucccgagccacgggucaggaugggacugggacaaguacagaaggccuuuucuacuccccaggaggagagcaagcagggacuguaacugaagaguagaagggaguccaaaauaaccuugggacauccaaagaaggugcugguugagggagagacagggagauagaggggaagaagaaggaagagcaucccaaggagcuuggagggcacuucggggcucucucuguguugagguuaggcacacaugugagcgaagccagcagagagaauguuaggaacccuagggacagaagaugggaugaggugggaagagcugggaaaagcuuggucugaugugucacuguggucccgguucuugcucaccugaagagcccucaggcaagauggaaggucugcgcaggcccugccggcuccagcccuugugcuuguuggcccccucacuaggagccacagccuguccacugcuguccccugguggccucccugagucccgccuguggggccagcuggacgccuucuccaggugcagauggcuggguuuuucuggcugccuugcuuggcccacaggugaccucccugggccacuggcuccuugcugagggguuguccuucucaaagguucucucgcaggggccucaggguguucugagaccccugcuucauccuuagaggugggucccuggagcuccggaguccagggagugguaggggaagaggggcauaggaaguuugucauguugcugaaagccaugccaggggacacuucgcucuuacuccugcugguggaagugaaagacucuguugaucuagcuguggccgggggccaggaggugcguccagcagaggcagggagggggacuguccagucuugacaagcaggucuuguuuuggcaugacccccugaguucauauguccuccccgagugcuccugcuccucccccuggacuuugggggcaaugggggugguucggugggagggucuaugauggguaguggggguagaggccuguagauccuugagcuaccaggagcagaaaugggaggaagguggggcugcggcaaaucagggguaggggguagcggcuuguuguaucuccaccuggggguggccugagcauggugggagcugucugggguagauggcagaggucggugcugccuggccacagcggggucagaggcuuggggaagugggccuuuauggggggcaugcagcccugaaccuagggccaauggaggaggguggcuaugcugcuucagcgugggaaccacuacacgagcauggccaucugucuccaccacggagggaugggugucccuccucugugggggaggagggggcagagguucguggauccucacauccuccauggagacaaaggauggggaagaaccguaggcgggagacucuguggcaaaggcuggauuauguggggagacccagggcuggaugcugggaggacugcugggucucucuagauuugagauggauucuugagaguccugcuucagcguggauaaggcaguaggggaugcugaaacggugcuguagucccuaccacuccuucugucccuucuuggggucacagagcuguagauggcagguuuggggggccucuggggcagcucugagugggaguaggaaagcaacauucccaccaggucuggagucugcucuguccugugagaaccagggaaggagucacuccguaagugcuggacggugccuguggaguuggcugggggccucggagggcuggucccgguggaggggaagccauagagggcagccgggcacaucucagaagucccacagggagaugggucauccauugagagaggggcacuggcaguuucuggagcacgugcagcacaagagguuucccuccugggaaaggcaacugggggccuggcagauaccgaggcaggugugaugggguaggcuucagcaggacugggaggagcugaaucugguguccuuggaggagucacagaugcacuggcaaagaccaccucagucccuuggcuggacacuguucccuuccucagccuggauuccucuugcuggcuguuuugaucuauuuccuugucaggugacuccucagucaaaaaggagcccaguagagaaaugggcuggugagagcaccugaugggcucuagcgagggagacagagcugcgggggacaguuccucagcccuggacucugucugagucccgggaaucugagucaugagauaugaggcaccuggaaacaggucacagugaggagaguccucaggggcuaucagagcgggcauugaaggcccaugaugcucauucuccucuucccugcuccucgcucuucccacugcccccagccugcccccaucccaacucucuggcucuuucgccuccugcccgcugacuggcaccccuuucuccuuuauaccaugaucuucuugcuuuccaguuacuuccucugauuuucccaaaaagguuugacucuuuucguccugagaguccgcccuauucucuucuggcaccugcagcucccucuuccucucuucucccuguucuggaccucccugacccugagccuuccucuccauauccuccugcucccacucaccgucauucagacccucuggcuccccagugagccccauucuuucuccuugucucccaagcaucacaucuuguaccuguuccuguuuuugcuucuguucucccuuuucaucauuaaccugcucuaucaucuguuccuccccuaauagcccaucggcacaaacauccucccucagaguuccuuccccccgaaauccugcuuccugcugucccugcuccuccagaacuuggaccuccuggggaugcaagagcccuugacuuuccugcagcuccucagguggcagcucuucccccugccugauagucccacuuucagagccuucauucugguuggucucugcaggaugcucuucgcagggagaauaauaucuggucugaccagaguuaucugaagagguuuccucuucuucuucugccuguccagaucccaaugucaaagaaguaaguccuggccaaaauuccaccuccucuucuucgcuucccaggucacuggaaaauggggccaugucuagaugcucacucugaauggggcaggcccagagcucugggggagcuagaguccuugcuugucggccugcuaggcucugggguacugccucccaguguuccggagugucacaggccucagccacaaggcuuuccugauugggcuccacaucugcagaaccuuccuugggaaaagagggcaucgucucaaucgcauagucacacacaucccuuaacucacucugcugaguugcugagagucuguguuccucucuccacuuauaggauggguccucaucuucuugagcuucaagccccaaggcagagaccuggcugcuccucaugggagccucagggauaaugcugaauuccucuauggcagagaugggaggagaggcuccacgcugggccuccucagccuccaucagggcugaauccuaaggaggaaucaaagacaaauguuucuaacaacucugcuuuuaccuaucagaggaagagaccauaaaaaagaagagugaugcauuuauuugguuccauuuagggucauucuuugagacaacagguucucaacaaaauaagcaauagccucuaaaaaacuugucauugauguauuuauuucauaaauauuuuccuagcgacccuguuaaguguggggcauucaguagugaaugagauaaagaucuugucgucauggagacuguggucuugugagggaaacaggucauaaugaacaauuaaauuauagcagaggaccauugucagagagugcccagaagcucccaguugucaguucucucuagacuccauuaugucaucuucugucucucccugucuacucuucggacacuaggagugacucauccucauauaacccccagacacagcaagggacacaccucagaucuauuaggccagagaagcagugucaggagagggucuuccucuuaagcuguggacaucaguuaaaauaggccaggcuaugauagccaaugugugaggugcuaugguuucaucuucuuuacagaggguuuggaguuuacucaucuuucuguuuuccauagugucuacuacagcauuguaacuaacaguuuuguuuccaauucuagaggcagcuguuguaaagugggaugauaacagccuuauuggauuaguguugaacuagacacauuaccaccuugaaggaagaccacagaagggugcuuucugcaucaccuuacucuccccuuggccucaguauccauaugaacucuucucauuaauucuuuugaccuuccugucuuuugauuucgaccuuccugccuuucuucucacuuccagcagaacaccucaucuccuauuuugcaaagaaaauagaaacugauggaacuggguuucucucaccucaauuucuugcgauccaaagcaaccuguauuuccacucuuucuaucuuccgcccucagucaggaaaagacguaucccuccuuuccaugcucugucauuucuugccugcuuccccaggaacacugugcacucauaccuucaacaucccugcugaacaaccccugggguauggaagcauucccacauucuucucaucuuucaaaugacuagaaggaguugcucuuaucugcugucuucauacucucacaucccaccugccuccaacugagcuuugauagcggcauucugccaauauucccuacaaucgacauguuguuaauuccaaagaagaccuuauggaucuucauuuugggugguucuugucaguauuugacaguacugagguuagaaauacucucuuguuacuugugguauuacauuuuccugguuuuaccccuucaguuuccuccagucuuuuuuuuuuuuucuuuucuuuuuuuuuuuuuuugagauggagucuugcucugucacccaggcuggagugccguggugcaaucuugggucauugcaaccuccaucuccggguucaagccauucuccugccucagccucccgaguagcugggacuauaggugugugccaccacacccagcuaauuuuuguacuuuuaguagagacgggguuucaccauucuggccaggauggucucaaucuccugaccucguuauccacccgccucggccucccgaaguguugugauuauaggcguaagccaccacaccuggccuccccugaucuuuuaacuagguuaaauuguaccccucuuuguagcacuuaccaacuauaauucucuuuacuuuuccuuuguagcauuuauacaauuauaauuauauaaugauguguguauuuugaguuacccucuauugcaaccaauagauaguaaaauuuaugagauuaagaacuaugacuugcugaauuauccauacuuagccuaauaguggccuauacucaguguuuaauaaauauuuuucacauaaagaauaaaauucaggucagaauaaaaugugauccuuuuacuucaauggaauaugcccaccuuuuccuaaaaucaugauuaacaguuuacacagaacuuuaaacauuuagagcucuauacacaacaaauuaauuuuucuuauuuuucauucugaaacacuaagguuuuccugcauacaugucauuaaaaauaaugaaaugcuucuuuaaauauguaugugccauacaucuaagagucaucguauaagauggguaccauuauucugcccauuuuacagaugaaaaacugaguuucccaaugcacuuuauguauauaauccugacacucugggaggcugaggcagguugauugcuugaaucuaggaguuugagaccagccuggacaaccuggugaaacccugucuccacaaaaaauacaaaaauuaguggagcaugguggcacgugccuguaguuccagcuacucgggaggcugaggcaggagagggauccugggaggaucccuugagcccaggaggcagaggcugcagugagccaagaucacaucacugcucuccagccuaggugacagagugagacucugucucuaaauaaauaaauuaauuaauuaaaauaaaauaaaauucuuguuucccuccuggcccagauuccccauaucuaaucaaucaccaugugcuauugaccucgucugcuaaauaucccuuaagacuguccacuucuaucccaucccucuccacuggugcaugcugcuaccgucucgcccgggccacugcacccggccacagcuugggcacuggccuccacccauuucacgcuauuccaguccuuucuccauacagcaccuaagugagcuucaaaagcaccaguucuagcuuagauucuucagcagccucugaaugcucuugagaugaaaucuaaaucuucagcauggguuauacucccugcacaaccuggcucugccuucuucucuagcagccuauucaccugucaccaucugucccugcccccauccccccccucucccacuggcuuucagugucuuuagcucacuucucucugugucucucaccuguaggccuuuguagacacugcuccucugccuggaauccucuuuugcaacagagaauccuuugcuucuccucaaacacaccuugcacuugucaugucauauuuaaugucuauuuuccaggcuagauuaugagcaccaugaagggacaaacacugccauauaacccccucugccugaagccuaguuggcccucaacaaagauguaucguaugaaugaaugacggaagaauauagaguuagaagaguguggaucaguguuugguugugccucucugguaucuuugcugguuuuaagacaauuguagaaaccauuaaauuuauuugaacauccauuuucuuaucuuuaaaaaggagauaaaaggauuccuucacaguucuaguaaagauuaaauaagguaacauaaaaauguacacugcuaucuuuaagggucauagaaaugguggcugugguaaauacuguugaccugagagacagagaauaaguguaagagagaaacacaggauucauaaagccggaaggaccuucagagacacacagaaacugcucaauuuacagaugaagaaacuaaaggucaaagacccuagacccuugcucaaaucuccuaagcaaaugguaugggcaaaccugaagcaaagucgcuugacuuaagucuccuguaagcacuuagagguccuacugaaagaaagcuggcaggccaucaguccagagaagaccccagaauucuauggacccaaugcugcaccugaccgugcaccuuucuugucugguccaggcuuaaacugaaaacucaccugcucagaauacuguccugcuuagccacuguguguguacacacacacacacacacacacacacacacacacacacacacacugagccauccuuacaaacucuugcaauagagccugacauaaccaaacaggcaggucccuagcacacugcagaguaguaugugacaagauucuggccaucccagagacagagauaccaucuauauggggcaaagagauaugucugacauaauuguacacaggcagaaggacuuuuauguccuuuuccaguuaacugacaccauaugcgauuggcucccuaugucuagcccuuaaguacaaaauacuauaaucccuaugggugauucugugauguggcccuguucucucaaccacacaucgaauaauauacuugcuuacuuuaagacacuuucugaaacuuggccuaaggagaccaugggacuaaaccuguagucucuccucacuuacaucugcaugguucaggcccucuccuccauauacaccaucacgucuucaaaacaaguagccucuaaauaaaaguguguuucugccauaucuaggguauaucuauaaauaccaugugcuaccuggacauuuucuguuccaaucuaguggcacagugcaugccugccucugcaagcccauugacaccguuucuaacugucuuuuuucauuuggaaauaucaguggucaccugcucagccaccaguuaccgcaaagggagaacauaccccacguucccuauacuugauccuaucucagugaucccguugcaaucaggcaugacaaagcuaaaaugugacaaagugaaaggaaaucuguaaaucauggucuuacucacguaaaggcaucaggagagaguuuuuugcaaugcucauuacguuagagugcaaacauccucaucuccuucuccacugagggugaauaaucacuguuuaucuguguacaggcaaagccagggcaugggauuauggggauacggccuugcuucagaccacagacauucugcauccacauaaccucacccacgugugacuucuugagaggcaaagcuucaagucaucccuuuaacauaaugugugacagagcucacuaucuucccuagagccccccccaacaccuuagcucuugucuauuucuagucacuagaaacaacacuguauuucaaggauacaaccccuccccaaucaaacugccaaaucuuugaacugagacucagugccauauauauauuuuugaggaccaugcuuccuggauuuucuagcaagguugauuucaaauauucugacuuacaaaucacuaaaauaauauugagguuaaaauaagaucaccacauagauauauaacuuuauucacuguuugacaucacugcccucaauacuacaaagauaucaaaacagggguagcuuucuggaccacugacuacuacaguguguguucuauccauugcaggaaagucccaccaugccagugaaagcuguaauacacauuuaucuauucucuaaugucugaaaaugucacaccaacugccuuauagaccagauaguuuauauaagaacauuauuagugucaaugcugacuuacacucuacaaucucaucugugguccugguggcauacacacagauaacauuagugugagugacguguuuguguauuaacacagaccuugagggugacuuuguuccagucuaccuugcaggcacuauaagugaucggcuccugcuuacuccacagacacugugagugacccagccccugucuacacuagagcuguuggucaccuguuugucuacaccacugacacuugaguaaugcugcucccguugaacccaagacccuacgagugacuccauuccuguccauaccacauagcgacugaccucuccagacaccacaaaugacguauuccugucuaucccacagacaccacguguaacguggccacggaaccucagacagaccgcguuaagggcacugauacacucucaggaccucuaauauaugaacacucuucucucuauugagaaucacuauauucuguugaugagagggauuccuuugcacuccuccugauuucucucuccuccccacuaggaccaugacauacauuccuccugcauaucagucucacccagaacugacacgcccucaucccaucuucccagcuccccaggacuccuucacuagccauggcuucacuuuuaggcccacagauugguuaacaaaugacacccauuuugcuaaggccuaugccaggaacuucuucaugcuccaaauguggauaaaacaagacgucugagacagaggccacaucaagagcuuuuuagcuggagcugggaccucuggauuaggcccaagaugcaaggccagacaguggagugcaguaggggagcaagcuagggaggaagcucgaaaggaaaaccacccucucucaucuguuugacacacccuucucucucaaccagacaagaguccuggccagaguucacuucuagguagacaggagggcaaaucugucuuuggaacccaagauccaggaagggaagaaagggacugagaucuggaaaugacguaguaucacaacuggcucuccuccgguagucuugccggaaggcaacugcaaaagaugcucagggguucuagagcucugcguccgcauucuagcaccccaacgccuaccucagcccccaacucuaaauaacuucuuuccaccuugcuaagaaugcaacguugugauucacaucaagcuuuaggaggcuccccauauguagggaacuggggugaggggcagggcaggauucacuguuccagguuacggagcuuugguuaacacggagagaagcuacacauagacucacacaguaugcaaauaccuauggagauacauaaggaaaggccccggccugguuaaggaaaaggagccgauaaaaccucuccagguaaggaacagccuagaaagggaaucucaguuauuccuucugauauggcuuagcuuuccccagggcgccuacuuugaagaaagagcccugauuauuggcccggggaacgucugggggcagggugcccauuuccuaggcgggacccgaccggaagcaaacuuguaggcaacaacauuuccucuaguuccucuccucuuccccaccaggguccucagccacacaccccgagcccugccugcgggcccagcccccccauuuccggagccugcgccccggacccagcgggggcugaucccugggaaaggccuggcuuccucuuccuuccugucccugccccaccuccgccgggcuccacagccgccgggagcccagggccgagacgggaggagggcacccaccuggucggugucacaugcugcuucggccccagcguccccuccaggucccggcgccggccgcaguccccagagccguccccagcgcaggcccggccgcccca

SEQ ID NO: 21235 - RNA, 1896 nt, Homo sapiens
ugauagaaaucuggagggacuuuucacaaaugccgacuucugguuugugccuuucccauauuuuauuaaauucguguuuuauuuuaaaaaauuacagcaacauuaucaaagacaacauauguacaaacauuuuacaaaaaagaacauuaccaauaucaguggcaguaagggcaagcugaagaauaaauagacugaguuuccgggcaaugucuguccucaaagacauccaaacugcguucaggcagcugaaacaggcuucuuucccagugacaagcauauguggucaguaauacaaacgaugguaaaugaggcuacuacauaggcccaguuaacaaacuccucuucuccucggguaggccaugauacaaguggaacucaucaaauaauuuaaacccaaggcgauaacaacgcuauuucccaucuaaacucauuuaagccuucacaaugucgcaauggauucaguuacuugcaaacgaucccggguugucauacagauacuuguuuuuuacacauaacgcuaugccaucccuuccuucacugccccagucagguuuccuguuguuggaccgaaaggggauacauuuuagaaaugcuuccuucaagacagaagugagaaagaaaggagacccugaggccaggaucuauuaaaccuggugugugcgcaaaagggagggggaaggcaggaauuugaaaggauaaacgucuccuuugcgccgaggaaucaggaagcgugacucacuugggucugggacgauaccgaaauccgguaccccaccccauccccugccccgccggguaccuacaagcucgguuccuuucucaacucccccaguuccuugaucuccaccuucuuguacuuccccgacuuucuccgguuggugaucaccaggacggccaugccggcgacgagggccaccacgaccaccacgaugacggcgaugaggccggcggugaggcgcuucauggagaacuucgggggaaucucguccagguaauagaugagcgugcgcuccaccugcagggguucuccgcgcacgcgcaaguccaggccgccgcggcccuggaauagagacucgcccuugaugucccucucgaaguaguaggcggcaucgccgauauccacgucaccggcggccuucugagacguguucugccgcagcucgaucuggauggugggcugcucguagugcacggccgccacgaacuuggggugcagccgauagcgcucgcggaagagccgccucagcucggcguccaggucugagugguugaaggcgccggcgguggggcgguggcgcaggucaaugaggauguggugggugcgcaccagcucaucgcagcguaggcucaggucgcccuuguccgugcggcgcacgcccaccgaguucacgcaccagcacaccgacgucugguugcacuggcgcgccuugaagcggcccucggggucgcagucggggucguagaggccaucguuguccacgagcgcgugcucacucggccgcaccagcgugcgggcguucuugggggcgcucaugcgcgccuugagcagcagacacuuggaggucagcguggagcagucgaccgccaugcccgagcccagcgcgcggcacuggcagcggccgccggggccgucggggcugcacacggucaucuuguuggugggacacgugcaguuguccugcgcggccguguggccggucaccgccgccagcaccagcagcagcagcggcagccgcagcgguggcggcgcgaggccggggccccgagccaugguggggcggaggaacgcggaccggacgcgggcggaugaggcgcggggacucgucggggcucgggcuccggcgucugggauggucugcaggcgucugccgcccggccgcucccuccggcucuuau

SEQ ID NO: 21236 - RNA, 228879 nt, Homo sapiens
cgcgagccggcgagcgggcagagcucggcacugcgccggggcgcacggcucgggggacccaggcccagcuaccuucccuccgcccccgggcucuguucucacuuuccagcaguggaaggacgggaagcgggagccaugcaguccgaaucggggaucgugccggauuucgaagucggggaggaguuucaugaagagcccaaaaccuauuacgaacucaaaagucaaccgcugaagagcaggugaguggugacagcugggcagaggcgcaccgggcggcuggggggcacugcgucugccacucuggggcgaggagagcgggucgcgggagcucugggacaaggacccagugcccuugccccggagcagagggcgaacugccccucgcaguugggggccgcgccugcccggcccaagugcgccuuuaggaagcucggauggagcgcacuucgcgggggcgcggcgggucgccggggacgaagcguccaggcgcggggacccucggccgaggaugccagcugcugagacugauugggggcuggggagcgaccuggcgcgaugugggggaggaggagcgccgggccgggacgcugucccggugggaugggggagaaagaguucuagugaacccccuuucugaagaucccagcggguugagggcucggagagggagagcuuuggguggacugagaugcgacauuggagggaagcaauuaguucgcuuggagucaccucuugggaguccggucucuguggggaaacuagccucugggcuccugcaggugagguuucucugggcuccgccucucaccuccagaccgcugcuagcgggcgcgggaggggccagggcagcggugggcguguccccuuguucaaguuaaacucucuggaaauagagucccauucaaauccaggccuuaccugcagaggggaaaugagccuuggucuuggggguuacugggaguguaccccgcuuggcagagacacguguuuaauucgcuggggacuucagaaacuuuuuagacgaggagugaagacauccacugcucugaugccccauccccucuagugcccacuucccuugagccacccuuuuugcugccuccauucccacuugucugucgaaauggauugggugucuuccguucucucuguccggcagccacucuggacgccucguacuucucguuuacaauguuuccuaaaagggacauggucaauggaggcuggaauagcugagaaggguuuauuuccaccccucuaagcugugagcuaggauaaggcuaucauuggaagcauccagcagggcuucugcacucggcuguaacuuccugccuugcccuucgcuguggauggggccugggugaaugggccuggcuggcagagugggagagggucuugaaaugagggugaguggagaagggcaacugaacggggagccaagugguguaaucuuggccucuggcgagcacugggcugguucuuuuucuaguggaaagugcagccagguuuauuuccuucagggcuguggcaggacucuuuauccaaguuggggaagaaaaucugggaacagcgguccuacugacugccauugcugaagacucuuuguagaugcuucacggcagauuggaaggaaaccgccuaagcaguuggacguauaaaaccagccuuuaguuggugguuuuuccucauaauggcuguuuugugugugagcauagauuguguguguugggggcuggggguuuugaguaauauugugugaaggguauuguugguuaugcucaucagggcuuuaucugcauucggcugaagggaccaguguuuuacugggcagucucugcuuuugcuucuauaagcaaaugcuuacacggccagaaugagggaaugaguguguguguggaauccugaaagaaauaaauuaaccggacuguuuggaacauuucugaugguagcugauacauaacauuaaaucaguuugagagagcgaggaaaauaccaucuggaaaaacccaaaugagugccgugaaacucauguugcacgauuugggccuguucuuuuucagagucagcaaaaaagacuuguaagggugaacguccucaguagcuagcuagcaggcacguguaagggaaaauguggguaugugggaagaaauggcuucacacguuaaugcuagaaacaggugugggccugaaccagcagggaaaggaaggcuaaauuaaaaaaguuguuguaaaacuuguauauggagcacacacaugcucuuugaaauaaaccaguuaaauaaaaucugugaauaaauauauggaguuggcaacauuucucuauacuguuuuccacaguugucuaagguauugucgucgacaucuguugugugacuuaaaagggcugcacauuguucagggccuucucucucauugcuuuuugucuuauguuuuugcuggggcaccucacuucuuacaagucuuugucggaaaaaguugaaauugauaugugaagacugcuguagccguucugccuaucaacugucuucucuggauuguccagaguuguuagaguugaaaauauguccagaaucugcccgcuucuuaccaccuccucugcuaccacuuugguccaagccaccaucagcccuugccuggauuauugcaguagucuuuuaaacugcaauacccacauuuagugaauuuucaguauaguagccacaauguuccuguuaaaacugguucucaguuggaggugauuuugccccuggggucauuugacagugucuggagacauuugugauuguuacaguggaagggaucauuacccauaucuaguagguggaggccagagaugcugcuaaacaucuuacagugcacaggacagcccccacaacaaaggauuaucuggucccaaauuguuaguagugcugaggucaagcaacucuguguuaaaccucaagucagauccugucauucucugcccagaaccugcccauggcuccuaauuucucccaguaaaauucaagguucuuaagaugucagcucugaccuuaucucuuguugccugccuccuaccucccucugcuacagccaggcuggucuccucacuguuuuuggaauaccccaggcccuuccaccacugggcauuuuuauauugcacuugccuugaucauccuuugcccagacagacccagugcucacucccccaccaaccaguaugugccugccuccaggagucuuaagaacauuaagugugacguugacugugggaaaguauuagcauggugccuggcacguaguaagugcucaggaaauguuagcagauguuguucuuguuauuuucuuuacaguucauucuuuaaacaucauucccaucacacugauaguguggcccuuuuuugaccacaguauuugcgauugcuguuccuccaaauucucugucuucuuuguccagcuauauauuuuuuucccauagggcuuauauuauaaucuacuguauaauuuuccaauauguuauguuuauuacguguuucuccaugcuagacugcaaacuccaagggaacaggguuuucuguuuguuccuugcucacuauuguguccccagagccuagaacaaaguuucucaaccucagugcuauugauauuuugggccagauaauuccuuguuguggaggguccuaugcauugcaggauguccagcagcaucccuggccucuaucuauuagaggccaguacuccugccucuaucaauuauggcaaccaaaaacaucucugaacauugucagacaucccgugguaggcaaaguacccucauuucagaaccacuggcuuagaacaaugcgugacacaauaaauauuuguuugaguauguguugcuuucuuccuuaauaccauaacccacucaagguaugguauuugguuuuuuguuuuugcaaugaauauuguguuuccuuuaaaauagauaccuacuaggcuuucuccaaagaggaauucauauauuguucauuggggcuaaccucagauauucaagucuuucaugaggaaggacauguuucauuucuaacccagacauccuugccuuuaggaaucugaaguugcuggauuuagauuaugugaaucucauuuuggucauauuggugguuaaggcuguguauaggaagacacaugcugugggaaaagguuccaaugaauuguuugcacaccguuuccuccgacaagguuuuagaaaccuuguguucuccugggaaugaguucugaaugguggguggcagaggaaaagcgcugaauaucuagagugagcccagaauucacauaggcauagucauggcagggaaacaaaugugaaacuguugaaugagcuccuaggagcagaggaagucucuacaggucuuuuguacccaaaaacauuuuaaaccguaggagcaucuuucaggcucauaguccuuuuguuugguuuacucaguccacauggcuuuguaguuguuaauguccuuuuccuggacagacuucacaguuggcuuaguuuaauuccaauuucuucuuaaaucuuuaguacuauuuagacagcuguuauuacauuuucugcaaauuagaaaugggaaugaaagugaguauuagcuuuaucauggcaggacaggauacagcagugauccccaaaugcugauucacaaaggugugugaacuuuuaaagguuugggugaaaugagaaagacaaagacuguugcgucacacgcauaccuacauauauuuggguguaaggccgcugccauuucuuggaguuaugcugagauguuuuucuccugucuucauauuaaaaaaugcccuuucuuugaugacauaauaauccauucuuggcaaaacaaaacugucaaucauuuuuugauuucugaaaguuuucuugauuuuuuuuuuggucugucuaaucugagggaaccacuagcauagagaugaagagccuuguucugccaucgaugucugucccuaacuaacugggugaccuugggcaggcugggugacgucuaauuucaguuuccucaucuggcaaauaggggccugccuccaguagucucaagaauauaaguguuacauugacugugggaaaaguauuagcauggcaccugacacacaguaagugcucagugcugacacauaguaaaugcucaguaaauguuagcagauguucuuguugcuauuuucuuuauuaccuagcagcgaaccuggcauuuuggaagguguuuugcauuugcuugacugugguugucuucucuaaggcaaguguuguuacgcaacacaguucuuugaauguuaguaaauuccuuuuugcuuuucuucuaaugaaguguucagauaaauauuuuacacuuuguaucuuucauuuaaucauaacaauucuuuuaugcuaguuaaaaaaacuaacaauuuugacauuaguguauccauaaaaauucguguucaacacauauuuauugaguccuaguaugugcacauuaauacuaauaaugaugggucacauuuauugaguauguacuaugugugagccccauucuaaguguuuuuacguguguaaaaccuauuuaaucuuugugaaaucugcaugaggugaucauaauaaauaaaaacaauaaugauauuaauuauaauuuuaaaaacaguuaagacuuaucuagugcuuccuaugugcuaggcacuauuaugaauauuaacucuauauuaaugcuguuaauucaaccuuggguguauguaauaguuuauuauucucauucuacagagagggaaacucagguaugccaaguugguggggccuggaguuaaacugaugcuucuguagcuacaugcucuuguccucuagucuguacuaugccugguugauugugcaaaauucaaagauacaucauacugugcccucccuguguggugagggaaagagaacucauggguccagcuaauuauacaaggcagaguguggucccuguggcagggugggcaucagcaguugggggcauuuaacagaggaaggggaacuggggaggcaguuuuguggacaaauagggguguuugaguuuggccuuaaaggugaaacaauagucaaauguguuucucuacacuaaguaaaauguuagacaucuuggagggcaugguccuaaaguagacauuuaggguuuccguuugccuuuuaaacuucuaaccuuucuuuaagcucuuucuuguggucuccaggcaccugaugauaccucaugguggcagagaggcugcaugcauguggacagguuuagagggagcccugcuuaagugcugucuguggucgcugcuuugccacuuaaccaguacaucuguguucaagaaacuuaacuucuuggagucucaauuucucuaagcuguaaaaugagaucaauagaacccacccccuuaggguugguagaacuuuuaaaacuaagcaaaaauguauaaauguguuuaacauagcaccuagcacuguuaguaaaugaaauuaauuccuccuuuucuaguagaauuuuacuaugguagcaguuuuuacccuucucuuaagaauaacuaaaacauauauagaaucaugcauccaaaacaaaguagacaagauugaggugccucaaccugcagauguucaaaucguacuaugcagauucguuuugugguaugauuagagggaacacuugauuaaagugggauucucagucuugguuucguuuguuauuggagauuuccuuuucccgauuacuacuauuuacagauuuuacuuaaguugauauauguuuaauucccuuugaguucugcagugcaguuugcacaggcugauguuuauaucugcuccaguugugcaagaaguggaaaauauccuuuuuuuagaacagaucacaugugcuuacugucaggaauaggaccucaguguaaaaaaauguaucuugggacaaaucaaaguuacuaaauuucccucuccaacugcuuuguuucaggauuggcaguauuaggauaaauaauaggaaaaaaaaauccuuggcuacuuucuuuuugucaucuuucaaggacaauaagugagaguuucauuuuuuuuguguguguguauguuugugugugugagguauaaaauguacuuugcugaggguuugucuaaucggaauaaauuauaaaaauauguuugacuacacuccaaguaugcauuauuuggagaaaauaaucaugaagacaggucaaagauauuaaaugcagccaccacaagcuuuugauauuauaaaggcaaauuugcaguuuauaagaagguuuuugugagucuagugaacauuguguacuccgaggauaggaauuauaccaagggauaagucugcaucuuuauagagacaaacgaggucgagaagacccacagggaggucugggaucucuguugaaauuucugcaccucccguucuauugcaaaugaucuugggaggaggaccagguuuggcuucucaaugguaagcuuauuucucuagcccauuucuacaauguggcuuucuuauuucuucgcuucgucuuucccuccuguggcuuuggaugcaugcugugaagaguagagaaguagaccuuuggaguguucaccugagaccccuguccugggauucagagugaugaagcuuuuaucuuuaauggcugaccuuucuggggacuucucaaggacugggugcugagugucagucucugugcuggccauagggaguccaguggagaagcagauggguuccugcuagcauggugcauacaucuuggagguggcgcacaguuaacaaugaaccaaauacaugagcaagaugaguuuuacuaacugcuauggaaauuaaauggagcauuauugguagaaugggccuaugaaagaagggggcuuuuuauucgguuguaugaucaggaaugaccuguuggaagaagugauuuucaggcaagacugaauaucugacauaaaggcacaaauccagacacuaccacucacuggcucugugacuuuggucaaguuauccaaccuuucugaacucuaauucucucuucuguaaaacgggacaguugccaucuugcaaggcuucugugaagauaaaagguaauguauguaaagcagcuaauauuaggcuugaggcuuaguagguguucaggguuacccauaggacugaaguuaacauaugaauaguggaaaaagaagcacagacauuaaucuuuguuauaaguguuuauaacucagucuuaaauguuuuccuaauguugagugagucagagauucaugcuugucuuuauaaaccuaacccuggacuaaaagaggagaugggucuuguuaguuuuguuauccuuucuuuccucuaggaucauccuacuugaugucaucccuuguucuccugacuguuguuguccugagauaauuaaugucugaccauaguuuuuggggcuggauuuuuaauuacuuuuuugguguuaaggagaggccuaaguaauugaggauuaaaaaggaaagccugagauugauuucacaaaacauacacgccuaccacgaacaaauaaccaguguagaacuccugacuccuaguccuguguuucuguccugagaucaugcuuccuguccacucuguugugaaaaugucaguguuggugcagaaacaaaaaagaagaagcucuccucccacauaccaccuccaguguucaccaacuuugacauccacaggaaguggcaugcauuuaauuugacaucuuuaaaaaaaucuucaaagcauuuggauuuuaguagcuguguucuuugauucaaguacccacagagugauaauuuucuuucuuucuuuuucuuuugagguggagacucacucuuuugcccaggcuggagugcaguggcaugaucuuggcucacugcaaccuccgugcccagguucaagcaguaguccugccucagccucccaaguagcuggaauuacagauguguuccaccaugcuugacuaauuuuuuguauuuuuaguagaggugggguuucgccauguuggcuaggcuggucucgaacccuugaccucaugugauccaccugccuuggccucccaaagugcaaggauuacaggcaugagccaccaugcccggccagagugauaacuuucacaacgaaaaauacuggguugugugacagcaaauauuuuaagucuaagugcaugcccuauagagggcacugguagaauccugucauauaagaaauugugccucauugagcaauuucaggaaggcaucuguggucuucacccuccccacccuugccucuucuccaaagugggguaacuugcugaaucauucacacacauucaucaguuuucccaugugauuaagggcaucauuggaaaagugguuguccccacuguugggagaaagcauagcuuguauuuguagaauagguuuccuucugggaagguugacuugccucaguggaaagaagacuugaggcagagagguuucacuuagccugguggcugugguuauauaugaaauuacgaaaugacagacaggaaugcuauauuuacuuugguaccuuuaccauaaaauauuccuaaauacuaacugauucuaggaagcauguuuuucaaaaacauacauuuuauuuuuuacaguuggagauuugaaauuuggugaaaggaaaugcucauggaaauccuaaagaugauuuccuuguuuaacucaggaccuagcucaauccuggugaaggcuacuagagaaccucauugagauguagccacacuguaccucuugccugcaguguguccuaaauucguagagauggugcucuaaaacugaguucaugaaccaacacacagauaugucauuggucaaauuguaacauucccuuccaucaaaaggacuagguauauauuugucauuguuuuguuuuguuuuuagcauuugaauuuuuucagcgaaagguggaaagguauuauuucaguguuaguuuugcucugcuguauuggugagccugcauaguugcaccaucuaaauuuaggaugcuggcaccucagccaauaagaacucuuuguaacuaauuuauaaugcuuuuggcagagagugccuagaauaaacauuaaaauaguguuggccaguuaaggucauuuacuuucaagggaagagggugaccccaaauaugcauucuugaaaauucuauuuauuuaguuuuaaaggaagaguuuacaauagcuuaugugaagcaauaccuaaaaauauaagcaacuggcaugauuccuggucacauuccgaauaaagguuuguccauuugcugcaaagaagcaugcuuggaggauaacuuguaagaggucggccacuggcuuaugguauauuaaacaaccaguguguagacuuuuuggaacugcaucuuguaucaucucagcgugguaauuuuuccacuggucuuuggguagguacacacuaauaauauuuuuuaucuaggcaaaugcgagaugaguaaaugcuaaaugauaggauuuuggaagguaauucuaacaauacugauuauauuuggaagcuuuaaauuguugauucagcagugaaugagagaguuugauggugcuugcuuggucauaauaucaaaaucacuaaagugcaugauguaacggcagggagcugaauggcaaggacaauuaauugggguuuguuuuugggaaucaaugauaccacaugucaaucugcuguccuuagggagucucucccuaguguuaccccucuuucucacuuuuggguucauauaccugauaccuuucuaaaaaagucaauuucauggcuccaggaguggagaaucugauacaggccuggcuacauguccuuaucacagggauugguuucacgggggugcacauuguucaaagugaaucccaggauuuucuugggugcuaccacaacaguaauauagaucugauaacaaacuuucuagaggaaacuauagagcuuuccuuuuuuuuuuuuuuuuuuccuuuuuuaaaaaccagugaguaauuauuaucaaugauuaucucuggccugacaauacaagugacacuccuuuuuuuuuuuuuuuuuaacuaaauguauucugaucuggugaauuuuucauucuaaaauaacaauacaagaguauuuaauauggagacaugagauuugugguaaaaucauuagggcagugguucuuaaacucgagugugcaucagcauucccuguagggcuuguugaaacagauuucagggacacacucccacaguuucuguuugguaggucuggaguagggucugaaaauuugcauuucugacauguuucuaagugaugcugaaacuauugguugaaucacacuuugaaaaaaucauggcacuaaggugguggugaugguguugggagugggggugauuugcucaaugaacuugugauagaaagcauugcauagagaugggauauaaauaauauauaagcuugggugacagaauacccauauuugccguguuuaaucagaaaaugaauuuauugguuaaauaacagaaaagucuaaagauggggcuaaccaggccuuccauggauaggauucuugguuguauaaugugaucucugagugacuuagaguuaaccuagcuuuacuaccauaaggagcccuggcccaaaucucaaaaagggguuguauuuuaaucuacacucuaaaagugugaaacuugaagcauacugcagucacuugacugaaagauuugguugagaaacagggugauggugguuuugggcauguccacaugaccaaacuguuuuucacaaaacuucugcugaauaaaauuugaaauacuacugucagccuguuuuccugucuuaaugaauuccagacaguuuguagagugugggagcuuccaaaacagagagguggaauggaugugaccagccagcaucuguuuugucacaaaugaggauguccugacauaauggaaucguuccccuuguucugaaucucaccaagcuguucacuucucugaucaugaaguacagacugugagaaggaagggcaaggccaaugucauguaacacaagccaaaagaaaauuucuggauuccuuauuuaccaggaaauucagccuaccccuguguuucauccacuuagacccaagcauuuugauuuuuuuuuuuuuuuuuuuggcauguugacauucuuuagagaaaaagcgcugaucuguucuuguuguaaacugguuaagacuucuaaccagucuaauaagucuaaauuucagaguaagacagauuugaacuuaaauuccaauuuggccacuuacuggcuauauaugugucuuugggcaaguuauucuuguggccucuguuucaacagaggcugauaugguuuggaucugugucucuaccauaucucaugucaaauuguaauccccaguguuccagguggggccuggugggaggugauugggucauggaggcaguuucucaugaaugguuuagcacuauccccuugguccuguucucauaauagugagugaguccucaugagaucuggucauuuaaaaguguguagcaccuccccugucauucucucgcugcugcucccaccacgugagaugccucacuccccuuuugccuucugccaugauugcagguuuccugaggccuccccugaagcugagcagaugccagcaucaugcuuucuguggaaccgugaagcaccgugauuuaaucagcccauggaaccaugagugaauuaaaccucuuuucuuuauaaguuacccagccuccgguauuucuuuauagcaauguggacuaauacagaaaauuggugccaagaaauggggcauugcuauaaagauaccugaaaauguggaagcaacuuuggaauuggguaacaggcagagguuggaagaauuugggggacucagaagaagauaggaagaugauggaaaguuuggaauuuccuagagacugauuaaaugguugugaacaaaaugcugguaaugauauggacagcgaaguccaggcugaggaggucugagauggaaaugaggaacucacugggaacuggaauaaaggucacuuuuguuauguguuagcaaagagguuggcugcauugugucccugccauagggaucuguggaacuuuuaacuugagagugaugauuuaggguaacuggcagaagaaauuucuaagcagcaaaguauucaagauguagccuggcugcuccuaacaaccuauguuuauaugugugagcaaagaaauuaccuaaaguugaacuuauauuuaaaggggaagcagaguauaaaaguuuggaaaauuugcagccuggccauguaguagaaaagaaaagcacaauccccuugguccuguucucauaauagugagugaguccucaugagaucuggucauuuaaaaguguguaggaccucccuugucauucucucuugcugcugcucccaccacgugagaugccucacuccccuuuugccuucugccaugacugcagguuuccugaggccuccccugaagccuccccauuuucugggaaguaauucaagcaggcuacagaaauuugcuuaaguaaaaaggggccaagugcuaacauccaacacaacggggagaaggccucaaaagcauuucagagaacuuugcagcagacccucccaucaugggcccagaagccuagggggacugagucguuuccugggccaggcacagggcucugcugcccugcauagccuugggacacugcucuccacauccuaguugcuccagauccagcuauggcucauagaggcccagguuacacucaggccacugcuucagagggugcaagcuguaagccuugguggcuuccaugugguguuaagccuguaagugcacagagugcaagagcuggggcuugggagccuccaacuagauuucagaggauguauggaaaaacuuggauguccaggcagaagccugcugcaggggcagagcccucauaaagaaacucuacuagggcagugcaaaggggaaaugugggguuggagccccuacacagaguccccacuggggcauuaccuaguggagcugugagaagagcacugccauccuccagaccccagaaugguagaucuacuggcaacuugcacucucagccuggaaaagccacaggcagucaaugccagcccuugagagcagcugcaggggcugaacccugcaaagccacagggguggaacugcccaaggccuugggauugcacuucuugcacuagugagcccuggaugugagacauagagucaaaggagauuauuuuggagcuuuaagacuuaaugacugcccugcuggguuuuggacuugcauggagccuauggccccuuucuuuuggccaauuucuuccuuuuugaacaggaaaauuuacccaauuccuauacccccauuguaucuuggaaguaacuaacuuguuuuuuaauuuauaggcucauaggcagaagggacuagccuuaucucagaugagacuuuggacuuuugaguuaaugcuggaauaaguuaagaauuuggggacuguugggaagccaugauuguauuuugcaaugugagaaggaagaaggauaugugauuugggggaccagggguagaaugauaugguuugaaucuguguccccaccaaaucucaggucaaauuguaauccccaauguugcaggugaggccugaugggaggugauuuggaucauggaagugguuucucaugaaugguuuagcaacacccacuuagugcuguucuugugauagugagugauucuuaugaguguggcaccaccccuguuagucucucucucuccuuuuuuuuuuuuugagacagagucucacucugucacccaggcuggagugcaguggcaugaucuaggcuuacugcaaccuccaccuccuggguucaagugauucuccugccucagacuaccgaguagcugggauuacaggugcauaccaacacgccauguuggccaggcuggucuugaaaucugucccccuuggccggccaaaguauugggauuacaggugugagccacugugccuggcccccugucacucucucuugcuccugcuuccaccaugugagauggcucacucccacuuugccuucugccaugauuguaacuuuccugaggccaacccagaagcugaaaagaugucagcaucaugcuuccuguacagccugcagaacagugaaccaauuacaucucucuuuuuuuuuuuuuugaaauaaauuacccagucucagguauuuuuuuuuguagcagugugagaauggacuaauacagaggcuaaaagaggacagugcauaauaauaugaucuaagugauaggguaauuguacagauuaaaagaaauacauggguagagugcucagcccaaagccuggcuuuuaguucccucguucugauuaccucuguauucacagcaucaacaagguuuuugacuugaauuucuaguuuuagacaccuuaauaaagaaaaaacgacucaaaggcaaucaguguggggguuggggggagaggauccauagaacaguggggaggaggaggcuaagggagggaggaggguaaauagucuuuaaguuagguaaucagcauuaggauuuuugggaguugauacaggucaaauaguggugaaaggugggaugccuaacaggaagauauuuaaggauggcacaugcuauuuacaagcaugguguuacuuuuguugccagaacaauuuuugucuuuaucaacauguuuccuuucaucauaauuauagacuauagcuaaguggagaaauaaauaaugagauacacuaauugggguuacacaauaccaaggcuguguagcacugcugucucaacacagaaaucucgaauuccuaacugucauguuucggccuuggccauagugacuuccuaccuuaucuuuucccacuugacuuggcagccuguuuauauaguuaucuuuauccaauauaagccauaaggcccuguauucuugagccucaaaaucuuuguaucuuuuacccuucuggguuuuuuuuuuuuuuuuuuuuuuuuuuuuuuuuuuuuuugggaauagcaguauauagccacuuuagagacuaggauauaaguuuucaaggguuuuuucuuuccccgacacgaauaugauaguuugcuuuucuugauugucacacaauuucucucccgaaaacuguggcuuaacuggucacuagcaagcauaaaggggaaaaaaaaagcagaaagggggguuaguccaaauaguauccaucuuucucaggggagagauuucgauuauauuacacauguauguggauaccuucaucaguuacaguuuagucauugacuaacuuggacaacugggugccuaccucauugaauaguugugaauauucaauaaggugaugagaugcuaccuguaguaagggugcaguagauaccagcugcugcugcucaccuuacugcugcuccuccuccuguacuaugauuauugcucucugccuacugcuguuuugugcuacuacuggugucauugcuacuagaacuuagaaguuugcauaagaauggaagaaaugguuaaucacagaaacauuucucugugcaggugguauugacucucucauugccuuaucacuguugaguaaauaagcaacaguuugguucucuaucgcugaaaaaacucuaaccacauagucaauucucaaauccuugggguauauguggcaaguuuuuuuuuuuaaguucuaggauacaugugcagaaugugcagguuuguuacauaaguauacaugugccauggugguuugcugcaccuaucaacccaucaucuagguuucaagcccuacaugcauuagguguuuguccuaaugcucucccuccccuugccccacaacccccgacaggcccuggugugugauguuccccucccuguguccauguguucucauuguucaacucccacuuaugagugagaacaugcaguguuugguuuucuguuccugugauaguuugcugggaaugaugguuuccagcuuuauccaugucccugcaaaggacaugaacucauuuuuuuuuuauggcugcauuguauuccaugguguauaugugcuacauuuucuuuauccaaucuaucauugaugggcauuuggguugguuccaagucuucgcuauuguaaauagugcugcaauaaacauacauguacacgugucuuuaugguagaaugauuuauaauccuuuggguauauacccaguaaugggauugcugggucaaaugguauuucugguucuagauccuugaggaauugccacacugucauccacaaugguugaacuaacuuguacgccuaccaacaguguaaagcgucccuguuucuccacagccucaccagcaucucuuguuuccugacuuuuuaaugauugcuacucugacuggugugagaugguaucucauugugguuuugauuugaauuucucuaaugaccagugaugaugaucuuuuuuaaauauguuuguuggccgcauaaaugucuucuuuugagaagugucuguugauauccuuugcccacuuuuuggugggguuguuuuuuuuccuguaaauuuguauaaguuccuuguagaaucuggauauuagaccuuuguuagauggauagauugcaaaaauuuucucccauucuguagauuguguggcaaguuuuuaaaccuaucauagcacuggguugcagcccaggagucuuccagaccacuucccccaacuaucagcuguugugugcauaggaaugagauuaccaaguuugaguaccaauuaaaggaaugcauauucuaucagaauccauauauauauauucauacaaacauauguaggauucucaaggcaguguuuuucaaaauauuuucagacuuucuccaguauucuuacuaaccaaaacuugacucuugguuaaacaguucccauucagaguuuuauaagaaaagaggaaaaaugaaauucuccucuuucugugauugaaacaaaaagacaaacacacugaagaaacugacauagaaguaggugcuuuagagugagugguuauguguucagagaagcuguaagcacaggagagaagacaguuggggagguuuggucagaaguggaauggugggaugagcuuccgaacucugcauuuuagugagaguacaggauaaaucugcuguguaggcugguguugagaguuaggacacccugaacuuggggaagagccagcuaucagagaugaaaaaaaacaguuugggacauuuucagaauagauauauuucuugaguaucuaaauggguggacgguaagagauccgacuuuuacucuuguuuuccaggaguuaugguuugagaauuauguguaggaucuucgggcaaauuuucauugccuuguaguauaaaaggauucuuaauaaauauuuguugagcugaggauaauggggagcaggaagggucaaacuugaaccaguguugccuguggaaaauggguagcuguugagugaugguguggaucccagaucagacccucaaaggccaggggaggucuuucugggagaggaaaagaaccuggaguuacccuagggcaugugugugugugugugugugugugugugugugugugugugugugucuauauauauaauacucucuuccaccacucauaaaguauauauauaaauauauauauauauaaauauaucauaugcacacacacacacacacacacacacuuucccagcacucagaaauauauuucauuuuauuuacuuuuuuuuaagacagggucucacuccaucucccagauuagagugcggggaugcaaucauagcuuccuauagccucaaacuccugggcucaagcaauuccccugccucagccucucagguagcugggacuacagguguacaccaccaugccuggcuaauuaaauuuuuuuuuucuaagguugggaucuugcuuuguugcccaugcuggucuugaauucuuggccucaagcaauccuccugccucagagucccaaagcacugugauuacagaugugagccucugugcccagccuggaaauauauuuuaacugguguucacugaagauggccuuuagcuaucacuuuuuuaaaaggcuuuauuuuuaaaauaauguaucuuuuaauaaaucaaaagcuucuuauguaucaauagcccaauccgguaauacuuauuuuauuauugguuaguucccaugggaacagggaauuuguuaguucacuggacaucucaagguuccaggauacagaguguguccaauaauguuuguugaauaaagaaugaccuagauggcugaaguguuucuggugugcuagaaggggucaguaaauuuuggaaacuuugcuaaacccuuucaggaaaauguguaagaaauuaucuuaccuuuucuuuuguuagcuaugagcccuugccauguguuucugagccuuaauaucuuuaccuauaaaauggagcuaauggcauguccuucuugggauaacugugaggauuauagaagauaauauguaaaaugacuggcauauguacauucucaauacaaaguuaguaggggugaugauuguuacugcuauuggugcuaaagauacagacugcuaaaaauacagucaauucucauuauuuuuguuuuauaaagcugcuacaaauaccgaauuagcaaauacugaaugauuacuacuagggaaauacaggauaaguuccuuagagccucuggucgcaacauuuaaucaaucuaucaauacauaacuuuguuuuauguguguuucuguguaaagacacauuauuuaauauauauuguugauucauuaacguugaacuuguggccagcagcacuauaaccugacugacuuaggaacacuagacagcacuuucgcacuaaacuuuggugccauacugaauagaggagucaccaacaaaaacacacaaaagugcaaaaaauguggcacuacauagacugugaaaaggacacuuuuuuacaauaugaugugagagcugaaaugagaaggcagaccaauaccuuauuuaaccucaauugguaacgugcauguugggggacucaaacuucuugcuguucugugcacgugauugacuguaaaaacucugagaauguugauuuuggguuuacaaaucaguuuuagugaguaggugaauuugaaaguggagaauccaugaauaaugaggguugacuauauuaaaaacuguuuucuugcaucuguauuucucuagcaguucuuccucuggacuaaaaagcuuacccacuggggaaaacauuuuaaaacacuaucugcucagauguuguggauuacagagggagccacauuaauaaagcuuuuccagguaccugaucgcucucuuuuuuuuuugagacaaagucucgcucugucguccaggcuggagugcaguggcacgaucucggcucacugcaagcuccaccuccuggguucgugccauucuccugccucagccucccaaguagcugggacuacaggcacccgccaccacaccuggcuaauuuuuuuguauuuuuaguagagacgggguuucaccguguuagccaggguggucucgaucuccugaccucgugauccacccgccuuggcaucacaaagugcugggauuacaggcgugagccacugcgcccagcccugaucucucauuuuuaucaguuuguuugccaauaaaaauggcccaucacuuccagaucuuuaaaguugacugaggcuucacuguucagauaugguagaauuuugacagauuuuuaaucauucuuuaauaagguggagugugagguuggggacccaggaaaagaccacagagagauuauggaccauugcugaaaaauccagcaaaaagcaguaggauugacagagggcaggugagcccccagauuggggccuagccugggaggguucuuggcauugcucaggaaagaguucaagaacgagcuggugguggaagaaugcaggucuagugaagcaacaguguacaacagaguaccugcuccuugcagagcagggcuaacccauagacaugcacccagaguagcagcguauggacuguagacuggcaguauuuauacccacuuggaauuacaugcaaaucaagguacagguuacucagaaaucucuagaaaaagggugguaacuuuugggaguugccauggcauuuguaaagugucauggcacugcugggagugucuuauacugaugagcagugagggcaccuagagguugccuuuggugccauuugcuaguucugguggguuucuucauuucuuccuguggagaccaggaaauaagcgcugguagucucuacuucaggauggcuuagaaauucugguguaggcaguuuuugagguaaccaggcucagcuuacucagggccuagaggauaaaggugaugauuuugacuuuugcaagcauuggaaauuagcauauuauaguuaucagaauggucauuauuguaaacauuaacugaguacuuguugggauugcuuggaauucuuuuagaaagaaggagaaaaagaauugguuucaguagguucuguacuuucaaguuacauagcagauagaucacacaauuuagugacaacagagcacaaagaacaauaauaauaacaguagcaucuagcauuuuuaaagcccucuuuacagauaugccuuguguuagugcuuuagccuaucuuuuauauauuucuauaguauucuuacagauuauacuggaguuaaggaagguaccuauguaauuaaaaaaaauucuuucuguguuagaaaagugaagaaacagaaacaucaggaauuaauaauuuacaucuaggugaauuauaaacauaguaaggcacuuacuaucuaccagguacaguauuuaaguguuuuauauaauauaauucuaauaugagguagauaggaucccauuuuauaaaugaagaaacuugugcuugucuguuuucugucacuugucuaucuuaaguuacucaaauaagguugaaccgcgauucaaacugaggacugucugacuucaaagcucacucucuuauucaccaugcuggcagugguuuccauguauuuugguguucggagguuuggagggagaggcaggagugaucaggagugacaacuuauguugauuuuugaauggaaaggagacuagguuucuuaugaaguaaaggcagaagacucagggugugguugcacauucaaauccaaaacaaauaguuauaucuauuaaaggugcucacagcaugccugucugcauaguccuuuguuucuaaagcugcuucugaaggaggaaaggagguaggcugugaauccuccaagaaagguaggaaaagaugggaugguggauacuuaaucauucacaagggugugguauauaaguaagugguagauuuuccuaauuucuuauuaauaaucuucaaauguugcuacuugaugacaucaaguugucuugucuacauacccauccuuguguucuacuacugaacaugaacauguagcucauaacaucuggauguuuuucacucaucucuuuuucccucucucuuuuuucugcuaaccugacuuguugauugcuauuuuugugugucuucauaaauuuauagccagucuguuccauucuggacuguuuaucuuuggcaugccagaggucuuuaaacaucauaauguuguguaaugagcauaacuucugccuugacuuguggguguuaagagcauuagucagugcaaaguauugaguuaaauauuuucaauaaaaggauauaaugaucuagcagagaagaaguuauaaaaaauccuaguuaauggcuuuaauggugagccauauauuuaguggguucuaucagugaugaguuagagauucacagaaugaauguaaaagcauucuuacuuuuaauuaaugagagaggagaaagaaaaacaauaauaagaaaaaaaggacuugauucucauccauaccaagaaaaguguaaacauccaaguucccagugauucuaacccugauucauuaccuugcaugugucuuuaacuaccacaagaaauguuuaagauuuccauugagauauuaucgacagggacuccugggcugcaucauaagccugauugaaagccuuuagccuuguaaugaucucuuuuuggaggacaaucagggaauucuuugcaccuuuaucagagagucagggcuuuccugagcaaacaaacuaggucuuuaccuauggagcugauuuuaugaagaguuuuggucagcauuagucauugugaaaccaugggccuccugcccugguuuaucucgacagucaucucccuacagcagaagauugaauccucaucucuccaugagucugagcaucuaaagauguuagagguacauugguuugauucuugcuggggaauguguaguggguacuggucuucugggaauagugucuagaugaauguuuaauaaucaguuuaauagguugaugggcugucuuauuuccugggguuggagguuuaaaccaggacacccugugcuaacucugcucuuuaccuugccagcaauccucagucguccugguaaacaaccucugaguuaaauaccuuuucuuuucuggagagguuaccaacaaaggaaaaggcuuugaugucagaacagggggcauaaacaguguuuauggcugcuguuaaaaauuucucaucuggguauuuucaaaagaauuccaagucaaaauauaucacuuaugggaaguaucuucuuuuccaauaugauaucuuaugaaguugauaauuauuuucaugguuuaaguaguaauugaugacauuuuggggguuggaagauuugugggaaggaggacauagauuuucaucagauguccuugcguccuuuccuugcgaggauuauugaucucuagucuucauauguaagguguugaauuuauuuaauguuauuaacugaaucuauagauaaagagguaguuuuggagccaaguaaccuguugauguaaagucuauuuuaccuuuuaugauuaccaucuagcaccucccuccuuccuggcugaauucccugucauuuuaaguaggcagcaauuacugguuugcuaaagaagccagcuccugcugccaaggauccuguuaauuaucacucuaucucuaauuuagccuuccuaguguugagagaaggugcacguaagcguguggcagaacgucugcaaucgcaucuuuguaauaaucuccuuucugagacgguucaguggacucaauguuccgccaaagggccaaggcagcccuggugaguguuuucagcucucuucuguagcuuguuuggucagucgaguuuggugugauuguccucuccuuuugcuucugaccuaaguaaaagcuaaugguuggcauuaaucuugggaauucagaccuauuccgcuccaucucugaagucaaaugggacaccuugaaaauacuucagugguuuucccacgagcuauuuucucucucugugaaaaggaaaccaggaaauugacucugugccuguuuucaagaagguaauacagaugauaaccaaaguaccucaguuuacagguucuuauauagcauguuuuuuaagggaugucaaucuuuauaucguaugaaaucuuugguucuuguucauaaauggcuagauugcuuucuguuuguuuucggaaauguucaguucacuuguuucagugaacauuuuuucagaaguuccacuggaucauuugauuagguuuggagugcuuaugcuuccuuuuccacuuuuuauguuauuuuuggcaguguugguauuugaagcuguagaagugauucacugcaaagugcauuaauuuuccacauuuccaaaugcauuuuccagugguccccaaauuucuuuuccucuucucagaugauucugcaguuguccuucugucauucugcuggcucaaacauaaaugcugaugucacugaauuucuuaaauuacagcugguggggauuaacagaaauuguaaaagaauaccacuuccucauuuugcuauuuucuugacuaauuauugucuuuucaaguacuguaggaacauagggauuugaaaaugaauucuuugucuugcaguuuaaacagcaauuuuccuuuuccuuuuucuguuauacuucaaaaauaauguagcgcuuaggaugcuuuucugaugugcccuuuaauaaccccagacagaggagucucacuccugauuuugcacuuuggacugucuucuacccugggugaaggguuuugaauacuucccuuaaguaaguuuccuuauauagaauauuuuuacucaacaguuuuucuccgacucaaggccguuacugguauuaugugaaagguugugauuaauuuauuuguuuguucagagccuuugcuccuuuaaggaaugcuuagcucuguccucaucauuuucuuguuuaggaucuguguuauuugugacaauuuugauugcuccagcccucuacacauuaauuuuucuggcuugccucuccuuguuuuaacagugggagucugggccucaggcuuucuuaucacuugguuugugguuugagugaugguuccaugaaccuuuuccugggaguucucugggcuccugugcuggacgcuggaagccaucuggaagugugcacacaggauggcugggugcugcugggugguauugauugaacugcagucccguggaaacagaaauagaaaggguucagcauucccacuuuccucugguggcauuuuugcuuauuuuguguauuuagaaaagguagccauaugcaaacugcugacuuacuauuuucccuggaauggaaaccauuuggauuauuucaaugaguuuuagcgaagauuuguuuguucacaguauuaguuuuguuuucugguagccuguuuagaauaagaccagaaugugucuuuuuacuuuauggaaaugagugcuuacuugguguuuggaauuuugcaaaccaacaugaauuugaaaagucauauguuuauuccagagucaaaauagaaacucuuuagugaaaauuauagauauuuccaucuuggaucauuuacuuucugugaaaaauuuuuuuuugacaaaauuguuuaagauuucagaggaaccucuuuuccugguuaauuuucccacaaauuaauuucccucauuuuuaaaaagaaaaauaagauuaaacugaagaauugcagaccaagcucauaugugcuggaauauuugcuguaagcuggugacugauucuuugcuguuaucuuucauaagagaguggauuuaguuuaacuguuaguaguuaagguuuggauuaggaauacaaauaugauucccuuaccauaagaccuuuuaagcacugauuugcauugcugaggauaaguuaugauuauucagucucgggaaaauuuguauuauaagauccauauacacuuagccaacauugccuucuaacauugcaaugauaaguucuuuuaauugagauuuuggaaugguauagcuaucuggaaaauauuucaaaugucauuguggagcuuuugguuaaaugugaguuuuaaaaguuugauaaauagaauaaagagcggaaaggaaaaauaguuaugaauuuguugaauuguuugggcuaugaguuaucuuuuuaaaaagagguuuuauguuuguguagaaaaugccacuaaauauaagaaaauggaaguuuaauaguugaacaagguaagaauugcagauaucaugagauuguaauuuaacuggaguaugcauuaaaugaauuguauauuucacuagcuuggugaccaugaaugguuuuguuugucauuuuaucuuucuuuucuuuucuuucuuuuuuuuuugagauggagucucuuucacccagcagcacgaucucagcucacugcaaccucugccuccuggguucaagugauucuccugccucagucuccugaguagcugggauuacaggugugcaccaccaugcccagcuaauuuuuuuuuuuuuuuuuuuuuuuuuuuuuuaguagagaugggguuucaccauguuggccaggcuggucuugaacuccugaccucuagugaucugccuacuucggccucccaaaguguugggauuacaggcgugagccaccgcaccuagccucuuuaucauuuugucuuaucccaguaaauaccaucaugcuggaccuuguauuaaaaaaauguugaaucaaugaaugagugaaugcacguuuugggaggccugguugcagaccuaucugugcugcuaccuacucauaugacccugugggucugucucccgcuauauacaaugaaggcuaaagaugggaucagggauaaguaugugggauuguguugcucccuccuucugcugcaguacgguagauauugccaacugucacuucacucuuuccugugaacccaggaggagccuugggccuuucugaauuuagugcaucaggcucccaugacucaccguagauacaagaguuaaaacuuacuguaccuucuccuuuuggauuuggucccugaagcccaauuacaaauaggcaauauucuaugauguuucuuggucagcagauguucauuuaaacaauagagacaacagcaugcaccauuaucccuccauucaauaauuuuucugguagauuuagcagauauauuaauagauagaacuuaaugaaugggucuagacaguauucuuccaguggaguaagauaugaagauauaauuagauuagcagaguuuuucacuuuuacucuccaaagcacaugucuccaucuggggcacaguuauggagcaccuccuguaugccagcacuaugcuacugauaaauggccagccuguaauucaugggcucugccuucuuguaacucaaagugacauaaguaugaugcuaggucuguaauuauuccuuuaaagacaaaagauggaggggcauguaauccuggcacuuugggagacugaggugggugggucacuugaggucaggaguucgagaccagccugaccaacaugauaaaacugcaucucuacuaaaaauacaaaaaauuagcuaggugugguggugugcaccuguaaucccagcuacuugggaggcugaggcaggagaguugcuggaacccgggagguggagguugcagucagccgagauugcgccacugcacuccagccugggcaacagagcaagacuccaucucaaacaaaacaaaacaaaacaacaaaaaaacaaaaauaaaaaaugauugucaaacagaugagaggaaagcauuccagguagaccgaggcauggaggugcagcauaguguggcacugagacagucuaagcacggaguguggcuggagcaccagggagugcggccagcuucauacagaggaauagugcucuggcugccaaaugaagaauggguuggaggguggccagggcuggugucacagaggccaguuaggaugguuccagcugaacugucuuugugaggaacgaugauacacaugcaucguucagcccugaagauagguugugauugcaagaggguaaaaaccuuguuaaagauuucaaggacagugaggacaaaaguaaggcuauauguaaacugcuuacugcugacaauaaagugacugcuuguucauuucuuuaucauguagguggaugccuguucuguaccaagcaccuggaaaauacaaucauguguaaaguagacauggucucugcccacaaucaagcaaaaagaaaaugauugauuacuaaguagucuuuauaaggugcaugagcaaaauucuuaggguccaugcucuccacagauuccccuccuuuccugaaguuaauuuauagucugacaacauguucucugcuuucuauaggaaauuuuggaggauaaaguuagauaagaagauaaaccucaaggucugugccuuauauggagcaugcuugcauguacacacacagacacaugcucacauacacaccuuccuccccuaauaaaagacaccugucuucacuccauagauugacaagcaucuagaauaaggcauaugaggauucccauaaguaaaucugcuccaagaaaaguucuagauaucuucucauauuuucugaacaugauauuuuacauggaagaauccgggcuguugaguuccugauccaagaagaaaagucuuccauacauaauuuggcuuugguggcugcuucagauuagccauucuaucuguguuccagguuauuaccgguguuuggaauucaugugcagaagcaagaauuugccuugaggcagcaagacugguagacacuagauaaguggcuuauuuuaaagugauguuuugguacagaaauggcaguaacaacaaauuccucccccuaauagaaaucuuccucacauucccuauccaacccagaaucauuuauaauaauguggagucaaaauucagcugaauggguuugauacaaauuccuaggaagccauuguaaguucaagcacuguguuuuaaagaugaagcauucaaauuuauuaggaugguaauugcagcugauguagguggggagggcaugugucccauuuugcaugauuuggagaggcaauagcuuguugagacuaaaacucuggaguaggacuguucuagguuugaaucucagcugcacugauugguggcugugugaguuugggcaaaucacuaagauucucucuucaccuguaaaaugaaguaguggguaagcauguaaguccuuuguuaaauuugccaagguuugagucuuuguuguacuacuguaugacauugagcaacuuguucucuuuauaucuuggauuucuuaucuguaaaauaauaauaacaguaauaauaacaauaaugaugaugauaauaauaauuauggucccuaccucauaaggauguggcaagaauuaaaugagauuaugcacacauaggguuuucaucuugguagucuggcaccuaguuagcacucauaucuuacucaacuauuuuuccugccaucauuauauugagcuuucuaaaaauuauuauuuuuugacuacuuauuuuguucuuucugaaaguuagggcuucacaaaguguagucguugcuaugugauuucuuuuuuuuuccuuuuugauacggggccuugcugugaugcccaggcuggaguacaguggcuauucacaggugcaauccuaguacuaaccagcacgggaguuuugaccuguuccauuucuaaccugggcugguuuacccuucuuuaugcaccuuggugguccccuaggaggucaccauauugaugccgaacucauugcacucaccagaucagcaaagugcacuacagcccggaacuccugggcucaacugauccuccugccucagacuccugaauagcugggaccacaggcaugugccagugccuuuucuuucuuuaaacuggagacucaauaaugcaauuucugaauuuggggcagaguugccagauaaaauccagaauguccaguuaaauuuggauuucugauacagaauaauuguuuacuauaacuuuguucuagauauuucaugggauagcgagacuaaaaaauauucuuuauucaucugaaauucaauucaacugggcauucuguauuugcuaaaucuagcaaugcuaguuugguaguaaaacauacuccuuugcccucucauucauuuuuucacucagauagauauuuguguaugcuuauaaaaaugcagugaacaacauccuuggggcauaaguauagaaauaguuucauaaauuugaaaaaagauuucuuaguaucucugguaaaucuaccuccuaauuccuucucccuguguaagccaugggaccaucaaauugagauuauguugauacuugaguauauaguaugauguugcuugaaaauucugaaauguucuaguguugcuuuuaccuaaagggaaugauuaauggugacacauuaauggguaugcauuccagagaauccugaaagcuuugucauuuuugaaggaaauuaccucauuacuuuuagagucaccuauccaggguagguuggucccugugguugaccugguuuuccaaguaggaaaauaaacacuucaaugguuagguuaauaacuuggagugauuuuguuguacuuacaauucaaguuaauuuuuaaguaggauuggucuuuaagcuacuagacuaguuggagacucugagagaauugcauucuaagagugagauccuuucaauucaaucagcauuuacuguguauugacugugcaaaagcaacugcauaugaagagagaggaauuuaaaguguuuugaguuccugcucucaaaaaccuuaguguuuaauggagcacgaaagcaagaagcaauuaugacaaaaggcaagauaaauaaggucaaaauugaagucuaguaaagcuaggucccaggaugguugaauguaggaagugguuaaaucuggaggccaaguagaguaggaauggcuuuuauuaggacagguuucuuugaagguaauaugugagagaacuauucaaagauaagaaugauuucauuugggaaaugaaauguucuaggugugggcuuagcauuaacaaguauccgaagguggccacauuuugaaaugcacguguuacuuagacaugacaaaaauauauacagcaccaccguaacugacagcaaccgcuucucucaugugugacuguuuaugaucuagaauuuccagaucagaaacuugauuuuauguagguggaccuggauucauuccauguugguuuccuaaguauuuauugugcaccugcuguugcuauguaugagacagccagagagacuugggcaacauuuaggaauucuuuuagguggucacuuaaaccaacugaaaguuacuccguuuaaacauggguuuuuuuuuuuuuccugaaaugaacacuuccagugagcucugauuuaaauugggcaaaaucaacagcaaaagaauuccaugagaagcaucuugucaggcgcucugacuuugaguauuugcuuaaaugacuuuacaagccagcuuaacucauuuccuguuggaugacacuuguuuauuaaacuuggcccaagucagaguuaauagccuuaaugguuuugaauggucccaagugauucuccagcagugugucauuagugaacggggaggauucuacagauaggaugcaacacacacauagcugcuucagccaucauagauuuaagagaauaccuauagcccucuuaaauuuagcuaaggaaauugagaauacuggaaaguaaguguuaccauugcaguaaaugcuaaaauauuuuucaacaguucuaguaguuuuccuuuuuuguuuuuuugaaauacuuccaugugaaauuaaugccauuuaaaaauggcaccagcauucagaacuugaaucaucccaaauucucuagcaaaugaauuaaaaugugacaugggguucauguugauuaacagauguguguagagaauuggacuggguagccugccaucgcgaugcaugcuugaugcaugagagggauugcuaagauugggaauggaaaacuuuucuacuuuuccauuuauguguguguugggcuauaaagcucuaaauuagacuggaaauuggugaugcauuuggagaucguugguuuuuaauuuucaucaauuaggauugauguaugucuuuuaaguuuggacaaguuguucuuuguggaugauuuugcuauuucagguacuggugggguaagaguagccuggaugcaaaccuuuauuggguucuuaaacaugaaagagcauaaacugcuuauguuaguuugggucugguugaauguuauuaauuuuuuuuccuugauggccaggccaaauauuauguaguuuuaauaucuacccuugguuccuacugccuuauuuuugggcacucuuaauaucuuccuuuauauaucugucauuaaguuauaauugaagcuucauguuuuauauuuagaauggugcauggaggcucagcugugccagccauucaggccuaauggcaaauguugguucaugccagaaaguuuuuggagucuagucucuuuuuugggauguccaaucuaagcaaaccauccuuuucugucuuaagcugaggggcacagggaagcaauuuagaagugauuuccacuucugugcaugugacagcaucuuguuucugauaaaaauuauuuacuugcuaguucacucuuuaacccagagagucaugcagccuuaaaagggauugcuuugacaagucuuuaugucacuucauuccuuaguuuacugacuuccaugcggaguaucagugagugucaguuaaaaguggguacauagugauaguagaugacacccaugccaccagcugcuuccuaugggcugccagaugcuagcaaacguuucacagcucuugaauucucuggauuugggccacucuugaacucuauccaucaauccauacacccacuuauugagcuaauauuuauugagguuuuacuauguuucaggaaguugucuagguaugaggaauacagcagggcaccaaacuguugaaaaucuuuguauucauggaacuuacaugggcaagcagauguagaaauaaauaugugaaugaguaaaaugcauaauaugcuaaaugcugguaaguguuauagagaacgauaaagcauggcuggguuuggggugacuuguaauuuaaaacugaguggacaaggacugccucacugagaaaaugacauuugagaaaagacccaaagaagaugagggagucaugccaguauuugggggcaaagcacagcagacagaaggaagaguaaguacauaguaucuggacaggagugagucuacuucaguaacagcaucauggccacagcggcuggaccaggcugagcaaaguggggaguuccaggaauggcaggagguggggucagugaaggaaugggauuggggcagaggcagacacuguaaggguuugcaaagacuuugccuuuuacucauuaaaaauugggagccguugcagauuucuagcuaaaggaguagcaugaucugauuaauucagguagcagcccaguguggugggggaaaacaggggucugugaauuuggagaucauguaaaccacgguuuugucacuagguaggggcaaauaaauucagcauccuuagcuucaauuuuauuccuucuuauaaaacaaugcuuguggguuggauaguuuuucaugaccuuccagguuuugauacuguuacccuggauuaguugccuuccugugaguauuucauguguauggcugauuacauuucuccuugaguaugcauagcuggaccacagauuuguaaauuaucuuucugugcuuuauuuacuuaaaaaauuuuccauaaacaucucaaauugaaaacuaugaagcauuaauacuucuauauauugauguuaaagguugcuugaaggcuaaaugguaaggguaaacacagauuauaagcuuuaucacuagccuuaauacuauuuuuuguuauagaaaauagaauugauuuguagaguauugcacugagcuaucaguugggauacagugauaaauaagacacagcgucuuaaggaauugaguaggaggagagauuccuggauaagacaguaacucauaaaguguuguuaauggaggagacaguccugguuaagacaguacccuacaaaaugguguuaauggcagaaaagagggccagaagccaugacuaggugcaggcccaugggagcacaggcagacuaauauucagguaugucuucauaccaauauccuuuaaaaauguuuaauauuuucaacaaccaguuagaccuagugccacacaugcuaggaggugccagaggccuggcaggcuuucuucuacagcccugagcaauuuggcucugccccaaaguugcaucaugauguuuggcacaccaaggucugguaaguaacucuuauuagaagaugguuuagggaccgucuuuuauuauucaagaauguccuuuggacaucuuaaucuucucccuuccaccagaauauuucuucuacuuccugugauguuauagugcuccuucuagacugguaccccagguagcaggauggcuagucaguuucuguauuuccucuguggagaaguauugcuuuagucuuaccuugucuucaggccuccaguaugaacucuguugggagucacguggagcccuagucauuuuauccacugacgcaauguauuccuuguguucuguuaacuggcuucuugggcagccuaggaguauucuaaguuuccaggucaaagauucuggaagcaacuuuccaagagguagaagggcugccacuuucccagacuuuccccuucaacugaggcucccuguguauguugggguguggggugcuagaggccuugcugcugaggaaaguugccaugguuaccagcaccguggcucucggaaggaggaggcuagcauguuagcaccucagcuguccugugguaaugcuuagggggcaaaugaccauaccaaugagcacuguuagagcuggaggggaaacugagguucagaaguugacgcuggaaacaggaaccaagagcccuugacuuucacauugcauugcuuccuuucaguuauuuuacaccucaggccuucacacacauucuuccugccaucuugaacauuuuccugccauucuucuguuuucuuucuacucauccuuuagucuccacuuaaagguugcuucccaacccaccuccuugccccucaucugaauuagguuaccaugcuuuucuuuuaugguuuccuaaucuuauccuucaugcuguuuacauaauuauucuauaugcauccguauguucaguguuuguuucccuacuccaaagggccaaggagcacagcuguuuuguucuccauuuuauucucagagguuaagccaggcuguaacacagauaggcaguguaugacuccauaagugaaaggguaaaugacuggaaagaagacugguuuucucucaccuauuuaugugaaaugucucugccugucucagcugaggguaacaacuguuauugguuuuguguauuauugaggauacagaagaugugauucuugucucuaacaucaccaagucuguggccuucuggaauuuuauuaaggguugucucugcaaaaaccaaaacccaaugauacacacaaaucagcauucuuuaauugguauaggcuugacacgaggggcugugauuugucaauuuauuuuacaauauuugcauuuuuauuucuuaauucuguuuccagaaaugagcuuuaaugccauuuggaucccccauucuuuuuauuaaaaaugaauagagaaaauaccacuuuucauuaauaggauucauaauccuuuuuuggagggauuuguuuuggcuuguguaauggaacuuuuaagaggguaggcauagaaaacugacugggacucuuuguagaagaaagagcagaguuaccuacuguguguaaaaaagaaaagcaggaacaguggacuuucuuuauuucuaaaacuaaacugcccuaauuguucauaucaaaagaugggcuuuucccaagcucgguuggcauuuuuaauuuacagagaaagcgugcauuguuuugcagugugcauugcgguuacauuggcucccagaagauuagcucaaagguaucuaugaauagucacacccuaaauuauaugaacugaagaguuuuaaagagguggaaaaucugaugcaugcuauuucccagacauucaugccuuaggaaaauaacuagggaagugggagagugaaacuuagaaguugcuacuuuauauucaccaauguggcacuuguaaacugugugacccugggccacugaauuaacuucuguaagccucagaauuguaaaguggagauaaaaauaccagcuaccuucagaauuauugugaggauuucaugagauaauauaugaaaagugucacaaugcccagcacauuauaaaugccuuauagguaggggauaguacacuacauaggauaauaguuaagggcacagacucuggagggccuggcuucugaauccuggacuugcacucagggguggggccaucuugggcugguuacuugacauuugcguguuugaguuuccucauaugcacaauggagauaguaauaauaccugcuacauaggguuauuaugaagauuaacugaguuaguaugugucaaguguugauaacaacuugugguucaugguaagugcuauauauacguuuguugcgaugaagaagucugggucuugcagacaguuagucugcaaguucuugaaccagacuucauaauguaccaaguauguugagcuucaauuuucucuuuuuguaauaugcggaugauucuaguuauaaugucaauuuuuaugagaaaucggugagauaaugcauauguaaagugcucagcauaggauuuggaacauggaaaauacucacuacucauagcaaagacuuuucuuguaauugcuacuaccauuacuaugauuauuuccauuauuuuuaguccuacuaugaauaugccucuggcuuauauagaacuuauauucgaagugaauuccacaaacacucuguggaaauaaaaaggauuaauauguagaaaauaauguugagaguaauguuacuguugguguauuucuauaaauggagcuguuucagcaaauugaaaaauauccaguaaaagucuuauaaucaugcauuugcaauuuugcagaucacaaaagaucagaguuagucagggucaguguuggguggacaguuuuauauucauggaaaaugacucauaggaaacaucaggaacuaaaauuuccaaaauaaaaaaaaauuaaaaagucaucauauaaacuguguuuaagucaagucuauuuccuaucuuaacugagauuauguucauggaguaaaguuuugacauggucuaaauuucaauguuauaucuuguuuguggcaucacuggaaaugaauaaguccugauuccagugaugguaacauuuuccacuuuagucauuugggucauuguugcuacaauauccauauuuaaaccuguguguuguuuugcaauauaucuuuaaguucaacuuccuuuuuuguuucaagugacuagggaagaaaaaacagugauuauaauacagaguacaaaugauguuugagaaaagcagggcuuugaguagcauugguccugaaguccucuguguuuuaaugaagggugggagcuugcacugagaagucaggugugcagagaagugcuaauggucgcaucaaggccuggaugucagauccuuucaagucaaaauauggaagugcugaugaaauuccuagauuauaugaucuagaaggacaagucaaguuaucccaucaaaaauauaugggggaacuuccgcuaggcaugugcauaucucugauaacaguaugccaugguuggaaggcgggaaccuggaagggaagauaaauucaaguucaguaucacuggggccauagaaugaaguacuuuuuaagccaugguaagaagggugggcuuuauuagaaggccaauagagaggaauggaaagguuuuaagugggagggagggcauucuauucguguuacugaaagaucacucuggcggugccacagagaauguauuguaggagauggugacaaagaaaaccaauaaggagcaguguaggcaagagcuggggucacucgggacuugccuguggagauggagaggagguggagcugagagauaucagggaaggagaaucguagggugggugauucguuggacuuaagugguaagagagagcaaggagggaaggaugucuuuuagauuucucacaugggcaggugguuagaacaauggugcuguucauggagaugaggcucuugguagacaaaacagauuggggaggaugaauauuaauucuuccuccuauaugugguagaguagauggauguuuaugggguauaauagaugaguauagucauuugacuguuuuagaacgagucugguucuugggguagaaccuguguuucagucagguuugcauuuucaagcaugaaauuaaauugccaauuaacaguuguguaaacaaauagggauuuauuuaucuccauacaagaagcccagggcucuguaaucacugccguuguuuaguggcuccaugaugucagaaccagcaucucagugauuugucuugacuuuuuucuaauauuugucaccucaugguugcaagauggcugccgcuccucugggcaucacaacugcuuuacacuuuaagaagaguguaaaucaagaagggagaacaagcuaugauuucuuauuaacauauacaguaugaagugugcuuaaaguuugacuauauuuuucuuagauaccuucuaacacauauagcucugaguagucuuuaaaguauguuaaauacauuuuucccugauuaaaauucucaacuugcaaaaaccauuuuuuuuucucucagauuuauuccaaaucuuccuuauuacuaaauucucaguggaccucucuggguuucgagcaagugcggaaaauuccauuugguguucgccggcugaugugcaaguaaaagcagggaauguaugauggaaaaugucauacccuuuaugaugacuuuugaucugugaagaauauaauuauucuguguuuaaaacuacagaagggaaauguuuauucacucuuuuugaagguaacauuauucgggguaucaugaagugcaaauauuuguccuuugcugcaguuuaauucaagauagucucaccaccuaauguuugcagaauucuguuggugacuguuuuagcuaacagucauucugaggcauagcagaaggugcagagauuuuuggaaagagacaucucaagguguaccccgaugcugugugauuuucuuuaacuucucugaacugguuuguucugugaaauugggugaaauugggauaagagcaggagacagucuuuacauccuuacuacaaacauacacaaaaaugccucugaaacaaggguggcuaugacacacugaaggugcaaguuaaauaugaugggguguggaauagggaaagauuaauuucugcugggagauauugugaacuccauguuggagaaugcagaagauuuacaggauaauggaggauggccccaggcuuaucacacacauguagugugcaaaguacauuagaaguuuucaggauuuacuguuucugauaagggucaaaaugaggagacccuugaaauucuggcugagcgagcuugaacuuuguucuguaugugauggggagcaacugaagacuuaaaaauucacggaaacuuaaugucgauagaagugaaauugggggucaaaaaauauauauaauuaaaauuaaaauuaaaauuuucauuuugauauaauuauagauuaacacacaguugugagaaguacugagauauccauguaucuuuuauccagugucacccaguaguaacauuuaguauaauucacaaccgguaaaucaacugaagucuuuuaaagggaaauccaugauaugcugaagucuguguuaaguggguuguccuaguagcuguggacuagaauggauuggaaaaagaacauggaagcuaggacaccuuugggaggcucuugcaauaaucugagaguaggggcauaacaauaggauugggaagaagggauauuuggcaauauggggcugauaagagaagcugaugcucuguguaguugcucaacaaagagguauugagggucagcugugugccaugcagucugguaaguacuauagggguuaaaagaugaucuaauagagacagggcaaugcaacugaaggaaaaugggccacguggaaacgauguuaggcuggacgagacagugaguucugucuagagggauaacuacuauucuaccacugguuguuaccauuugugacuauagguccgguguggcugguguuuugauuucuuagaugccagaaaucuaaauuucuuugugaaaucucucaauuuuuaaauguuaccuaauauaaaauuacaaagaagaugcaugccaaugagcagucaucugugagcuagauucacccuguggguucuuuguuuucuugauggaauguuuagagcuuauuucaguuaucuauuacuggguaaauugaguggcuuaaagagauaacuguuuuaucucacauaguucugauaauugacuggggagcaguuuuccuggucuagcuuggggucucucauggaauugccauuagaugauggcuggauuuggagacaucuugaagccugccuugggcucuaagauggcuauaacuuucucuuucuccguugguuucaggaccucuuguggccucuccauguggccuuucuagcaggguaaccagacuaauuagauguuagcucagaacuccuuauagauuguuucaacagggaauaaauagaagcuacuagucuccuuaaggcuagguccagaguugcuagcacaucacucuugccacuuucuguuaguuaaugcaaguugcuccagaccagauucacugugggaagggacugcacaaagcaugaaugaugggaggccuuguccauuggugaccaucuuuggagacaaccuaccacugaaaucaagaugucuagauauuggugacacuguuuaucaaagguaaaugagggacauagcaaauucuccuguuuagcauucauguuacuuugaaguuuuuagaaaaccacauaauagugaguuuuguuuuuuuuuuuaguaguaacugugauucuggagaaaccugguuguuaauacaguggcuuccuuuggaagcauaauucauuuguagcuauuugguguccaguucauuaaaaaauaauacuauuaagugauaagacagaucuuuucugcuuugggugagcauguucuuuucaaauacgugaccagguuguuaauguuggguccauaaucauguaucuuuucagaaaagagccccucagauaaagucuguuacauaagacuuccaaauguuuauuagccugaauacaugcaacuaaaauguacuuuaucauggcgcuuuuuguucuccuuagacucagaacuggcugcaaaauuugcaggucccagugcaaaaugaacauguggagccccuuguuaugauuguaaagacgacaccagcgagcauuaaaccaagcccagggcccugugcaccugcauagaucucaugccuaugaagucaucccugcuuagauuuuugaaaacguguacaaaaugugggaguauacuguauuuuuccgauaaagggccauuaacucugaucaaauucucauuagauuuugacacccccaaagguugguccuacugcuuaugcaaauaagaaaagggugaaagcucuauguuuaacaagaucucuguucccaagcagucccuguaccuccuagccacagcagcagguguuggcaggcguuagucugagcucccugcuguucaggcuuucugaauuugagugauuccaacacaguuaggaacagcauaucucuugucgaaggcuuggcaugcuuuuuucuaaauguacuuucuaccccuuuacugagcucuguuccugaaggauccagaauagauugccugucucguugaugaguuccuaaguucauuuggaacagacacuaacacaguucauugcacuaaagauuuaggguucaacaucuccagaagguaguugauagacuccagacagguuugcaacauuguacaacugcagagagcaugcucagaucauggccuaggaauggcagccccuggcauugugcagugcacagccugaguggcuguacacagaggcccugcccuauaagaaucucagucugcuauaauaauuuagagagguuguuguacagcugacuuuuuaaauaaggcaugagccauuuugaauuacuuguuuggcccccugaccuguggcuucauaagcucuuaauuuuuguuuaucaucucuaucaaucaguggaugccaaggccaaauuagcccuauacccauacaccugacccuuauaauagaauaauaguagcuaacauuuauugaaugcuuauuaugugcuagcgacucugcaugcauuaucuaauuucaucuucacaacaagucuauuaguugcuguuauucuuccauuuaauugaugagaacacugagauuaagugugguugugugaguuacucaaagucacaaagcuaauuaagugauaagcugugacucgaacccaguccugucugauuucuaaacccaagcagcauuacagaggguguguuuuuagggcaauguuugcacauggcaguauucucuauuugaagcuuguuuuauuguaggccauuucuugcuucuggagcauucccugauuaaauauucucuaccuauacuuauuucucaggauuuuuaguucuuucaaaguaaccaucagaccuuucauaaauuuugaauauccuuuauuacuaucuacuucaguaaaucuaggaauauuuaaucucuuaauuggaguuacaaauggcaaaugcugaggggauuauguucuaggugaguguuuuuguuuugcacaugccucagagaacauaaaaauuaacacauuuccuuaacagagaugagaauagaguccuaaacaucaccagauaauuuccuacuagugauaagaaaaauuauucucaucuaauuuuuacugcuuucaguauaauguacuguaggaugagaggaacagaccaguucccuugauaaacaccuuuugaccuuauuccauccuuuccaggagguggaaauucugauuuucccuuggagugauauuccaguucauuuaaugcaugugaacagacagguucuuuuccaggugugagaacaauacugguuuggaaguagagaccuagguauccucugacagauuguggggaaguugagauaccugaaauuaccuuuugcuuggaugcuccuugucucucuugcccaucuguacaguauuagauuucuaacaaugugauagacucuucuaauauuccuaguuauucuugacugauaguuuuuguugaacaaauagaaaagaaagguaaggggcuuuaucugaauacagaauacuuagucaaguguuuguaugugugugugugcacguauucaaaggagauauuuauauaugauauguaggauauauauauauauauaauuuauauauuuaauaaaggagauuauuucucuuuuauuaaaugccaaguuggguuauguugcuuucugcaccacagauaaugacuaaggaccuacuuacucuaaucgaaugaucugcccaaagacuaaugguauacuuuauuauacuuauuugcaagguucugauagaggauguuuuaaauuauccagaauauguuuuuuuuuguucguguauguguauuucuaaaagugguguuucacaaaguguaguuuaagaguuaccugugucagggucaccuggggauguguuaaaaauaggaauuccugggucuuuggacuccagcugucucuacugauuugagguuuucaggaaucugcaugucgcucagcuucuuugugauuuuugucccacuauaguuugagaaccauggucugaaaugugucagcauagggauaaagauucaacuuaauuuugucuuuuuuuguucccuuccucuuuccugucucucuuucuucuccccuuucaaauauauuagagacaacuauuuuaagggguauuuuaauggcuuguguuuuuuauuugcgaugaaaggcuuuuguuaauguuagcaauaucacaauuccaucuuuuccuuuguggucuguauaaaaggagccauuggggaagaguugcuuuuuguuuuguuguuguuguuguuguuguuguuguuuaaauacccacuauuuuccauagcaaaucuccaggaaggaacaacauacuguuuguucuuuuuucaggauaacucuggcuuucuuugcuaguggguguuguaaucaaugcuuuucagaagcaacuuaauacuccuccuuacuauaaaucccagaauuuaaugcaaacauuucuaacguuuauagaggcuacuuuuugggguaagagaagggaggaaugaaaauccuuugagaagacauuuugaggauucucugugaucucagaauagguaguaaugacucccugaguuuuagugucaaagauuuugagaucucuuaguauagaaaacaguuacaaagcuagaagcuuuaauggauuuuuaaaaacacaaaguuuuuaacugaagauauuccugaaagguaaauucccucccuccuucccccucccccauauuagagaaauuacuuuuuugaggaagcugaacuagccagcuagucuccacucuaauccaugguagauaacuaguuggauuauuagagauuggaacuuuuccaggugacuuggauagagacucccugaagauauauuaagccaggcaaugaauuuagaggcagauucuucuuuauaaaggacuucuuaaaauaggaaaaugaugaucuaagugucauaaaguuaagaaacuauuguggugauuucuucugaaggucagauccaagguuuguguuucauugaagauccccagggaaaucucaaggguccugugucccauucuggagagacuggcguggacugugggccccugcagccagcugcuugccuuuuguuuauuuuccuuguuaucuuugucaaagugcugcaguuggauuuuuuuuuuuuuuuuaaauagcacaagaugauugucuuucugcugugucuuccacgaaagcuuuguauuaguggagaacuuuuggcugcagagcugggcugaucuguguggcacugagcauaauucagguucuccugcgggcacuugaacauucuucaugagggcugaggcaggcaagcugaguggagcagugagucacggcgugcugcggcagugguguccugaaauaacagcaagcagcagcagcagcagcagcaguaauuuaacagcaguagugagcauuuacugaugcuucccaugugccaggcacucugcucaguaccuucugugcacuaucucauuuaaaucagaacaaucccaugagcucgguaccaucuuucaugucaguuuuacagauacucaucugcaggucacaugaccaguaagcaauccaaguggggcuugaaugcugauugcuugggugcccaaauucaugcauuuaaccauaguaccauacucuuugacagaaaugcacguuguuacugccuuuuuugcuuugcuuuuuccuuaaaucacaucagaacugguuuuugcuuuuuccuuaaaucacaucagaacugguuuuugcuuaguaauuuaggcuccaugaccugaagauugucuuuucuuauuuuuaugaguugagguuuugagugagagggaaauacaaccugagaaaguucauccuugggaaauugagcauggccuuuugccugagaccauguccaucuacugaauggucaagggagcaaaaaaggaaucgugggaggugaaagguagaaagauugggcuagagaaaaagagauggacagguagacacauccagggugaucuguaccguggaugaaggaggaagagggauaugaaacauaguucaagaacuagaguucaaaggucaccuggguaauaaugccauauagggcuuaaugggggaaaaggaagguucagugaucaaauaaauuggaaauuguacauucuaacaucuguuuggagaacaaaaaaagcagugcagcaccuaacacuucuugagugcuuccugcguaugcuuuaaguagcacauuccacucuuagauucuaagguggagugagcuuugccaaaggagguuugacuccuagagggaaaucaggguaguuuccaaaguaaaugagaauggaugcagauuuaaauaguugggacucaugccacaauuuaccugauguuuuucucauucugcaacugccuggugccuggugaccuuugucaguggcuuccucuuguugccucuagggcaugaaucccugcuucugucugcuuuacgggauuguugacaguaaaugaguaugaaguccuuugcgcucuguagagguaagacgcuuuugaaguucaaggucuucauaauguucauaucaaauaucuagaguuccuucaauuuaguuaacaucguaaaaugaauguauauccuuuuaggacagauuaaauacccuuagcuuacucaggagaggaaaggaaaugcaucuaaaaaguguuuacugcucucaggagacauaucuucaaguucuuauggguugcaccgagaugacuggugacaauccucgaguaacauuguuauggauuuuauauaagacuguggaaaaugagacguguuugcuuguaugggcuuauccuuuugaagcccaguuaucuggggcauacauccguggaaauaccgucauuuaaaaacaauuucuuuaaaauuaggguuggaggagcauauuagguaaaaauccauucaguuggaaaugaccgaaaguccaacuacagcaacaaaggagauuuauucauucauuuaggugaagaguccacauccuuuuggacuugcuuugaguaucaugguuggauugaccauaggccuggaguuaucaucauguaccugguuucucauccaauccacucugccuucaugguguuaugucacuuuuagaguguugcugguuccacuucgugaugauaagaugucugccaaauacuccuggggcugcuuauucucucccgcauguggugagagagagagagauugauuucugggagcucuuccacgauagcaaaggagaagcucaaaccguucuuauuggccacacuuaagucauguuccauucaugagccagugcaugugaugaaggaauggguuuuaggcugguuaguauagacaccagaaccauguuccacuccugaauucuaagggggacugaacuucaccaaaggaagugugaaaccuagaggaaaaucaggguaguuuccaaagugagaauggaugcagauuuaaauaguugagacucaugacacaauugaccugauaguuuucuuguauucucauguuagcaguuaugugugaaacuggcuuuuuaaugaauaaacgacuagaucaagguuuaacuuguaaaggaucuuguuccaaguuccucucuguuucuuaguaguacaggcuagacuagaccaaauugaaggauucucuuucuuuccacuuuuugaaaagucuugguguuugguuuuugaauuuguaaagcauuaaguugaaucuguaucuggccgugguuuucuauuccaaaugccuuuuggaugagucagugugagguuucauuagggcaguauaaauuacccucacuuuuuuucuuuuuuucucuucuugaucucaguaugacugcuccuuauuucugacauugagccucauguuuuaauacauaaaagauuccuguuuucacauggaucuccuacguguccaacauuacauuuuauccuacaaaaauuacaccacugauaaaaauaaaauaguuauuauugaaaggcauaaauaacaagaaugguggugguagccagaaguuacugagugcugacugugugcuggguaagcgcugugcuaagugcuuuauuugcauuguucuguuuauucaucacagcaacccugugaaggagaugcugucauuaucucuguuuugaagaugagaaaacugagguuaaauaagguucacaaggcugcauagacaggcagugguggagccaaaacuugagcccagaucucuuucauucugggaccugucuucuuaaccacuauuuucuuuuucuuuuuuuuuuuaauuauuauacuuuaaguuuuaggguacaugugcacaauaugcagguuuguuacauauguauacaugugccauguuggugugcugcacccauuaacuugucauuuagcauuagguauaucuccugaugcuaucccuccccccucccccgaccccacaacagucccuggugugugauguuccccuuccuguguccauguguucucauuguucaauucccaccuaugagugagaacaugcgguguuugguuuuuuguccuugugauaaccacuauuuucucucucagagaagccacgauacuuugaguaugcuauauaccuaaugcuaaguuuaaaauuucuggaaaguugcauuaugucuguaaauucuucugcaguuagugcuucuguauacuacuagugguagaagauugaaagagaacccuuaacaucuuggaccuuggaaaaacuugacccagaagucuuucaccaaaaauuugcauuuaccugaagagccaaagcaauuuugagaaagaagaacaaauuugaaggacucacacuuucugguuucaaaacacauuacaaaacuacaauaaucacaacagugugguauugacauaaagacacacaaauagaccaauguaauagaauagagagcucagaagugaacccuugcauauacggucaaaugaucuuugacaagggugccaagaugauucaaugaaguaaggacagucucuucaucaaaugggguugggaaaacuagauagaugcaauggaaugaaguuggacccuuaucuuacacaaaguacaaauauuaacucaagauggauucaagaccuaaauguaagacccaaaacuauaaaacuccuagaagaagauguauggaaaaaacauagugauauugaacuuagcaaugauuuauuguauguaacaccaaaagcacaggcaacaaaauaaaaaauugacauaggacagucuucuaggugcuagaaaaaaaaagaaaacagaugaaugcuacuccauuaaacuuaaaaucuuuugugcaucaaaugacacaaucaucagacugcagagacaaacugcagaaugguaaaaaguauuugcaaaucauauaucuaauaauugguuaauauccagaaugcauaaagaacucccacaacucaaucacaaaaaauaaaauaaccugauuaaauaauuggcaaaggacuuuaagagacauuucuccagaagugguauacagaugaccaacaagcacgugaaaaagugcucaaugucacucaucaucuaagaaaugcaaaucggaaccacagagaaguaucaccucauacucauuaggauggcuacuauuaaagaaaaauaaugacucuuguugagaauguaaagaaaguggaacucuugugcacuguuggugggauuguaaaaugauacagcugcuacggaaaggagcauagagguucauaaaaaauuaaaaauaguaaucccagcacuuugggaggccaacucagguggaucacuugaggccaggaguucgagacaacccugggcagcauggcaaaacccuaucucuacuaaaaauaaaaaauuuagcugggcgugguggcacacaccuguagucccacauacuugggaggcugaggcgugcgaauugcuugaacccaggaggcagaggcugcaaugaauggagaucgcaccacugcacugcagccugggcaacagagugagacugugucucagaaaaacaaacaaacaaaccucucaugugauccaguaaucccaguuuugugugcauguauauauauauauauauccaaaagaauugaaagcaggguccuauagauaauugcacauccauguucauagcagugcuagucacaauagccaagaguggaagcaacccaaauguccaucagcaggugaauggauaaacagaaugugcugcauacauacaauggaguauuauucagccuuaaaaagggaggaaauccugucauaugccaugcuacaacauagaugaaucuuuaggacauuauaguaaguuaaguaagccagugacaagaagguaaauacuguaugaauccacuuauaguaaguuaaguaagccagugacaagaagguaaauacuguaugaauccacuuacaugagguauguagaggagucaaacucauagagacagaaaguacaauggugguugcuagggggaggggguagugggaaaaggggaguugguauuuaauggguauagagcuucaguuuugcgagaugaaaaaguucuggagaucucuugcacaacaaugugaauguaauuaacaucaaugaacuguauauuuagaaaugguuaaaaugguaaauuuuauguaacauguuuguuuauuuguuuuuuaccacaauuuuaaaaauuucacauuuaucaccuggcacuaauuuuacuacuucauugaguauuucaacaucuuacuugaaguugcaaaccccaaggccacaggcugaauguggcccauggacaaucaguuuuugacaaaugugaaauaguggucaauauuuuuuaaaaauuaggaacuuucacaucaaaaccccuauaucucgcuucucuuggaaaacuggagaaucuggaaauuccaagucccuagucuguccaaucaacaaauggcuguagcugaggagcagcaccccacuuucaguccuaggcaugaaauucagauucauuucucucacucucgaauuucuuauacaagacccaaguccucgugcagauauacuaacuuccuggccacaguauuuguagguuuaagauauuaaacuucuuaauuccaaaugcauccaauaauaauagaccguagaugguggaugcucugcgagcucccacacuaacuucuuuuuagagacacuaauuucuagguuucugcuucuguuugagguccuagaguuaucaucucuguauuucuauaugaacaaauauagucccaaugcccuuuuuucuuuugccauuuugcguacagcaaauguccugcaagucauguucuaaauauagauguguuaaauuucaaaugugaaaguuuuugaagggucuaaagccaguuugcuaaucagggaaaugcugugauuggcgccagcacuugcagucccugagggggauugugaaauccggccuccgcaacugugauucaagucugggaugaaagaaaacuccaugaucgcugaagagcucuccaaguuguuuucuucuuaacagcguggugguggugguggugguuugagugucauaacagagaaaagacaaauacauguuccugaguucauuuuacuaguacuggauuaauaguaugguaacaaaucauuauuuugcaagcaaaaacaaccauguuuugcaauucuuuaugugcaaguuguaagaaaaugccugucaauagaaaggaaucuagagacccaagaggcucaagaccucuucauggcaaguuaagaagaauggcuacuuaugcaaaauauaaaaaccuuggguauuugaaaguucaaacuggcacaguuuuuucucuuuuaaaucuuauuauucuguuguuuuucaagauagggcugguggcaucuaauggcaaguagaggcaaaauacuggaaugcagcaguugugcguuuuucaaagcuaugcacugcaugacaucccugugugugcauuuaaguguguaugcaagaggcauuauuagaacugccuauauguuucaugcugggucuauuucauuggugcaguagaacuuggaaaaugcaguuucaugcuuugaauaauagugaacaacaguagaggaggccuuaguuuccaagacugguggagcagagguauucggggaacuuucugggaaugagacuuggauaauuaaguugcugugcccugagaguugcuccuugaaguagagacggaugugcugaauccucaucuguacuugccagaagugaagcugucaucuagcacaguugcugccucuguuuuugaaaagagauaugacuaguugauuccaucacuaucugaugcagaauuuucaaagaugaguaguggaucagagaaacgaaacaaaacaaagccaacugaacuaaacuguguugcuagcugaaagggucugauagugagcaaagggccagauguuuggaguugcuuucuucaauuuuauuucacugcuuuuauccauuaaauuggucaacagcagcacucacugguaaaaauaggaacaacagauucaaguuuuccuaugugcuguuacagugaugcccuuuuuuucuuuccucucucaucuccuugcuuuuuccuucccucccuucuuaagcucaagcuuucauuauaugauuuuuuuuuuaaauuccaaaagaauaacgauaguguauagauaaaaugugguuaauuucccuacucaccaucccuaauccuacucuucuaaagaaaucaauauuaagaguuugguuuauaucaacaauccuuccccaacccaugcaaauaagauauguaucuagagaaauuuguuuuucuaauuuuuacaaaaguggacucguucuggguacagaaucuuguaacuugacuucccuggcauuauuuuauuggcaucucuccaaaucaguacauuuagcucaaaaucgcuacuuuuaauggcuaauuuuuuuaauaguauaguuuuaucacaauuuauucauaaaauuccuuauugauugauuccucugccccacuaaaaauuuccucuccuccacuaaaaagauagcauugcauauuuuaauuacacauacauauuuuuaaagcuuuacccuguauaauauuugaagaggaaaauuaaaggguuucuaaauguuucauuugcuuuauuacuuuaaauuuuuucuuguuuuaugggcuaaagucuuuagcuuuuuuuuuuuuuuuuuuuuuuuuuuuuuuuuuaaacagggucucccucugccacccaugcugaaguacaguggugcaaucaccguuccugggcaaccucgauuuccugggccgaagugaucuucccacuucagccuccugaguagcuggaacuauaggcgcuugccaccacaccuggcuaauuuuuuuguauuuuuuguagagaugggguuucgccauguugcccaggcuggucuugaacuacuaggcucaagcagucugccugcuucggccucccaaaguguugggauuacaggcguaagccacugcacccagccagauuuucuaauuugcugauuuaccucuuugaauuuuugcauuauagcuaucuaugcuguauagugaaggauuucucaagcucggcauuuuagucauuuuaggucauauagcucuuuggugugaguagcugugcuguguguuguggaacacguagcgucccuggcuucuacccauuagaugcucauagcaugcacccucucccaaugcucauagcaugcacccucucccaaugcucaaguuaugaugaccaaaaaugucucuagucacugccagauguuccuuggguggaaaaauugcuccuguugagaaccacuccuauaauguauauaagguauauauuuaaaaacccaguuauguggaagaacacuacuuuucuuuauguauucaccaacacuuggcaacaugaauguaaugucacaugcauuagaagugaaucucaguauugggccccagauagugagcuucacuuaguuccuguguacaagccagcacuggaaugaucuucaguuuaugccauuuugguauccauaauggcacauagacaacaguguccucauuuauaaguugugcuaucucaaucagacaguuugaauauuuucuggcugugguggggcaacaccuacucaaaugaggcaggaaugccauuugcgucugacaucauuuucuucgacugggauuugagcaguucacgaggcacccauugucccacccaugucaccccagcuauaugaaguguauaggaggcaguggcauccagguagccaacgaccucuuuccucuccuaguaucuuuucuacagagucucccccaacuucuggccuugagcaaaauagccccauugggaagaucacugagggaaacugcuguuuccacauauucuauaaucuuuuucugugaaaaggugagcuauauauauaauuauuuaaguuucuucacauuugcagguggcuauugugguuggucugcuuaacgaaauagggugugguguuauguaugugaacaaagcugggcaucaggcccuucaucagaaaugugaccccuuauuaaagcauuguuuuuuguuuuuacagaaagucagauggcuuuguguuguuugacgugguuccuuuuccaaauagaugacuguaaagaugaccugaugauccuauggacugggcuauaaacuuugugcaucucccuucuugugccuuaauggcaagguaagaugcuggagaaccaauucucauguccuugguuggcauuuuaaucgugguagcuuggucaucaggguaauggcaacacguuaaaauucacaugcauuaaaaaaauagcagugucauccaggcugcuuugcauuuguuauuuguuuauuuauuuauacauagauacacauccauguagcuacugcccaggucaagaauuaggacauuuccagcacaguagaagauucccuuuuccccaucuuagccaguaagcacuucccgaaagaauccauuagucugaccucaaucacucugacuuaguuuugucuauucuugaacuccacggaaauggaaucaaauaguauuuguucuuuggugacuagcuuuuuuagucuaacaguauagcugaaguacauucguacugggacauguaacaguaguuuguacuuuuugaugcugugugaguaguaggcucuguaugaauaauuuauucaaucuuucuacucauuauggugggcauuuggguucuuuccuaggugaggauaugaggaacaaagcugcccugaauaucccuguacaugucuucaguggaugauguauuuucuuuuggguaaauaccugggaguggaaugguuagcucaucuuuugauagauuuauucuuaguuauuuaaauguuuugaugcuguuguaaauagauuuucuuuuaaaaucuuaauuuucucccaagcgauguauuauguuuucauuugcaaacuaguauauuuuaauagaugccaugaaacaugcauuaaaauuaauauuugccucuuuuuaagagagccugauauacgacacuucuaauuuuuaaaaaacauauagaaaauuacgugauaacucuugauauaaauauugcauuugguuuuuaaaaaacaaugaacugucuuacauuauuuaaaaauaaaucuaggcugggcauagcggcuuauuccuauaaucuuagcacuuugggaggccgaggugggaggaucuccugagcccaggaguuugagaccagccuggacaacaugacaagaccucaucucuacaaaaauuuuaaaaauuggcugagcauggugguguguaccuguggucccagcuacuugggaggcugaggugggaggauugcuugagccugggagguugaggcugcagugagcccucuuugcaccauugcacuccugccugggugacagagugaaaccguguuucagaaaauaaaagguaaaaaauaaaucuaauuacaacaugcaaauauuuucaaaauauuucucauacaaagcuaauauauuaaaucaaucuaauuucaaaggcacguauuuaaaaaauauaaguauauaauacacauuuuuagauuaucugugauuuauuuuuguucauauguauaccacaacauuuuauauaggggucuuuuacaucauaaaucaaauccacuguuaugaagcaaaauuuuaaucuuuuguugcuauuuuuguuuuuguuuuuugagacggaguugcgcucagucgcccaggcuggagagcaguggcacaaucuugacucacugcagccgccgucuccuggguucaaaugauucuccugucucagacucccgaguaguagggauuacaggcaugugccaccacaccagcuaauuuuuguauuuuuaguaaagacaggguuucuucauguuggccaggcuggucuugaauuccugaccucaggugaucugccugccucggccuccuaaagugcugggauuacaggcaugagccacugcgccuggccucuguugcuauuuuugaagauuguguuuaguuuguauucauuuuagaaauauggcaaagcauucuuucuuauuuagaaaagggaaucuaaucugaaaggauuuuuuuuucuuuuagugccuaugaggaauuuccuaaauacuuuugcagguaguaaaacauuuaaagcugcuugaaugcacagcaguuugugaagcuuacaaacaccgucuuucuuuuuuuuuuuuuuuuuuuuuuugagacggagucucgcucugucgcccaggccggacugcggacugcaguggcgcaaucucggcucacugcaagcuccgcuucccggguucacgccauucugcugccucagccucccaaguagcugggacuacaggcgcccgccaccgcgcccggcuaauuuuuuguauuuuugguagagacgggguuucaccuuguuagccaggauggucucgaucuccugaccucaugauccacccgccucggccucccaaagugcaaacaccgucuuucuaagauagucaugaaacauaaccugggacagagugauuuguuaggccauaucuauugccuugacaacaaacuaaacauuucaaaauacuugagcaaaugccaccaacaagugauguguagggguuaagugguuaaagcagaagcaccaagaccauguuugugugauaaagguugcagaaacuguacccauuuuauaggagacuuuuauugcagguuuucugacucuaacauaagcuaaauacauuagcaaggagaacaucuacuauucuaaguuuauaaauuauuuuuaaugggaguaugcagggauuuguaucauaauuuaguccagaggguauaccucuaauucgcucccuucaagccaauuuaaugccacaugugaauggaaaauuguauuacaccuaucccaggugcugaaggucagagugauacaggaaaucuaaaauaccaaucuuugugcucaaggaguuuguuugaguuuuuuaaccuguguucucagauuguacauauucagagagguauuuuauuuuuugucucgauggaaauuucuacaaaucauauaaaugaagacuuauuauagcaucuacuguuauacuaaagaucauuuauuaaauauuuucugggaaugaauggacuacagaaaagaaauggauucuuuuggccagacaggaaagauuuucuauuuugguggacuaaaaaaauaaauaaauaauacaauauuauuuuugccuuagauuuugaagggguauaggugugaugguggaguaauuaagaauuuagagagcccauuucacucuuuucuguuuucuugaauucucauaguuuaauauuguccucuuugguugaaagcaacaucuacuuucagucuugauuuuaaaaugcugacacuuucacuguacauuuugugaagaauaauacgauuccccaaggugacuugauugucaaagucauuucuuccacccauguugguggaaauacccaacauuuuucaucuauaaccaagguuaucuuuaucuuuuugcagucagugccaugguaacagguagugauacaaaucugggaccccugagugcugugggucagagauuacaauaaaaauauaaauguugguugcagaagcaacguacauuuuagauguuuauggagggcuuuaaacugaucacagauaaaguggugacucauaguuuucauuuuuaauuaaucagcauucaaauugaagaggaaaauccauccagaacuuuuuguuggcuucaguggaucugaaucccaguacugugacucugagcugggauauguguacccaccuuaggccuguaacugaucugguucugccucagucuccccauguguaaaguggggauaaugcuaccuacaucaugcaguugggaggauuaaaagcccaguugauagaaaugugccuagcacaguuccuggcucuauaguagcugauguucuuauuauuuuuauagugaggaaaccauguuguauuaguggaagccaggcagaucgacuuuauugaauuccuucuauauguuuuugucagcugcacagucuuggccaaguaauuuaagucacuuaguccccuuggagucuugguuuggucacaugcaaaaugggguucauacuauuuaucauucagaguuguugugaggaaaacacaauauauuuaaagcgcauagcaugguuccuggcaccuaauaagcauucagcaagugauagcugcuacuauuauuaugauugugguuguuauugucauuuucaugauuagacuguguguccacaucucaguauuuuugcugcuauuuuuauagcccagcuacuaucaucucucuguagauuauugcaacagcccucuaacccuucccccucuguuucuauaaagacccaaauggucuggccuuugccaaccucccuggucucccacauugccuccccauagugcuuuagcaacaguggacuucauuuauuccugaaaaugcauuauacuccuucccugcacagggccuuugcauaugcugcuuuuucuucuuggaauagucugaccucuuucuaccucuccuuccacccuuucacucuccuacucauccccuuguuaauacacucauagguccugauacaucaccuucauuuugccuuguacuuaauuacuuaauuugcuuguccuuuuacauuuauuugugugaucauuugaugaauucugugucucauccuagacucugaugcccuagguucugauacagcagagagagcgucagacuuggauuaccaugguauguuucuuuaguuccccaacacacucauuuguugagggagugagugaauaaaugaaugaaugauuaugaugauaaucugaugauaauauaaaauaucugggcaacaauugaggagauagaggagguuuuaggaugugagguucauccuugggagaaugcauagugagaaggcagauuugcuaaugauuugggacaccagugaggaaaaauggugugucugugcaggaggacgaaugguuaaaugaagaaaugcagggagggaggaagaagcugagcaggaaauaguuguggaguguuggaaagaggaaauaacugggaagugaccugacagaaaauugggcauguauuuccuuugcuacaguuuuuauuucucugauuuaagcauugucacauuggcucuuuuuguuguuguuguuuuuaagucugauuuacaauauucuuuuuaccuguaggaugccacgucuaucuguuuacauggacaaaguuauacacccaaaacgggcaaagacacaguagcaguuuagccuuuguuuugucuuccuuuccuaggacaaaugcccccucccuuuaaaacaguuucuuucacacugucuuauuucuuuggucaaaaaucuacuguuuuuuguuuguuuguuuguuuuuguaguucucuacucugauguaaucuccuuaguaugcucuuaggguaaacuguuucucauuguuuaaaguuuccagcauugguuucucauuuuuguuguucgugucacugaagagagcagggggguuuucacaaagaaaccuauacugggaccacuaucaggugcugugugguuauaaggggugaggaacuaaauagacaucuauaaauuuaguguuuuucagucucuauguuuuucuuuuagcauaauuuuaaauugagauguaauucacauaaaugaaauuuaucauuuuaacauguacacuucaguaguuuuaaauauauucacuauguuguguagcugucaccauuaucuaauuccaaaacauuuccaucaccccaauaagaagcuucguaccuauuagcaguuagucccaacuccccugcuccuaucccauggcaaccauuaaucuacuuugucuucauggauuugccuacuggacauuucauauaaaugggauuauacauuauguggccuuucaugucuagcuucuuucacuuagcauauuuucaagauucagccuugaaaggaaugaccuuuuuauggucauuccuuuuuauggacaaguaauauuccaguguagggauauaccacauuuuguuuauucauuuuucagcugauggacauuugaauugcuuccacuuuugccugcuaugaacuuucuuguacaaguuuuugugugaacauauguuuucaguucucuugaguauuuaccuaagagcggaauggcugggucacaugauuaaacauaccauagaucaucacaugguauguuuaaucuuuuaaggagcugccaugcuguucuuacagcaggcaaaccacuuugcauucccaccagcaaugugucagggugccaguuuuuccacaucuuugccaacacuuguuauuuucaguuaaaaaaaaauuauagccauccuaguguugugaaguggucauugugucucuuuuauucuuuuguggugacucuucguggccuuaauuaguuccuccccccuuuucauuuaaaaaaaaauuggauauuguucuugucauuuuuauuagcucuaaauuuugaaugggcccucuguagcacaggggaaauauaaaauagaauuugaaauacuacuuuauaacugggaaacagcaugcuuagagaaagugacugaaccagaaaaaggcaguuauggccuacaaauuaggauuuauucuaccaaaggagaccucaaguaaauauucuuauguauaaauuauagaaaccucucauuauaggaauaaaagucagaaaaugaaauugggguaauaacaauuccucuuuaugguuuguuguuuuccuuguguaacuuuuuuuuuuuuuuuuaccuugaaaugcuauuccuuauaugcuguuaccgugaagguuguucauuuguacacuaaucuuggaagaucuuugaaauccuguagaaaaagcucggcugacguuagccaagcucauuuuguauuccauuguuucgaguggcuaaaauaucaggacuaaaggccuggaauuaagaagcuuaaauaauuauagauucccucuccucccauucauuagauguaauuuaguacugaaaaaaauaaaauuacucaacuuggauugaaguucagcggucuuaaauccuucuaaaauucugaauaugaauuuuucauuguaaacugugacaaugucaaaucaauaacaguauaguuuucuuauauccagggucaccaucaucaccuagaaaugcguaaugaauacuuuauuuguggucucugauuucuaggaacuuaacaguggaauauagaccgcauugaugccaagagauaucaaggguugugaagcauugcugcauauaccaggcagcaggaagucauuaauuauaagguuggaagaggcaacugugauauauuuuacaugaguacuuuaagggaccauuuuagauuccaugcaguaggaaggcauaccaaacugugauuauucuaagaaaagaaaauuaagaaaaauguuugaaggagacaaguauuuguugagggccuacugggugacaaacugcauuggaaaaugggcuauagaguaugguggagagcucagggccuuggagucagaugacuucaauuugaauuuuggcuaugacaacugcuauuugggugcuuaugggaguaagagaacugcaaucuauaugauuguagugaggauuggagggaaucaagugauuugucucuauucugugccuggcauguaauaggcccucaauaaacaugggucuuauuauuguuaguauugucauuauuauuauuuuuguaauuuaauuauuacaaccauuacuugaggaaagugguauuguacacauuuucauaugagaaaacaaggcuuaaguaaccaagagauuugccuagagcaguggcucucaccugaggaugauuuuagcucccagaagacauugggcaaugucuggagagcuguuuuugguggucccaacuggcagcgcaggguguuacuggcaucuccuggguauaggccaggggugcugccgaacauucuggaaugcauaggacagccucugcaacaaugauccagccccaaaugucaaucgugccaaggcugagaaagucuggccuagagucauggaccugccagaucaaggagcagaauucgaauucuuuucugauucgugcguuuagauguucucccugaagcuauuccauuccuucaugaaaauccagggagugaaauaaaguuaguuuuuggcaagucccuuuaacuuuucagauaauauucugauggcuugagacucaaauauggugucauggggugggugacaggccaaguacagggaaacugaggugaugugugagggaaccgccauccauucauuuuucaccauucauuuguguauugaaucauuauugaucauugacuucccaaacacuuagugagcaccuacugugugcuaguccacaguccauauucuuuuuuuuuuuuuuuuuuuuuuuuuuagaggauguuuggcucuuauugcccaggcuggagugcaauggugugaucucggcuuacugcaaucuccgccuccuagguuccagugauucuccugccucagccucccuaguagcugggauuacaggcaugugccaccaugccuagcuaauuuuguauuuuuaguagagacggaguuucuccccucagccucccuaguagcugggauuacaggcaugugccaccaugccuagcuaauuuuguauuuuuaguagggacgggguuucuccauguuggucaggcuggucucgaacucccgaccucaggcgaucugcccgccucagccucccaaagugcugggauuacaggggugagccaccgcucccagcccacaguccauauucuuaugcagcuucuguuuugccagccaaaccuuacugagaaaugaaagauaacauuucugacaugaaacauaagaaaugaaaaauaugcuucaguauacaaaaguccaguuuaugaagcuguguguuuggaggccucacacugauauuuguucauuuauucauugacuauucaaaauacauuuguacacugccgucuucuuggguauauacccccuaagaaacucuguugucugucuuuucauaaacccuauguuuaauggcaguuuuaucauuucauugcaaguaaaaauccuuucagaaacaggggcuguauuuuucugugucucugaggacuuuuggagguuaaugcuuggagaaggaacucuuccuuggacauuuccugagcccugugguuuacuuuuaauaauuauuuugguaugaaauaguuugcuggguuuugugguuagugucauaaaguaccuaauuucccuaaagaaaaauaaagccuugacauauuaaaaaaagguugaauugaauaaaaguaaaucuaauuuuuuaaaauaagugucuguuauuguagaaauuucuuuaaugacagaaaacaggcacaugugugugcacacacauauacaucucaaaacgauacaucuaaggccuugcuucucaacaguuuguaauuuccuccuaggaaaaaacaagaauugcugcugcuguuauuauucuuaugaacuccauugaucuaauaacucauguuuuuuuuuuuuuuuaaauuaaccacaaauuuuccuguagugaggaagagguaaacaguuuccuugauguugggaagucccuuuuuuagaaguguauagucaccgcaaauuagcuaggcuguuaauuuuuuuuucuucuuuucuguucuugucuaaauagaagaauccaugaagcaaauguauccugugcugggcuuauggaagaacuugcgguugaacaccacaaaacacaguuuccuuggucacuccuuuguagucugaaauguuugaacaguuuaauuguauaugaaaugucuaaauaguuuaauucuuugacucaugggacagccaacucugugaucuuucugaaguacuaaaaauacaugaacaguuguuacgacagacaauguaagauuuuguuucuugaucaaguuuuguuagauuucucuucucuucuucccucuccuuuguuccccucccaucucuucucucccauuucccuccccuuccucuccccuacccccuuuccccuuuacucccucucuucucuccucucccuucuccaccuuuuccucaacaguuaaucucuuugaacccuuugcacccuuucgggguugaggcucccucuuuuauucuggcguuucccucuuuuuccacauucuuuaacacuuaaccuuuucucucuauaauucuuccaugcccaacauuuacuacauuuuugugaauaaaucucuuaaaauauacacuugauauuaggauguuuauuuuuuuacuugaauuuuggaaaguuuauguacgaaagugcaguuaagaauugguaguuucaagaugugguuugcuuuugugauaugagagcaaguguuuuuauuugacucuaacauguaucauuucaauuucuuuuuguucugcuuucgagggucucugcagggucucagaguccuggaggggcagagaccaucuucagugagggagcucugagugaaggaagaucugggaguuggcugucuuguggaaggucagcgugaugacgucucuagacuuaaucaugcugaauccugucccuugaauuugaaaggcuauacaauaauuuuguccugcuuaucagagccauaaaaccacauuaagguauagauagagggcacagcucuuucacacauguguauugcuaaugguucugaaucuaguuuuuaaauaaagcuugucauuuucuggguguauuguggagacauguuauaggaaucauuugcugacucuucauguucauucuauuuaaacaaacaagaaccaagucuacaauaugacauaauuuugccuuguaacuuuuuuucugaucuugcaauuucccuuugucuucuuagcuaaccaauuuaaguuaggaagauaauugaucuauugccacguguuucuuaaccuccucuccauuuguaauccuuucuucucgguuggaaggaaacuagaauuuaaaaauaacuaauauuuugaugaccauuuauaauuuuaucuaaaauuuuaaugguaacuuugauguuuuaaagguauuccacaccucagaaucccccucuaauaauuuuuaaggauuucuuccuuggguggagcaaaaaagaaugaggccuucccugaccaucucauguuaugguaaaugacagcuaccugcugguuucuuggguuuuuuugcagugauuaagaacauuuguuaucauguauuuuaaucaucuguguauuugcuuauuuguuguuaucuuuuccgcuguauauuacaagggcaggaagaauguuaguuuuguucacaauccucuaauauuuaauaugugcaugguaugcaacagacacucgauaaauauuuggugagugaaaaaaugcaucuuucuuuuuuuaaaugacgaggucguucucugucaccuaggcuggagugcaguggcaugaucauagcuuacuguaaccuccaaccccuggccucaagcaauccuccugccucagccuaccaaauagcuaggacuacaggcauaugccaccaugucuggcuaauuuuuuaaauuuuuuuguggagacaagaucuuucuauguuuuccagacuggucucaaacuccuagccuuaggugauccuccugccuuguucuuccaaaguacugggauuauagguaugagccaccaugcauggccaaaaaugcauuuuuagaagaauggauauagagcuguuaugacuuaguccauuuaauauagacuaauuaugugaaaaucuacuuugcaaagcggauuugggguccacgguaucuguuagcagagccaauuuuuuuuuuuuuuugagacagaaucucacucugucgcccaggcuggagugcaauggcaugaucucggcucacugcaacuucugccucccggguucaagugauucuccugccucagccuccugaguagcugggauuacagguacccaccacuaugccuggcuaauuuuuguauuuuuuugguagagacaggguuuuaccauguuggccaggcuggucuugaacuccugaccucaagugaucaccugccuuggccucccaaagugcugggauuacaggugugagccacugcacccggcccauuuuacuaauuuuuaacugaagaguugguuuucaaaugaggaauucauuugauaaugagaaagguuuuuuuuaacuuugggggucaagagccaauguauaauuugaagauaaagguccuuuccccagaaaaauguaguuagaccauuacaaauuuuugcauauaaucauaagauuuauggaucuuuagagguggguccuugaacuccaguacuaagaacucaggcuaagaacucauauguaacaguuccacuuaauuuuuagguuggguuugcagcaauuuaugaggauaauaauucgugcugaagaugaaagacaaaagugucagaugcccggcgaggacagugcuauccacuaagggguuuaauucuugccuccauucucucugaggcuuuuaaaauaaauaacaggauucugauaaagauugagcuguuucacuugagacucugugggccuauggacuuguaaugaaaaccacaguuauuguuaguuuauuuccauguguaauuaaagacaggaaaaaaauacaagccaguaaaaugaguaaugcaaggaaauucugaugcacagcuuccuuuugaagaugguuuuacacauucauuccugucuaguucccuguugaagauucuuaucuuggcugcguagauuguucagaauuuucaccccauaggaaaacaacuaaacugguuugccucuucuuggcugggggagcccuccaagcagguauucuggcugagcuaggccauauucucucuuaaguuacaugauuucaccuaucauguugguugguggucuuauugccugacuucucuuuuauuuacaauuccugugguacauuauagcuuucuggagccagguuaagaaugagauagucugcccccaaccccaggaaugcuuggauguuauuuucuggucuuggcaaccuaaggaucucuuaacuucuuuaaucugauuaauggggaauucagaacuauaguuacaaaauaguuugccuaagcuauuacugcuuugauggaauuaaugaucaaauauuggcuaaugcccaaagcagauucgugaacugugcuuaauuuuacauuucccuucucaaaggcaauuguggaacaaagaccuuuuauguugguugaacccaauuaaugaauggaaauguaauuucauuucuucuacaacuaugguugaauuugaugagucuugcuugucuacaacaacaugcauacgaauaucacuuuguuuuuacuaagugaaguuauuaaggcaaaacacuuuuuguugaacuucuaugguggauaagccacuuugauaccuuuauuugggucaaaauguucuuuaaacagccuuugaggcauugaccucaucaaagcaguuaauuuuccaaugacccauuuuggaguaacauggacacaauggcagcuucucuagacuugaucuaaaguguagcauaguugguaacuaagcuucgugauugcaaaugccagagacuguuaagagcugguuguauauuugaugacucuguuuguuuagcaguuuguuagaagcuacuugguugaucuuggcuuuuugccugauguacauauguauauauauaaauauaauauguaaauaauauauagacuuaacaggucagccuguuuuauaaauaaaaaugggagcauugcucagaaaauggcaaaagaaugagacauaguauguauuuauauauacagauauaaaauauaaaaauauagauaguauaauauauaauauaaaaauauauaaauauauauauaaaauuagaguguucuguuacaagauuuguacucauuaauaagucaaucaauuuuaaugacuacuugauauaauuguaaaaguauuuacaggggauucaaugaugaacugaaaccagaauaaccguacaaguuuuaguucaguuauaugccuuugagagucaaggggggcacuuuuaaguacucuagggcagcagguauaaacuggaacuaucucaggaaaguugagaugaauggucacuguaauuaaagcauacauauucucugucauggggcuugcaggcaacgggggagacauagacaaauccaauaaucagauagugaauaccaauuuauagcuguaaaaaaaugauaaagugcauauaguaagaggaguugaucuggucauggguuagggaaggccucccuagggagguaaaguguuugcugagcucuggaagaagaguaggaguggaguaggggagaagggaguacggugugaccaaggaauugccagaagaccagggagacucacucauggacaucagagcagagccuggugagggaagaggcuaggaagcuggguaggguucacaccaugcaggaccuugaccucccugggaaggguuuagaucuuuacccuaacugccaugggaagccauuacagauuuuaguggaggaggugagggggagggauuuuuagaugggugaaucacaugaucagaugugcuuugggaaaagaucauuugggcuguaauguggagaagagauugaacagggauggguagggugaaguggggcuggggacaaaaguaaguuuggggagagugguucaguggcuuugcauuaauccaagugggagacuaugaugacuuuagaguaguaacagugggguggagcauauggauaaauuuaagagauauuuuggagcaaacucaacaggacucuuccaaacuuaagaguuuggaaacagacucuuauggugaaggaaggguauuuaaaauuauuuugugccuccuauaauaauauuacaguuuuguugugucuggucagccuguuuuauaaauaaaaauggaagcauugcucagaaaauaggauaaggaauggggugaaugugggggagaguacagaguuuuaaguuguuaggcaagaguugaacuguagcaugaucucaaccaguauugcugugucacugauuucuuacccugaucucugcucaauuagccuuuuggacagcagguccaagauaucauuuaggaugccagaacaauaaucuucuaaauaauacccuggugccuugaaggaguuaagguauggauucccagaugcuuuaucuauaaccagccugcaucuuagacuuugggcccaacugguagaucacauaauucuuuuauaaggcuguugcucauauuaaaguaugauguaauaaagguuaugaauuaaaaacaaaaaccuacagggucacaugaauguguauaaacaucaaugaacuaaguacauuuuuuuuuuuuuuuuuggcagaagacuugcuauugcguauaacauagcaucaggcugacaaugguauuuaaauguaaauguuagccaaguaaugagauguuguuguuugcuucuuuugugggcuuuggauucuugugucauucauucugccuuuauugaucuacauggcuuuuagcauuauggcauucuaaauuucugaagauaauaccaugaacauucuuccaaaaauauucucaguuaaacaagaagcggagacucucuuaugcgucucucuucuuuugcuucucucuugaaucuugacaaauuaugaaauuucaacucuaguuuauacuuagagauucuguuuucauuagcagucucuuuugcuugaguugaggugaggaaggauguuguuagaaauucucauuuucaccuacuggcucuuucuuuuucaguuuucuuguaugugcccuaagcugaguauucauuuuaagcacgcucaucuacccuugguccucuguccugagccucauacugacuggccagaaaaacuggauguuauuuuucaaaagcuuaguacagauuuugauaucuuguugcagcauuugauacuaagaaugacugaggccgguguucagggaugcugcaggugguuuugauuacugauugccaauucaugucuuuacaaagcguugugucauauuuuaucuuaaaugugguuaauuuuuuuuccauucauuucuuaaaucuuucacacugaauuggauagguuuuugaaguucaaacugcguuugcuguaagcuggguucuuggauugcuguccagugugagcuugggcaguccagggauuuauuugauggcggugugcucagcuuuugaaauuaaguaauagaaguaggauuuaaaauaacuuuuuuaacauacuaguuuugaucuuuuaucaaaagaucaguuuugauuaacucccugaaaagacauguaauuucaacauuaucugugugauagguggaacacauauauugcuuuaagucuacuagucuuagcuuaaaaauccuuaucagugacaaggaaauaauaaugccuaccuucagaggccacugugagggauaaaugaggccauucaugcaguuguucauuugacagauauuuacgaagcaucugcaguguacaugggacuggugcuuaacacuggaaaugacagagaacaaaaucaaaucuuuggccuucauggagcuuauauuuuaccuaauauuuguaaaaugcaugauagaugaucaauaaaucauagcucuaauugucacuaccuaaaauuuggauaaaacuuugagaucuaaaauauauuguuaaaugauuucaggucuucccuuauuuuaacuucaaauuaaauuagagauguugaagaaguucuguagauauauucugcacauuaauuuuaagguucuaaagcagugguucugaacucugacaacacauuagaaugacccuggaggcuuuucaaauacugaaauaccagcguugggaagcuucucucagagauucugaugguggucuaaggugggcacugguauuuguuuuaaaagcuccuaagguaauucuauugggcagcuaggguugagacucucugaaauacuuuacgaguauuuacauguuauggcuauuuauguaucaagguacauagcuugauaugagagaagggcuauggcauuugcuauggauuggacaaguuugaugauagguuuccgagcaaaauauauggcuucugagaacccaggugcauggacuguaggcaugacugccacagugcaucucuguccccuggaucaaucacuguaccacaaagcccucaguauucucauccauaaagucugguuaaaugcagugaggaugccugccaauacuagcaguuugcugcucuacaggguauugauuuaauaccccaguauaugaauuaucuguuucccagaaugguuuccagccugcugccucguucccuuccuuugccacagcuaaucaagccaguggugaacauucagucaaagccugccagaucuucagcuggcaaacacacagcuaacucauucuggagagacuuugaguaaugaugcaaaugucauuaucaucugggaagcauagaaugacaaggaagguaugggagagcuugauuaccaccuuggucuuugugugauuugaggaagacuguguacacagagagaauccuagaguaggugugugaggcaaggugcaugcacauuccacagggcugcaacucgauggcccaugagacagagagacggacaggagagcuuugucccuggccugguuccaguuccaguccucagggccccaccuguauuuaauucuguccuugggcaacugaaauuucuugcuguuuccuuaucauuccuccuuccuuguacuuccuucaguggguuucuguccuuaugcaaccccagaugcuuugaguagaacauuagauuaguagaaacuuuucaguaaccaguggggcaguacuaaaaauagaaaugggguaaggagaauaagcaaaagagugugauguuguggaaagaaugaagacaguaaguuauagucuuagcucugucccaaaauagcucaaugaccuuccccaaggugcuugacucucccagguuugucuaaaauggaaauggugcagucucauagggcugggguaaugaaaaaaaaauagauuauaguuguagaaaugccuugaaaagguaaaauggcacaccaguaaggagaucaucucguauccccucagacauuuagacaaugugagauuugaguuguuugcuuucagagacagagcuaggagagaagagaaacugagucauaauaaaauaugccugaggggcaaaguuuuuaaguguucauugaauucuaaauggaauacuucuuuacuucugucaacuuuuaauuuucacagcuuuauuauucucccaauggcuauuauuucuuucucagaauuucugauuauuugcugccucaguugucucaguuuuucaaauauauauuuuuagauagaguucaauuuuuucaugagguucugcucacaaugcgggugacauaguucuuuguguuaugaauucgugauaaaguuacugauuuucuuucuuugcauucagcaaagaacaagaauuagggcaugcauguaaacgauuugguugguuggccuucuuguccucacuuggcauauccuaaaaucauuuuauugucuccuacauaguggauugggcaaugggaaagguuuacaauuggaaaggaaaguugguguaggucuuuccagcaguaaaaucuauuaaagauccuuuuacuuuugccucucacauaaaacgaauguguaaguggcucugagaaagguaaugauauuaaugcccaaauguacacuuaaauguacuauuauaaguguacuuacuaugagccacuuacaauguacuauuccaauuauacaauuggaauagaaagggugucaagcauucaggacugaggaaaauuggccuggcagugaacaggcuuacuuuuggacacugacauuaaaccugacucagaagauuuucucauuccuuaauguuacucuucaagauaacuuuucauugacacaguuagguagcuaagggaagauaaaguaaaaucaaagaaagauuggaucugucaguagguugaaugugcacaaaagcuuuccgcucuuuugcuuccauuaugcauuuacaccaaguggaauaagucucccucugggaagcgcuguugcaauucucaguaccuuugggcauuaauaucauucccuuucucagagucacuuacaaauucagcuuaugugauaggcaaaaguuuaaggauuuuugguagaguuuacugcuggaaagaccuaggccaacuuuccuugcauuccaaacuguuucauauugcuuuaguggaaaaggaagaucacugcuacuuguagaucugacauuggaacacaagucucuugaaucauuagcuuuucuggaguuacgcagcuuuuguauauuugagauuucuuuaaaagguguaaaguucauuuucagugaaguaugaauggaguauacaauaccguucuuuuuaacaacugacaaauugauuagcauuuauugaauuaaaucuaguugaaagucaguaauuuuuaaagagugccuuuuaaaaaauugguguuaugaacaaaaagugagaauacuuaaggaucuuagauaaaauugugaaauggacuuaacuaggcaaugaaagauugcgaauccauuacuuucuggagaccccuuaaaaucuaugggaacuuaauggagggccacuagguguuuagaugucccuggaagauauuagaugccuaucaacaauaugguucaucauuguuucauaugcccuucaguccaugagguaaauggugguauggcuggcucaugggaacuagggaaaacauuauaugcuauuggucaggucacugugucacugggcagcuucuugauuuccuuuucgaccuauuuccuguuuauaaaaaaaaaaaagugcaacucucugccacugcgguauucucaggucaaauaggaaacagguuaaauaaucaauucuccauauacuuuuggccaucuucccaaauguaaugaguucacagugucugaugacccaaccuugugguauaguuuauaaggaacaacuuaaguauugacucauucauucauucauuuaauaagucuucucccauucuauauauuuuuguuauuuugaucucauucugucaccuaggacggcgugcagugguguaaucauggcucacugcugccuuaauuucccaggcucaagcgauccuccugccucauccucucaaguagcucgaacuacagaugcccaccauuaugccuggcuaauuuuuuaauguuuuguagaaacggagucucccuguguugcccaggcuggucucaaacuccugggcucaagcaauccuccuaccucggccucccaaauuguugggaugaaccagugugcccggccccauucuaucuuuuuuaacuugccagcuuuacugccauuugugugugugugugucuguguguguagucugaaauuuugguaucuuuguauaccaaagaggcaugccaguuauuaaucuacugcggcauguaaaaagaaggugcaagcuuccagguguccccucccaguggagucacauggagauuugcuugauucucccggcaacaaaggcuaaguauuaccagccaggaaagcucacuggcacuuugauguucagggauuuuacuggagaucauauagugucuguguaacugaccucaacuacuuaagacuucggcucuucuuuucucccugggcaaaaacagguguuugcccuaaaucgcacuguaaggauaaacuuuucugguaaacugguacaggauggcucggggccucagguuuauaaaaacagaugcuaaccauaaauacaguggggcccagggccucaggcauacaaaaacaaauguuuaccauaaauacaauaugacccaagaccucagacauacaaaaacacugaacgaagcagaauauuccaaggguucagagguuaucuccuaggaguuaacaagguccaguccugaagauaggccuuucuuugguaugugcagaguucuagcaacccaggccuaccaaguuaaccguuuccugcucacauugucuaguaauaagguugacucuggacaacacaggucugaacugcuuggguccaccuguacgugauguuucuucugcuucugccacuucggagucugcaagaccaaacucccucuuccuucucccccucagccuacucaacaugaagaugaugaggaugaagaccuuuuugaugauccacuuucacuuaaugauuaguaaauaucuuuucuuucuugugauuuucuuaauaacauuuucuuuucuccggcuuacuuuauuguaagaauacagugcacaauaaauguaauauacaaaauauguguuaauugacuauuuauauuauugguaagccuucugaucaacagaaggcuauuccccguugaguaaguuuuggagagagucaaaaguuauauguggauuuuugacugugugugugggguaggggaguuggcaucccuaaccccuacauuguucaagggucaacuguauuuuauugaaugcuagucauugugaauguuaugcugugugucucuggauuuuaucauuuuguaaggaguguugaauuuuguucuggaaaguggaucauuuccuugggaucagcuugauucuuucaagggcugucuuuaaauuuucugagaguggaucuaaagucgucuuauuguaggcuuaguuuagcccuauacccaaguguggucuuucugggaucucuacagaacacuccugguguuuaaagaagucucuccacuucugcagguuggaacuugaauguuucccagcccuugaugagcucugaaaguuguucaguuuauaacuuuauuacagaugcucucuuccugguagucauucuuucucuaguaguugcuguuugcccaggacagugacaucucacccucugcauauacacauuacuauucagccaaagacucagggacacaccuagaaagacuucuaggucucuuccuuuguuguacuguggccugcauauuccagccaucucauucuccccaaauguaaaccguuucuuuccaugucauugagacuccucugugcugcucagguuccuucucucugcugcaccaucuggaaaguauuucuagacagaaagcauaggugaucacacugcucaucucauuuguuuuucuuccuuugggaaccacagucgugaacuguuguuuaauaacugaaaacucuuguuucauauauuuuugucugauuuucuaguugauuguagugggagaaauaaucugguaccagcugcuuuucauggcugaaguguaauuuacucuaacaauuuuuauguaagaccagggguuugagaaucagacauguggacuucggauuugguucccagcauuugcuaaguuuugaucuuuggcaauuaguuaacaucucucugacuuagcugcuuuauuguaaaaugggcaugguaguaccuaauucauagggguuuaugagcauuauuugugauagugcaaguaaaaugcuuaguauaguuccuuacacauauuaaggcucauucauugaugaugaugaugauguugauaaugguggugguggucgugguauucagcugucuguauuuucacuauaagugaggauguuacauagaaaaaaaugcuuuuguuauguuacaaagugaaagugcugcaagucuuguggcaguuaauugucacaaaugugauaggaucaaggagagcuuagacacucuuccuuuucacugcuugcagaacagucacagaaguuacagaaaaauucauugaugacuucugggugugguagccagaagaguugaugcuuuuucugaaaauacucauauaaguuuagggauacaaagcuccugaagacuguauuuaaaaugccuuuaaaagugaaccugauuauaucuuuaauguuuugcuuuuuaagcuguguggugcaaacauagguguguuuauuauuauuuuuuauucuauuugauauuuugauauaccugaaaugguucauaauuuuccaaaccugucucacccccucaaaagcaggccuuuuuccagagucagucugugcuauaagucuaaucuguuaacauuugaguggaucaaaucuuaaaaccaugagauagcuucucauuaguacuaguguacguauuugagaaauuguugaauuaaacaugcaaguugcaguaugauguguacaaugguacuacucagguaaaauuuuaaaauauguagaacauuacuguauacucuggauggauguguguguggugugugugugugugcaugaaaaacuugguuuggaaagaaacaugaaguuuaggaaaacaauuauuuucugagaaaagagaugggagggagagcaggcaagaauucaaaauagucuuaaauugaauccaucauauauuauuucugaaaaaaaaugaaucaaauauuccagauaacauuuuagaaucugaauggugcauguauggguauguuauauucuucuuuguauuuuucuauauguuugauacuugucuuaaaaauaaauguaauaacaauaauguacaaguugguaauggaauuaaaacuuuuggcucuaggggcuugguucauguuugaucaauaucaagccuuuugggguuaucuucaggaaugugauuguaauauccugcauugugucuuacucugggacaaccucagaauguaaaguuauacuuaggaguccagaacaccuuccuuuuguaaacacauaugcauuagauauuguuaggauaaaacuucgcugaugguuuuaucagcgauaaacuucauacuuagguaugaaguaugaauauuuaaugcaguaugaaguuugaauauuguaaugcagggacuuuuuccugggccagucuauacucuuaagucuaaucuguuccccuuugaguggaucaacucuuaaaacccuuaaauagcuucucaucaguaggacaaaguucaugcaacuuaaggggaccuaggaagccugcuuccccuuuuccccuguugcuccucccaccauccuuuuuucuuucuuucuguuauccaacuauacuagacuuuuuauccuucuucuguuuccucuuagguguccuguucauucucuugaggaggcauugauuuccccuuuccucuuuaacuccgucccuaucccucaguuuuucuaguggaccgcucuacaucagucaaaucuuagcuucaguaucccaguguaaccacguaaguuccacuacuguaugcuuucuacaauuuuccaauauuaaugcucauauccucacuguuauuacucacaugcccaccuuuccagucuucaauuuaagcccuauuaggaagaaaccauguuuaucuccauuucucuagcaccuauguagcauuuauaauauaagcacuaaauaaauauuuguugaaugaaaacaugaauuaaguacaguuugggcuucugaugaauauauacucacuagauacuuaaaauuuuuaauggaaaauacuggauuuaaagaaaacuuuuaugaauauuuuaaugaacauuuucauaaaauauugagaggauuuauggucaaagauauauuuuuaaauuggagaaguaaaguguuuacucacaaggaaagcaaugcuagagucccaugggcauuaacagguuaauuuucuucuuuaaauaaauuaauuaaaauuuuuauuacuaauacacguguauggaaacaaucaaagaggacugaaguguuuaaaaugaaaagcaguaaucauaugcuucaguguuccucaguucuaucugauuaauaaguuaaaacuuuaauaagauucaccuucaagaagaaaaaugugcaugaacaaaaacaacuauaguuguugaguugaagguagaaugggaauaaagccucacacuaaaggggcuuuuuaagucaugauuuguuuuuaaaaaugccaucugaagggcacagugauuccuccaguguuagcuuguguuuucuauaaccuucuuccucaaaggcccauccuaaaaaagauucagcuuugcuuuuuugccccucuuuccaaagacaggaucucaaaaaaugguaacuaauuuaagcccugcuaaauguccagaugcagcaccugggaaaaaugaaguucagaaguucagaauuuggaagcgcuuaagcuagaagaaucuucuugcugugguugcaugucugguucuggaagcuaguaacuucuuucaggcaggcauuguuccauuagaacagauggcccgaaguguggcugugccagagagcagagaccaagugugaacuuguccaggaaguugaaacacuucucagaauaucuucuucuccugguaauagccgugccauugcaacuagaacuuucuggguuggaagagugaacucaacaaaacaaaacaaaacaaaacaaacaaacaaacaaaaacuacaaaaaaaccaugagacugggugccauggcucaugccuguaaccuguaaucccagcacuuugggaggcugaggcagguggaucacuugaggucaggaguuccagaccagccuggccaacauggugaaaccucgucucuacuaaaaaaaaguacaaaaaaagcugggagugauggugcaugccuguauucccagcuaccugggaggcuaaggcaggggaaucgcuugaacccgggagguggagguugcaguuagccaaaguugcaccauugcacuccagccugggugacaagugagacucugucucaaaaaacaaacaaacaaacaaaaacauaaaagcuagaguuagagcauugauguccaaugugguagcuauugaacccuugaaauguggcuagcccaaauugagacguacuguaugugugaaaugcacaccagaccucauagauuucauaugaaaaaggaaaguaaaauaucuuguuaacaauuuuuaauauagauucguuuugaauuauguuuuggguaaauaagguaguaaaauugacuucacgugcuucauuuuguuuuucuuuuuaauguggcuacuagaaaauugaaauauacauguguggcucauuuuguauuucuauuagacggugcugcuuuugagagaaacuuuaccagggauguucauggaacucuguccaaguuacacuuugaugugacucuuuacucuggaguagaucagauauggaauccaaaccuuggaauuucuaaguuagcuucuuaguaacuuacaguuuaaauguagcaaugaaaacaagaguaggauuuuuuuuuuucaguuguaaaagaaauuucuagaaacuaagagcuuuacagagcuuaaaauuuauucucauuguuuuauuuuuaaacucuaaguuucugccaggacaaaaauguucaguucuuuuuggauucugauggccugguaaaacuucuuuguaaaccuaggggaugugauagaauuggcacaggagaaaauuaauuugguugggauccaugaauggaauggaggugaugugcaggccuugcagucuguuguaaucaaucauuauagaaguuuugcugcgaugcuggccugcccaacacucugcacuuugggcaacaucgugaaaagauaucuuccuguagaucccugcucuggugcaauacaagugucaacauagaaauagaauguguguuauuauaggccacauauauacacauucaauaaaaugucucagcauuuacucguguguguguguguguguaugugucuguguguguguucuggaaaaaaguuaaaugagauuuuccacaacuuuuuaaaaaaauuucagccucguuguaggauauuuuccaaacccacauuuuccagcaauuugagccccaaacuuauagcaaugaggcacuuucuugacaaaggugagucaaaaacaggaacccuuugauucuguuugucacaugaugcuggauguuauaaaauaauaauagcaaggaguucauuucuuucccuuugaucgucagacuuuuagcugcuucacuuccauugcuaaagccaggaauucagaaguguaggucagaugcugugcguagaaaaugcauuugggagcauacacauuaaauggguuauaaauaguaucugcccugacaaugcuggaauuuucucagcuuuuagagacauugaagucuuuguuuuguggguugcugcccuccacccccaacccccuaagcuugagucauaaagccugaaaaacuaaugagguugcugaaacuuaaaaucuaauugguaggauguauggaaaacaaugagagauggcagaaaccguacacuucgauucaaguuggcuucucuguugcagcauugcaacuugcucacuuugcauuuuauuguuccagguccuugaauuaauuuuuuccuucaauaggaucaaauuagaccuagauuuaaaaaaaacucauaaguagauaaccaucaaggcuaauauuaggauccuaaagucuucauuuagaaaaggaaaaaaaaaaacuaaaaaaaaaaaaaaaagcaaaaguucaaacgggauuuucuuuuuaauuuuaaaauuuuauuuuauuaugcuuuuugagacugagucucacuuacucuguugcccagacuggagugcagcgacgugaucucggcucacugcaaccucugucucagggguucuugugccucagccucccgaguagcugggauuacaggcacaugccacuaugccuggcuaauuucuguauuuuuaguagagaugggguuucgccauguuggccaggcuggucuagaacgccugggcucaaguguuccacccgccuuggccucucaaaguggugggauuacaggcaugagccaccaugcccagcccaaacuggauuuucuugauagucucucucucucagaaauauuuugcucuuaucuucugaguuuauagaugauauuuuacaacaaaggucuacaaacuauaaaccacaccuggccugucagcaucuucauggaugccccuacaauuaagaaugauuuucacauugaauguuuuuccccccagccguuuaauguugaaaaaacaaacagagaaagaacaugugguagacaucauaccuggcccaccaacccugcaauauuugcuaucuggcccuuuaccuacaaagcuugcuggccccugguuuagaaugugcuugcugugucacccuugcuauuagauauguaaucagauaaaaaguuucuuucuuggauuuuguuaauucacccauugaauauuucuggaguauuuauuccauuccuggcacugucauaggcacuggggaaaugaaguguaaaaagucacaccaaaacacagacuaaagggcauauuucaaaagugacagagcuugcauuccugucgagagaaaaagaccaaaccuaaccaacccgaacagaaacaagaaaugaaaaacuuaauuaccaggaaaauaaaccagcugaguaugagauagauaauaacagcaauuucugugcuuccccccuugaacugcacuauggaauggugacuaaguuauuucccacauuuugaauucacccacccacauacaaacaccaaauacuugcuugcuuuccccaagucauuuccucauuuuuaauuuuauuuuuuuccuaaagucuuuuugccccagcugaaauucauuacucaaccccgucuuauugaguacuuuaguuugguguuuccaagguuuauuuauuugguguuuguuuuuuuuuuuuucuugaaagagucucacucugucacccagggugaguacaguggugcaaucucggcucacugcaagcaauuuuccugcuucagccuucugaguagcugggauuacaggugcaugccaccacgccuggcuaauuuugguauuuuuaguaaagaugggguuuugccauguuggccaggcuggucucgaacuccugaccucaggugaucugcccaccucugccucccaaagugcugggauuauggacaugaaccgcugcacucggccucauccuuuuuuuaaauuagcuuuucugugucuuuagacuuaaggcuuguugcuuguaugcagcauauaguuggauuuugauccuuacucuuugucuuagcagcucaggcugcuaucaugaaauaccauagacugguagcuuacacaacauauuuauuuuucacgguucugaaggcuaggaaguucagaucaaggugcuggcagauuugauuccugauaagaaggucucuuucugucuggcagauggcugcuuucucacuguauccccagagagccaaagaagcucucuggugucucuucuaauaagggcacuaaugccauccugggggccccauucucaugaccucaucuaaacucaauuaccucccaaaggccccaccaccgaauaucaucauauuaagauuagggcuucaacauaugaagacaacagucuuuuaugcuuuuucccccuuuuuugguaaauauguauuauggauuauaguuauuuuauuuauuuuaguaucagaaucuuuccucagaucugacauucucuaaaacuuuugugaucugcaccaaaguaaguuacagacaaauguuugcuuguuuccuuuauuuuggaucuuuucuguaagaauucuuugugauacuaccagauuaguaauccugcucuccuaagcauacugagugguagccuaugauuucuuuugugguucaaaauaugcccuguagccuguguuuugguuagcagaauggccagagcuuagacuaaaggccacgacucacacauuccaaauacauauaggcuugaaguuauccuauuauaaaacaguuaccacauucauguaaauggccaggcaaaggucaaaauaugagcaacauuauuuguagcucagugagagauuugauguucaaagucugucagcauuugucagaagacugauauugucaauggcuguuucagauuaagaccaacuaaaaagugauuuggugugaacucagaauauagggaaaauaagacaauuugaauguaccccaggaaacaagagcccugcacuugacuccaaaaggaguucuauuauucuggcuguuuccagacuuuauuguaucuugagaagagaacuguuuucccucuaaaucaguuucaucaucuguauccaggguaguacucacaagaacaugucaauaucaauagcaugcauaugggguguuggauucuuagaacuuauugcaauugcuuccucuagguucuaugaugauuaucaauuuauugccucucagguccaaauucacccuuuauugucugcucugugaaaauggaccugaacucuuuaaaugguaugauguuaagguuuggcaggagagggugcuggagagaagucacaggaagaagggguuuuccuucuuaaaucuggcgugcauucucacguggcuucugcagcauccauggcuucuccaggaccuggcucuugcagcaccggagacaucuccagggcuuguuucccacagcacuuguggcuucucuagcaccauguuccuccagggcucuggcuucacuagugccuggccccugcagugcauaguggccacagccgcaccugguagccagcagcuuccuuuggcaccucuccuugggcuguuuuguagcagggugccucuggugggacaccucccugugaacagcuucccugaaacccuagaggauggauuccaguaagcuccaccacugaagcaccacagcaacuucccugccuccagauuucuggcucuuagcccuggggauaaaggcucucccuugggcccuguaucucugucuuagaguuaauggccauuccuugucucugccauuccuauauucuuuaaaguucuuucagguucucuuuacuucuugcuagcuaagucuuguuauaguuaguaauuucuucuauuaaaguuucuauuuucagacaguaguuugaaaagagaaaguuuaauagaugaaaugacaaaccaucucuccuaauuggacccaggguuaauauagggucccaucaauaguauuaugggguucugugcuuguguugcaaaaaacaagugguugaaagagaaucuaauggauuuguucaaaggagcgugaaaucagaauguaugugcuauuauauauuucccugcacucuucugguugaauaaaccaauuuuaggaaaaucuggaaguuugccauuaucuguaauggaggaagagaauagugguucugaugauacuagagugaaaaaaauucauugucugacaaauugaccauucugcuuugugugggaacuucagguucagguucucacaacaaggcugcugaggggaccuaguggaugaguucaguuucuggggauugucugcaaagugauaauaucuacauugauaauccuaaauugauuaagagugcaugucaagcguuguuuccuuccacccucauaucuugugauagggccauagcaguuguucuuuucuuccccuuuucugugugaauccugcagcaguaugauaugggccagccuaugaugcggaaguaaaagaaaaaccagaauaaggugccuugaggauuaucuggucugaucccuuuauuuuugagauggggaaacugaccaagagugagguuaaguguguugcucucaagaguguccaccuaguuagaaaacacaaaaauauagcaaaacagaucugauuccuagcugguuguuucccuccaaacuuuacuuuuuaaucucuaaugauuuauuucuuuauauuuauauauuaagauuuacaaaacuuggaaaaauaugauauauacuuuaaaauuaaaugauauuuuaguccacauuaaaagaauagaucaguaaaugucuugugcaggugcaucuuuuuaaaauuuuacacuacauauauugaaguggaauacauagagaggagaauguacauauuauaaguguacaccaugaugauuuauugacaaacuggacucucguuaaccagcccucagguaaacuaauugaacauuaccugcacccuagaugcuuccuuccugugccuuuuauucacuaccccucccaagguuaaccaguaucuuaacuaccaacugcauagauuaauuuugccugucuuguccuuuauagaaauggaacaagccauauggucauauaguagguacuuacuugggccuggcaucuuuuguucaugauuauguuugggaaauugauucuuccucauugcuguaaguaguuauauaguucauucauuuucauuuccauauaguauuucauuaucuaauccuacuaggauuuaguuauccauucuacuguugauggauauuuggagccuuuucuaauuuggggcauuuacagugaggcuaugaacauucauuauaauuacuuuuaaaaacuuuuggacauuggaagacagcaaaaugugagguugaagacacaagcuuggaguuagacaacucauuaacuguucagucuuggucuaguucuuuauguucaugagccugucuccucauuggcaaugggcuuacuaauaccaguugugcaggguuugggaaauaauggaauaaaaugauggauacugugcacagugcuugacacauaaguacucaaauaauggaagcugccauuacuuuuuaaauuaaaguuuuauacauuauagcaaaguaucagccaagcuuauuuuacuauuuguaucugguugcuuguacacaguguuuuucauuuucucagggccugcacaugcuuuaucuuuggaguaauguuugauucuuuaucuuuccuuucccuuccucucugccacaauuauuaccugccuguuguauucuagguacuggggacaggaacugaauaaaugagcagacauuauucauuccugaguuuucuucucaguuuuugcuguuguauuagccuacauccuccucuucucaugccauccucugaaugcuaacauugcucuuugacagccucucaccaguguaacccauccuaucugagggggacaggaucaucuuucuccaguaccaccacugccaguugaguucuuuagugaggacuugagaaaauucagcuuuacccucaagucuucaacagacacuguggugcaggcuuuucuccuaaagauguggaugugcagugagacaaagccacuguaucagucagcagaggcuaaguuuugcugcauuaacaaaggacuccaaaauuuuaugacuuacaaaacucacagauugacaguagcucugaucuuuguccaauuccuucugaaacaaaggcuuaaugagcacuauccauuugggacauauuugucuugaauaggagaaaaaaggaaacggaggaaccacagaguggcucuuagaacuucugcugggaaguggcauaugucacuuguacucacauuuguuugccuacaacacgucaagccugauaucaauggggagggaaauauaaaccucccagagagagcaaucgguaggaagggacuuggcacagagucccuuggcucagucauguuuuaaacauguuuuaaacacuuccauugaaucaguggacaugacuuuuggaauauaauucccaauuuauuuucccuuuuuuuuuugaccuucacaucacuuuacugucaaaucagcaaacuggcaaugcacaagauauacagaagaccaaggcuccaaauuaguggcccaggcacccugaugacuuccuguuucucagaaaaguaagcuugggcagcagugaccuccacagccuaugauaaaugaggaaucaacaguugcauuccauaauucaauaaauaguucuuccuucugccaggugaugugauggaagcucugugcagcuucaaaguaagaguugacuucugcgucuauacaauucuugucauaaaugugaucaaguauaucuuuaccuuucuauacaguuggcccaagguaugauuacuggcaugggugccagcuaauaaguaaaucagucaguauugacaccauguuuagccucaagcaugcuuuucucuggaaugcacauuuggaugaacuuugaggaaaauuauuaacucaccccaacuuaaggagcuuugaccgaccagagauuucaggauuauguguacauaguuucaaacguuguauuuuaagaugaagaauaauuuaagaagauuagugagcauccuucauuaaucuggagcuauuuuaguaauaauaaaaaagggcaacuuguuuucaucuuagaagaguaauaggucaguuuuauuuauaggugauaucuaaucaauuuuuuauuuagcuuguauaggaugauucucaaguagauaauguuaacucaccuagaauaaaggaaaccacuuguuaccuaaguauacgacauuuuaauagcuuuuaaaaaauucaccauacuaguuuacacaauaaaauguuucuauaagucuguguauauguauauauaaauauagaagguaaauauacagauuauauuauauaaauagauaaauauaaaaucaccaugguauuuugauauauaaaaugagucucauuauaaugauuccacuaaauguacaaccuguuauaaaaugagugauaaucugacccucauuucuguguuuuaaucuugggaugauuugaaguaaggcauaaucauguaugaacauauuccuggagucugacaugagcaucaugaacuugcuaauuuuauuccuugaugguuuauauaagugucugacaaauuuaauaggaagcagagcuuuauuuuuuuucauuaucagcuagagaacaaaaacauuggcaucugaauugaauacuggaauaucgugugaguguguguguguguguguguguguuuuacuaagauucaugccacucaaagugugacccauggacuggacugcuucaugaacuguguggugcuguccuacaauaugcuaagaauagaaauagaguguucugaaauuuuagagcaaucggaaagaguagcuuuaggucuguuggaccuaauaauacaaauuugggcuugcauauuuguguuuguuuuguuuuucaucucauuugucuaagaauucacuuuuauauagucuauaaaaguaucagccugugauggauuuggaguuaaaaagacaaacaaacuaaugccacagacgguuuagaagcauugaugaggaaccugcaucaugaugacagaaagugauauaacuucuguuauucuauaggcgugaauuuugacauggaguacuguggcuuguauugcauugagauuuuaaaauucauguccccuaaccuuuaagccauauccccuuaacuuuccacuacaaauauucuauuuaacugugacuuuugauccacuuuuuucuagauugauucagaaaaaguaauucuuuggauuuauucauuuguucagccaucguuuauugaggaacuacuuugugccugacacuauuccaaacacauaaaauucagcaguaaaaaaacaguucuugauuuauuuuagcuaauaugaaaagaacucaaauauacaaauauauuuguguauauacaaagguguggaugcacacacacacacacacacacacaccaacugucaggugauagauuguuuccaccugucauuugguuccacuuggacuacuaaugcauacauucuuucucccuauggauguuaacaucacuauuggugugguuuugagcugauggaaguaagucccagguaacaaauguaggugaccucccuuagggccagugaugccugaggauggcauucccaguuuggugaugacaguggguugagaggagccucagacaguggaggaaccuuagaauucacugccacguaucacuguuuccucuagggauaucauuaaagagagaguuccaucuguguguuucuuugguucagcaggagggaccgugaugugaucuucugggcgauguuucagcucugcgaaucuaggauggaucaggaagguguuaagccucugaaauuagggcaguguuuugugcagaugcucuuuucuggggugagguucccuugcuuucaucagguucuaucggugguucaugacccucaaagucaaagaaucacugguguacaguggccacaagagccuucugcaguuuggccccuguuacucaaucuggcuuuccccuuugugcuucccugcugcauuugggcuggccuccucacucuugcccagugugcugcacaggagcucaccuggguguguacuuccuggaaagcucggccugcuaccacgcacagagcucauugccucaccuccuucaagacuuugcucagaugucauccucugggccuacccugacuaccauguuuaaaauugcauuccucuccuggcccccaaauccuggcccuuugguugcuucuuguucuggcuuauuguuaacccuggcacuugcuaccuuuaacauuuucugugcuuaguuauuugguuuaucagguuuaucauuagaauuucccuccccaucccgaugcuucaucaaaguggggauguuugucucugcucacugcuguaucccccacacuuugaaccugucugguguauaaugggugcucaguaaaugaaaaggggguucaauaaaugaaugaacagauaugauaucugucucucccuuucagugugcccaacauggagcuuaaauuuggcugguugcuccauguauacugcaucccaucgguuaugguuucaugaaucucaugucuuacguugccauaaauuagcuuuuaauguaucccuguauuuucuuuucagauuacaaauauucccauuauccauuuucaucuuuuucuuauugauuuuugcugucuguuucaucuugcuuuacccuagacccucaaaguguuuguggauaagaccuuaggcaaguuagcugacuucucuaccccucaguuuccucaucuuguaaaauagggauaacgauacacaaccuugcaggguugcucugaggcugaaaugagaugaugugugucaagcaguuagcauaguaccauacuuaaauauugguugcaauaaugcuguugaagauguaaguaucuuaaggcucaguguaaugucuggcacaugaugggcacggaguaaauggcagccguuaacaauuaugcuucccccccauuauuaucaucacuaaugauauggucuggacaaucgacauggaguagggcacuagcagaaaauccucgacaggguuaaggguugacguucuuguccucuuuuucuguuccuuuuucuuuccucuuccaugguggggauaaacuuuuucuccccuugccaugcaaaggaagaccuuccguucuuugcugugugcugugauguugguugucacuaucauaguaauaccauaucuuuugcaauuuuuuuguuugacuagauagcaguagguaacuaaucuggguccucaagacauauuucuauauauggauuucacaacaaucuugauuuccggcaagaguuucauuuuuguggagggcauuucaaggagcugccuuguaaauuucugaaugcuuggguuguuugcuuuguuucuuuuaccccucagugccagguaaguaaaauuccccagauuugaaucuuacaguuaaucaaucagcaaauacuuauuaaguauauacaugggagauuauuugaagagcagaaugacacagugaaaggugagcuuuagaaagauuaaucuggggguugugugccuaauugguggaaggcucuggugagcagagaagggagaguuuguugugggaguccacaagaaccagugguggaacggugcccgagggagugggagcuggggugguacacaggguguacgcaugcucagcuucccuagguauagccagccagucucccggagccggugccccaauuuacacuuccauccacaaugcucagaauuuuggcugcucucuggucuuuccaacauuugguuacuacugcuacauaacaaaucauggucaaacuuagugagugaauacaauacaugucauuuuguucacucucaugguuucugugggucaggcauucuggagugcugggcugggcaguucugucucagcaucucuuaggagguuguagacagaugauggcugccagaccaucagaaggaggaggccauugguggucaauuuauacccccacuuaacaucuuucucuaucucaagggaaaggacugggugaggccaaagaggccucuuucugaggauacgaagugaaggaggcauuuuuucucaggguuaugcagguucuggcccugccaaagaaaguagaugccaaacaucuacuauguguuagaccuugggcaagaucuucuacauuuauuugaggugacuuacucccuuuaaugugauguuuuuuucaggguuaacuuucuagauaggccuuuccuuaccauccuaucuucaugcuuucccuuuguauuuucaucuuauugcccaguggaucaccuucguagcuugcuguuuuccuaugacauuguacgcaauuguuuccccguuuacacuguauauuguuguuugccuagucacacugugugugguuguuugucuaguuacaguguauguguuuuuuuugccucguuacaccauauauaguuguuuuccuauuuauacugaaugugguuauuucccuauuuacacuauauguguuuuuuugccuaguuacacuguauauaguuugucugguuacacuguauguaauuguuuccuuaugugcacuguauguaguuguuugccuauuuauacuguaugugauuguuugccuaguuauacucuuugcuuaguuacacuguaugugguuauauaccugguuagacuguauguaguuguuucucuguuugcacuguaugugauuguuucucuguucacacuguaugugauuguuucucuguucacacuguaugugauuguuucucuguucacacuguaugugauuguuuuucuauuuaugccguaugugguuguuucccuguuuauacuguaugugguuguuucccuguuuacacuguaugugguugcuuuccuguucacauuguaugugguuauuuuucuauuuacauuauaugugauuguuuuucuguuuacacugcaugugguuauuucccuguuuacacuguaugugguuauuuuucuauuuacauuauauaugauuguuuuucuguuuacauuguaugugguuguuucccuguuuacacuguaugugguuguuucccuguucacacuguauguaguuguuuuucuauuuacacuguaugugguuguuucccuguuuacacuguauguggugguuuccccguuuacacuguaugugguuguuuuucuauuuacacuguaugugauuguuuuucuauguacacuguaugugguuccuuccccguuuacacuguaugugguuguuuuucuauuuacacuguaugugauuguuuuucuauguacacuguaugugguuccuucccuguucacacuguaugugguuguuuuucuguuuacauuacacuguaugugguuguuuuucuauuuacacuguaugugguuguuucccuguuuacacuguaugugguucucuguuuacacuguaugugguucucuguuuacacuguaugugcuuuuuucucuguuuacacuauaugugaugguuuuucuauguacacuguaugugguugcuucccuguuuacacuguauaugguugcuucccuauuuauacuguauguaauuguuugccuuuuuauugccuguccaccugcauuccuucagccucuauuacugaaggucugugagagcaguagccaugccucuuucaugcacuacugugcacccaguagcauugccagauuaaauauggauacucagugaaacuugaauugugacucaaaacaaauauuaccuucauuuuacuaauuuauuuuuaaaauggacacauuauaauuguacauauuuauggguauaauuugauguuuugacacguguguguugcauaaugaucaaaucagcauaguuaacauaucugucaucucaugcauauguguuuucuuuguggugaaaagauucaaaaaccucuuuucuagcuguuuuguaaaauacaauaccuuacuuuuaacuacagucacuguacuguacaauagaacaccagaaguuauuccuccuaucuaauuguaacuuuguaucuguucacuaaccugucccuauccuuucuucacccauccccuuccuaguuucugguaacuacuguucuguuuucuacuuuuaugaugucagcuuguuuuaccccuuagauuucacauuugagugacaucauaugauauuugucuuucuguguauggcuuauuucccuuaacaugauagccuccaguuucauccauguugcugcaaaugacaggaguucauucuuuuuuauggcugaguaauauuccauucuguauauauacuacauuuucuuuauccauucaucuguuguuggacacuuagguugaucacauaucuuggcuauuguaaauagugcugcaauaaacaugggagugcagauaucucuuuggcauacugauuucauuuccuuuagauauauauccaauagaaggguugcuggauuauaugguaguuauauuuuuaauuuugugaggaaccuuccuacuguuuuccaaaauggcuguacuaauuuacaaucucucuaacaguguguaaguguuccuuuuucuccacauccucacuaauacuuguuuucuuuucuuuuuuuuuuuuuuuugauaguagccauucuaacuggagugagguaguaucucccuacggcuuugauuugcauuuaccugaugauuagugauguugaguacuuuuuucauaucuguugccauguguauauuuucuuuugaaaagugucuauuaagcuugcucuuuuaccuuuuuuuuuuuuuuuuuuuuuuuggcaaagucucacucugucaccuaggcuggagugugaugguacgaucauggcuuacuguagucuugaccucuugccucaagccaucaucccauuucaaucucccaaguagcugggacuauaggagcaugccaccacgccuggcugauuuuuguaguuuuuguagagaccggguguugccacguugccgagacuggucucaaacaccugggcuuaagcaaucuaccugccucagcuucccaaagugcugggauugcaggcaugcacccagcuucuauuuuuuaauugaguuauuugguugguugguugcuguuaaguuccuuagcuauucuggauauuaacuccuugucagauguuuaguuugcagauguuuucucccauucaguagguugucucuucacucuguuaauugucuuuugcuuugcaaaagcuuuuuaguuugauguaaucccauuugucuauuuuugcuuuuguugccuguauuuuugaggucuuauuuaaaaaauccuugccaagcccaguguugugaagcauuuugccuguguuuucuucuaguagagucauagcuuuaggcuuuacauuuaagucuuuauuucauuuugaguugauuuuuguauauggugagagguaggggccuagucucauucuuccgcauaugaauaucugauuuucucagcaccauguauuaaggagacuguccuuuuccuauugaguguuuuuggcacauuuguaaaaagucauuuggcuguaggugugcuaauuuauuucuggguucucuauucuguuucauuggucuuuguguguguuuuuaugccaguaccaugcuguuuugauuacuauaauuuuguaguauauuuugaagucagguagugugaugcuucuuucuucuuuuugcucagaauugcuuuagcuauucuggguuuuuuugugaucucauaugaauuuuaggauuuuuuuucuauuucuaugaagaaugucauugguauuuugauaggaauuauaauaaagcuauagauugguuuggauaggauggccauuuuagcaauauuaauucuuucgguucauggacauggaauaucuuuucauuuauuugugucuucuucaauuucuuucuuccuuguuuuauaguuuucauuguagagaucuuuuacccugaugguuauguuuauuccuauauagcuuauuuuuugguagcuguuguaaauggaauuaucuucuugauuuauuuuucagguagaucacuauuagcauauagaaauacuacugauuuuuuaauguugauuuuuguauccugcaacauuauugagcaaauaauauccuaguauaaguauaugccaaauguaagacauguuuauacugaaaaauuauuuaugguuuuccugaaacucaaauuuaaccagaugucugguagguuuaaaugcuacauccagcaacccuaguaccuggcguugaguaggguguguagcauauuguaggagcucaauaaauacuugaaugaacaagagagugaauacaaugaaagaacacauuucuuucucaugacaauuuuacaaaguggaucuuauuauuuuauagauaugaugagcaaauaauucaauaagcuugucuguggguccagagccaguuaggacagggugggauaacagucaaauuuugaaacugcucuuuucagcuuuucaguacauugugcugccuugcuuuguuaaaugaaauuucuuccuuguagcagucagauuuuuugguuguaucaacagaaaacugaacccucccuaguuuaagcagaaaaagauauauucauguguauauuaaaggauuuuuaggagcucugggucccuggaggccagagaaacaaaccagaggcugacuggccaggacugauucccccagcguguuguagaacugauccaauggaaauauugauguugcccucacugggcacagauacugcagccugcaccauugacguccccaauguggaccacuagaccacacagccaagccccugacccuuagggcuuccagauguagcugcaucuuuccuugccaguguacauacagcuucacacuauuugucccagauauaucugauugagaaccugaaggcauaugucuccaugcuagcuacaagagagucugggaaagugaaccuuuggcuucuaaagucaaagcuaucucugucucccucuacauucauuagaaggggaauuuuucaagcacaggaaguaucuuaaaaggugcugggcagccuaaaagauaauacguguccacuugacacugccuuugagcuucaguagcgcaauaccuuuugauuuuuuaaggcagguauuacuuucuaccuuguuugaaaacaggaguuguguuugcuuuaauuuuuuaaugugcccacagaguacugagccuguacucucaagaggcacucaauauaugaccgaauaaaagcugaauuaucugucuagugggauuuuauaggugacuuaaauucuguucguguguauuuaaaaaauuuccaaucauaaacauuuguaauaaaaauaguuaaaguuuccaaaacuugaucuaacugggagaaaaacaauaggucugaaguaucuuaucuucaaaucugaaauccaaaauucucugaaugucgaaggauuuuuuuugucugauaccucauuggcagaauuaccugaccugaagugacacaaggcuauuuauagucuucauuguuccacuuaauugaauauucauauguuucccggcagaaauauuaauguacuugauuacaaacuguugcccugaucucacuggaguacuauacuguauaugaucucuauuaucucuauaaaaucuggaaaacucugauguucaagacucaucaguccccaaggguuuuuugaaguguguaugcauguguguauuuguguauacacacuugcauaauauguacauagaacguucuggaagggugcauucaaauugccagcagugauuauaucuuacagaauggauuagauggggagauagugaggaaugaauuuaugcuuaauauucuuuagcauuucuaauuauuauuauaaaaaacaauugccuuuuuaaaugaaagaagauagaguagaauugaauagaaauguucuuguacuuaggaaaauagugguaauauuaauuuuaaaagaugguuugucaaguaggcuaugcguuucacauuaguucaacauuacaacugauaaagacucagaaaaaguuauacacagaauagucagucuccugccuuuuggacacuauaugcaugcccagguggcagggaauuuacgucagcaaaagcacuaauuuugcuaaaaaaaaaaaaaauagaggcacacaaaaaugugaugaguaaaugaaacaacuguuauuagugacggauuuggcauguuuuacgaagucugaaugauuacucauccacuguacauuugcagaaguucuuuaauaaaaaccagacgcauauguaguagcagggguuaguagguggaugggaggauuaaacccugugcguuucuggagcauugguuuguaacuguuuuuuggcuugucaacaggcuauuuuucugagucagccuauaggauggcuucccaggguaagucugauuuugcuuuucugguuuuaaaauauaaagugguaauggagagcugacuaguugcucucugcauuagauucuguaaaucaauauugccugcauuucuucuguaagaaagacauuggucgcauuucagcauauucuaguguuccugcugcucauuuuuguagcuuugccuuaccucccccuaauuuuaaaagucaaaugcccaagugcugaaagaauuugcaaggggaauugcaaaggucauguguaaguucuguggcugaaguguggagagcaguaugauugagcugcagcccuucaugaaccuuucuuuucaagaggagguuuccaauaaauuaggguagcacacuuuaugugcuuguuuaugaccuuaaaaaugguuuagauuuugcugaguggccauuacugcugcuuuaugacauggaauaaugguuucaaccugcacaguuuuucauuuuuuucauuuuuguacugaaacaaugucaugcaucagucaaugugaaguucauuuuuuuuuuucuuuuaaagggacuugggagaauguuagacauuagaauaaguggcuggguucuaacuccagagaacuuugguucuugaaaaaaaaagugaagauucuccaagccguuacaaaugagcuuuguagugaucucugaugaaaugauaaaaacacugcuuuucccacuggaagauaaaugccccuuuucauuaacuauaguaugaggaacaaaaucaugugauuuucuuuuuuuuuuuuuuaaguuuaaccuuaauuacuuuuuaaaggcaguuuucauuuugugauuacuuuuuuuuuucuuccggugccuagcauaguugaggauuuuaucuucuugucuauuuuaggauacucuaaugaauaacggaauuuugacgugcucuuucaaaggaagagucuaguugcauccucccagccaucggcugguugagcuguccuacccacuucguuucagcucauggaggccaccgugaggggcuggggcaugucaguggcccacagcuauucugaaugguaguuauaucuaugugggggcucagaagggaaccgacuuuccauucauuaauguucaguacccacgaaagaaaccgauauuuaaaaaaaaaaaaguaagggaauuucaguugauuuuuugaaaaacgaaaacguucacauuaggaccuuuaaaaaugaaagcauuuauguucucagugcuguggaucucacauauaaauaauugcaccccaucccccuccccccacaccccuccuccccaagucugaaacccuguugcaagggcugugugaagugggagguuaauguggccucucuuucugggacaucaguaauucuugaauauuuuggguaaggguagaaaaguaucccauuucagcugaucaguaauuuaggagcuuuuaaaugcugauguaagcaaggguauauuauggaauagaaucugagaugauacuauaaagagacaucucuguugcuaagggucaguccagaccacacuccuagaccuuacuucugguccuccuugcaaggguggucaucuguccucugcugugagaucuucuuugguagaaaugugaugggguuugcuuucaccccuucucaaaaggcugugccaggaacacuucuaugggcacaauaaggugaaccacugugagguuugagaaaauuaauugcccggggugagcuggaacacuuaauccaucgugucacauauacacagaggucuuugaaagggacaggagucuugauggaaggcucagcuaccauccagacauuguuagaauaagaagacaauugcuccuuucaaugagagaaagggaagaauaaaaugugauggagauuggcaccucggaaagggaagaauaaaaugugguggagauuggcaccucuucugccauucuuuaaccuccauaaugacuuaccaaagagcuuuuuuuaaaaaaagagaucgacaggaaaauuaauuaucaaugauuucagagcagauuauuagauaugugaauuauccagccucuuuggauuuuguccuguugucaucauuugucaguauuucucaacaugucaucgaaaggugauucaggaugaagcacaaaacuguuuuuuucucuuuuuuuuuuuuuuuugaaacagaaucucacucugucaccuaggcuggagugcagugcugcgaucucagcucacugcaaccucucugccuucuagguucaagcaauucccgugccucacccuuccgaguaacugggauuacagguacaugccaccaugcccagcuaaguuuugcauuuuuaguagagauggggguucaccauguuggccaagcuggucuugaacuccuggccucaagggacccacccaccuuggccucccaaagugcuggaauuaugggugugagccaccacaccaggccucuaaacugcuuuuuacuccuaguuguguguugccaguucagaaacuuaauuaagcuuauggaaugacagacauauuucaccuuuuaguagaugagaauacauucaagacuaggcuuaaguacauauaucuucgauguaauuuauuaaacccuuaaauccauauucacacauacaaaauaaucagaucuuaaaauaauuauuggaagaaagaagagggaaaaauaguaggcaaucuucaugacacuuuaauguguauguuuacugcuuaaaauguucaaacacaucuuuguuuuguauaguuaauuuuggugguauaauauuugaaaaggugauagauaaaaagugcaggaugcaauucuugaagcuguaauuugcaggacacuaauaauacaaguccauuuucuuuucugagugugcuauuuauacaauuuauauuuuuaacaaaucuuagaacuggaaugaaaauaguaauucaucuuaaggguaagaaagguugcagcugugccaaauuuggaaacuuuaaucaguccucuuagugcuuaagcacagacuauggaauauucuaauuuguaugucacagagcacagugcucagcagaaagcaugcacuaucuuaaauuaauguuaauuaauuaauguuaaaugauugagucaauuuggcaguacuucuuuucgucucugaaaagaaaucauauuuaauuuagaaguggcaggucaauuuuaaagccaagcuaaaauaaguaggucaagugaaauugugcacagggcagggauagugguguuauauguacgaagaaaaaagacugaaaggaaaaauaucaaaauguuuaccugugaagaugaugaauaauuuguuuuuuauauauuuuuguuugccuuuaguuuaccacagugggcaaauacauucuucggagcaguauacuuucaugacauauguuaagcuuuacauaacucuuuguuaaaucucccguugaugaauuaauaguaaacaugauaccuaucaaauaugaagugagcgguguccucuguaguugggcagcauaguagcuuugaguggaacuuacauucuagcaaaauucauuuuuucaaauaagauuuuauguaaaauccaaguauagucaguucugcuauaacacaacauauguguuucuaaaaaaucaucaggcuacuccaaaaucaugcaguagacaacacacgauguauaggaaaaauggggcuaggagcacaaugcuaaaaaauuucaucagugacaucugaaaaaagaaaagauaggaagcuaauaaacacaguagacagauuuauacccuuuaauuuaagcgauacauuaauacaacaacaaacuuguuacuuugcuuugaauaacaccuggauuuugcuuguagaaguggcuucagaagaguugcagcuggugaguuauuaugcagugguagaaggaagcuuaucugaaacuggaucaaaaauuauagcaucagaagugaaugagugugaugcauaacacucuuaguaaacggagguagccgguagauguuugaagugugugcuuggugcagcugggugcaguuuucaggguguucaccuacuguuucuugaagacagaaucacgcacaagcaaaccaaaauucuugggggauaugcucaaguuguuuacuguguaacaaauuugcauuuccaaaaucaacgugauggcagaacugacugagauggaugaaaaaaagcugcacuagcucuagguaugucaggagcccaguguggaacccaaccuccccaucaccaccccagggguuccacagagcacugcugugugguguaaacuuuauuuuguuuguuuguuuguuugugaccuggaacagacacagaaaguuauuuuucuuguggagaguuucgguccuaccuacauauccuucccuggcuggagucuggaggugugccaagggcuuuggcauugacaacuuucaguuccacugccagaugggcuguccaguaaagcaaauggccuugaacugaaaacccuauagaauaccucgcuccagguccuugccagggacuauaaccuugaguacucaaugaguacuccguaaguacucaauacuuaugaaaugcugcuaugaaaaaccaauaucuauggauuacagugugaagaacagauguucauuuguuucucuggauacccaacaacgagggaagaaggguauguuguuugagaaaucauuuccaaagugucaauauugaaagaaggcgugagaaauuuacauuuaucaaaaggggucauugguuauaaaauaguucagggaaaucuguauaaucucuaccagaaauaaucuaggccagcagaaaucucuauucugagauuuugauaucccugaaaauuugugcauccucccuccacccccggcaauuaguuuuacuggauuauacuuaauauuaugccucugcccccauugaaucucguuacaagauagagccuuacaaaucuuuauuguauggggugucugucuuguggguguuacaauguccuuuuuaugaagacucuugggugaagugucucucugguuucaauaccacaaaugacuguacuucuacacaacuuuggguuuuuauuuuauguauauaguuagucauguaacugaucauguuuucuuccucuuuauggccacagacauauuuucuuugacccauaccguuuuuguuuguuuguuuguuuguuguacuuuaaguucugggauacaugugcagaacguacagguuuguuacauagguauacacaugccauggugguuugcugcacccaucaacccaucaucuacauuagguauuucuccuaaugcuuucccucuccuagucccccgccccacgauagaccccggugugugauauuccccucgcuguguccauguguucucauuguucaacucccacuuacgagugauaacaugugguguuugguuuuccuuuccuguguuaguuugcugagaauuaugguuuccagcuucauccaugucccugcaaaggaaaacaacucauccuguuuuauggcuacauaguauuccauggucuguaugugcuacauuuucuuuauccagucuauuauugauggacauuuggguugguuccaagucuuuguuauggugaacagugcugcaauaaacauacaugugcauguguccuuguaguagaacuauaguaaccaaaacagcaugguauugguaccaaaacagauauauagaacaauggaacaaaacagaggccucagaaauaaugccagacaucuacaaccaucugaucuuugacaaaccugacaaaaacaagcaauggggaaaggauucccuauuuaauaaaugguuuugggagaacuggcuagccauauguagaaaacugaaacuggaccccuuccuuauaccuuauacaaaaauuaacucaagauggauuaaagacuuaaacauaagaccuaaaaccauaaaaacccuagaagaaaaccuaggcaauaccauucaggacauaggcaugggcaaagacuucauggcuaaaacacaaaaagcaauggcuaacaaaagcugaaauugacaaaugggaucaaauuaaacuaaagagcuucugcacagcaaaagaaacuaucauaagagugaacaggcaacuuauggaaugggagaaaauuuuugcaaucuauguaucugacaaagggcuaauauccagaaucuacaaggaacuuaaacagcuuuuuuuuuucaaacaaaaagaaaaacuauuuuccagcauuccagugcugagacaauuucacacaaguguguuugaauuacuagcauuuacugaaaaaucagaucugguaacauugaacucucaugucacuauggcaaccaugggauucaauaaaguauugccauuuuccuuaaaauagaacaggcacucuucaguuuuacuuuuuuuaauuuuaccugccugggcccuguagauguuuaacuguaaacccucuggcuuagaaagcaauuugugacccaccucuagaaaacgugcaggcuuuuauuugcauuuguguacuaaucuuauuccugaacucauuuuauuuuuuucuugaauuauguuuccuucauucuauuuucuucauccacuuauauuaauuuuccaucauugguucaucuugggauguugugugcuuuuucauaaauugcuuuaaguccuuuuagaaagaagcaagagguauuaaauauauaaauauuaaaauuaggagaaugacuucuuucucccagaucauuuuauuuuuauuuuuggccuaguaaauuuaaagugauuucagcuauuuuucugaccuauuuuugagucuacuugauucuaguaccauucagagcucugcaauucuuuguuuucuuuucuuuucuuuuuucuuuuuucuuucuuuuuuuuuuuuuugcuauuuccucacagaaacucugagaaaacaugagacauucaguacauacauuguuuuguaccuaaaguugguugacucucuaugauuuugcauuaagaacugaagaguuaaguaauuuucacauacaauuugggauuuccauaucuccuugagaaauaugaagacacaacuagacccaguuagccuuuagauguguuugugucuaguucaccacaucuuuuccuuaccucccccauugccuccaugacacugaggcugaaugcuacuuguccuguuuuccuugauuuucuuggucugcaacccauuguugguccaccacccaagcugauccugcugucaaaacauguucuacucuuuggcaggcacugaauuggcuuuucuuuaaugucccucuuagagccgcgagcuuccucggcaggagugucauggcucugugugugcauguguagguaaaaagaacacuagguuaauucauucaccaaauguuuauugagcaccuacuuuguggcaaggacuguucuggugcugggaauagagcaguaaauaaaagaggcaaagauaugugcccuacuggaguuuacauucuacugggaguugguaagugcuauaaagaaaaauaacaccaaagggcuuucucuuuaauuugaggaugauauguuagaccuugcugccuagggcuuuuuuuuuuuuuuaacagagaucuaaauuaauugagagaucuaaauuaaaugagaucuaaauuaaaugagcugugcagcugucuggggaagagcauagcaaaccaaggggcagcaaugagaguaaaauccugaaggagagaacauacuggauuuaguauuagacaugacuuuuauuucaaauacugccuugccuaauggugugaacugugaccuucuggaccaugucugggaacucaucucuaaaaugcuaagauucuauguagaagaaggaccaugccuuacuaguuucuacccagugccaagucuaguccuuggcucuugguaagcauuugguaaauauuugugcaguuaacagauagacacaacaaugguuuuaaaagaauauaaagcaucuuggccagccgcaguggcucaugccuauaaucccagcacuuugggaggccaaggcagguagaucaccugaggucaggaguuugagaccagccuggucucaacauggugaaaccuugucucuacuaaaaauacaaaaauuagccaggcauguuggugugugccuguaaucccagcugcucaggaggcugagacaugagacucacuugaacccgggaggcagaguuugcagugagccaagagugugccacuucacuccagccugggcaacagagugagacucuuucucaaaaaaaaaaaaaaaaaaaaggaauauaaugcaucucaaaagccggaucuuagcugauuguuuaauacaaucccagagauuaaugacaaggaagaugccuaguccugaaauguguccaaggaauuucucuuuaaugauaauuccauauuuucugcacuuagcaagacacaucuacacaucaaacuggggauuauuaugacccaggaaagggaccugggauucuuugacuguuuccucuugagggcauuagugucacugauugggagacaguccucuaaauucagcuaaauauuggucacccucuauaaggacagugggacagcgggaagcagacuaagugcaaggauugugucuuaguuguuguauccguuuuuuucccuuaguguaucccaacuucuaauguaguacccaugagcucacaguaagagcucaguacauauuugguaaagagugaauaaaaucaagggaugcauuuucaagcucuuucggaagacaguguuggagucaugcuggaaagacaucauacauucugccuguuuccuuccuaagaaggacacacuagaacuagaggagauugaaaaggcugaaaaguggcgugaaggccagaccuagugguaaugucuuauuugcauaacucauuuaguuauuaucuuuacuuacauauggggaaaugaggucagagcuaguaaguggcagaaccagguaguuugacuccagggguuguauuuuuaacuccaagaguguguuacguacagagaaggauaacuagcaguuacagaaacagaaguaugaaaaaaaaucauucacuaaauagcugaauggauucuguuaguggcauuagugacugaugaucuuuucuggugaaaaaucauuucuuucacauggaacagguuucagauggagagaaaagucuacuccguaacucacacuucucuggcuuuuuuguggacuccuccaagacuuugccauguuucauuucuugagacuuuauaucagauuuucuaaaagccauuggggaagcccuucauaacaggaauucuuauuuugauucagauaacacauggguauuuccuaacuaccauguucccaaucccacaugcuucauagccuaagagcucuuuccacauuuaaugaugugcuggccacauuauuucccaucagcuucaacuccuucuuuucuauuucaugaaaaaauucuuguucaugaacgauuagguuuucuucugcuuauuuuccguguagauagaaugaacucaguuguuacgaugcucuugcagaagaacaaauuuaaagcuggaagaaagcuuugcgaauuuauaacagcagucuguuggguucagagagaauuguuggaauccuaugcuuuccuuucauuugugugcuuuucaagugaggggaacauugugauuuuuguagauggugucagcauagauggcagagauaagcagauauccuggccagcguucuggggaagaugaaaaugcuuguguuuucucaugacuuuauuuuuccagagcugacucuauggcaauaucacucugacaaauauuggcuggccauggaauauuuuaaagagcaaggguuuugugaauguucugucuauuaccauggcugaggaaucaaaacacaauauucuccacacauuuccucgagcacucauggauggauuccaguaugauacuuucauguuagcucuuagaccacaggaagaauuuaaaauaaaugauuacugaaaacacaaugaagaagaaucgaguagaauguuuuguaccauuuuucucuuucugcacgguaauaucaugcucagaguggugacaaagacuaacugagugcaaaagggcuuugcaaaaauuuauguuuucagaugcuuguugugaacaugauggcaaugacaaucaugucacaucugcuucgcucgugaucucuauccuuauguaaggaaagagcagacacugaugauguucaaaaacaaacccaccacagacaucccaaagacuucuauaauuuuccccccuucucuagaauguacuucucacauuauugugugauuaaugagaauaaauuauauggugugaguauacaaaggaaggaauuugagagauagcuuuuugcacuggaaauuauuugggcaaagauucuucuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccauuuuagccgggguggucucgaucuccugaccucgugauccgcccgccucggccucccaaagugcugggauuacaggcgugagccaccgcgcccggccgggcaaagauucuucuacaguaccucuugggucuaugaaugaagcaggauggccuggauguaaauuaaggauuucaguuacggugcuguuuuagaggaguucccuuugugaugccauguucguaucaggcucuggugaccaagauggugguggcggugaugauaauguuuauuauaguggcugcaguguauucacugcuuguacuucagguucugugcaaaguacaugccaggcauuaaucuaugcauuauuccacaacagccugugaaguugagacuguucuuaugcucauuuugcagaugacgauacugaagcuuagaaggcuugaguaauuucccccugggugaauagcuaaugagaaaugggaagagcuuggaauugaggcuaguacucucugaccccagagccugggcucugauaccucauccuugcuacauccuuucuagaaguaggaaacucuugccuggaccauuucaggggccuguugccucucccuacuuuccuccuguuuccucuuuagcucuuuuuccuagcauguaccucaccauugaagguccaucaucccuguuucuuugccugacuuauauaccucucaaucuucaggacuucuuuacucuggggucucuccuucgaauucucauaauauuuuguucuuaucuuaaucaaaacuccaugcaguuuguggucagcuaguuaaguauuccagggauuccuaaccuguggucugagcagucaaucgaguuuuuugugucuaugccugugugaauuuucucugaagucuguaguuuucauaugaaucucagaaaaguauuugaccaaaaagaucaagguguuuauuguuuauaggaucccccacccucccauaaguaauaagcucccagaggaaaggagcauaucauauuuauguuuauuucccuagauggauauaauaggauaauauuuuuggaguguucagaugaaugaauguaguuacuaguuagacaaugaggugauauagccuguggcuuaagaacauaggaucuagauuccaacugugccuuggguugaauuccuucuuugcaaaccguuuggcaagugauacagucucuuaaagucucauucuccuuauugguaaaagggauacuaaaauaauauuaaagguagaagguuguuauugaagauuaaaauaagguaaugcauauaaaaugcuuagcuugggaauacauagcauaccuuccauaauuagcugcuauuauuauuacuuaagaaccuuuugaaaggggccaaacaaugagguucucaugauuuuccuagugacuauugcagagaaacaaaaaccugcaaaggaaagauuguuugcaugcugcuuuugagucuuaaagacuuagaaccgaugugcugucauuaacuauggugccaggugcaaggcagcuaccuccuuaaaauguuuuucuugggcauuuccauucccuguggccuugacccuggauagacaguggcucaggcuccccagacaggcacccagaaugccagcuaauggaaauuuugugauagucugccccugaggauuuggacauauguuguuuugugucuaaaucaacagaaauaagugcagcuguaguuacccccucugcauaaucaucuaaguagccuguuucuuugcaugcucauggagcccccaagugcugggcccaucacuugccacccacucugugcauugcaaaugaguacaguaggucagauaaaaggcagaggcugguugggcaucauugcugacuuacacagcaaugaugaauaguuacacauagaucaagacauaaaaguuauuuauaauagucuggucaccagggucacauuggcaagaaggaaccuuuggaaaggugcuuugguuggauacuucugaacucuggcucauuaauguguaccaaauauagaaaaguuaguuuaaaaucucuuuacagaaaauauauuaugagcuggauuuuauugacauaggaauacugacuuauacuuuuccuauagguuucuuuaaaguauguaccauuucuuuuuauuauugguaauugugaccuuggcucagucauuugcaaauuuucuuuuuuugguauaucuuaaaaauggauagcaccuuuuauucauaauuaccccaaacuggaaacagccugaauguccuuauacuagugaaaggauaaacaagcugugguuuauccauacaauagaauacuaauuagcgauagaaaggaacaagcuaccgauaccuguagcaauguggaugaaggucaaaugcacuugcuaagggacaaaaaacagacucaaaagccugaaugcuauaugauuccauuuauaugacauccuggaaaaggcaaaacauagaaacagaaaacugauaggugguuucugggauuggagaugggggcuguuuugacuacaaaggaguagcacaagagaguauuuugaggugauggaacuguucuguaucuugauugugcugguggugacauggcucugugcaucucaaaacucgaacggaaggugaauuuuaguguaucuaaauaaaaguaaaagaauaaaaaaggagaugaaaacauuuacccaauaugcucacaugcucacaaagaaauguugcuuugaaaaggccgauauauguaauuuaaauuucauaaauuuaauuuaaaccucacaaauauuuauuggugagcugcuauaaugcagugcuuuaugggaaauccuaaaggaaauacugauccaugcacucaguaauguaaccaucucuuucggcaaacauauacaaacaauuuuagggugauuuuaagauuauaauuauauuaugggacauuagaggagaaagaggcaucuagaugggaucaaggaagauuguuaagaaagugaagaagguuugucaaggaauagucuuaaagaauagguagauuuuuaaaguauuuuuaguaaacuuuuaacugaaauauaauauucccacagaaaaguauacacaucuuacaugcacugccugaggaauuuucaccagauagcuagcacccaaucucuaagauagagcaucacuagcacccuugugccuccuccuagucaaccccucuucuaaguauaaucacuauccugacuucuaacaccauggauuaaucaugucuggguuuuauuuaacuucauacaaaugaaaucauacagcauguacucucauaucuggauucuuucgcuuaacauuauguaugugagauuuaucccuuguuuguauguagcaguaguucauucucauaggauauuccauuguaugauuacaucaccauuuauccauuccacuguugaugggaauuugguuugccuagaguucugcacuauuaugagcaguguugcaaugaacauuauugcuauaugcuuuuuggugaacacacauauaaauuuaucugguuuggguuaagaaauggaauuacuagguuaugaggcaugcacauguucagcuuuugguagauacugcaaaccauuuuccaaaagucuuucugugaauuuacaccuucaggagcagcaucugagugugccauuugcucuguucuucaccaacauuugguaauacaucucccuuucauuuuacugaagaauacguaguguuuuuuugauagggauggugagugcaugaagaguaguacuccaggcaagagaacaccccaagcaagaguguacagcuagaguuagagaauaaguuguuuauauugguuugaaucauuacaauagauaaguccagaaggauaaguuggugcuugauugcuagucuaaauaaaacauuaaaaaaaaauucauucauuguauagugaugaaccauuaauuuugugaccauaguugccugaaaacagcaaaaucgugcuuuaggaaguguuaucuaguaguagguguauaauauuuugggggaaguugucagaacaaccuaguaguccaggccagaguuucaccaugucagaauaucugugagaacagagauggugguugauagauaagaugugauaagcaucuguucgguagaggguuaaggggaaggaagaguaagagauaccucugacccuggugguaccuuagccaauuaugccaaaauucacuauuauccuucuuaaugucuuuaaagaguaguuuauacuugccguauccauuucuuuacuucccuauauggcuuauuuuuuaacuuuuucauuacuaacaauauucaauauuauuauuauuaaauauaucauacauauagaaagcaauaccuguccguuuaguaaagaccaauaaaaugaauaaccaugugcccaccauccaucuuaaaaaauagaacccucuggaagccucaucuuugaggcauucuccucuuuacucccuaccuaguuaaccaucauccuuuuuguucuaaucacuccuuugcuuuucauuacacuuuuagaaucguugacuacaucacuaaacuaugcuuugaacuuuaaauaaauggggucauaaggcaagauucuaugugacuucuuuuuucauuccacaucugucuugauuuuauccauguaaaggcauaucacucauguuuacugauguguagugaugcauuguguuaauauuauuccucaguuuauugaucucuuucgucuuuuuuuuuuuuuuuuugacaaagucucacucugucgcccaggcuggagugcaguggugugaucucagcucacugcaaccuucgccucccauguucaagugacucuccugccaguagcugggauuacaggugcacgccaccacgccuggcuaauuuuuguauuuuuaguagagacagaguuucaccguauuggucaggcuggucucgaacuccugaccucgugauccucccgccucagccucccaaagugcugggauuacaggcgugagccaccgagcccagcugaucacuucccucuuaaucauuaaucccuggacccacugacccuaauauuguggcauaugugauagacugaaguaaaucauguauugugucccauagacuuaaaacuuuuuguuaauaauuuaauguuuacaaugagguggaacuacaguuguccuugguauccuugggggauugguuucaggacuccuuuggauaccaaaauccaugggugcucaagugucugauuuaaaaugguguaguauuuucauauaucuuauguacauccuuacauauacuuuaaaucaccugcagauuaguucuaauaccugguacaacauaaaugccauguaaguaguuguuauacuauauugaguuuuuauuuguguuauuuuuuauuguugcauuguuuuuauuuguuugcuuuuuaauauuauugauccaugguuggcagaauguguggauguggagcuuauggauacagaggggcugacuguauuuugucuucuguaugaaagaggugcuuauuguacaauagaguuuuccaaucugggcaauauugaccuuugcagccagauauucuuucuugugaaggccauacugugcauuguaggauguuuaacagcaucccuggccucuacucacuagaugccaguagcacuuguuucucuguuugcaaaaaccaaaaaugucucuagaccugucaaaugucccauggggacaaaauugucccuuguugaggauuacuccucuaaaguauuaaaauucagugaaaaggcagugaguuaccaugacugacuggagagaaucacagaaguuaccuuccucuuaguacuucccugcugccccaucccagcccuagguuggugacugugaacagugguauuuuucuuuugucuuuugguaguugacuuuuacugguccuggagaccagcccccucauguuguaagcauguuaucaguuuuaccccccgccccccagggacuacuuuucugcucucauggucuacauucugccuacgugugacucucuuugcccuaaaccccuccuaauccagaggcagucuuuauaaguccaagggagaugaucaugcucauugcauugcauuuaaaaauugcuuccauuucccauaagcaaaaaaaaaaaaaaaaaaacacuuaaagaaaaaaaaguacauaucuuuuugaaauugucaguuuaaaaaucuauaauaauaaauacauguuaauaaagaaguuaaauaccaaugaguuacaagauuuauauauuugaaauacacauuuuauaguauuauugauacuuugauauuaauuuaagcuuaagaguuauagaaaaugcuaaaaugauagggccuuuugaccucugaaaugaaaauuuaaaacauuuaaaguauauuuaguuagcacacagcucucccguaacuuuguguaaugauuuuuuuuuucaaguacaacacaaaaccugcucacgaaucccaaagcauuauaaagcuggcuccaucuaguguaugaaguacuauauagcuaauacugggggaaaaauuguacuaggaaucucuuuugguacuucauuaugaaauuagauaacaaccaaaacaaaaauggacuguaagcuaaauuuauguuccaggagauaacacaggccagagugaccuucacagcauuagaggagaggucuuuauauaucgaagcaucaaccuguagcaugccugacauuuuguucugacagccuugauuuuuuuuguuuuguuuuguuuuccccugggcuagaggucuuauuuacaggcacuaucaacaaacgcagcauguaacuuccauggugauauucucaguccuacuuggccagcuucccacuuuuucuguauggaaucauaucugagagucaugcucauuucccacaguuagugagagauuggggcugggcucacuuacugugauuucagaacccuacaugguuuucuuuaucagacugaaauucuuuguagcuauuagccucucaccacaauagagugggccacucuaucggggcuguguuuaaucucguuuccacugaaaguuucuagcacauucuuuauaucucucaaucaauguuuccuaaauuuuagcuauucucaugcuaacuucauuacuuuugcuugcaaaaaccacauggaacuuuaaauauuacauguuuuaaaggaaauguuaucauacauggaagccacgaauggaaauagguauuaaaaucaauauaaugaaauugaaagaaaauuguuagauucuugcuagguauauugucuggaccggcaggugucugaggucugaccuguauugugaacaaagggcaaguguugagagauugaagacauauuagcaucaaacagagacuuuccuuagauggaagaaauuugaaagggcccuucucacugugugauuccaugcuuaguuaaugugaagucuguacaucucuauuugagaucaucuuguaucccacacuuugggaacuuuugcucaagauuuaccauguuucucaaaggaagccuaucauucucccccaaauuuccaaagaccuuguuuccccuagaaagccuuuuugaaaaauuauuuccuuuuuugagaacuuucuucuucuauuaagaaguauaaauuguguugauauguuggguuacuuuuuuuuucuuccuuguaaucucauauuuucuuagucucuuuucuaacuagauuaaauuauuugaggacaaacauuguuucuuucuaguaaaugccauuaauugaauucaugcuugguauaauauucagggaagucugcuucauucucuguuuuuuuguguguguuuuuuguucuguuuuguuuuuguuuuuuuuaagucagaucaucguuagagguggccaagagaagccauuauggucaauuaauuaaucauuuaaccuauuggugaauaguuauugagugccuucucugugucuggaauuguauguggugaaagaaugaaguagugaccuaaacagacaugguucaugccuuuauggaauucagaaucuagugugggguacagacaaguaaagaggcaacuccagugcaagguucuaauuuuagaauuaguuugcuuuuguguucauuggguagauuacaaaaacuuggaacagagaaccauagagaggaaagugugggcucuggaguuucaaacuccagaccuguggcacauuaaccucuugauuuugcacaggauacucauaucucaaucccugccccccccaguuucuuucuuuaaauaaaaaagauuuguuuaauaauaaacaugggguaugauaugcaaauaugagauacaguuaucagugugacaauaugauaaacaauucuccaugucucuucucuccuccuuccucuuuuuucacauaaggcagagacgugaucucaugguuuuuuuuuuucaaauuuucauguuucuuucccaacacgcuaauaaaugaaaaugcagugaucuagaucaaguauaggaacuaaacauguuuguuaaugggaauaucauuguagaugguguuuaaagguugcaaaugcauucaauuuucacauugucuguuuaaauuaauaaauaauuugagcauucagcauuaccccagaacauuuuucucuuaauaaucaugauauaucaguuaugcaucuuaagccuauugaacagugccugggacauaggaggugcucaauaaauauuuguuuaguggaugaauggauuuuaauaauuuugacucuuccuucuuuuauucaugauuuuguuaacaucuuuuaaaaaugaaccaauauuguuugauauuaggagcaagauaagcuuaaauuaugguuuauauuauucucuauaucuguauuaccagccuuaccuguuauaucuggcagguaauuaauauguaguaaauguuaaggggagaauuuaguaguuuuuuuaggcauuauuuuuuuaagaacacaugacaauauuuuaaguaaggauuuaauuugucuuuuauauuauuucaugguaauauucauuggaauuacagacuauuaauuuaaaauauugguuauuugaauauuuuacuaucaacauuaauauacacuuugauuauagguaagacucccuagagugucaauuagaugcagaaagcuaaugugcauugaguuuauuaugauugauuagaguuuauuaugauuaaucaacagacaggaaggauuuuugugcaaauauuauuuuucucauuuuaaauccuguuugcucagcauaacuguaacaggaugucauuaguaugagaguaaguuuugagaugcuuuaaaaguuugagaaauuugacuguuagcaaaaauuuaacauaaggugauuuauuuagcauaaagagguuugauuuuuuauaguuuuacuuauuuaaauacacgacuuccugugugacuccuggguauguuuacauagaaaaaauauaaacaaaaauuaugauugacacacugaaucagagcagaagguuuccuggacuagaauuugguuuguagcuaagacaaccacugaaaagacagaguuuguugucuacuaucagaaguuacagauaccaucaauauuuagucuuuaguuaugcacuaugaauauauuauucacagauuuaucuauaccuuuccugaacuuacauguauuuugaaucuggacuaccucuuaagauaucaaaauucaaaacuaccuuaagcauugucuccaaauaauaacuuuuauuugcccuagaauuuaaaguucuuugaggcucuaagggcugacuuuucauuaccuaacaauguuuugaaauagaguccucgcuccuugugucaccuugauugagugcuauuuuucuuguaccauguuaaguacuuuucauacuuuaucucauucaaucauaguauuaaucuaugaaauagguaguauuaauauucccaucuuauagaugcagaucuugagacucauaagucgaaugccuuacccagaguaaaacuaggauacgaaggguggugugugugucugcauugaaucaccacacuauccugucuccaguuggaaaaauggugccauguuuauauccauaggagugacacauuuauuaaauagcagaccucucagaaguuugcuucccacagguugaaaccacugcccuggauccuuaccacaucuuauacaaauuggagguuuugcacaccagugacuuccauaccaccuuccacaauggcaucguugucugcaagaaacagugucucucuaccuucugcucacucuuuggaauacaaacauuuaauuuauaugaauagacuauaaaaucuagauggcagaauaucccugucuucuuuaucucagucccuucuucuggcuccuccuuggaccagaauggauuuagaugguccauggaacugcugauguccugggaucuccuaaugagauggaaucaagggaaggguggguucaucucagcggcugugagcuuagccaaggugguccauggaggccacuucuacagcugaauugcauguugcuuuaaaauauuauaauaccuugacuccugcuuggaagaagaaagaaacugauguuguagaugaagaugauggugaugcacucuccuguuucaauccacaacaccccuaaaagauaggcagagacauucauauucuuauuguccuucaauauuucauaacuuaaaaaaaguuacuaacaguaaaauauauguccacauuuuucuuuuuaaaugaguaaagaguuaacccauaaauugagauaaaaacaccaugauuuucaggugcugauguggagauuuuauuuauuguaaagucaucuugugaauaacuuugucccccacacugaugacggccuuaucuuuuccuguuuacuuaccuugauaagauaguaaauugcauuuuuacuaaauuucucauuuaaaaauauuaucaaagcagcauaaucucaucaguguguucucuccaacuuuguguugucucaccuacucuguuuauauucuagauuguaguuuucuuauugcaaauacugguugccauuuauagauaacaaagaaaagccucuacauaaccuuuaaugcaggaacaaguauuuauuuugagaugaacacugagagaauaucaaagaguuuaagguaagggauuaauccgugguauugauuauuauauuaaagagucaugcuaauguuuuauauauuuuuguuuguuaauugcuuaaaaauucacuuuaggcugggcgcgguggcucacgccuguaaucccagcacuuugggaggccgaggcgggcggaucacgaggucgggagaucgagaccacggugaaaccccccgugucuacuaaaaauacaaaaaaaauuagccgggcgcaguggcgggcgccuguagucccagcuauucgggaggcugaggcaggagaauggcgugaacccggaaggcggagcuugcagugagcggagaucgcgccacagcacucccgccugggcgacagaacgagacuccgucucaaaaaaaaaaaaaaaaaaaaaaaaauucacuuuagacagaauuugagaugccucuuuguagacuauauuuuuauccucuggacagauucuuugaaacaguuuuuaaaaacauuuaauuuuuccuucuggauguuuguauaaauaucuuaaccauucuuuaauaauguugggcugcaucccaaucagguuuauguggggucaucuuagucucuucuuuauuucccuuuucaaccuugaagggcuuccuugguuuccggggacaaugagcugucuuugagaggaugcuguaauaucacuguuacaggcagaucuguucuugguaggagaaaaaaauagaaacaggaugaaagagauaaacgugagugagugcuacugcacaguuauuucugcaaguagguagucauuaaaaauuuucuucagucaugcugugaugguuucaaauuagagccgcuggaccaguuccuugcaaauuuguaccccaauacuuucugcaugaaagugaguugugcucagccacuaaaagcuugcaaauaaagaguacacaguuguauaucccauuuaugacuauugacuuucuucauaauuaauuaaaugcuacccucaaauuauacuucauagauccuuccuuaucugaccuuuuuucauuuuugucagucauucaugcauucuucuuuccuucuauccaucuauccagcaaauauuuaaauacuuacuaugugccaggcacugagaaaaagguaaguacaaggaaccugcccuuaagaacacaggacaaauagauaaauaaaaggauuacaaguugaauuaagugcuauaaaagaaagaagcuugcuucaagagcacaaaacaaaaggagauguuucuucuuuaggaaggauggucugggaagaccucucugaggaagaaauauaagaccugcaaaacaucaucugccaggucaggaggcgccaggccagggaaggaguugcagaggagagagaagagggcucuagcauucuguccucccuguacccucuucccauuggcaugugagugugagucuuggguuucucuggagugaacgccuggaaagcagagccucuugcaucuucauccuugucuuccccauggcgcugagaacagugccucucacacacaugcugggaaaacuaauaaauguuuggauugaagggccuuucgguggcaugugacuuuucccagaaugugagugugaggccaucuggacaaaagagauguguguguuacucuugagaguacuuugugaguuucauuauuacuuugaugaaacucuuuaauuaccccacaauaaggcuuucauugaacauuccacauggauauuuuaaagaauuaaaauguaugaguaacuucuuuauucaauaaauaaaaggagcuuccauucuugaguauuuuccugccacucuuaacagaccauuuacauagauaauauuauauauagcuauauauauuauaauguuauauuauauauuagugguuucuagacuugacuucacuuuagaccccuaugagaaucauuuuuuagaaacacagaauucuaaaccauaccccugcagaaucucacucacucauuuguuuggggaaagauccuugaacuuuauacuucuuaaaucuccuguauuuauuuuaaggaggugggguaaggagaaggcuccucaagugcuucugauaggaagacagguuggggaaccauuggcugggaucauaaugaaacauuccaagaccaaguagaugcuucuuaaauuguguguaguucaugggccaacauaggacccagcacauaguaagcucucaaguguuaacuguuguggggcuauugaguagaaguaugaguuuacuggaaagaaaaaugacuaucaaaagaaagaauauaagaaaauauggugugcucgggcugggcaauaaaacauuuaaugccuaaauaaaauaagaagaauuuugagcuaugauaaaacaguagcauuacuuuucuucagcuaagucuuggacaggauaacaaguaaaaucccuuaucucuuuucuaaccuguucaaagcagugauugaauuuuuccuuccaaaaagauucugaaacccaguuuagcuuccaaggaaaaaguuggcugucacuuggaugguugauuacuuuaaaucccauuuuaguuaagguucagcuuuuaaagggucaguaagaauucugaugacuguaguugauuugcugcaauuuagggcaaagaguaguacuuauuauugcagaagcacuggaguacuggugauguuuuuauucugcauuuugugcuuaguuuuucugauauuauuuuuuccuccccaaccacacuacaaauucuuagucuguguuuaaacuuaggauuuggguaucucucucuaucucucuuucccucuguguguguguguguguguucauaugcauauacauauauguauacaaacucaggaaacacaucugaauaguacagaugugcccaagacaguugcuuacauauuacguugauucauuuuaaagauauucaucaagccauggacuguuuauucugcugaguucuagggauacaacauuaaaccaaacggacaugguucuugauauccagaagacauguguucguuaauuugggugaugacuugaggagcaguauuuuagugcugggaaaugcacguaacaucucaugaauuuuguauaugguggccuguguucauauuuaagccaagcuuugguccauuugcuaguggacguuucauugcuguauccaagaagguucccuuagaacuguacuguaagguagaucuuucuaaaguacugguguaaauugucaauagaaauauuucuugaggcgguggauuguccaacauaaaaagucaggugauguuacuggcugaaccugccaggggaauauuuggcaccacauuauguccccuucgggaagggcuggaauugauaccauugguuucgugaucaauauuugagaacucauggaggguacagauuuucccugugugugagcauguaauaaaucagaguuucaguucuaagauguacccgagugccuuguagguuuacucagcuuuaaauagugccuaaggugagagagaaaaucuggcuugaacuuuuauuuauuuuauuucauuaaaauuuauuuuuaagagauggggucuccauugccugggcuggucuugaacuccuggucuuaagcaaaccucccacuucagccucccaaguagcuaggauuacaggcaucugccaccgucccuggcuugauuuuuuagaaaauuaucccuuaaaguuucugauaugguuauucccuauccuuucuuuauuucuugcucuuccacuuucuugauuuuucauuuguuuuuuucacucugucucauuucucuuaguucucuagauuggucaauauuaauacaggacagguagcacuaaccaugauuauaauuguaagagcuuuuuuaaaaauugagcguuuauuaugcaucagagacaaugcugaacacauuacuugucaucucuuucaguucuaacaauaaccuauggguagucacuuauuucuccuuucucaggugaaagaacuggggcccagaaaguuuagaaaauuuguacaaagucauagaauuaguaaguggugagauuugaaccuggauaaauaaacgucagaaucuauguucuugauuuucaugccaaacugugcuagaggcaggaaaagagaggugggauagguuaguaagauaaauaguguaacaucuuagucaucuguuuaccccaauaccugguacaguaccuggcauguagaaagugcucaaugacugcuguugaugaacuuucuccucuaaucguauuuauugguccuuaguuuuacgagcaaucugcccacuuuucuccacuuugcacaucugcccuucccaugagcuaccaucaccuccuaccaggacuauugcaguagcuaacucugacaguuuucuaguuggcugucaacauagcaaccagagagaccuuucuaaaaacucaaaucugagcucaucguuccccugcuugccaucucucugugguuucuuguucaucuugaaacagaaucagugaccuuucccuggccuaccagauccuucauggucugguccuggucacuguguaggucucacgggcaccauguuuuuccuucauacuauguccuucagugauagugagucugccugccaacuucccaccucauaguucuuacauauguuguuacugcugccuggaaagcauuuuuucuauacuccuccucuccccaacucagaucucagaccagaagucccugccuaaggaaagccuuuccugacccuuaaauuuuaacuuuuucaccucucugcagcaguuaugacauuuuucauuacauauuuaugugauuauuuaauauguguuucccauuagacuguaaacuccacgaauuuacacaaugccugggacacaguugguguuccauaaauauuuauugaacaaaagaaagaaagaaugaauaaaaugagcagagaauaaacagaaccagaaauaguuuggccgagacuccuggcuagauauuuccuagcauuagagggaaguuaaaaaaaaagauaauuucauuauaucacguaauuugaguuugauuauggcugaagagguugcauuauuuuccaaccauuuacuuuggagauaaauguaggcacagagaggugaaguaacuugcccaguguaugcagcuagucagugucagaugucuuuguuaugaccuuugaauuguguguagggagaaacauacauacaauauuuucacaacucuguagggcaucuuuggugugcugaguccuguaggagcugcaugaauauuugauaauauugauguugucaugucugcauuuuaaaguguuuuuugagaacauguauugcuguuuuuucuucuuguauaccaauguguucagaauuagauuggaugacagucuuaagaauacacaguuuauggccuaacgauuuguguguccugaaagaugguggccauaauuaggagcaguuuguguuuuacuuccaccagaaccgggcaaggacaacccuccuaauauucuuggggucugaggguaaggaaugcuguuuuggaucucuagccugucagcaaggagggcauauucaauuaucaagcuccaaaaaugccugugcacagaugcaaaacaccuagaguugugugaugaguugaugcccgagagcucccaaacugagaggggacacaagcaguuccacaguccucccuccuagauucugugacuccaguaaguguugacaauucacugguaugugaaauuaccucuccuuuuaaguucucuaauaaugugcagucucugcaagccucagccaguaccggagcuggguaaggcuaaauaagcuucccgaggugcuugccuggcugcugggcugccucccuggccgugccuggguccuugaguagcccucauuguggugugaggcagcguuuuuguccugcagguacaguagguacuggauuaaacaggucugcuguugcagacagaaaccaggcaccguucuagcacagagcuguguuuggauuggaguuuccagggccuuaucaggagccaccccuagugacacagccagugccagaacuaacuuugacuuucacucuucgccaagggcuugcagaacaccuuaaaggaaaaaagauggaggcgcuuagaguucagauguucaugccaugcuccuuugaaagcuuguaucuguaagugaaguuuuauucuggaaauaaucccgggaccacuuaagaggagcaguuuuuuuucucuuuaagggggaggauaaaggaagagaaggguuuauugggaguuaaaaauacugaagcuguuacuucucacuggcuuuaaucagcuucagcuguaaccucugguagguggcuaugacaaggauaacaacuaauuugggggugggggugggggugguagauagaaaugcuaacccaauauccuugcccucuccuuuaaaauugaauacuggucuuaaguuaauaaugacaaaaauaccgcgacugcuugaaaaaucugaguuagagcagagcuugauuuaugauugcaagauagacugcagcccagcuuuguuaugaauaaaacaggauuuucuucaggaaaacuguguguuuaauacaguaguaacauuuguccaaacucucccauuguaaacacugugaauuuuugguuucuccccccaccuuuuuuuuuuuuuuuuccugacuguggaaugguaacaguugcauuaaugaacaucuucuuugcauucuuguauauugauuuuuuucucuuggaaggggaaacagacauccaaacaucagaauugucugccuggcauauaaauguagaacaaguuuaaaaaauggcaauuucaaagaaauauuaaaauggagaaaaacuaaacagaguauaguuccccccacauccuuuaacauuuacuuucacuguuaggugauaagauuugaaaacagugcuaaaagcuguguccccaagugaauaggcauucaagcaaaucaacuuaugcaaaagcuaccucuggagcuuaaucauuauuuacugaacguuccugggucaugggagagguucugauuaagucagaaaggcauuauguucagcagcuugugaagguguguuuaaagacagcaagaauaauggaaaaauacuagauguagcagaucuauuuuuagaauuugauucuuaaaaaauauaaauauaauuaccauaaguuuaaguguggguuaaaguucaucauuuucaguagauacaucuuuaaaaggucuuauaaaagguaguuuuaaaaaugauuucuaacuucuugagcuucuauuucugcugcaguuuguuuuaacagauacuuuagauuuuuuucauucuuuaugucgucauaacagcuuaauuacucaccucuauaaaauguuagagcauuuucuaaacaaaguauauauaauuauguguuuaaaaugucacuaugcuagaaauguuauaaauuuuugccuuauuaaugagauacuagcuggggagaugaugucuacucuuugugauucauucucuacaaaaauauacucuaacuuacuaauuuuuuaauauuaauaauggauggcaugaacaaaugaaacuugcuauucugauucuacguaagaaugguaguaaugucaaaccugaauucacagccaaauuaauucuuaauuuugaauuucauucuuuuaguuaacuaaaauacuugucguaagagcaugcuucccuuauacacucucagaaugaaauucuucacaaacacguuugacaaaacuuguucacugaguuauugcccauuaacuuuucugugcguauucuuuuaggagagcacacacugugaauuaauuguuuuguauuuuccucuaggaaagaaaaggaacaugauagcagaaggcagcauucuagaauuuuggcucccuagaaaguaacuugucagcuuugacucguuuuuagauauuaagauguucagcagauaccauuucaggaauuaaaacacagacuagaagaauucauugccuaacuuuuacucauguccacaugguuugugggaacuaugcuaaguauugugcuuguauuaacacauuuaauuuucacaacugcucuaugaagaagauaugucuuuccacccccauuuugcagcugagaaaacugaggcuuggauaggugaaaaaccaugcccaagugauacagcuaagaaaugacagggcuaggaauuugacccagggauccuggcuccagggcuuaaugcuauuaucuguuguggucuguggauuuucacuuaagauacuaaaugaaucaauauuucuuccucugcuuuuuuaucuaguggguuucuccuaucccuagauuucugaauuaccaaacuguaacucauuugagcucuugaggggccguguuugguccugaugccacgguuuucgucuaccagguguauuucccugaguccaguucaccauugauuauaagacagcuauuggcugggcgcgguggcucacgccuguaaucccagcacuuugggaggacaaggcagguggaucaugaggucaggaguucaagaccagccuggccaacaugaugaaaucccgucucuacuaaaaauacaaaaauuagccaggcauggugucccgggccuauaaacccagcuacuauggaggcugagaaaggagaauugcuugaaccugggagguggagguugcaguaagccaagaucgcaccacugcacuccagccugggagacagaggcaagacuccaucucaaaaaaaaaaaaaaaagacagcuauuugguggagaaagaaacuuacuaaaauauauucauugauuauaugaucucuucugacuugggaaaucuuaacauguggagggaaaguuccucuuagaauuaaggaacugucguagaucccuagagcccagaguucuccgucucuggaugauucaagcaaaugguuugaauaagggugcaccaacucuaagguucuaguauuauuagauucuaugagguagaauauuuguugggagacagacaccaacuuuacucacugaacaaauauuuauuuuguucuacuaugugcuggagagacaauaugugaauaaaacauguaaacaucucugcccuccuggagcagauuggaccaggucaugaaggaccaagcacauaccaguuucaucccugagucuggcccucauucucaugguucaggauggcuucugaagcuccagccagugcagccagauuacaggagacaugguggcagaagguuuagagaaggggaucauuugaaggagauuuucuguagcugauucugauacucagccauguuuggaaaugaauacuaaaacauucaagaucaccuguuuguuuaguaggcgagcugggacaugagcccacauacaucucucauucuuaagccaggacacuuuccuccaugucugacaaaauucacauucucuuccccaccucuagucagccuggccagaggucugaaaagcccuucugauacugaauucaguguuuuggauggaaucaaaugagaaggacuacucacuccugccaaaugggcuaugaaaccaccccaaaacaucuauccauaaacugcccauggcuuuuuguggguacagcacaacugcuuugucauaaacaaaaggaaccgauaggcugaaucuauaggaacugccucccccucaggagguacuaugagaugggucguaugaagcuccuccugcucguaugacucacuucacaauaccucucaccccauguccuucuccagcugaggaucccacaaucuccuaagauguaaacuuuaaguuauguugaaauggagucuuacguagaacuccagaaaacaguuucggugguguucuugggguugucuuagaagacucuugaggaucuuuguucuuuccuauuuuucuucaccuagaaccaccauggagauguauauauuugaucuuuaauuuauauuaugcuauaguacaguugccguagucaguuguauuugaauuaauaaaaaaaacaggcaaaaaaaaaaaagccagucuguuucaucacaaaaaggaauucuuaagaauguuuugaaagugccaccaacugcacaaaucagaguugguaaauggauacacacacacacacacacacacguguguguguuuauauauauacacauacauauauacauguauauauacacacauacauguguguauauauguauguguguguauauauacguguguguguauauauauguguauaaauauauguguauauauauauguguguguauauauauauauauauuuuuuuuuuuuugagacggaaucucgcucugucaccaggcuggagugcaguggcgggauauccgcucacugcaaccuucaccuccuggguucaagugauucuccugccucagccucuuaaguagcugggacuacaggcguguaccaccaugccuagcuaaauuuuguauuguuaguagagacgggguuucaccauguuggccaggauggucuccaucucuugaucucgugauccacccaccuggauauauauauuuuuaaauggcagucugggugucuaacauuucagagugauuggcacuucuguuaucuacuuaaaucuaauuggcgaaacuuagcauguagccaguccagcucuggagaccugggagauguugugggugggagugugccuagccaaaacaaagagaaaauaggaaaauagaugggugcuagguuuuaugaauuguaggucuuaggcugaaacuuugacuuuuuccccaguauuacugauauuuuuuaaauguuacaaaaccagcuguaguaucccaggguacaucaaacuggcuuaagaaaaaauggaguuugauuggcccucgugaaguccuuguccaggguuaguccagggcuaucaugacuucaggaaugauuugauacaggugcucaaugucauauaaacacuggcucccucuuucuuuguuauuccuucucauuaguccucuguucuuucuuuacuguuuccuccaguuuggcuuucuucucggauagauccaggaaguuccagauuuacauccuaccagcuuuucaaaccuuaguuuaaagagacucauuuuaaccuaauaguuucaguugaaggaauagggauaacccuuacuugauugucuuggggcacaagcacauuccugaguuagucuuugugaccagaaggauggauuuccugauuggccagggucguacuuccaugucuggagguagugacaacaccauaaccucaugaacugaaagugaaggaggcugguuauucaagguuaaaucagguacuuuaccaaacaagugggacaggaugcugggcagcuauaaaugccauguggccaccauaaaucauuacugcuauguguaagguugccuguuaaaccaugacagguguacccauucacugcuccuuagauuacaguuuguacuuuugucuuuauuucaacacaauguuggaaacuuugcaucuugguugacgugugcuagacaugcaguaauuguuaagugaugguggucuaaggcuuuugaauuuucucugaucuguuauaaugucuagaaaaacagccagagcaugcccugugauuggaacaauuauuugaguacaaacagaagggcuuucuaccuuuaaaaaguuuauuccaguuccuuucacacucaugucugaauucugucauuaguuugucauuguguuagauuuuuaaaaauugcuuuuucuuuuaaaauacucucaguggagcaucuugccaugccguauuaauuacuuuaagggaugaauuucucaaagcccuuuaaaacauggcaguuagaugugaaugggauuccacaguuggacagaguaagcaagaauucuagaguacagucuagugaaaggaagcuugauaugaaaaacagaaaacuugaguguggggcacuucaacuuuaucugcuucauaaccuuucaaugguuuggcucucagaggcgauuuccuugaaaggaauugaguguuaagauugugccaacccauaauggcaucuguggaaaauggagaucagucguggucauaaaaugaggaaauggcaaaguucauauccuuaguuuaaaauaucuuuuaguaagaacuugauauuccucuuaguuggaguauacauaagugagacacacuuugguaaaaaaaaaauaaccaacuuaaaaaaaaucugcugaugaaaauugccuggaagagcauuguucguauguuacagaggucucuaaacauuuuugauccuucuuccuaguuaauuucuuucaagaaaaccuucucaacacauuuucauuugauuuauaaguuauguacaugugcaacuauacuauuauauaacauguacaaaaauaaaaaaugaaagugauaauauaaaauauauaugaagaaauguuuuaauuuuuucuuccugcacccagguugucauuuuugguauggauuuuuggagaauacugauauauugggaaacuuauuaagguucuccuugauuuuuaucuaaucagucauugagauuagucuuuccugguaccuguugaagguccagcuuaaaaaaaauguggagaauccugaauggauaugaaacaucuuccauuuuuagcagcgaauugaggucucagcauuagaaagaaaagacuucagauuuuaaguugugugugauuggugguucuuaauuuuuagaaugcuuuucucccuauguacugugaaauguacaaagcucuggagauaggagcauuguccaguugcgacaccaugauauccugcaugucuagcagcaccuagcuuuuggaaagcauuugcguggggcaugaggcuauguuuuguaagccuuuguauuuuagcuaugccagagaccuggaguauuuauuaucugagcugcucauguuacccccaaaaagguggaaucuuggcagaucuccauucuuuuucuugaugacuaaaacccaaguuagguguugacagaaguccagaagaucucagugugaagccgaacuaugauaucugguacuuucacauuuacauggguuacacucccagcuauuuuaaguacgagggaugauauaguuucuuauuaguauuuuuuuccaccaugcauggugaaaaacucauccugaaucacuuuggaaggaauggaaaguuugagauaacagaagugccauucacucugaaauguuagacacccagacuaccauuuaaaaaaaauauagccauuuaccaacucuuauuugugcaguugguggcacuuccaauagauuguuaagaauuucuuuuugcugguggaacggacugguugggggcaguucuuguagauucaaccuaucaguuccuuucauuuaugauaaagcaguugugcuguacccauaaagggccguuggaaguuucuggauagauguuuuuguuuggucucauagccuauuuggcaggaguaaaguagucuuucuccuugugucccauccaacauguugcauucaguaucagaaggacucuucagaccucugggaaggcugauuggaggugagaaauggaaugcgaauuuucucagacauggaagaaaguauucuggucuaagaauuagagguauggguucauguuccagcucuccuacuaugcagacaagugauccuggguauuuuacuauuaguuuccaaacaucggaaucagucaagugucagaauuggcugcagaauuuuuguggacauauugauuccugggccuuaccuaaacaaaucagaauuuccaggaaugaggcuggacauuuuuauuugagaugaaguucucagcgaauuuuguuuuucucagcuagccuuuugcauuuugaaaccccuguagcuuaacccauacaugacauagguuucuccuuugcccaggagguuaacacuauugaaccuuccugugucuucacuguguauaugaauauccaccacugugccuccuggacauaaauaaauuguacaucagugcaaacaaauacuaggcuuugagcucugucaaccaaaugacuaugaugaagauuauuuuuuacugaauaaaaaugcuacaauuccuacuuuauagcucaugagagauuugcagaauaaauuaucuucucucuccaucccugaaaaaguuuuuugaguucucucauuuaaauggacauuggcuaaacuuuacaagacauaucuucugugguccaaacuugcacauaggcauauaaaaaguagauuccuuguauccaaaagaagaagcaugcucaugguuuaauauuauuauuuuuaccacuaauuuuugaacuguauuccaguuuauuggaccauguuucagucauugugcuaaguuuuucuaucuauuaaaaauuuuaauccucaccacagugcugagaggcagauguauugcgaagcacagagauagacuaacugggccacagucacaaguuaccgcacagcccagcugaacucugccugaggaguggacuaaaggaaacgcaaggaaaaguagaacauugcuuuagcgucucuagguuucuacugaugaccagaguacugucuuagaggacugugauauugagaccaaagaccagucccuaugagauaguaaaagaacacuggcaucaugucaaaggugaggggugggcagacagauguuuggaugcuggagcauugaauuuaauggaauuucugauauuguuagguggcugacaaagauagaauaaaguauugggauuuagcaaaacgucagauaguucagagcccauguccaaaauaccuauaccaucacagagaagagggaggcuuugaagguuaagaauguaaauucugccauagagguaggaacucaggucacauuugguggccaucuggugucuguauaccuccagccacugugcugaacacuuuaauuuagugaacauuaacugacccaaucccugcagcacauuaaaaugcuggguuuuggaaaagcccagagaggucaaguggcucauuaaagcucaugcagcucggcagugacugagcuagcccuugaguccaaucgguggcccuccuccucgagccauugcugacaaauucccaguucucaggggaguugugugccuggcuucagugaugccgauacaugccaguaaaggcauuugucucucugcccaucggcuuucaaagggagcuuucugauggugagaugcccaccuucccaugugggacuugaucagaguuccguagucuagguaacugacuuaauuuuaaggcgucucagaagaauuaugugacuguggcuuuaaacucuaugagauuagaaaccagguauucccagcaccuggcaauaacuauuuguugaauaaaugaccuuuacauaaucugauuaaaaggaaucagacucauggaauuaggauuaucuagcgaagauucagcuucauggccugggaugaguucaguuagcuuuuaaaauuaaauacauuuggacaucucuccuuguguaucauuaguagcuucagcaucacguccucguuuuaaaaaauaagcauuguugccacuuguaauguucucacauaaaccucaauuuggagcuuaagacauuaugcucauuuguccugcuaacauugugacaugcagauauccuuguuuuugucuagaaggugauaauugcagauucaguuacuucuaagagaaagggauguuuagaagauugagagcaaagcugagaaucugggagucaucuuucacaauguggaaauaucccgcagggagugugugccaugaggcgacucuaaugcuuccuuugcacuuuuggguuuuuuugcaggaagauuuauuaaaacacugucaauuaacugagcugugcuauauuuauauaacuauaaaaauauauuugcucuauuuuuuagugggguuucuuuucacuuauacuggucuacuucauacauacguauuuuuuuuucagacaggauauuucagaaaaugcuuugaaugauauuguugucgacuuucacguaugaagacuuagugcaguugauaacuagaaauuuuaauuuaagaugucuuaagaaugcuuuacuguuaauugaaaggauuucuucccccaguaucacagccaaugacucgucuugagcagcuaauuagugcgauuauuccacagcugcauuugcuacagcacaaagguuugcuucuguuuuuaucaaaaggaucagucucucugggaauguuuuaaccugacaggcuuugaauaguaaggccgcuuauuuauuuauuuauuuuaaaauaacuguuccccccgcgcuuccccccgccacccgccaugccccucaucacagcucuccuucuuuucuuggcuuaggaagguacauuugagcuuugaacacauacucuaaaaugggaaaauacauuuuuaaaugcucuuuuaguagagcuguaucaagugaauagauuauuuuaagugaguuagaauaauggccaagugcccuuaauauguggaugagugcaugauauuaaauaauaugcaagguauuaaugcuguucgauuuguaugugucuguagaaaauguaggaaaacaugaaggaaagaggguuuguguuuucuggaaugcugagcacuuccaaguuugccaauguacuggauauauucaccacuuucccaucguauugucaaaguguugucuauguuggauucuguccccuuucuucuagccaaauggugauuuugaucacucaaguccuuuuuucauggucuuaaauuagugucuagaggcauauauucugccauugaaaaaauacuaugacuucuuuauaguugaggggaguaaaaugauagaaagauaaauuuaccuguaguucuauucucacccuggcaacuaucgugaucuuuggacauucccuacuaaucauuuugcauacuuggauacaugcauauaccacacuuauuucaaauuagaauguaaauauacuuuugaauccuacuuuuaaauucccucuuguuacauacauuucccacuuuguucuguaguugcacaauuuaaaaaaauagguaguauuuuauugaauucauauaugauaauguauuuaaccauucucauaguaugggacaaauuuuuuauuauucauauauuuugcaauuuguaaagagcuuuguaauaucaguuuuugcacauuuaaguuauuuacuuaggaaaauuguccaucacaacauuucugaaucaaauuguaugaacaauuuuuagcuuuuugguaguguuguuaagcuguuuuaauauauaccagcaaugguguagaguaacauuauucuuaugcuuuuuguugucauagacaguuuguuuauuaaaaaaaaaaaaaaaccuuggaucuuaccuuaaauacuauuuuguaucuggcuuuucuaaguucuuuguauuguguaguuuuauucacaucaguaacuauauuuuuacacuaguuuuaaugguugcaucauguuacauuuugauucucugacaauauacugagccaauuuccuguugugaaaauaagcgaacuguuaaauuguuauuguguaguuuuucugggauagcgugaggguaaaaccaauacuucuucauccccuagcauguuuuguuaccuucagagccugaagguuccugucuuuaaggagcucaugaggauggucaaugauauuuaaggcuucauuuugccuuuuauuagaagguaaaagauaauaccagaguuuauauucaaggaaggaaguucaaaguacaaauacuuaccucgaagcaugacuuucucaagagugaauauuuucucaaauguuccuuuucuucuguuccaggugcuaagguuuugaaccguugaccuaaacacagacguuaaaaaauauauauagagagagaaauaaacaaugaaacauuuucuaccuauaauaauagugacagcaaacauuuguugagccaguacuacaugguacucauuguacuagggcauuuaugugccuuguuuuauuuaaucccccaaaaucccuaggaaguagggcuuuaaaauauacaugaugcuauagaaauuuuaaaagaacagcucccaccuuuauaaaugguaaguggguaaaaaacuauuguuauccuucuuuuccggauacuaagacagagagagauuuaauaacuugaugucauagagcuggcaagauaaguuaucagaaaccauauuuaggaaaauuaggaaguuuuuucuuuuuaauuugugaguaggguuucagaauuuuaaacuauuuuggguagagugaguaccaaaaccauuagaaguaguccucauggggaaugcacagagaacacauuguaacauaguagagggcaugccaaggugaaucagaagaaaagacagcacaaagaaaaccagacagagaaguauuggcuugucagaccagcucgucuucugcccccuuacccaaagagcgaggucgaguucaguguuaacauucuggcccaaaugcuuccuucauuaauuauuuuuacuuauuuuaucuuagaaaaauuuccucuuggcaaagcucaccuuuucuuuaaucaauauuuguuaguaaacauuuuaggcaucuucaaagaacuuagauaacauguaggaguaguuauuugguuagauucaguuauacaaaaaagcaaaucaagcaauuuauuuuuaaauguggaaauuugggugccauuaagaugcuuugcuucuuggcagugcauaugguggcgcuauauuugguggugaugaguagugugcagcauaaaauguaaaaaaaaaaaaauuaaaaaaauuaagccgccugauaaaaaugccuugaugcaaucaagcugacuuauuuuaauucaacuacuaaugacuuaaauccugucaccucuugauuuucaauuauguggaguaccauucugugacuugauuauauuugcgcagacucauuuuauaguuuggugcaauuuaggauacccccaaagugcaaacgaagggucucauuaggaaacuaaauguuguaugcauuuugguuuucccacagcaguuccgccgagcauccuggggccuccaagccuccgauaagcuccuccaguaugacaucacgcaucuugcuacgccagcaacucaugcgugagcagaugcaggagcaggagcgcagggagcagcagcagaagcugcaggcggcccaguucaugcaacagagagugcccgugagucagacaccagccauaaacgucagugugcccaccacccuucccucugccacgcaggugccgauggaaguccuuaagguacgugaguguugcucuuguugguuggaccaaacucucuuccauuuuccauuugcuagguguuuuguuuaucugaauauguauuuuguuagacugacccuucagaauuauauuugaaaacuccaacucccuuaauucuuacguggcuuuauauuuuaaaagaaggaugcaaacgcauuguaacuguaauaguaacaaucaguaaauggugggagucaauguuccaugagaaauugcaaguaggaauacauguuuguugugaugacaucuuucuuugggaaaguuucaaaaccagaauuaucugaggugggccucuucugauaauuuguguaucuuaaauauuuuucucuuaaauaccuuccauagccacucuuuacuuuucuuuuuauuuaguauguaauauugguuguaaaaucugacuguuuuagagagcucuucacauauaagauugaagaagagcuuucugcgcuuugauaaccagacuacauaauccuuuuacugaagugaguugucugcuuugggucucuuugauuucuugcuagaguagaaacugcaggagcuuguuagcaucauucgauuagggacauauagcuuccuaauuacuaaggaaaauuguaacaagucuaagaauagaauuccaucucacacgugucuuccacaucacauagggagauacuccuuguuuaagaauaaacauuucaguucuuaaauaugacugauucaaggaaaguuaaaaggaaaguagaggaacuuccuuauuuuuaguuuuuuuauuuuaguaccugcucaccuaauucugaaaagucucaaguguuacuguucauuaaacaaugugaacuuuacagaccggugauucauuauugguuuuugcauucauccaugugcacagaaaaaaugucucccauuauuuaaaguuuacuauuaaaguaaauagagagaugauguguuauaaucaggaaucaaucugugaaccuuaccaggaaguaggaaagagauucuuuaaaaaacaaaucaagagucaauuauuuuuuauuugcgaagacuuaaaauauagugaugcaauaauggaacucggaugaagaaaccaacugaaauuggguuagggaaaaaagauacaaauaguuuagcauaaaguuuuacucuaaugugauuguuugaaauucuggauauugccacaguuaauggauuuuuuccucuuucuuuuuuuacccgucaguuaacucaagguuuucucucuggaguagaugaugcauugaaucuuucuguucugcuugggugaaaauugauaugaucacuaaguuuuuauagauuuaagaauuauuuaagauuuauguuguugucucaugccugcaggggugauaaucauuguguauaccuuagguuauuuaaaauuguaugaauuaaauaguaacaagauguggagaaauaugucuauuuuauucaucauaauaguucaccuuuauaaucuguagggcaaauuuuagaagaguugccauggauuugggcuacuaguggguuauauccaacugaagguaauguuaaagaauuuuuauuaaaaucaauauuccuguuaaggcagcuacaacagagaggaaauuacccaaaugaaaauguguugaaacaucauuuccagauuaucuuaaaagugagcauaauuucuaaaugcuuuugucacuguaaauauauuauuuuugaaaaugauuaaaguuaaaaucuacauuaaguuguuugaauaacauaccaauauuuuuauauguugcuguguccuggugacacuggauugagcuacaaccccuaacuuauguaugccagaaaaauguccaaaguuaaagcacaaauaaauuguuacagcuggacgacauacucuaacuaaaaauaaguauuagguaaauuucucuuucacucugaauauaguuccugucuauuuaacuucugcuuuuuuauauuucaguuauauaaacuaguaaacuaugucauauaaauaaaaauaaggaauuauugccauagcuauaugguuagguuugauagcuauuuagacaaauuuugguauucuuaaaugaagaaacaaauaagaauacacgauuuuauuaagacaauauuuuaagaaaaucagauaacauuuuuaaagagaauaucauauaagugauugcuucagauacuuaaagacuuaggacuucauaaauauaguuggcuuauuuucaaaauuuuguguauaaaaguauuaugaaacauuauagaaagauaagugagagaaaggugguuuuuuuuuucuuuuuuauaguuuuuaaaucauaagcauaauuuugugaaguaagugguuaauagcaaaacaguuaauaugcuuaaucuuggaccauuuauuucuccaugaauauauauuuucaaagaaugguaauaccaaguauacuaauugagugcauuaugauacagauuauauugaauaaauauuuucucauaguauggccugaguaaauucgcuuaauuuuuaaagguuuaacuugcuaaaacagaacaugccugcuucucaguggagguagauguauacaauuagucacacuugcaugcacuagagaaucugguuaaaucucuccgucucccaaguuguuuguaagaaccagagggaagaaaggucauaguuuaguuuucauacacacacaaaguuaaguuaccaacauucugcuaucuggaugaaugacugauuucaaaaagcuaaagcaguguuuucagguuaaucccuuuuuuuggcagaguaaaauuuaaaauaugaagcuuuauaaagcauguuuaaaaguuauugacaucugguaaacuuaggacuagucagauuuuggguuagagaucgaaaaucugcaccacucauuccucaacguauagucauugugccgugaguaaguucaugaaucuuuguaagauuagccucugguuucuauauugauuuaauaauauaugaauuuuccuucauauugauuuucauuuuuggggacauggaaucaugagucuuauugcuauauauuuacauaguaaagauauucuccaaguuuuuuaagaacaaccuuacccaauuggguauuguaauuuaaggaugcucuuuuaccauaaauuaaccaacaccuggagugcauaaugcauuuuuuuguaauggugaacacacccuguauuuugaguugugaauuaacaacaacaaaaaaaaagucaucaagaaccauuaauggaaucaguuucuuccacaaguggguuuugcugacaugcaagucaugcaaaccugaaguuugaaauuugauguagcuuuuuucaaacaaaaacagaguaacgggacagaacuguaggugaguucagccuuauagcuaaagcaucacgguacaaaccaccaaguuaaucauuuauguagucaccaagcaucuguuuucauaguuuugucucucugacuuugaugaauuauaaaagcacuggucgcucucauccuggacuaaguucaucaggauuucuuccccuacuaccuucccaagaugggcuuugacgguugaaagcuugaaaacauuaguuuacaguuugaaaauguuucucuguucagaaaucugaagggaguugccaaggauuccccacuaccucugucucucccucccuuccuuucaccuugaaauuuaaaauuuuaaaggcaaagucgaagugucuucucuggaacggauugucccuugaauuuuucuguucugcuuaagggaaagguugcaugaauuuuaaaaggaaaagauuuuuuuuauuacuuuggggcauuucuuaacuacuuugaaggaauuuauuuuuaaauuuucccuuuucuccaaaucaucucaagaguugcgcaaauugcucuguaauuagugaugaugcuugcuguuugucaaauacagaagcacuuuuucugggaccuucuacauuguaaacuaaauuuacgugggcauuuauuuggugguuaucucgucaaaguugccucucauuuguauugagauucuagcgaggugggcuggaagcccugcuccuuguuacccucuuucaaaaacugacauuccauauuucacuagugaggggaaggguuaauggcugaacuacuggucuuucucuguaaauuaugaaaucugcauggaguagaauuuucaaggugugauuuauuuuuuagguauaacacagaacaugaaaauguguguggaguuacagguggauuggugggcuacagauuggcaaaagggacuucucccacaaccuacccuuagauuuuguuucugguuuauuuagccaggaauacagacccuaaauagcaucaugguggcugcaagaagccagaacagauguagugugucucagaucagcuugccuuuguccccucaguuaggggaucuguugcuagaggugucacucucauaaggugaagaccugcuaugucuaagauuucuucuuauagcauaguccauucacacauggaccagcauauacuuaugacccuuguaguuugacuuacacaaacaaccugucagccuugauuucagggaucauuuauaaacauuguuguccuuuuguuuuugaaucaauguuggugucugcaaggcuacauccucauucagggggagaaagggacucagauuucaggucaacagacagcucuucauucucccagaaaccucauuucccugcagaaucugaaucauucagugucacacauaagguaauuuucucucucuuuaaaacucacguuauugacuuuuuaaauugcagauaauacuuguuaacuuuuaacagauuuaaacaaugcagcagaauaguucaauaugaaucucacccugccuaccaccgccucccuuccgucauguucccuggaaggaacgacuguuaacaguuuaggaugcagccuuccuguuauuuucuguuuaauaacccuaccaucaguugccuuuuauaggagcgaggucugaagaaauauguuagucacuuuuuaucagguagacauaaacccuuuauuuuucuuuguucauauuugcaaauggaacaaaaaaauguauaauuuauuuuccuucuggguugucucuaucuuuaagaaucccgcuucaagguccacucuucccuaugugcagugaggacuucucacccugugucuugagagcaguuuaauugguucaauguguaaguauguaccagcuugcacggcacugaguggcagccccuuugcuucccaggcugcuuuaugaacacuugggggugaggauuuagugaucucugggcugacacaagaaagugcuccauagaguugucuuacuugguaaagucaaacuuaacacaggcucaguagugcaagaauugcaauaagugcaagaaucacaguaagugcuuuuggauucauguuggacuugguuuuucugucugcacugcuuuuagugacuaguagcuaguaaugaaaugcuggcugcagaaagucaucuucgcuuaaauuuuuagguuuuaucuacuuaaaagagcagaccgaugagaccaacuaucugaaacaaaauauucagccuuuacacaacuaagccuaugaauuaaucccaguuucuggaaacauuggaacuucagcucuaauuacauguucauugggcaauauuggcacagaauggaaaugauuucucccuuuaugaccacaagggcauuuucauguaacugagggguacagcacaaucuggguuuuguacagcacaaucuggguuugauuucaucagguuguggauagggccugauguaccugguggacacuugacuaguagcuaguaaugaaaugcuggcagauacgcaacauggcgcucucucuuuaaguaggagaaucuuugccaucuucuccaugagccccuuugcaaucacugaauucauccuguggguuucaaagagaagagacaccuguuuggcuccuccucguuuucuccuguuagaggaggcuauacuaauaggugcagucuccuuucauuuacacaguucucauaauuccauacugccagaggugaaggcaguaucauaaggaaaauauuaaggucuggggccuggaagugagggcuaaaaacuggagugggccuagugucaucugacucugaaugguaauuucuuuuuuaaugucaugagaccaguagaacgugcauccucaacaggggcgaagucacuccccacaaguaggacaaaaauggauuguuggagggcaaaagagucuuagauguuacaaugguuucuaaaccuccaaagucccaguacauaaaccgauaaacaguauaugugucuuuuaaaauuuuauggugauggggaugaaggagaagcaauuaggggaaaaaugucuuaaaaggcuuuuuauugggauacuaaugaauaaaagauugagaaacauuccugcagaggaaccagcaucuuucccaauucuuuguguuuuguuuagggaccauuuguggaggcuccuauagaugugaugccuauauucugucuggucugugucuccccaggaaaacuguuaugagaacaaucaugaucagcaagugccagcauugaacuuuaccuguauugacucauuuaaugccaccauugcucugugagguaguuauuauuagcauccccauuucacagaugcaggaacugucacagaggggucaacuaggucaucagaaagucacccaaguagguggugcagucaggauuugaacucauauaguugaacuccaugggccacuagugguaauaccucuccuggagggaaugaccugagaaacauuaggagggagagauagcaauguucagccucucaaaugacacgguagcuuggggcuuguagcaaauguuuacuacagagcuucaauccauagcuuaaacuuuuauaggaauuacugaugugaacgugacacuaccugaagcaccuuggaggaggaaaggcaauugugccuccuugacaacguggauauuaauuauaggguggauuggauggugggaugaacacuucaggucuuuuagcucauuuauuauuuuaguaaccuuaggaaacaaguaggauaagccuuauuuuccagauagggaaacugaggcuuagauuaucacugaucccugguuacauagacuccacacacuaccuuauuugcuuauaagcacacauccuacuguaaggacaugcucuaaacauuucuaaagaaucaccaguaacagaauauauuagagcaaaaugggaggucaaagagaaacuacagaggagucucacaggcuuaacagaaagauacaugagcuuaagcauuugaauuaguaaggggcuucccuauugaauaguuaaaauauccucaugagucuccacaauaugccagaugaaagaacuggauguguuuuuauuauauaaaaaagacuuccuggccacauugacccccgugguaauuuaugcuuuauugauagucaucauuauggguuaaaaagcacuacagugaaaguuucuauaacaacauccaaaaaucauaacucaagucacuuauauucuaaagaucuugaugguccaugcuauuacaauucauaugcuuuauaguucugaguauuuacuaauauauuugcauuguuuuagaugauuuuugaaauaauucaguagacucacacacuuuugauaucaauuuucuucugaaauuauguuugcauuuuugguuuuuccuuucccaugcaccuugcaauauuagagcucuugccauauuuuagcacuuaacaacuggaacuucauuucuggugguuuuucuauuugcuuuuaaguaaaugucagugguaauaaaucuucuauuacuauauugaaaaagucaugagucuccuucacaaauauuaccuauuuaaucccaacaauuaaagaaaggacuuagcuuugaaagaccacuuaauuugaaagacucuucaguuagcacgcuuuugaacagagauugugaacauguguaagcaaaaucuaauuuuaacuuugcucuacuaaaaucggugggugugaucuguguuaaaaauauguaaaucaguacaguggcuucacucaagguuauaacugcaaucaguacuagaauauuggcucuugcccugaaugugucuccuuuuauugacuucuuugaggaucagcuugaacuuaaaaaaacauuuagcuccagauaauauaccaguuauucagaucuuauuuauaaauuuagauguuuuuuguuuaguaauuuauaacuuuaugaaaaggaaaugaauccgaauuggagcauaugaaucagguaaagcagggggcuguuaaaggagagaaugguccuaaaaaagaaauuguuuuaauuacucuuuuuaaaaauagggaauguccuagaaaaggguauaggugaaucuauaccauuguuucuaccagcugucucuggagugaguauugggauuggaagcggugguggucaaaggcuuuaucauuauuauuaugauuuuuacuaggagagcauaugcaugcauucuuuauguaaagugauguccugaugcauuuuauuugagucacccacaacuuuuugaggagcacaguucuucugucagguguaaacucaccaguuuacuagacuuagacacauuauguaacucuaguggucuuuccuagaagaaagauaacaagguguaggaauccugcaaauucaaagugagcaaaaggauuucaaucacccggucgggaaguaauuuuuaaaaguaguuaagaggcccaaaaugaaaagcaaaauucagacuucuauuaccuuacuaccaugcauaacucuguuguaaucuccccuguugggccuggguuuuguauaauuaaaauuuaggggcuggaaauuuuguugagccuuaauuggaagugacaaaccagagacauuccugccaguuaggaaaggcuuaagaaauucuuauuggcuaaauuacaaauauguaacauuuuuucugaacacugcaugguaguucagacugccuaaaggugacaagauuagcucuguuuuucuagugaaguaguaaaaauuagauuaauaaguaccaggcaaagaaccuuuucuuuuuuucuuuuuuuuuuuuucuuuugaaagaaaucuuaccuugaguacuucuggcuguggagaucggugccuuaauuagccacauguucuuuuuaccuccugggaaauaaguacgggauaaaauuggggaucaagccguagacguacauugacuuagcacacgccgcuaaguaauucaucaaggaauguugguaauuaguccugccucuuucaacucuuggcuuauuuuauaaaaccgguugauuuaaaauaaugccugcugauuuauuacccacacguuucaagacugguacuuggcucuuaaacaaaagcaauauugugcagcgauggaaaugcgcccucuuguuuuuguguuuuuacaaauucugaagggccaucuauggccccccuauuaacuuuguugccuuuccuuuugccccauucagcauuuuacugggcuuucuuuucugucuuggugaagagaaaaggggaacaaauuuaaaacaaaaaacgaaaaaauccaggcucuuagagauuugggaugugaggugcuugucaaaguguauuggcucggugugauuugauggaauuuaauuugaauccuucgucugguaagacaggcuguaguaauagccuuugguuuuuuuuuuuuuuuuuuuuuuuuuugcauuguuaaauguuuggugauauuuauggcagccaggcuaaucuuaaaagaaugaauuuaugagaagcacagaaccucaugacuucagccucuuacccuuaguauccaagcacuguagugcauuauaguuugaaugccagauucccauuaaugcuaacugauggaccucauuaugcuuugagaugagaccuuaaucagggucccuguugaaaaucuacgauuaggcugucuuugauucauaacucugugaacuugggcacauuuccuguucucucugggucucaguguccucaucuauaaaauggagguaauaauacucgcccuggggaguuuuugcgagaguuaaaugagauaauucacgaaagcagugcugucugauagaauaugaaccaaguacauaaauucaaaguuucuaguacucucacuaaaaauaguaaaaaaaaaaaaaaaauagugaaacuaauuuuaauguauuuuauuuaacccaaaauaucuaaaauaucacuucaacauguaaucaguauaaaaauuauuaacaagauauuuucacauuuuuuccuaagucuuugugcugccuuuaaaauugcauguauauuuuauaccuccagcacauccccaauuuggacacuaaauuuucaucagaaaauuuauuugaccuguguuuagauuuuauaaaauguauaauugaaaaaguuagauucauauaccuaacuuguuucaaacguauucaaaagauuuccaauaaauaaauugaauaugucuuuagauuuaaauuaaauuauaugaaaaguucagucugaaugagucugaacaagccacauuuccagugcucagcagccacacguggucuuugcauuggacagcacagaacuaaggcauuagccaaguagauggaaagugcucaggaaaggauucugcucuacuguugguaauaauaaaucacauaaugauuuacaauuauuaaucacacgaauauaaaaauuauuaucuucucuaaguugccaucuucauaugccacuauuguaccuacaaaguauuacuguuuuccuacugcccgccacaaagaaaacacaaaaaaauuagucauuauuuucuugcucauuauuuggagcccauguuagcugacauaucuuauguaugguugauauuuccugucaaaaacagccucuuauaggagaaagcagcaacgagucacccuugguaacauggcauuuugacucaucucugccaauagccuuccauucagacuugagcauggugacagcccucaacuuguuagccacacaucuuacucauacucucaauccagguucuuuucaaaccuacacauaucacacuuacauagcaccuguccgguguguuaaagaugucuaaagucuugcgaauauaugagcauuuaaucaauguucuuggugugagacagacauuaggggacaaggagauuaguuaaucauacauuguucuuuaccauacauuacauagauugauuaacaugaaggauauugaaaacuagguuuuuuuggugggguuuuauguaugauuuuuauuugugcugaugucucuaaggcaauuuucuuucuuaguuaacuugcgguauauuuuuaggaaauuauagcacagcucauaaugcaaugaaacaguucuuuaguaauucauuagauaaccaaguuuucuguuuugauaguaauuuucaaccgcuuauuaaaccagaaauaauaccuaagugauaauuuauauuuuguuagucaccuuuucauuccuaaugcaaacaaugagucaauuauauuggaauuaguaaacuguguuagagagauuuaauguguucuucauauaauacuaagagccuauaaagucacauucuugugcaauuacaaaaagcaagaaagccaagggagcaaaaauguuaaccaugcuaugaccuccagaaagaaaaaucaucacguugucagauuucaugauuuccuuaguuuggaguuagaucuauuuucugagucuguauuaaucucaauauuuucuuauuaucuuccauuaacauaaguuaauaaacuuucaggccauugcaaaguugauuucaguuuuccaguagcuuuccagguuuguuuuaaaaucacauaccuaaauaauuuuucaacuaaugaauuagaagaaucuugauagagcucauaauacaauguuaugaauaugggcaauugugaccauuuuuauugacaccugggacucccaaugucucauagagagggaagacaaauugaacauucugacaagacauuuaauuuugauauaaaaucucuguucaucaguuugacaugaagcuaagauguuuagaacuuaaccucaaaugguggaaagcauuguguaacucagggguucucaaagugugcucuggaaccuguagccacugcguccccugcgaccucguuagaaauacagauucccugugccuaucccaggccuacugaaccagaaacucuguggguggagcucauuaaucuguguuuuaaccagccuucugaaagauucuaaaguaugcucauguuugagaaucacugcuguagaaaccuggagguuaauuuguaagaaauguaagaaaaauuagaaaaugcagaggcaaauaaagucaaauaaauuucuuuacuguagagccucugagauccuuuaacauguaaagaguuauggcaaaucuccaacagugguacagugggcaagcacuuugagaagaaaggggaggaguaagacaggcaaaggaaauguugccuugaguugcucaguggaagaugcaaaauaccuaauagcuauuuaggguaucuuguacaugugguacauucuauuaugugcauauauuuaugaaaaguuuauaaaaauagguuaauucugucaagucuugaggaggugaauugaggauaagaaaacaauaagaaacucuaaaaugacuugcuuuagcacugggccuuuccaggaacucugagggucagugaauccauuuguccacaaauauuuguaaauuaaauauguaugucacauauguaccauucaucucuuuuacuaauaaauguagaugcugcuaugauaaaguacaaauugauaucagagcucuauguuucauuuuuuuucuuauuuuuaggcauuuuccugaucaacaaaaaccaaagcacaacucguaaucaaauagggccuugaaauauuugacuuuuaaaaaugauugaaagcuacuuaaaaauauuauuuuuuguuuuuuagacuuuauuuuuuagagcagcuuuagguucacagcuaaauugaccggaagauaaggagauagccauuuaucccugcccaugcauauucacagcuucuaaccccagagugguacauuugcugcagucagggaaccuagauugacauaucauuaucacccaaaguccaaacuuuauguuaguguucacucuugguuuugugcauuccaugaauuugggaaaauguguaaugacauguauccaccaugauaguaucauagacaguauuuuuacugccauaaaaauggucugugcccugcuuugguugcuccucugaagaaaaaagccacuuuucuucaggaacuguguuuuagcuaucaagaguuauuuaaauucuacuuuuagaagcuacucuuuuuacaaaauuggauuuagauaaaugguagcacaaaauggcccuuucagagucugcagaccccugacaucuguaauucccccagcaguaggcccuucauggucugucucugacaucaaaggucuuucuacugacguggcuguagucuuggcuuugucuuuuacacuggggcauugacaucaagagaaaguguuuuucuuccuuucuccuuucuuuuuuuguauugguuuucugccugaaggcaguauauccagugcauguggccauccugcccuuucuguugaaauaaaacaaacggucauuuuaagaagcuccaugggaaagaucaacucuuucugaugcuggaguccuuaacaugcacguccagcacgaugaccaaguacagccuuaggugagaucuggcucauauauagccaugaagugcacuuuucuuccaccagaugauacugauugccuucucaccuucuuaccucccuuucauaguuauaguccaccuaguaagagaagaaaaggagaaaucaccauaagauauccccugaggacuucugcacuggaucgugaaccuuguuuccuagaccuacuuuucuuuucuguuaggguuugcauuuuucaauuaaaauucauucaaagaacuccugcccagaggcauuugauuaugccuacaccugcuaucuaguugcaguguugaaaggcaugggcucuggaguuagaucgggcgauauccauauguuuucucaaccugaauucccuuguuugcauaacagagauaauaaaggucccuagcucauaagcuugcucugaggaguaagugacaugaugcuugcaaagcacuuagcacggugccaggcgcaauacuuuuuaaugcugaucacugucaucagcauuucaaccagagacacacaguccacaguaauugagccacauaauggguucuugagaagugacuagaagguuaaugcuuugguaaaagauuaggaaaguugauucuaccuaugaucuagaauuaauuucucuagagaugcaugggauguguaaagauucuuuuaaucaauuacuguugaauuacauugcagcagcaaggaauuuuaauucuuaaaaacuaccuggcuauguagauuccucuaacaguaauuuuugggggauaaggaguagugagaugcuuggccacaguuuuuaacuuucccccaaauuacacccacuacauaaaagacuuauauguuguuuuuaaugauugacagccaaauuaggcagcuguuaaauccuuacuuauagaaaauucuguggaaagugguaaaaauugggguuaaaguuucaagaaaaauuaauagacaucaggcuaucaaaauguuucuugauucugaaauuaaacuuucacuuauaagcugagaagccaacaauuuugguucuagaauacagguuacauaggagugaccauauaugauuuuauuaacuguucacuuuugaaagccuuauuauuuuggggaaacuugaagguucaaaauacauuuaaucacagccuuucgccccuaagccacagggccuacauugcagaaccagucaacugaugaaaacaagugaucuguguucagaguguuuucauugcuaaucaaguugcauaaucauuuuuaucuagucucuaaguguuuugauucauuugcuuuggaauuacucgacuucuuccuuacaugauauguccauuuaauuuuauuggacugcgcugugcuggcugggcacaguggcucacgccuguaaccccagugcuuugggaggccgagguggguggaucaccugaggucaggaguucgagaccagccugaccaacaugcugaaaacccgucucuacuaaaaguaugaaaauuagccaggcuugguggcgggcaccuguaaucccugcuacuggggaggcugagaaaggagaaucccuugaacccaggaggcagagguugcagugagccaagaucaugccauugcaccccagccugagcaacaagagugaaaaaaaaaaaaaaagacuacugugcuauccuaacuccuccacuccaaucucuguaauuuaugguacaaguuuaauuuuuuuauucauuuguuuauauuuuuuaccuuuuagaaacaugucaccuugacuguucuguagucaguucuaacuacuugcugaccuuuauuuuugcuauuaaaccauuuaucuuccauuacauagacuaucuucagauaagaccagaggccauucucuccaaccagucuugcaaaguucacuacuucacaauugauacugcaaccaugaaaucaaacaugccucugcauggaccccuaguaugacccaggggaaguugucuuucuggguguaggucuccccaucugagucgucucagacuucccuccuagccuggacuuucagugaauuaucuccuuuuuccuggagaaucgcccaccuacagaccacugaaguuucauuugugauaagaugaaggugacaaaggacuuuaaaagccuugaaagaaacauuagguuuauuuuaaguguuagauacauaaaacaguuguaaugauaaagaacagcaguguauauaauacuuacaguuccacuauaguuuaagucaccaguuucuccuugaggguggcaacaggugaguugagaaaagccucuuuuuuagauacgcuauuauuuugucuaaguguguuuugccaauuauaauaauaauguuaauccugguuaucacuuacugcauuccugagacuuuucugaaggucuuuugcguagagauugagcacagacuuauucagaauagauggcgagguugucaacuaaacugccacgaguuuauuuacacaaauguccuaaagucuauauuaaauauuuaguucucaaguaugcuaaaucccuaauauuaaaauuuaucucugacacaauuuuuggucacaggauguucuauagcucuuauuuucuuucccuuaugaagcagaaaacaaauaaaggcuauggaugcuuuuuuauguucagucaguggguauaggacaggugaagggggauuuacaaugugacucacuucuauaaauauuuugcucacuuuccuucaguuuauauauuaauacuaauuuuaauucauuccuuaagagagaauuguggaguguuuguguguguguguguguguguguguguguguguguguguguauguguguguuuugacaauuuuucucuuaaagccuuuccauuuucacugaucuuucaacuuuuccucuuuuccauccuuggagaauaccucuauagaugcuaacaccccccuuccccuauuuaccucccucccucgcucacuccuuuccucccccucucuuucuccuuccugccuucccuugaauccuagcucuguccuuugauaaacuugggcaagugacuuagucuaaaccuuaguuuccacaucuguugcacuguguuucuuuaacaugaaaaccucccauguuguuggcaaauaagacagucaugucaguauaacaugaaaauccuuuugguucauuucccacagcauauuaaugcuugaaguagucaaagacaaguuuuaucauauuuaaagagaaagucuuagcccuagauaaagcauuacuuggcuuuccacagggcucugcucucuggagaaguugagaauacagaggcagcagcugcagagacaauacugucugugcuaacacaggacauucauaaagaaggcugucucugggaucagauuuuaauuuuuugaaaaaggaucaacauuagaagcaucuauacuuguuauccguggucuaccuuuugagagaggaagcaggagccccaguguuuaaggcugucugggaugcuagcugcagaauccaguagaaauuuaaccagcugaugcugaauuaggguuuacugauuguuguuauucgugcuccgguuauaaaggugcauagguuuugagggaucugcccccaaucuucuuuuuucuuaauaugcccugcuauucauaggugugauuuuugcagaacgugauguuuuccaggacuguagaaauggaguuagagcauaaacaccugaaccaaccucagagcuguaauuaaaugaauucauguauguaaguaccuagcacagccccugagcugguuggcuuugauuggagucuugaaggacaaguaggaaagggcuuaaucaguaucagcuaguacuguugaacccuucaaacauugcaguucagccucagaaggugagggacguaucccuguagugguuuguguugaguggaaacuugaauaacaaguaggguuauacccaaaagacuaggaugagggggcauggcacauggagagaaaugaagcaacaauacauacucuggauuuuggugugaagcagugaaaugcaagguagcagaagguaggacuaggaggguauugggaacugaagcuagauggaugagcaggggccaggagcuugggucugaugcagucaggauuggguagccaucaacagcgugucuucauuuuccuuuuaggaaagaagaaggugguuaagguggacuucuaugggagcugguggagaugguggcguugguuuuggaggaaugcaguuggagguggggaggcgaucaaaaugauuuggggaaugagugaugaaaguguuggcuccagaagacguaagaagaaagcacugguuaaagaaaauuaaggaguaaaguauauggaaccuugccagacagaaggaagaaggcauaauacuauaaugcuuuacagagaagaaaaacugaacauaguagagcuuaagaaauuggucuauauugggaguugacaaacaauguccaugggccaaauccugcuaccaucuuuuuugguaaaguuuuauuagaauacagucaugcugauuuauuuucauagggucuuugguuccuuucacacuacaaugacagauuuaaguaguacaacagagaccuugcgcccacaaagcugaaaauaauuauccucuggacauuuauagagaaaguuugcugacugcugaucuguguguauagcuaguaaguagaccugggauucaaaucuucgagaguugggaucauaucucuuuugcucacuucuguauccugggcauuuugcauugugucuaacauauaguaagcccucauaaauuaacauuuauugaauuaaccuacaaaugaaugaaugaauuaauaaaaucacaaagucaagucuaccugagucacagcuugugcuagucauuauuauucuguacugauucuuacaaagauguugaaugggaguugauauacaaaacaaauauauuuauugagugccaacaauauauaaggcauguucuucguuuuaggauacagugaaaaacagauuuucaugugcccuuguggaacucacugcuaacagggaagacacauguuaauuaaauaaucacagaaaugcaugcacaguuucagccucaacagguaccagacaggagaggggcacagaguuuugagagcugccaaugggaagaugugauguaaagaguccaagaagucuuuccccuguucaccugucuugugaucugaagagugagugaacuuuaguuuaaaagggaugugggaugaguauuucaggcagcaagcacugcaugugcaaaggaccugugucaggagagagcaggcaagaaacaaagagaagguuggucuugcuggaggagcaacagcaaaggggaucaugguaaggacugaggcuggagagauaggcauggggucuugugaucaagauagugaagucagucugcuucuagagccaagucuaaacuagagcugcaaguuugggacucaguaauagaguaaguauuguaguuaaagaagaguauuguacacaccagagagagggcugugagagaagaugugauccuugagaaguacucuggaacaugccaguaggacagagagggagaaccuaugaagcagccaguaggacagagggggagaacuuaugaagcaauguaaaaacacaggaacaaagcuuggagaaccaggaugguaaagguuuugaaauggaagguuauggcaugcaugucuaggauugaaaagugucuauuggguuggucuuuugugugaucacugugaccuuggaaagaacagguuugggagaguggaggggaauggcuggagcugguaauuuguugaaugaaugggaagaggaaauggaaacaagcauuuauucauucauuuacccaacaaguaguuauugaacaucuuuguauuagggaucuaauggugagugaaaacacauaagauccuuguucuccuggggcuuacuguuaaguagagagguggguacuuagucaaacaaucucccuaccaccacccaaaaagauguaugaacacuaaaggcuacaguaauugcuguaaaggaaagaaagaaaguuuuguaggaauauguagcagagaacgggggaaguguuugggccgggaagaguucuccaacuaagugaucuuggagcugaaggaagcauaggugugagcuuugugaaagcuguggugagagaaaauuucagcagguggagaaaagcagaugcugagacccugcagugucagagagcuagaagcuccaggaaauaagaagugagguccagagugguuaugugugaagagcagugaugagaauugugcacuacaaggcuaaaaggugggcaggggccaggggccuaggguuuaagcucccaggacuuaauccuuaagaccaucuaaaggauuauugucuuuauuuuaagagcaaugggaagccauggaaaggcaugggaagccauggaaagguauaggcuaggggagccacaccuggguuuuaaggaguguagucugcucuuugcagagacagcguaaaccuguuagaccuuucugaaccaacauggguacauggcacggagaaggauucucaucucaggggguuaucauucccucuucugaguguggagucaucuaagcucuucagaaaaccuccagcucagauauaacuuaugccugccuuggcagaagaacaugaagguuucuccuaaaacccacuuggaaaaaauucuuuuuuccaagucuccaagaagacuuggagaaugucuucuaaggacugcauaagcuauaacuucaggagacaugaauuucuggguuaaaccaauugcaggcaaaaagaaaaaagcauaggcaacuucugagauaaaugauuucaagggcuuuaggcuugaguuaccucugagugaugucucuccuuggggucugccagggcacaugauacagcaaguguuuuagagaccucucucuauaaaagccauuuugaccccucuccacuuaugcaccauucuguccucagauuugaugaauagagaaagcuuugcuaagaauaacugacuugcucaguaccucuuaauauucaaagaagucuuugcauauuaggaggacuugauuucugccgagugggagggguggggaaauaauagauuuucagggaagguaauggugggcccuauugggaguggaggcagaaaacagugaccuuccuggucacacuucuaaucacagagagugggugacccuccccucugcucccagcuaacacacaccucagccacccuguugcagccgguuuauuuuugcaucaauaauaaccguccuccauggaauuaaaaaaucgugauauuucccugugguucuugccuacauuuuccuguuucugaaccaaccaacucucuuccuuuugcuuggagagcacauccuuaauuaguuuugcauaacaugugugguacaauuaccugaauuccuucuccuccuucuuggcccuguuuaaccaaacaccucccacgucuuuguucuuugugcucauccugauugacucaugaggugacacuggcugacacuuggcaaaccagugaccuucuuuuugagcuagaguugacaaaaccugauagaacaggguaaaaagggggaggcagaagccugcagccagcccuuuuuuuguuaaggagaaagcagcauggguaaauauauuaagaagaaguucugcuuugaauacuuugggaauauuugacaaaauuaucuguugaagaacaaaaguaacauguuuaaggcaaauaaaggaugaggagcaaugcucaaucaggaaaaaugagguagagggauagaguagugauuauaccaugucuauuuuagagauauuauguacuuuaugaaauucuugcauuuguuaacuauuaaaaucagaagaauuuaccuggaaaaguaauagccagggaggaaaaauagguuuaacacaccuugagcaccagaagcuguccuauguucauuuucccagaaacgguguuuucaauuaaaaaacaaaacaaaacaaaaaaaaccuaugaggauggaaugagguauguguuaagugaauugagcaguuuggaggaagguugcuacaguauaaccuuuuauauuuccaugacuugguuuuugguuguaauuucaagcaguacacuccuagaccagcuagauaaaaagaauggcccuuuaaccaaauaaucagggauaacgaaccagugugauuuuucaaaaaaaaaaaaaaaaaagauaaauuuuaagucaacuuugcuacuaucaguguuaaaauuaguuguauuuagcuucauuuagagcccuuuuccuaaauauaguguguuguuaauaaugcaaguguuuuggcuuuaaaaauuaccuuuuauaacaauuuuuacuauuuccauuuugccaagauuuagauaauuuucauggguuuaagcauaauccuuuaaacuuaacccaaguuuuuagcccugucacccugacucuauccuucuguucaucuccuaucccucccccaauccccacacuucaauuuucuuuaagauuuuguuagagugcacuuagagugacuagagucugagcccauggaaguuuccuauugcuuauuuuucucccaguggcacauggucuaaucaccuauuagagcgagaauaguugguccuccccuccgagucucuccacaguucugcauagauugcaaccagaugaugacauuaauuaauauggcgaauucugaaagcaagcauuuaaaauaacccucccugucuaauucagagaucacagaaagacuugggcaguacuuugagccuugacgacauagcgugugcugagcauggccucccuucccuaugucaucaagaguccauguaguguaggcaauuaagggacccauuucucccagcaugugucacccuugcaauuggaaaguguccacuauucugggccuacauggggauaguagagggagcuggcuuagucaggcaaaguuggggcaauggguaguaguaaugugauuugcuuuauaacuguuugcuuugcauuggcaacugagcuguggccacacuccaacuggcaguggagauggaaccuuaauuuuagauugugucccuaauguuuggugaaaauaaaaauggagaggugaccaugaguugacuugagacuuuuuauaugugagucauaguaucuauuaggaagaauugcauucauauuauguaauuauccuuuguuuaguuuuucuuuuuuuuuccaguaaugaauaauccuuaucaucucuuuugcauccuuauuuauuuuucccauuuacauaaauuaauaaggccaugacagcuaaccccauacuaaauauauguauacuugaagcuugcuuugaacuuccugaaaacauaucuauuuggcuuacuguuggguccccagcaccuaaaauauuacaaggacauaugacaaacuccauaaauacuucuuaaauaaaauugcaguuuaauucaugacucauucuucacccuuugauucuuauguuugagugaccuagcuguccaguggguuugcauggauaauuuauauguuccuccacaugaagggauaaauagauagcucauagguuauucugguauagaauagaacccuuugaaaaccagccugaggcucuuuuuccuuuuuuaaaaaauuagaaugcugguuucaucuucagacaaaaaauacuacuuuuaauuacugugcagucuuuaguuacacccauaaccucugggacacugagaugguaacacauucaauucuuugucuuugacuugguuauuaacuugcguuugccuugguuauuguuagcccaugauauuuagggaaguaccucugaaacauuuuaaugucugccuuuuuuuuuaagguaaaaugcagaaaaaaaaacccaaauagguuugguuuugaauuuuaaauuacuuuguauuauuuuuguuuuauaaaaauauacaguaauuagaagaaugcaauaaugcuacuuucuaucguguuuuauuauuucaauguuguuuguagagguuguaagcuaugaucucugagucuucaaagaguuugagaauuaaaaagaccacaaucuauggguuuuauuuuuaauuauuaugaaaccauagagaugaaaaugcaauguguaucauaagaacaauuuuucucuaugauguggauugaguuuguaauugagaauagugauuuucaaauuagcuaaucuuuggacugcucuggugagguuuuaaacauaagaauagcuaggucuaguccuagaauauaggaauggccuuguaaucuguauuuuuauaaaaucucccuguuuauuucagaugguaagcacagccuaguuuagaacauuagaucaaugagcucaagucauggguaugauuuuucaguuggccuauugguuguccucuguucugugaccugagaccuucuucugagccugacuaacuaucuugcagauggauguucuugcugugguguagguaagagaguguggacaggggaggcauugagccuagauccaguuuaauuaccauacaaauaucuuaggucaugagguagcuagggucaucuucucuaagggcagcuaauuucuuugcuuaugccaagcaacagccuugucacugggggcuuuuuucuuaauuuggccuuuuuaaaaaaaaauaucagcaagaggaguguuguuaaauugccaaccaauucagacucacuagucuuuuccaguaucuacuggagcuaaaauucacaaacccaacucacuucuagaaaucauagcuucugacucugcgucagcaugguggguguuugggcagcaagugagcagaaggugcugggaucagauugccuggguucugacucugcugcucccaugcacuggaugugcgacuuggaagcaaaauuacuuaaccucugagagccuuuguuuuucccguuggcaaaaaggcaauaacauuaauacuaauauaggguugucggaggauuauaugagauaaugcucaugcaucaaaaaugguaagcacucaacacaugucaguggcugguauuauuacuauaauuuuuaccacaaauucugaauaaacacgucuagaaacaagguauugccaugauuagcuugaaccaguaucacccauaauuuuuuuauuaauuauugccucccuuugcacucucugggauuuccauucauuuauuucacaaauacuuauuuaguacuuacuauccaagcaggguacuaggcacuggggauacacuagugaacaaaagagacaaaacauaaaugauaguuuaaaaauugaugcuucacuacauuuuaacagccuuaccauuuaaccguacugaagacugagagaacugaaauguuugaucauauuuagauuuugugaauuugcccauaccagguacugacuagcaugaaaaauagugacagaaaugcuacauaauuucuuccgugugucuucuacuggucuguccuucugucucuauccauucuuggccaaauccugcccacccaauaagacccacugaaacacugcuuuccaugugaagugccccaagguuuucccuccuggucccucuaccucucucuccuccaaucucuacucacuccuuccguagaauuuggcuuguauuccauguauagucuguaucaauguauccuuuguauucccauuaguuauuuucacccuuauaaaccauaaguaauguguaggaccacauggcuucuacaucuugcaggccccuggcucuuaagaccgucccagguauauauuaaguagucaguaggaugcagaguucauagacagagaaaaaaaaaauuuagucuacaagugagauuuuucucucuuugcuccuuuguaaaaugggaauaaagaguacccagcucacaggcugguaggagugugagaugaugcauauuguuggagauguuagcgcaacccauucacaguacaguuucaauaauagcuauuucuuauuauuuuuaaaaguuuuauugaagcauaauuagcauauaauaaaguacacuuguuccaaguguauaauuugauaaauuuagacacauuauaccucugugaaaugaucccuacaaucaagaaaauuaacauauccuuguaccucuuuguaaccccuucuuccuucccagcuuggcccuacuccccuuguccccaggcaaccacugauuugauuugugucacuauagaugaguuuguaauuuccagaguuuaaaaaauauggauucauaccuuuuguaguuucuugggagagaggccuggcuucuuucacucagcauaauuaauuugcaguucagccauuuuguggcacguaucaauaucucauuccuuuauauugccaacuguauucuuuuauauaggcagaccacaguuuuuuuuauccauuccccucuugaugagcauuugcuuuuuuuuuucagucuuagaauauuacaaaguuccuaugaauauuuauguacaggucuucguguggauucauucuuucauuucuccuggguaaauauuugggagugaaacagcugaaucauauaguagacauauauuuaacuuuuagagaaagugccaaacuugcuuuccuaaguagucuugucauuuauauucucaccagcaauguaugagaguucuauuuccuuauauccucucccacacuugguauggucagacuuuaaaauuuuuuguuagcuuuauguacugauggguguguaauacuaucucauuguguguuuuuuuuuaaauuugcauuucccuaaugacuggugauguagagcaucuucucaugggcuuauuugccaucuccguauuuucuuuuggugaagugugugcaaaucauuugccuguuucuuaacugagcuguuugucuguguuuugagaguucuuuauuuguucuggaucuaucauaugcuuugcaaauauuuucucccaguuugugguaugucuuuccauucuauuaauagugucuuuugaaaagcagaaguuuuaaauuuugauaaaaccaaguucauugguuuuguaaauuaaucauacuuuuaaugucauauuuaagaacucuuugccuaacccaaggucauaaggauuuuaccuauguuuucuuuuagaauguuauaguuuuaaguuuuaugauucauuuugaguuaauuuuuauauaaguuauaaaacaugaauugaaggguuuuuuguaaauauggaugaccaauuguuccaacaucauuuguugaaaaaacuauccuuuuucccuuucauugccuuuguauguuugucagaaaucaguugauuauaugugugggucuauuucuagaaucucuguccuggucuguuuuucuuccuugacaccaauaccaaacucucuugauuaguguagcaaguaagucuuggagucaaguauugucugaccuccaaauuguuuuuuguuguuuuuuguaguaaaauauuauauaaugaguaaauaguuguguauaugaugucaaucauuggagguaaaacugaaacuuugcuuuguugcuuugguuaauaagugccaugauuugucauucuacuaguuaucuuucucugaaggugauuuaucugaagcauuucagaauuuucccaaauagcagagggaugaguuauaugcaaguguacuuguauaaucuuuaacauuuucuaagucuuauuuuacauggucuuuaauccuguaguuauuuaucacuucggaagugacuucacaguacaugucacaaggccaauuaaacccugguagauucugaaguggauuguaggaucuguccaggacuaugauuugguuuuuguuuguuuauuguguaauaugcccagauggagagcaucuagaauggagacuagcaaccuauagacuguuggaugugaaugaaaauaggagcugucaacgcacucccuuucugcuucuuugaccacacaucuacaacaaaaauagcagcuuuuuuuaauuggcuacuuaauauaugcuggucacucugcuaaauacuuuauguaaauugcccuaugugguacuuacauuguccaugugagguaggcaccauaaauccuuguuuugccugaagaaagguuuaacaaguuacccaaagcuacacaaccagaaguaauagagcuaguguuugauccucuccccuuucccuccauaaucuuguguuccuaaucgcuaugcuacaguaccuuugguacuaaagaaugaaagggauucaaacuugaaauauaacguaagucguccauugagcucuggaacuccuacuuucuauguccaaaacuuuccugucuaugauuucuucugaaucacuggaugaaaaagucauguggguuuuagagauggggcucugugugucaaacugguugaauaaauaaaugaacgaguuauucauuguauaauucagcacaaaucuauuggauaucuauguaccaggcauuguuauaggugccagggauauugcagcagaacaagcaaaugaacaaacaacucuuucuucaugaaaguuauauucuacuggaggagagacucaugauggacaacuuugagaucauguagaugaaaucacuucauaagcaggagguaguauucuccucagauccuggucuaauggccuguauuauggugccaaaauuuguauuugaaaucacccuugauuucaggcaggaggccugaccugucuaucccugguaauuuugagcacuguuaagucuggguagaccaucugcuuuaccuaagcuuagaucauuggcucucuuuuucaguagucugaggcuuuccucagaccagucaccucuucacggacauuuuaaguguaugagggcuaagcuccaaaacacaguaauugcucuugagaauaagcaguuuucucugugaacacaagaaaaucauauucugcugggcucaaagagaguuucuuaaaguugacucagaagaggcuuaaaaacaguaaguguuacaaaugguuuuuugaaaggaagaggaaauuauuuauuuauuauuuuaagaguuucauuucaagaaugagggaaguaaaccaaaauauccagcuuuuuuuguuguuguuuguuuuguuuuauuuuucccuaaaacucuuuugcaggaaaccuuauggggcuuuugccuuuugaucuugcuauagaaucuagauggauacaugagacagaaggauacagaaauguucucaaagugguugggccacccaauuaacucuaggggugugauucaguuuuguaccacuuuacauagugagaaaacauuccagaaggagcugugcuccccuuggguguaggaaugucucuccuggucugcaaugcaguugaaaagugaagaauaauuuccauuuucugcuuugucuauugaaauaaaaagacaaagcaaaaacaauaaaaaaaaaacucuucuacaucauuuaucgcuccuuuauuuggcaggaguuuucaaacuaauauuuucuuuuuguacaccagccccauuuuuuaaaaaguacugaguagaaguuuuuuaaauuuggcaauucaaaaaauaguuuuacuucaacaaacuuaaugaaaucauuauucuuuaaauaucauauggaaauaauaguaaguuuuuuuuuguuucuuuaccacauugauauuugugguuuguuuaccacacugccauucaaccuuugaugaacaugugggaugaaugagcacuacugguaauaaugaaauuagguacaacuuucccauaagaaaauuuggcaaaaugcaucagaagcuucagugguuuuuauauccuuuuaucugguaauucuuccacuuaggauuuuuguucuuguuagaagaaaggaauaagugacaaucugagaauauuugucccuacgugagcuaacacagucuuuuaagauuuguauuaagguuaguuccuuugcaccuaucaguuuugcuuuuaaguugagauuauuuauguuuguuuuauuuaugugaaauaaguccuuagaaaauaucuuugaugcuuauaguuauaggauauagugauuuccuuuaccagcugcuaaguucuauuagguuuuuuuguuuguuuguuuuuuaaagacauggugauacggcuuggcuguguccccaaccaaaucucaacuugaauugugucucccagaauucccacauguugugggaaggacccgggggguugguaauugaaucaugagggcuggucuuucccaugugguucucaugauagugaauggauaagucucacgagaucugauggguuuaucagggguuucuguuuuugcuuccuccucauuuucucuugccaccaccauauaagugccuuuuaccuccugccaugauucugaggccuucccagccauguggaacuguaaauccaauuaaaccucuuuuuccucccagucucagguaagucuuuaucagcagugugaaaauggacuaauagaguaaauugguaccagcagagugggguguugcugaaacgauacccaaaaauguggaagcgacuuuggaauuguguaacaggcauagguuggaacaguuuggagggcuaggaaggagacagaaaaaugugggaaaguuuggaaccuccaagacacuuguugaauggcuuugacuaaaauucugauagugauaugaacaauaaggcccaggcugagguggucucagauggagaugaggaacuuguugggaacuggagcaaaggugacucuuguuauguuuuagcaaauagacuggcagcauuuuucccugcccuagagauuuguggaacuuugaaacuugacagagaugauuuaggguaucuggcggaagaaauuucuaagcagcaaaguauucaaaaggugacuuugggugcuguuaaaaccauuccauuuuaaaaggaaaacagagcauaaaaguucagaaaauuugcagccugaugaugcaguagaaaagaaaaacccauuuuuucaggagaaauucaagcuggcuucagaaauuugcauaaguagcaaggagccuaauguuaauccccaagaucauggggaaaaugucuccaggccaugucagagaccuucauggcagcccuucccaucacaggccuggaggcccaggaggaaaaagugguuccaagugccauucccagcacaaucccugugcugugugcagucuagggacuuggugcccugugucccagccucuccaacuguggcugaaaggggccaacauagagcuugggcuauggcuucagagguuggaggccccaaaccuuggcagcuuccaugugguguugagccugcaugugcagagaagucaggaauugagguuugggaaccuuuguccagauuucagaagauguauggaaaugccuggaugcucaggcaaaaguuugcuauagggguggggcccucauggagaaccucugcuagggcagugcagaagagaaaugugggguuggagcccccacauagagucccuagugggacacugccuaguggagcugugagaagagggccacuauccuccauaccccagaaugguagauccacugacagcgugaagugugagcuuggaaaaaccucagacacucaaugccagcccaugaaaacagucaggagggaggcucuacccugcaaagccacaggggcagagcugcccaagaccauaggaacccaccuuuugcaucagcaugaccuggacguaagacuuggagucaaaggaaaucauuuuggagcuuuaaaauuugacuugacugcuccgcuggauuucacacuugcaugggcccuguaaccgcuuuguuuuggccaauuuaucccauuuggaacagcuguauuuacccaguaccuauacccccauuguagcuaggaaguaaguagauugcuuuugauuuuccaggcucauaggcagaagggacuugccuugucccuucuguggauuuuuggguuaaugcugaaaugaguuaagacuuugagagccuguugggaaggcaugauugguuuugaaaugugaggacaugagauuuggaggggccagggguggaaugauaugguuuggcucugucccuacccaaaucucaacuugaauuguaucucccagaauucccacauguuguggcagggacccagggggagguaauugaaucauggggggccagucuuucccgugcuauucucaugauagugaauaaaucucaugagauuugauggguuuaucagggguuucugcuuuugcuucuuccucauuuucucuugcugccaccauguaagaagugccuuucaccucccaccaucauucugaggccucaccggccguguggaacuguaaguccaauuaaaccucuuuuucuucccaaucucagguaugucuuuaucagcagcaugaaaacggaccaguauagaugggcucuugcuauguuguccaggcaggagugaagugacaugaucauagcacacugugccucagacucuugggcucaagcaauccuccugccucugccuccccaguagccaggacaacaggcaugcaccacugugugcaauuccuguuagguuuuuaaccacacuuccaggagaugguguuaauuagaaagacaaaguugauaaaaaguaauaaauaggagaaccauauugauaacauaaauaacaaguguaggauuaguaccuagaauauauaaagaacuccugaacaucaauaagaaaacaauggggugggaaagaaggcaaagaauaugcauagacaguucacaaaaauucaaucuguaccuaaggaauugcacauuaaaguaauacacagauacaaauaguauuuuacaaucagcuuggaaaaauuuagagagccugauaaugguauguuuggagagaaaaggaaaucagaaccuucauacauugcuagugagagcaaagaugguacaaauaccuugaagaacaguuuggcaauauuuaauaaaguuuccagugugugcaaccuaccauuuaaugauuccaccucagggcuuacacccugcagaagccauaaaggagacaaacauggggauguucacugcagcauuaucugugauugcaacaaacugcagucaaccuaaaugcccaucaauaagggaguagauuacauggcacaucauaaaggagagaaaauaaaugaauuagauggguguguuuuuucauggauagaucucagaaacuaaauauugagugauaaaagcaaguuuguucaagcacauguauggucaacaaguauguaauuuuugaagaaaaucacacaaaguuauaggugcuaucuugcaaaagcauaaacacauggauuggaugacuacacaucaaauucuggguaauaguugccucuggggagggagagcagggaacuuauggggcuuauuguugucuucaauauuuaauacaaagcaaacaugguaauauuuuugguuuuuuuucauucugggagacagaacaaugacuauucuaucauuuaccacaaauuuuaaaaguuaacaaaaaagguaaggaauacuuucagggaaauaaaaguaaugaggcgcaucucaaccaagguguucaucagaaacuugccaucacuguauuugcuugcacauguucuagucaucucuguugguauuuucccucauacuaucauaaucuuuuaggacaggaacuuugccuaugauuucuuugaagccaagccucaugcaauuuaccaaagaaaguaugaucaucauucuauaagccacacacagaaauuguuagaaagcuucacaaaccugcuagagucaguguuggggaaagugugggugaaugggcacuuggauccucuguugguuagaauauaaacagaauugcuuuuugcaaggaauuugggcugcaucucucaacauggaaaacaggcagucucuuuggccaacuauccucuaccucaaagaccccacacuccagaaagccuauauaaagguccaguauguucauaaugcaagaauauucaauucugcauuacuuaccauagugaaaauugagaacaauagaaaugccuuugaaucugggaaugauuuaaaauuuuuaguaauaaaauggaacauuugguggcugcuuuugaaaagaaagauagaucuagguguguugacauggaaaguugucuaggauauauuauuauuauuuaaaaagcaagcggcagaaaaauauguaucauguaaccagauguuuguuuugaauggauguauauagauauauaauuauauuuuauuuaauucuauuugaauuagccuauaaauaaagcagagaaugcauguaaacucuuaaauuaauuaaagaguagagauaagagagaguagggagugggggcuuuuuguauuuguuuauauuugucuuuauucuuuugggauuuuuugaugagcuuguuuucucauuuuuaauguacaguguuaguaguauuacugaugucugaaugacacuuccaccuaaagauaugaaggaagcacgucauguauugcauuucauguuuuauaccacuauuuuucuuuaggagaugaauucuuccuugagagaucucauuugccuuuuuaguaaucuaagguuuuucuaagacuccaaagaaaccugagguaauggagcagugacaauggugcacaguugaguuugcaugaaggugacucagauuucagcccuugaggugccugaucaucacacauagugauugacugcaucucauuuaugauggugcagucuacucuuuucagauauaaauaauagcacagcucauuggacaggaagggagagccagguaguucccugguugcauggguguguaaacuaggccagugauuuuacaucauccuaacgaacguauuaauagcaugauaaaacgaaggcccuugaauuguuuugguggugaugccuacucaaccuucccauauucaagaugauauaaagcuguaacaggcuuucagaaaugcagucuagauuugauauagugcuuuuuauuaacugugacacaauggauuauggcacuucaaaugagaaggggaauuuucuuccuuuuugaaaugugaauuaacaaaaugcuuauucucaguagaaguuguuuucaugggcuuuuccauuuauuucugcugugguugccuuccucuacugccucuuugcuagacaggcaaacagucacacacacauaguucauauacccauuaaaucaugcuauuagaauggaacuuuuuuguuuguuuguuuuuugaguuggagucucacuuugucacccaggcuggaguacaauggugugaucuuggcucacugcaaccucugccucccggguucaagagauucuccugccucagccuuuugaguagcuggaauuacaggcacaugccaccacaacuggcuaauuuuuguauuuuuaguagagacaggguuucaccauguuggccaggcuggucuugaacucuugaccucaggugauccgccucccucggccucccaaagugcugggauuacaggcaugagccaccacacccagccugaacaacucuguuuuugaggaacgguuuuauauuucagaagaggauauuucaauugggucaugcugggaaaacuccccaggagaugaaccugccacuucaucgugcaguuauugucuguacuugcacaaauuauugcuucuucuggcuugggauacuucaucuacuugugaguuggcaguagugacaccuaccugucccccccuggagcacugggcugaugucaucauugugcgguguuggaugaguaaguacucgagaaagggugauugccaagggcuggguaguucuucagggggaugggcuguguuaguugccugguuguuaaaauaggagauuaagaagaggaauccugagccugacuucuuccuuugcaacccaugaccucauuuugucugacuuuuuuccuuuagcaguuaaggccauuauacucuacagauauauuccagaggaaguggagggcuccaccuuuaaaaauaauaagcaauucaggacaguucauauaaagucaggauuugaauagauauuuauuaaaugucugccaugaguaauguauuccacuaagcacaagggggagauauaaaacguaguuuaguagguucuucauagguucuaaugaaauguaaacaccuuacgagaaguguauuccuuuaugucacaaggaacccuuguguucuguaggucaaucacugugcaauacuacguagauucagagauaguuauuaagcauaauaaaucaaucacacuuuucucuaaagcucaguagagauacuaccugucuccacauauuacauuugauuguaagauacagccuagagaaaaauguuagaaucucauugcagugauuuccaaugggaagaaaucuaagagaauccauucauuugagauuuucuguauuauaaaauuauuuucuaaaccagagucuauaauagauuuccuuuaaacacaagaauauauaucauaagcauaauaaaaaugaaucauaccacacaauucuuguuuguauaaagaaauccuaauacaugaaaauuaaugaaugauauugccacuucauauauauauuuguauguacaaauauuuauauauauuuaaauauguaccuauuuaaaauauauauauuuauaaccuaaugccuguauuuacaggauuaauaaaaccauaacccuaugucagaguuuuuaauagcuagcaacaauaagcaacuuuuguuaauuuugaaagaaaaugaauuuauugacaggguauuggguuaccugcugaguugcuaggcaguaagaagaccaggcuuggaaccgggagcaguaccucuaacacacugcagaauuggucuggagagcaauggaagccugcuucucuguuucuauugcaccaauaauucagucuucccacagccuugcccacucccuguggucccuguuccuuuuccuuauccuuuaucucuaacaccugaguccagugcagaacaccugauugguggauccucagucacauguucauucccuagcugcaagggaggcuggcaaaggaacaccugcauuuucucauuucuagaguaggaggaugauucugcagccaaagcaauugccaaauuguuauuacaauaauuaugcuagaaaguuugaaaggcagaaaacaugaaaacaucaucauauuccauuguucugauacaaaacuauuuuaaaauaaaauuaucccagucuuuuuccuauucauauguuuuuacauuugugcaaucauagauuuuauacuuuuacaucugcauuuuauuuucagugucuuuuuuuauguugcuauauacacauauaucauuuuaaauaaucacauaauaauucaaauaaacugacuuauuuugccauucuucuaaugucagagauuacugauaaauuuucauuauuuugaaaaauaauuuuaugaacguguucacaucuaaagcuuuggcaucugaauguuguauuuggggcuucagaacccagaaggaaaucuuaucaacccuugagucuuuaauaauaaaauuaguauacuugauuuauaccuuuccuuaauugacuuaaacacaaacacaguccuccuuuugaugugaaauuuuacaaguucggaauugagugaguuaaauuugggauuguuuaaaaaauuuuaaacauuuuauguaggcaagcuauguuuguuaagcaaauauuuacuaaaaaguacugcuuuuuaauuuaauacuaggaaaacaaauaaaugaccuaauaauaaauauccuguaucuaaacaagguaauaugaugcacaucauaauaaacuuaugacugucauaugacuguuaacacugaccucaauauuuuuuaaaguaaaaaguuucgauuucaucacgauuacauauaucagaauauuuuccuuaccuuggauguugugagucaguuacgguauuuacaaguggauucuuguagaauuaagugauauuaucauaaaauaaacacaucaugguguauuaguuagccccuugguaaaucugccagucuaccauuuuuaauauuuagaauaccuucugucuccuguaagauucugguauuguugcuuguucauuugacauauguuuagugcaugucuaguacauguuggacacuaaguguccauauuauauguccagugcaugaugggcagcauauuaaguaacaggguauaaaaacaagaaaaacaagaaggacaucugaccugacauuuagaggcuuaaaucgagcaggugauauuauagucuggaaauggauguguguggguguaucugaaaaaucacaauagacugguucugggaauaaugaccgaaaagucucuuuugugcauauuuaaguuacuggcauuaagguuaguaugcaugguuugaggacuugggacugggaaauucuuagguauugguuaccaucccugacuuugaaauaugaaaauaugaugauauuugacuugauacaguugccuccuuuuuuuuuuuuuuuuuuuuugacaucuuuagcccuuaaagucagccuggcuuaugauucugcucuuagaugagggugguucauucaugguauggugcugaagaggaauuaguguagcaaaaucagaaggcuuggggaaaagcauaggguuuuucagcauuaaaucucuccuuauauaacauuccuuauauucuucuucccacugaugauuccauuucuaucccuuggaaucuagcaaagggcuauuuguagcugcaaguauucccuggaauugggauccuacaacauguaaagagucaagaaucguaaaauguaauuuaaauuaauaauccagaucugaacuguacucucagagguuaaaccagacauaaucuuucaggaucuuggugggcagguugguugguacauuuuaugucuuagggauauguauagauccuccuuuagaaaagauagagacuguuuuuuguuuuuguuuuuguuuuuguuuuugaauaagacaacuuuugcuccaguucugcuagcaugguuggggaccacauuaaaauuccacuuugaucaauagaaagacaaauaccauaauguugucagaguuuuuuucucagcaugggauuguuauauguuguuccuuccuuuugcucauccuuuucucuaaauuuucuccagucauguacauuauggguuuugggguuuuguuuuuguuuuuguugagacacagucucacucugucacccaggcuggagugcagugacauggucucugcucacuacaaccuccaccucccggguucaagugauuccugugccucagccuccugaguagcugggauuacaggaguucaccaccaugccucgcuaaauuuuuuguuuucgccauguuggccaggcuagucucgaacuucugaccucaagugaucugccugccucagccucccacagugcuaggauuacaggugugagucaccacgccuggcccacauuauauuuuuaauaaggaaaguaauaaaauuggugucuuuuccugguauuaaggaugacaagaugaauucaauaaaauuuccuugguguuuuuucucucguauguuccuuuuugugacaacaauuuugggacuuuuaaaauaaguauguuugccauaucacugauagcagugcauugauuaccucugagaaaugaagccacgaugcauccugcauauuugguugguuuggaguccagcacaucaggguucagaucucugguuauaugaaagcaggcaagucacaucaagcuaguuauguaacccucugcccucaguuuccucaucugugaagugagacuagugguagcacuuacauucauugugagcaucaagaaauauuaauguaugaaaaggcuugagcauuaugcuuuguauauaagagaugcucaauaaaaguuaaccuuccucucuuauuuucuuuucucugaagggagagggugagaauuguuacaacuuauucucauacucuccaauaacuauuuugaauauggaaaauggcauggcuuguuguuaaguaaauaaucauguucuauauuagggaaaaagaauaaaaaauuuugcauuauuuagccuuuuguuauguuuuuccauagucauuucuauuauuucaagaaaucuuucucugucucuucucgcucguucucuuuuacauccaagguugacuuucuaagcauauucagugguaaagguauaacugcaucaucccauauuucaauaccaaaacggggagaagaaaacacuuaaauucagccaccacagugcauuuuccaaaguguuaauuaaauaauauacauaauacaaggaagcuucaguuuggcgauugaaaccacuugccauuuugcuaaaaguaagagcccauuuaaguccauuuaagaucauuugggucugcacuuauuugucauggguaucauuugagacaagaacuuuguaggaacaaucuuguuuaauuuaaugcuauuucuacuacuguagcuuuuguuuuguuuuguuuuucuaagugguuugcagauaguuuuguagggaggcaaauaauaaaauaaaacgaucuagaaucuuuaaaacugcaaagaauuugccauugaagcauuaggauuaaauuuuuuuuuguaaacccccaagacaacauuugugcauguaugugcauguguguguauauaucuaaaaacuauacuuuuuccuuuccuucuaacucuuuauuauggaaaauuucuaauaaauacaaaagaauagcacaaugugccucuugccccaucucugagagcauuuggcacacuucuauaauacuugaagagcaauuagaaaauaaaagucugggguuauuuauaaaauuaugaacaaaugacuuuggaaaguuuaaaaaauagauuggaaagaaauaacuuuucaaaauguaggaaaugaacagaugaaaaauuauuugcugggguuuuuuuuuguugcuguuuuuuguuguuauuguugcugcugcuguuguuguuuucagacagugugggcagcaagccacccaggcgccaaggcaagagaccgaggacaccagcuguuccaguauaauaaaauauaaaacaagaauaguuauaccagauauagaucuuagauaugauuauauaugaauaucauuaaucauuaguuuguagcaauuacuuuuuauuccaauauuauaauaauccucucucuguaaucauaaccuaggaaaaaccaggccauacagagauaggagcugaggggacuuagugaggugugaccagaagacaagagugcgagccuucuguuaugcccagacagggccaccagagggcuccuuggucuagcggugaugccagcaucugggaagaugcccguugccaggcggacccguggucuagcgguagcggaaagugucaaggaacaacacccacuacuuagcagacagggaaagggagucuccuuuuccccgggggaguuuagagaagacucugcuccuccaccucuuguggagggccugacaucagucaggcuugcccgugguuuuccggaggccuaaccaucucccugugaugcugugcuucgguggucacacuccuaguccgccuucauguuccauccuguacaccuggcucugccuucuagauagcaguaguaaauuagugaaaguaauaauagucucugauaugcagaaauaauggcguaagcugucuuucucucugucuccucucccucucugccucagcugccaggcagggaagggcucccuguccaguggacacgugacccaugugaccuuaccuaucauuggagaugacucacacucuuuacccugccccuuuugcuuuguauccaauaaauaacagugcagccagacauucggggccacuaccggucuccgcgcauuugugguagugguuccccgggcccagcugucuuuucuuuuaucucuuugucuugugucuuuauuucuacacucucucgucacugcacacggggagagacccaccgacccuguggggcuggucccuacaagacagagucucacucuguugcccaggcuggagugcaguggcucgaccucggcucacugcaaccuccaccucccugguucaagcaauuccccugccucagccucccaaguagcugggauuacaggcacacgccaccaugcccagauaauuuuuuuguaguuuuaguagagacaggguuucaccauguuggccagacacuggucucggacaccuaaccucaggcaguccaucugccucggccucccaaagugcugggauuacaggcgugagccacugcacccggcugauuugcuguuuuaucauggagaauuugggagaguaaggaggcuauaugugaaacuccguaagcuuauuguaagcuaagcauuagccaacuucugguuuuguuugcaaguauaguaacguuccuuuauuuacuauuuuaucagacauaagagacuuuuaagugacacucucagauaucaauaaugcacucauaguugauguucggaaugacucagaaacaccaaaagcagauuccuagugugcuuuuugaaacauuagaauuguucagcuucauucuauauaguuuuagggcauaguuuaucauuauuguguugaauugaucguucuugauuuauagcauagcuuuuccuguccaucugacuguccagaacucaaaucaguaugaauucuugaguauugaauuaggcuauuuacagugaagaugacguuuccugcacccuccaauuagcuagaaacaucuccuuugcaugucaagacaagaugugaaauaacucuugauaacugugaauaucagauauaagaaggaagcaugucaauaguucaugagauaccugugccauuccuggggcuugacuaguuucugugccuuuucugaaaucugccacugaaaggagucgggaaggaaauuggcacagccucuucuaggauaggauuucuacacuguggcauuauuaacacugggacgaaagagucuuuguuuugaaaggcugucuugugcaucguaggauguuuagcaucaccgcuggacucucgcauacuggaugccgguaguagcacccccuccucacauaguuaugacaaccaaaaguaucuccagacauugccuaaaauuccuugaagggcaaaacugccuguacaguugagagcucccaucuuaauaggcaggagcaccuuacuguaaauuucuguguggguuacucucccuguuucccccaccuaacccuuggguuguaagccccuugaugauagaaaugaaguauuuucuuucauguugaggucucgcuuucuuuucugucuaccacacaauauauagagauuugaggauugacuaugccauugcuuuuuuuuucagacggagucucacucugucgccaggcuggagugcgguggcacaaucucagcucacugcagccucugccuccuggguucaggugauucuccugccucagccucccaaguagcugggacuacaggcauaugccaccacacccagcuaauuuuuauauuuuuaguaaaguuaggguuucaccauguuggccaggauggucucgaucucuugacguugugauccaccugccuuggccucccaaagugcugggauuacaggagugagccaccacacccggccgccauugcuuuuuaguuuuuguuuuuauccaagccacauaauauaguggguuuuuaacaaaagggcagucuugacauuucucuucuucccguuuuuguuacugcuucacaacugaguacguaacaacugguacuucagugauacaguggccuauuuucuuucuuauaaaagacauuacuauaucauacaguauuuuaaccuuuccuuuacaaaucucaugauacugagaugccuuugguuaacaaaaauugccauugagucuggaagauuguuuguuugcugacugaccagcccccucaucucauccuucucacaaagaaagaaagaaagaaacaaacccucaacccuuaaauuagucaaaguccuaaggcaguuuucccagaacaaauguccauauugacuuucuccguuguuagguccuguccuuguugacccguugcuggcuugaggggcugauucuguucacuuuggaauuggguagcguuuugguuuaacaacaguguccacccagcgggggaccaaauucucaggagaagccuuauuuauaauaaagcacaaaaacaaauacucagaagaaauagugauuacauaggcccucugaacaguuucaaaagcagaaauaauuccguugaaaauaugaauccuguaaauaacucauaguuugguaguguuucauaaagugauuaggaguaagccucaauuuccucaugcugaaaauggggauaauaacaucugcuacuucguaggauuguaaugaggauuaaauaagugaauccauugaaaacuuucagaaaaacuaccuguaacauagcacucaguaauugcuuuauuuucuuucuuuuggagauggagucuugcucugucaccuaggcuggaaugcauugaugcgaucuuggcucauugcaaccucugccucccggguucaaucaauucuccugccucagccuccugaguagcugggacugcaggcacacaccaccacaccaggcuaauuuuuguauuuuuaguagagaugggguuucaccauguuggccugaagugaucggccugccuuggccucccagagugcugggauuacaggcaugagucaccacaccuagccuauuuucacuuuuuaauucuucuccuaauuaugaggagucucuauaucuucccauuuuccuaccuccuuuaaaauuccuaccuauauucuccaaagaaguagucuauccucuuccucuuuauaugcauuauccauuauuuuuaucacacaaauccaaaugggacuauccaaaccacauauauuggccugguauagguguguccucccuuuacagauuuuuauagauuuucaaaaaauuuuaaaucucugagaauuugcuuuguagaguaugauaagucauagguuuuuguuuguuuuuuuuuggcaaaguacuuuuuauagugaggaaaaauaaagcucugccuaaauaccuauguaagcuuaaguuucaguugauuacguguuuuagaugacauccauguagaucauuggccaauuuguuugaaagagguagucaugauuuuuuugaucugaaaaggucaauaugaauucaguucuguauccccugcacaaguuuuuuaaaaaauguuucauuuguggcuaaaacacacauuccugauuagaucaaugagagcacuccaugggcaaauccagcuuauuuugcuaguuaacaagauguuucucugaguucucgugccagcaacgccacagaagaaucacaggaauccuccugaauccauaaucaauucaugcaacaccaagucagaucucuuagaagaaaauugcuggugaagguccagaauagcaagcuaaaaagcagauauuugauacuugcaauaggcugauaggugugcuaagugcuugcuuaguaaacaugcuaccauaacacuuuuccuuuuauggagaaagaggacauaaauacauaaaaauaaaauaucaaauacauaaauaugugugcacugugugaauauguacagguugucucaaauuuauacgaaagcagagugaauaauagaaugaacccuucgcguaacccaucacccagcuucgagaguuauugacucggcucauccuguuucacggauaccucccucuaacuugcaaauccuagacauaauuucaucuuuaaaucugucucguaguuuguucaaccucuccccagaaaaauguacagucaaaguuugcuuacaauuuucaggaauuuacaauuucccuaaaacccaguuaaagagaaccacugacugauccagcucauuuggaaguaugagaggaaagaugucacgaaagccuucuguaugagacuguggccugcaagugucccagcucuaacguucauguuuuuccccuuuuucucuuacucucacaauccaucuaugauauuugaguuagcuaaagagaaaaagauaaaaggauacaggaaagaggcugaauauuuccuucaucuuuuaaaguccucucgucuccuucuugguggcuuuauauuuuuuuugagauugugagcuauaugauuuaacacuaauccacuuggaugugaaagcaaaaauuccaaggugaacaaucauagagaacauuauuuauuuacugagcauuuacuaugugccaaguacuuuucaugcaucucaucacuuaagcuuaucagcaucuccagcaacuauuagguagguaggauccaugagcccauuuuguaaacagaaaacugagguccaaagcauuuaagcaacuugcccaggauuugaacucagaucuauuugaaauuccauucagauguuuaacaauacuaaacugcaucucuccauuuuacucugacagugggucguauucuuagcugugugucccaagcaggcauacguggaguauuuuauagcugugugcaccauuuauaacaacuucuucaugguggcgugaggcauuucagagcauuauauaagaaagucucuuaauguuuaugcuguuuuuaaauuagacuuagugcaagccaagaagaagccaagggcauuuucaaaguguucaucagaucauguugauucucuuuauuaaaacaucucaauggcuucuuacaaguaguagagaauaaaaaucaaauuccuuucaauggccugcaaagcccuacaacaucuggcccagacauucuuuucagggcucucacugaccuugucaguacuccaaaagugcuggcucugugguuguugaucuuguccuuauucauccaauaugcugggcugcuuccuaccucaguaucugaucucuucuguaccucaccauagcuggcuucucaucauugagguuccacccaacuuguugcuucuagaauagcuuuguugcaauggccuuuuuuucucuuuuacugucugcauugcacuucucauuguaugagauucuuauuccuuuguugguucauuacucuguguuugucucugcuuccccaccuuaaauaugauuuucaugcaaucagggccugugcuuuaguugcugcucagucuucagcaccuagaugagugcugaguaaauccugguugaaugaaugaaugguuuguuaaguggggaugguuacauuaaaccugcaugcgaagcucucagcacagugcaugccccagucggaaagcacugccgagcugcugcuguuguuggugagguuaauuccaaucuggaacuucaucauaacauaaucuauaaggcaaguuuuaagaauuucccaagccaaugcaguuucucaaaaaccagaaggacccucagucucaugauauagauccugaaguuguguuauuaggagauggcugcuuuuugacaguuuuuagcucaugugggcuugaccuucaaaccaguagcauucagcagcucucaucucugccuaggggcuuucugaccuuuugcuuaggcccaaggcaauguuuucaucucugacaaacuugaccacugccaguuucuuaagagugucgguacuuaugagaaggaguuguucugccugugcuguaaucaucucuaauacccgauaaacugcaaacaaugggggcauuugaggggggaaaugguacaacaaaaagacgucugcgauucugaggcagggcuaaacuggggcacguggaaaaguucuagcauguggaaugcugcacucgcagcucccauggugggggggaucuggacgguccugacaaugggccauuauaaaggcacuauugaaccacguaauuguggccuuuggaaaaaccauaaaaaugugucaaauauuauacaaaugcaaacuguacaagcuugaauguuagaccaaaaauuucagaaaaaacaaaguccucuccaucugaucaaacaguucaagaaaaaguugaaacaaggcgaauuucaccauuguguaaccccuucauggguuuauuuguugcuugcaaaauuuucaguagaggaauucugccugaauauauuuucauuuguccagaucuguaggcuuucauucucauggaaugucuagcuuguuuaaauuacaaaaucagugucauguacauuauagaaaauaauaaaauaacaaucacugagaauuuaucgcucgggaauagucauuguugagacuugaccgaguaauuugucauuaguuuuuuuuuuuggcuuugcauauauauaaauagcauuuaaaaaucaauuuuggauagcagcauguauaguguuuuuaaccugcuuuauguucccauuuacauuaaugaacuuuccgucucauuaaauauuguuagauuaacacaguaacggaaaaccaaacaccacauguucucauucauacgugggaguugaacaaugagaacacauggacacagggaggggaacaucacacaccggagccuguugaggggugggggacaagggcagggagagcauuaggacaaauaccuaaugcauguggggcuuaaaaccuagaugacggguugacaggugcagcaaaccgccauggcaaauguauaccuauguaacaaaccugcacguucugcacauguaucccagaacuuaaaguaaaaaaaaaaauaaauuugauauaugaaauucaauguaguguacuagacaagaaauaaacaaaaaauuguuagauaaaauguggauuguaaugacugcauaggauccauuuauauguagugguucucaacugagggcuguuuuguccccaggaggcauuuagcaauguuuggagccaguuuugguugucauaacuggagugggacaugcuguguuacuuggcaucuaauggguauagauuagggaugcugggagacagcaggcaguucacacaucacccccacaacaaagcaguaucuggcuccagugucaauagugcugaggcugaaagccugaacuauauggcuuccuuauaauuaauugaauccauggccuaugagauauuuguuuucaauuuuuuuauuagaaauuaauggcugaaaaacuuuaucuauaaaaaacagaguguuuuagacuuuuggggccgucggguccauuacucaacuaugcucuuguacuguuauagcuugaaagcagccauagacuauacuuaaaugaaaguauggauguuuuccaauaaaaccuuauugacaaaaaugggcggcaugccccaggcaguaguccaccuacuucuguuagagauaaugcucuaauagaugucuguguaccuaaaucuuugucccguaucugaucaucuccuuagaaaaguucuugaaaagagccauugcugcaugggcaacauguauguaucuuuuuaaaguuuauauccguuuauuuuauuuuaucuuuuacaguucuaccuauuuauuuuauuuucuccuaugagauuguucauuucauguagcuuucugaacacacuugcgccaccaucauucuaucagauuuggaaccuuguucagggauaugaagugugaauggguaagguaggauuugcagauuuaaaagucuucaggaaucagacggguuaaugaauaaaguaguccaguugucagugucagaauaaagagugaugagaguugcagaaugaaaaguaagugcucauugaaagggagaagcuacuucucaacucuguugcuuuucaacucugauaaguugcuggcccaguaggagugcaguuugguaucucuagaucuucugauuuaucaaccagaaaagagaaauccaaacucugguuugagaaaccagauuuuggguugaaaacucccaauuuuucaucauuggugacaaauucauagaacacuaaauucugucuaggugaacagacuugccugugguuuguguccauggacugccagcuuggggaccuuggaauaacugugacuuaucuaggggucuacagcuagaggugaaagcaaaucucaggcuuccggccggucauuugagacccacagggcccuacuggcuuguuguacugcuagaugagagcuguaagaauuggcaaucuuugggcagccccugauagauaaggaagcuuuaucaugugaaguaggguggcaggcugugaaucaacugccuggccugaagacuuaguuccucuagagcuuucuaacuuaggaagacugagggacugucacacuucauuuccucaggacguuuccagagguggucagaauccuagccuacaaccccugccuacacaauguggccccuuguucuucgguucugccccuuauccaugcacgccagccacagugguuccacacugcuucacugacguaccaaauacuugcugagugcccacagugugccaagcuguguucuggacaaagcagagcagaggagggagaaucaggagcacugguagcaugugggcuggauaugugaauauguccuuaagauaguuauaggagacaaggucaaugagguaaugcuccuggggugggguggagugggagaaguaggcacaguggacaggggucuguagaaucuacguggagaacuaacaagcuaguguggauuucugaacaccauacccagagauucugauucauuagcucugguuuggggcccuggaaugugcauuucuaauaagcacugugaauagcauugauguagggacuucuaggccauugcaaauacuuuguuuuuguuuuuuuuucucagaaauaaguagggaaccauuacagaggugggguuuuucuuuuuguuuguuuugguuuaguuucuauagagaaaugacuugaucugacaauaucacaagaucccccuauucauuguauugaaaauacaccgucagagugccaagacagaagcagguagaagagucaggaagcuuuccaucaucuaaguuugaagagaugguggcuuggaucagaugguaacaguggagcaugaaaauccaucauauucugauuauuuucugaagauggaaacaauauuucuugauggguuggauccaggguaugaaagaaaggagucaaagauaaccaugauuuguagaaugagcaacuagguuaagccagaggaagaccauuuuuugaccuacccccgcccccaacaaaaauggcaauuuucuauguuucaaccuaauagaaaaaaauggaguugccaacugugaaaaugcagaagaccgugggaggagccaauuuggaagaguggaugaacaugcugagcuugagagucugcaguccuccaaacggugccgucucguaggccaguggagaugagucugguucucagagaccucuguucuggggugcuuaaauccaugugacuggguucgaucaccagggcugggaguguagauagaugaaaucaagcucggauccuugaggcacucugacauuuagaggggagaagaggagaaaacuagcuaaggagagugagaagaaaugaagaacgugagagaaaaaccaggcaagugugguaaaucgaaagccaaguaaauaacauguauuaagagccuccuugcuguucuuugagcaaccaaggcuuguucacaccugagggcuguaugcuuggcuggaaugccguuccugccaaucugccuggcucaucucaccaacuucaggucugggcgucaaugucauacucugugaggcccuuaccuaaacacacuguguaagauuugcacaguugccuggcaucuaguuggugcucaagcaauauuuguugauugaauggugaacauauaacuuuugaugaaggcagcaguccaggugagaacauaugaaagccuugcugcucgggauguaguguguucccuggaccggcugggucagcauccccuggcaacuuguuagaaaugcagaaaucuugggcucuagcccagacuuguggcaucacacucugcauuuaacaagauccuccagugauuuguguacacauuaacauuugcucccaguccuguauuuaauuuucuaugaaugucaagaggacaauugaguauacucucucagaugggaacaacucaaaguaagaaguuaaaacaaucaaaaucaaauaucuucagugguuguuucuguauucaaucagaaagcuaugauacaguuuaaaagcaaaagaaaacugugucgagacuuucaagaauauuuuaugugauuaucccccuaucuuuuuuacuuuuauuuuaugugguuauuccacauaucuuucuuacuuuuacuuugaauugacauaagcuaggagcgcauguaaaaugcauggcaucugguacaugguagacaaguuugagagaaugagcacuaauuccguucuuuauauuuuaaaacaucgugcuauauaauguaacauauccacucauaaugucuuauaagacccucauuuaagagaaaugguuuucucuucuauucggcugagauaaaaccacauguucuuuuuauuaucauggucuuuggcuuauuuuagccugagggagaaaaaaauaauguauauauuagggauuuucuuaugauaacaccuuuuuucugaggcuacuaaauauuguuuguccuaaaaccaaaguaugccugucuugugguuuauaauaagcauacuguuuuauaggucauuagcuaaggauaaaagacuugcugggaauuuuugauagggcuagucuagucuauucuguuuuaacaucaaauuuucagaaaaguacauuuguuauccuuuucuuuuauacauauuuacagcucaauucucugaauucagaagccuacaauguaauaagacaggaaguaguaugaaaguauacagacccauaaauaugugauauaaauguauauauauuuauuugugcacaccugggauaugcaccuggaauaugcaccuggaauacaccccuggauuuacacaguuuuaucuucccuucuuauucaguuaaaguccuagaucagaacugacccacagaagagggagcuucucuaguucgccucugcggacagaauaauggagacauggcuaugguuucuaacccuggcaaguuguuuagguuuccucuuaguuucuguuuucuuuagcuuuaaaaagggugggggguaauuaagcauauccuguauucuuacaaagaugcuuguccaguuaagacaguaguuggaaaaacaacuguaaaauuacguauacauauacuauuucucuuuauuaaaaucaccccauucuuuccuucaaauccugcuaaaacuucuguugaguaggaaaguucaauucuaguuuggugaaacuuuccuagagagcaggggucagcauuuucuauaaaaagccacaauguagauaauuuuaggccuugggggcccugcagacucuguugcuacucuucaaaucugcuauugcagcaagggagccgcccuggacaacaugucaacuaauggguguggcuguguucugauaaaacuuuauuuauccacauugaaaucugaauuuuauauaauuuucaugugucaugaaauauucuucuuuucauuuuuuuucaacuauuuaaaaauguaaaauccauucuuacuuuauagaccauacaggcagcagaccgaguugggcugauggguggacagacuccuguuguagagaaaaagcacuggguuugucaaccauagccauuucgaaccuuucuuuauuuaagacucuuugguuugcuuuguauuugcaucugauuuugauucuucucccuuaggccaggauucauacccuuguuguuuuuacuuuuuguuaaggacagcuuuguacagauuguacaguaaacaagauuauauguccaaggauauauguucugggcuuuuguuuucuuuugugguaauguaauugugggacugaaaagaaccucgacacuuaaucagaugugaccuuuugcaagacuauccuaguuauuuaagaaagcuagcuuucucuguuuuaccgcuuuuuucaggaaauaugauugcauaacugacauucucuauggauugccauuuuuaaaacaguaugaaaagaauagugguguggugauagauaacaauugauuaaaggguaaucccuuuaguuuucuuuaaacuugcugagcaaaagaacaaauuaucucucuaaacauaagugauaaaucugaacauuuuguugaauuauuaaaaauauauauauauaaagccauuugaguguagaagcaugucauagcuacucaggaggcugaagugggaagaucacuugagcccaggaguucaaggcuguagugugccaugauugcacuugugaauagccacugcacuccagccugggcaacauagcaagacccuuaucucuaaaaauauaauaaauaaauaaauaaacuaaaaggauuaagaaaaucuacacucgcuucuacuugaauucugguuuacaaauaguagagagaauagaagaauaguggauaucuagauagggauauuucuuccccaguaaauucuguugucagccaagaugguaguaucuauagcuaccaucuuaaacugacaugugaugugcuccaggaucucuuuagaaugaaacugauggaaaauaaccugucaguuuuacccaggaagugguaaagcugaagugugacaguuaggaggugauccauuccgauucucuugcuauccauucaagaucugaaugaagaaaggaaacaggugaaauuacaggagugcuaacaaugaauaaaaguuacaaagccuuuggguguuugcccuuuaacucagauagcuagcauaauuuauaugaaauauaaguuauaucaauaaauaauauuuuaugauaaaguauucuagcuuuauuuugcugucuauacuucagguguucagcaguacucaacuuuugcuaucugaauuucuuagugugguuagucaucuggaaagucaaaaacaugcaaacauuaucaggaaaucauaaagauguuucuguccucuuuaaugcuacauauauguucucauuugcauacuucuuuggcuauuuaaaaauuaaugaaagcaaaguuauugacuaaaaagcuaugaauuaggguggcugaagacagaaaauuauauuuauauggcuuuuuaaguugucaaagggcuauagagccucauaauaaugcuaugagggaguuuggacaggguuaguaucuuucuccagcaucuucucagggagggaaguaaacauagagaggcuaugucacacaccaccuguccacaguggggagugacauugcuggugcagugaugaugcuagaaugccaaccacauucuagaucagggguucucaaagugugaucagagggcccugguuguaucuaagacccuugcaggaguucugccagaucuggacuauuucagaauaacacuaagauauuguuuuccuuuuucacucucauuucaccaguaaacaauagaguuuuccgaaggcuacaugucguguugagaugucauuguucugacauccugugagauaucuacuaauguauaaucguguguuuucaaaaauucucaauuuuaauuucuaauaugcuaaauauugauagauauaauccauguaaacacaauaaauuuaaagaguguaaaaggauccuaagacaaaaauguuugagaauugcuguuuuagauauugugcuaaggccguuagaaacaugaucucauuuaaugcagaaaacacacauaugaggcaagcucuacugucauucccauucaauaugcuaggagaugagggccuggagaaguuaaugaauugcagaagguacacggguuguuaaguugcaaagauagaaucugaacccagguuucaaguuaagaacuccacugucuguguugucaggcacauugucuuucaaagaagcaccaggaaaugccuggauuuggacuaauuucucagaagagaaacuucuucccauaaccuaggcuaucuccaagggaauguaaauaugaagauuauccuuauagacaguguaaaauagagauuauuuucuaguaguuugugggccgaggcuuguacucugugaaacacaaaacaguugagcaucggaucuuuaaaccuggaggauuuuacuuaaaaaagaaguuuggauugccagcuacccuugaaaaauuuggagauuuugagcuaggcuggacucauauucccacauggccacaaucagcugcaguuuuuaucugcuguuccugcuagauagauguguguccucugguuugccacagaccucacuacuccuuauuaccuuccucguagcucauguuccucauuuauguugccuguuugagguauuuggguuagaaacagcuggagauguucugucuacugcauaguguuuauaggccaucugcuuucaacuuacgugaaaaauaaaaaguuauuaacaguaaaagagccaaauauaucccauucugcuuacccaaaccuggauguaauaaagaccucacugacagugccacauagaaagcaaauugcuucuuucuuuacuaaagcauaauauucugauucauuaaagaauuaggaucugccagugaauuaacauuuauuuuuaaacaugaaucucuuuucuuuuuaaguguaauagugaaauaagcacauucuacucauugcccucauuuuauguuuauuuuaguaaugucuacugucaucauuaucaugucuggacccuuuauaaaaaaaaaaucucugugaaccucuguguacauauuaaaucagucauuugaaacaauaugagauugucaaccuaacggacugcauuauccugggcauuuagacaacauuauugaacuucaaauuuuuagcuuaacauaacauuugucagcaguagauauuaagcauuuaucauaauuuauaaguauauauuugcuugccucuuuucuuuuuuugccucaccccagaauauaaguuucauaaagcuggaaacuauaucuguuuguucacaauguauauucuaugcuuuguacaguguuuagcacuuaacagucaauaaugaaugaauaaaggaauaaauauguaaauauaucaguguuguauaugauaacucauucuucuguaaucuuaagaauaauauguaaaaauucucagcaaaaaugcucaugcuuuuuucauuugagaauuaaauaggggagauauuuauuucuuauuauccacauaaauauauauccacuucugugugugcuauguucuauuuaggauagugcccggucuuccugaugugaggucaauaggcagguuacacaucuauguagcuaagaauaaggugcauauuaagaccaggaugcaagaagaggcuguugaacuugaacauucagcacagagucucuucucuucuauacuaaaagauagucauccugcagucggaaguggcaguuauucggccauuggaaaagucucauguaauaguagcuuuuagaugaugucuccuccaaaggggcauucugcuauuaaccuauugcugaaagagaaauaccauugucuauuaauacuacuggaacuaaagaugaauagugaauuggccuugaucugacagugaguuugacuuugauagcucgucacuuaaaaagguucuuuuauauuuaugaaaaaaagcaugacgucaagccagggggaaaaauugauaucaacauuuaagaccaaacucguagggcuuccaaaaaaaaggcccuuaugugaacguuuuuuuuuacaugcauaacuaauuagcuuagguuauuauaagcagggcuucugugauaaaguuuccgguggugucucgggauaccuuguuuauaguaccuucucuuugccaguccaucuucaaauuggaauuauagaaaguagagggagggauagucuaccgucucucacuggauuggugccaccuaaaacauuguuaugcuggaaaugcuagaauauaaucacuaucaggugagauuuauucugacucauauucagucuuugaaauauaaugcaauaaauugauuuaauccacuuuuuguuauuguaauagacauacuguuuucaauaaguauaaaucugcucuuuuaaugcuguuuauuauuugaugccauaagaaguaauucaauguaguuuugaacaaaguaaauauuaguaggauucuuuuuuuuuuuuuuuuuuggccuaguguguggcuaaacuaucuucaucagcuccuguucauugcucauaagauuaaauugucuuuaucaagaaaaaagugacuuaaaauugaauaauguuguuuuuuggggaaaaguauuucucguucugaauuaaugucuguaggaaaggagaaaaaacauccuguuggcuuguuaauagucaugucuuuuaaaacacauacguguaaguguuaugcauuugaaagaaacuacuuaauguagaauugcuuuuuauguugaguuuuuucuuaauuacaauguugaauaaucauguccaaaugaaaagugggagaauuaauccacaacuaguugauuuaaucauuggaagauuuauauuuauuuucuacagccauuuuacacaguugguucuuaaggagguguguguguguguguguguguguguguguguguguguguuuuaaaaagaaagcuguucuguucgccaaggaaagugaaacaaacaauuaugccacuucuacauuguuguuugaucuuaauaaacccuuucauguguguuggggaaauuuuugcccuaagauaauuucaaacuuuuaauuauuagauaugagaagaaggauacaagguuugaaagagacguauaguuaauuagcagggaaauaaaauagggcaaaguauuacaccaaauccuacuaguuagacuuuaaacuucaguaauaucaaaauccguuagcacagugccugguacauaacaaaggcuuaauaauuuauucuguugguggccuggucaguuucauguuugugccugaaggaagagccgucugaaacucacaaauaacagcgcuguuuucuuuucccuccauggcuauguucaggugcagacccaccucgaaaaccccaccaaguaccacauacagcaagcccaacggcagcagguaaagcaguaccuuucuaccacuuuagcaaauaaacaugccaaccaaguccugagcuugccauguccaaaccagccuggcgaucaugucaugccaccggugccggggagcagcgcacccaacagccccauggcuaugcuuacgcuuaacuccaacugugaaaaagagguaauucaugucuccucuccucuccuguuuucuuaugcuaaauaacuugucuguugaauaugauucccacacuuaacuguggacucuaguuuguccuuguggccacauuuaccagccuuuguccccgauucaccaucguggcuguggcauuccagccuguugucuccaucgcuggguuauuggguguagagcacaugacgggagaccuggcccucuccaagugaaauguggaggcgaggacacuuuugccacuugcuucuucuuccuuagcugagugcucucuucucuuccaugccuuucaguuuaugaagcagugagaaugcagagagaggagaaggggagguggaaaaggaaaagcaaaaauagaagaggugugggacaugcuguuuagaaguuccgcuuguugugaaugucuggaauauuauuuuuauuucucccugaguugggggaagaaagaauggaauaugcauggauggauuugaaucauauagcacaugagacuuuaacggaaacgcaaagguuuaauugcuggauacauucuguuucauaauaaaauugccacugcccguuaaaucugcuuuggugaaggcuggauuggaaacaagacucaaacuaccuucaagcuaauuggugcaucaaaauuugcagcauacaaauaccugagagcugugauuuaaugcucauuauuuccaaauuaugagaugaugagcuucaucucaaugggauuuaccguacuauggacuaugaaguguuuaugcaaauucggaggcaacuuuucuagaguuggauugauuuuaauuucuagagggacuaaaaucuuugccccuaugcccaaaccaacugcuuuauuuuucucuacccaaauuugucaucuagcaagaugauuugacacaaguucuuccuucauuauuucaucuuuuggucagauuccacuuuguuugaaagcuuaguucaucuuguugcugugccaucagcuuugugugaacaggucauuaaaaagucauuugcaaauccaaguuauagacuguuuuugcuuguguuuuugcagggauuuuauaaguuugaagagcaaaacagggcagagagcgagugcccaggcaugaacacacauucacgagcguccuguaugcagguacugaaugacuuggcagccugaggaugaacacuuuguaaugagaaucuauauuugugguggaucacaccuuccugaaaacuuaagcauuuuuuucccccauuguuuuuuuuuuuuuuauagagaaagcuaggaacauugccauuuuccucauaguaucucaugauuaaauaaugacaagggagaauaaacuaaaauguguuuuuccccuaaguugcugcaaagauuaaaaacuucuuaaaguacauaaauuuuaauaagauaugaaauauguacuuuaacauaauccauauauguuauacaaauuuguagguuagcaauuuuuguauuaguaaaaccaagauguguguguauaaucuagauauuguuuccuaaauggaaucucauggaacauacauuuugaaacuauauuaauuuaauaacauauaauggaugcuuucccaaauaacuaaaguuucuucuacuacauccuauuuaauggauauauaaauuaugcuauaucuauuuauauaucuaugcauguauauagauauaggagagaaugauaagcaacaaaauuuguugccuuucuauguuuccugucaucaacuugcauuauuuuugucauaagagaaaaaaauauuuuaaaaaugcuauuacaucaagcccacuaauuuuauuuuucuaagaacaaaauuaaaaguggcaaggaaauguuguucauaaguuuccuagccuauuugcauauuuaccaacucaauuagaaaaucaucucuuaaagacaaacaaaacaaauaaaaguggugucaauagaaauggaaccuaacaaacaguggauaguaguuauucaaaacuggccaauuauucuuuuuaggggucauuaauaagacuccuuuuuugaguguuuacuauguuccugguacuuugaaugcucuguacaguuuguccugaaaucauacaagaauccauaagacaguaaauauuaugaacccccauuuuauagauugacaaacugaggcuuuaaaagauuggaggcuuugcccuaaucuagaaagcaggagaacggggauuccaacccaaaccuaugaauuuuggauucucuccucuuuaauggaaguggcaagagacagaagagcaucccuguuaguucugugauuucauuguguaacuaugaaguccuguuaagacccaagcacagacacaccaacuagcucaaauacauaagguguuuaugaagaaauguuuucacaggcuugucuuugcaacugcugcaaugcacauguaaucacuguuguuuauuaucauaacuuauguuuugguacuuuagaaauaaaauugaucuagugggaaugucagcuccacgacuguaaugauaaccucauccugguguacucccuggggaguaccaagcacacugguagcuguacaaggagaaacuuauuuuacaagucacuguaagaugggugcagggauagccaguggccugggagccacaguguccacacuucccuguggaacacuacagacgguguuuuccuucugcaagaaaaggguaggggccaucgucuuuagggaaaaaaggaaguagaaugacagcugucauucaagaugaagugcugugguacaucucuccuguuuagggcaggcaguuuagcauaguugugaaagcauggguuaaauuguggcuccagucuuucuucagugugugacuuugggcaagcugcuucucauuuauuucaccuggaaaauugcuauaauaauaguaccugccaugauacgguuuucguuagggcaaaaucuuagccuaugaaaauccucgaacccaaugcuuggcaacucauaaucacucauuaaaugcuggcuacaaguauuauccucaucaccuauucguguuaauggucuucaauacuauuuuauacuucaauacuauuuuaguggaaagaggacaguuacuucuuagaaucuaacuaaagaccauuauugcuuuggguaaaaaaagaccaugagucucuuuuuagguuguguugcauaguuuauuuauuuuugucucucuucucuuacccuuuuuccuacagauggaugauguaaucgaugacaucauuagccuagaaucaaguuauaaugaggaaaucuugggcuugauggauccugcuuugcaaauggcaaauacgguauugauaaccuuuuuuuaaguagaaaaucuugagguguuuccaggguucuuuucuuuuuucuuaaacuuuuauuuuaucuuuguaacugguucacugauuaaauguauuaauaguaaaauggagaauuaucucaggaucacaaauaagugacuuuaacaucagaaauuaagaaguuuuuaugaguuuaugaauaaucccaugauaaaacucuacauucccuggaguccacgagcaguuuugauagggcauuagcccuuccaauucccuugacaucuaaugcccaacccaguacacugcagccaagggaaccauugugaacugcacuauucacaguggugcucuaguuggccugaaaaaguugguucaguuuuucaagaagguuuucucauauucuuaggugauagagggacauuggaguuacccuucuccaacagcaaaaucuauuccaaccucaguucauaaacaagugguccuauuugcuauuguauguuacuuguuuuucucuguaauuuagagccuugccuauauuguuuauuuuccuucauuccuuacauuuuagucuuauguuacuguuuuaccaaagucuuauugcacaucuuauuuaguccuugcaguuauucugugagucaaguucggaugguaucauugcccucaguuuuaaacuguaacuagguuagacagucuuacgcaagauuacauagcuuggguguaucagagccaggccugcuugguaggucuuugaaugccuucuccaauccuuuucuguuuccucugagagcaaugcuaugagacuaucauauucuuaauaacuaguguuuuaaagaccaauauuuauugagaggaaagggaaaaggggaguuguuuaauggguauggagcuucggauuugcaagaugaaaaauucuggagaucuguuugauaacaaugugaacauacauaacacuacugaaccauacacuuaaaauugguuaagacggcaaauuuuauccuauguguuuuuuaccauaaugaaauuuuuuaaagguaugacuaacuuccaguaguaaauucccuuggccaaaggacaaaauaacacuuacuuagguacaccagaauccucagaaaauugagucuuauaguuagcauuuucuuuucuuuuuuuuuuaaauccaucuugauccaauucuucaaguucacuuccuugaacucauguggggugaggacuucccuugaaaccucaagcuucuuuuaugauauuuagaguuugucuacuuucuacccauuuaaacccacccccugauuuuggaagaaccagguguucuacuauugugaugaaaguuuccaugccauacucuccgaaccucuuggaauccuugguuggcuucuguggaaccuuccugcuuacaaguuguugcauccuaugaggccaaacuacacuuaucuagcacucagaauccuaggacaaacaugaguaaaacacuugggggagcaugcccuggggaauuuauaaauauacccaaagacauggguauauuuacauuucacugcucuagcagcauuaauuagcaauggcccagucaucucaaaagaacuuugcugugagaguggucauuuugcuaguggugucaaaugggucccugggcacacucaagugaacuguagaauugacaugauucuguaaaaucauugacuuuuuuuguaauggcaaagaccuuugauaucauuuggucuaaccuaguacucaaugcauuagccuccucuuuuuuuuuuuuuuuuuuuuugauacaggguuucauuuuguugcccaggcugaucuugagcuccugggcucaagugaucuuccucccucaaguagcugggauuauaggugugugccacuacaccuggccugaccuucucuugcaucucguuaguauucuccacaaaaaaaucaaggcauccagcuucuuggaagccuccaaaaaaggaucuguacuagcucacuagggaaauagcaaagcacaaugguuagaauuuagagguuucugaccagaucuggggucaaacccugaaucuuccauuuccucugugaccuugcauguuauuuagcuuccugaaacccuacauuuccccaucuguaaaauggggcuguuauauauaccuauauuauguggucaacucacuugguaaagcaucuguaguauuuagcauuggaaacauaaguuguauucaauaauguuaucuaaauuauuaaguauaacuuauuaauuauaauaucaaauaauauugauaguauuuguuuauucagcugaucuucacugagccccuauaauguaucaagcucuauguuagcuaucugugagacauaucuaucucacaauaucccucacaguaaauaacucuguaaauugcagcaugggucccaguuugcuucauggagaacuuuuccacauaccaccccuucugaagacaguugucaugaccccauauaugcuucuguccuuuagaaugaauacuuggcuggguccaugguucacgccuguaauccuaguacuuugggaggcugaggcaggaggaucacuugagaccaggaguuggagaucagccuaggcaacuuagagagaauccgucucuguaaaaauguaaaaaauuagcugggugggguaguaguacauaccuauaguccuagcuacucaggaggcugagaugggaggaucacuugagaccaagaguucaaggaugcaaugaaucaugaucgugccacuguccuuuagccugggcaacagagcaagacccuguuuuuagaaaacacauuuaaaaauaaaaaaguagaaugaauccucauaccucuucauuccaucuacauuagcguugaggccuuguuccuucauuaucucguuguuccgaaaguauauuaaagauuaauuuagcauuuauggauaugccuaauagguggccagcaccaggcaaggugcuguggaugcgaaggugacuaaggugugcuuccuguucucacggggguuaccagucuagaagggggagacucuuuuagcccuugaggggagaaggacaauucaggagcagagaggccaucucaagggaauuuccagauaagaaagauccucugggcagaguugaauuaacucccagacaggagaggaguccccugcagccacccuuagaagucacugacuuuaucccggcauccacuucucuucuuuauccccauacuggaaaggcuaaauguggcuccauuagagucuuucaacaaaucuauuucagcauuuugccauuaggggaaagacaauguaacuucaacauuaggagcacagacucugaaccagacaucugaauacauacucuugacggagugauucaaccucucugcuuguguuuccuugucuguaaaauggggaucauaauagcaucuacugcaauagaauuaaugggagaauuauaagagguagcccacaaaaagcauuuagaacaguugggcccugauaagcucucacuaaaaguaaguuacuagcucuuauucuugaugaacuuggguuuuaguugucaaaauuaaguaacaaagcuacugcaaccuauuaacauuuuaauuuuuucccacaguaaaguuuaauguucuucguguuaggcauuuuuuucuuuuauuugauuauuugaaaugcuuuauuucaaguuaacuacuuaggaaaaaauaaaguggaaggaacacuuagagaggaaacuguccuaagggaauugaagucuagaaauaacuauucugagagcacaagggcccucuuguacuaucacaaacaaagaauaaaagucccaguuuacuuguguuaacagugcucaauugauauucagaaaaggggaccauccagagagaaaaaauaauaacguuuuacaauuaucauuuacuuggaaaaauauucauuuugguggagcacaacauugaagaacucaauucagaccaguaugggggcauagacccaggcgcaucuuccuucaauuuguuuguccggauuagacuguggcuuucaucuguccauggugcaguuugugcucuggaagugaaaucuugucauuuagguaaauggccuggauaaaaaucccacaaagaugugaaauauacauguuaauagaagaagucucuuccuuuuucuuagcucuaaagguguuauuuugaccuaauuaugauguuaacuguauuuaucgggaaaguuuucuaaugcagaagaaccaacuacagaauccuuucuuuaaaaugcauggcuaggagacacauuuuaaauuauuuccaucaaccuuccuuuuaguagcuucagcaaauaagagcgguugauagaaagaacauacaccaccauuuaggacacaguuucucaaauguggaacuguugacauuugggauggauaagucuuuguggugggagacuguccugugcauuuuaggaugcuuaacagcaucccuggccuucacccacuggaugccagcagcaaauccccugcaggugcaucaacugaaaauaccuccagauauugauccggggaaacaaaaucagcucuaguguggaaugccugacuuggaauaaugacuggucaccucagccuugcagauucccugauuucuguuccuagauuugcauugcagucugguaaaaaauugucuaaucguugacaauguacuuaguaauuaacauagcaagugguuuuguugaucaagugaaaauuagcucaccugucaaaacuguaaagugggaauccaguacucccuagaaaauuagaauacuguauuguuaaucauagcaguuaccacuuauugaucacugaaguagcaggcacuguuucaccuacuuuaucucuauuaaaucuuauaagaccccugugagaagaauguugucacuuuucaauuggagacacuaagccucagagaacuugcuuaauaucacauagcaaguucguaaagaggcaggauuuuaauccggaucucugacuccuaagcacaggcuauaaaguucugcaccauuaaucgguaaauuggaguauccacauucggcuaguaagcggcaggguuuuuauuuccucaggucuaauuggagaugaauugaaaguuugcaguuucuaacugguuaauaucagcauguugauacucuccccacccccaguucugcuguuaacaugggacgugagccuccgaccaaaaaccuccauuaggcaauggcaaaaaucuuggcuuuucuuucuguaaaaagcaguaagaugccauacacaaagugccauuuuaauucugugcuuggcccaaaguaggcacccaaaaaaugagaugacccccagcaaaauauucugccaugcuuucugcuucccacuccuaaucagcaaguaugggaaaagcagccgaagcaggaaaucuuucagagaaguagauagagggcuauaagcuuuuucaacuggaaguaaugaugucugaucucaguagagugcccaaugaggcaucuugcuauagggauuuuaauucauuucccuuuuugaugugcacugucgucaauccaugcuaaucacagcaguacuuucuguaguuuuucaugcaucucaauccauuucucacuagguaucccccacguugcucuuugucucccccacccuguccaucucgcugucuauggcagaaagcauucucucucucagucauguacauaucucuucuuuagaauauaguuagaaaauauguucuuguccagaagaagcuuagaauuagauaucuguucaacauaggucuaucaaugacuuggagauguguaucaguugcuauuauuuaucccuaacaaaucaucauaauaacacagugaguuuugcauacaauuugccuaugaaaaccauaugugugauuuaccuuucuagagcaaguggaauaauuuuucuuuuagcuuauugcuuugaauuuucaagucacauucuugguuuguuaaaaccucaacguuuucccaaaauccaaaauucucaaaagauaggggaauaaagcuuuggaauccaaggaguuaccagacaucauggcagcuguauaaguuuagucuuucugguacuuuacagggcuguuuugaaacaugugagugccuuucacuuugcguuaaauuggacaagaauaaaacuaaacacacacagagcaagguugacccugagaagguaaccuauuucaacuaaaaccacuuagugaaaugacagcuaauaaucaaagucacuuuuuaucaauuccuuaguuagagggccuugaaauaccauacaagggcauuuuaaaugaccacgaugucuauuuuugugccuguguauggggguauguguauuagguuuuaugcauauacuauaaacgcugcuuucaaaaaggagcaaaagagggaguuguauucugcuggucugucuguccucccugccuaccccaauucuguucgagccagugucugauucacccaucaagaaguaucuuauuccauguccauugccucccacccaaaucucuuuagcuagggguuuaauucauagaguauauguuuagaggcuaucacagaaauagaugcaaugguuaucaaugaggggaagcacauucgacuuguauuuugugguauauuuucaucuguauguuaguggucauuggagaggaugcaagguacucuguugaauacaguuuuuacuagauacuucucagucacuaaacacuuuaaucacaccuaaaugcuuucugaauguacuuuucucagauguagaauacaauuccauguguaaucaagaaaugggagggcuaaacgacuuaaagucuuacccaguaaucaugguuauagaaauuguuugaaucaaucuaguaaugguacgugucugcaguggaaggagugaggucagucaacgauuucuccauaguuacuauuucaaacuguauuucagggcaugggaagggagaucaacuugggccuuuucuacaaaaacaggccuauaaacugcugcaaccagcuaguuaccaagaaaugcacauacacaaccaaaggaggacucgcugcuuuaaaacagcccauucagaacuagaggaaaaacucugacgcuagcuuggggaaggcuaaauauuucuuuuacuuuuuuuuuuuauuauuauucucuugaaaguguaaauuuuugcucucuuuuaaagucugugggcucccucuuguggcuuuguggaaaauuucaauuucaaggaaacgcuuuuucucucuagcaauaaggaaaucauuuccaauuaaaaaaaaaaaaacuuucauugcuuuuccuuguaaaagaaaaagugagaagaagagguggauacgagaaggaaggaacaaaauuaacuuuaauggaaaguccuauuuggugaaaaggucauuuuauauacaauccuguuuuacaauaauagccaacauuuccugaacacccacuguuugcuacuaguuguacuagauaaugcauucaccacauuauucauugccuccaugcucaaaauaaacugacuggcuaguuagaguagucauuuuaugggugugagacuguacuuuccugccucaaagggaacugguugaggagauccuguaccucucuuuuaauaccugugaaugaaaaaguaaacaucucauauuuuccuauuuuaaaaaugauuuuuuguaucaaauaauuuuucuuaaauaaauccuagaguaggauauagguuuuaucugaaaaaacaugggaauuguucaacaguuaauuucuguuacuguuugucucucucuaguugccugucucgggaaacuugauugaucuuuauggaaaccaaggucugcccccaccaggccucaccaucagcaacuccuguccagccaaccuucccaacauaaaaagggagcucacagguaaacaccuaguaaaugugccucuuacugcagauuucuguccauuuccugauaagacaaaguuauugauauagugaugugcaaacuauauccaacucauggacguaacuuuuauaggucucugcagugguuaaaacauuaugcaauauuuuaagacggagaauuuauacuugaaaauucuguuuuuuuucaaggagauccuugaaaaucuccugagauacugggaaucggggccaccauuacugcaugucaccaaucacuguguguguggugaagguccccuuuguguuggggauaguaggcaacucuuucagcuguaacugucuccacccuaccugauauguauguuucuaacaagccccuagaggcauuugcauuugagaacccagaucugaauuuuccuuugacacacauucaagcccacaauugggauagcauaagaauauauuucucacaucuucagaugccuccuguugucuuuugcuguauugugugcaaaagauuuauuacacagaggggaaaaaauuauaaaauggagcaauggauauuauuuguucuugaggcaagugugaaauuacuuauuucucuacuuugcuuaaugcuuuagggaaggcauuuauuuggucauuaaaacauggcggaaacuauauuagaacuggcauucuaccauggugaauuuuauggcccuuaccacaccccucuuuuuauuauuugauccuugcauccugcaggauuggaugaacagacugagaauauggaauauggauuugguacagagaauuccuguuccagucaaggaugucuuaaaaaaauuuuuuuuagaaaauaagcaggagaaagauguuuuuuaaaaaccauggauuugagugaaaagaguaauuaauaaguaaaaaccauccaaaaccaaaacacaaguagcuacccuaccaaaaaggaaaauuacugcaagacaacaacaacaacaaaagcaagaaucgucgggcaggcacaguagcucacgccuguaaucucagcacuuugggaagcugaggcaggcagauugcuugagcucaggaguuccaggcugcaaugagcugugaucacaccacugcacuccagccugggcaagaggaaugaguccugucucaaaacaaagcaaaacaaaacaaaacaacaacaacaacaacaacuuaagaaucauugaaguggaggguauguaagucaugcuucugugugaggaaaaaaaaacuagaaaaugauuugaacugaccaucacaacugaaagaauucaacuucugaguuauauauauauauauauauauauauauaugcacacacauacacacacacacauagauaugcauauauaugcauauauacauggauguaugcauauagauaugcauauauacauggauguaugcauauagauaugcauauauacauauauaacacccauauaauaaauauauaugguguguauauauauauauauauauaugcuucaguggcuauaaguuaugcuaaaaagauuucuauuuugagauaaaauucuaaauuaugguaguguaaugcuucagcuaucacuucugaaaaggaaauaacagagcuuucuggauccccagauuggucaaguaacauguuuuguuuuguuuuuaauucuguuuuguuuuguuuuguucucuguaaggcaaaaaguaaucucuuaucccagagaugucacaagaguugcuaugcaaauagagcuuuccaauugcaguugccaccaaaugccucuauuccuauuuuguuuuuauagacucaagcuaguaaauagugguuccuaaguuauuagaugauuucauuacagcagguuuuaacagaaucuggcaccaacuucugaaaaaaugaguucauucuaugaaguagugaacuaguuagaagagacagagauccaauuuggcagcuuuuuuuuuuuuuuuuuuuuuugagacagggucucucugugucuccugagcuggugugcaguggugugaucacggcucacuacaaccucgaccuccugggcucaagugauccucccaccucagccucccguagcugggacugcaagcaugcaccaccaugcuggacuuauuuuuuuuuauuuuuuguaaagaccaaggcugaucuugaacuccugggcucaagugaucuuuccacuuccacuucccaaagugcuggaauuacaggugcaagcaaccaugcugggccacuacucaguuuuuauaucagcacguuacacaggcaucaaaaaaggauugaaagcuucuauggccugaaaagaaaauauaucagaccccugauaauagaguaucaacagcaaauugacauaguuuucuaauuaucgauuucuuucuugcuaguaucuguauauguuuacagugugcuauauauaauuuuuaccaggguuuuuuuuuaccauuuuguggaagcccaguuuuuacauauuguauauaugauauauauauugcuuuugaaaacaugcaagcuuuuuaaaaagauaucauuuuuaaaaaaacguauuuuuacuuagagucaagucaaauaagcuucuguauguuugggaaaugagauauuuuguaguuuacauuuugugcaacuucaaacaguuccaacuucuaaugacuucauucacgugcacagcguguauuuuucccacagagucugaagcaagagcacuggccaaagagaggcagaaaaaggacaaucacaaccugaguaaguugguuuuauuuauguucaugacauuugauauuaauguuccccauauaucaaaaauguuuccagaaauucuguagaggagaguugauuccuacagcuguuaaaauucucucuuauggaagaaaauuguauuugacagaaaccaagguauauauuuuccccauauuuuaucucagaucaaauugaauuuuguauauauacuuauuuucaguuucugaagaguuuuuauuuuucuuguuucuaguagugguuuucucucucucucucucucuuuuugguaagagggagaauugauccccaacuacccaauuauaaguguugcucacacuggaacuuauuaacaaaaggggauuagggaagcaccuucuccaaugagauuugaaagaaaaagaaagaaagaaacagaucugaaggggaguaaauggaugaggcagccuccuaaauuucugacaugauucgugacuuaaaaaaaauagcccuaaagcauuuaaaauauuuuuuacguguuuaauuuacucuugaucaaaucuucaaguugucuccuacgaauacuuuaauuuugguuuaauauaaacauguaagacaaguugcacagauuuuuuuaaaaagggauugggcuuggagguaggaaauugugugugaauuucucaucucauggccucauguccucuguuucuuaaauugauuuuuaagaaugugagucauauauaaacacuuucuccuuauaaaaaugauagaauaaggccagaguuccccuuuaguccccaggaauaugcguguugguuucaauuuggcauugcucuuccugaccuuuuucuguguauuaagaauauagacacaugcacacagaaaauaaaucauauggauuucuauauguuuuaacacaaacgguaucauauuguccauuuuauguugauuuuuuucuacuaagcagcauguuuugaagaccuuuugcuguuagaaaucuagaucuaucuacuuuuugaaaacaaauugcauaguauuuuauagugugacuguaugauauuuaguaacuucccaacugcuguguguuuauguuguuucuaguuuuuuccuaucauaagcaaugccacaguuaacauuuuuauaugugucucuuuguguacaagaaaguuuguuucucuagguuagaaaccgaacugagaggcacaacuucuggguccugugggugcugguuuuuacuuuaaaagcuacaccccuccccaguucucaugucaaguguaagaagcucuccuuaucuuuuaaccaagagauaaacuauuaucuccaaggccuccuccagcuucuaaguaauuuuacccuaagauauuucuucuuuuaaaacaccuuagaaacaagauaauuaggcauuauccaaaacuacuuaagugagauguggaaaacugaguuggaucuugucaaaaacaauagauaccuguaauuaggcaccugaacucucaaggucaagguugucaguaaagugcaaacaugaucagcucaaacucugaaggcuaugaagcaaucuaaaagucucagccaaccauugggaauuaauacucaagguuagauugccccuuggucaagcuguuccucuucuaggaauuuauuuuguaagaauauugccaaaauguacaaaaggauacauucauuuauucacucauucaaucagccauuacuguauguauguguguauguguguauauauauauauguauguauauguauauauauauauguguguauauauauauauguauguauauauauauauauagagagagagagagagagagagagagacagagacagagacagagacagagaaagaaagagagagagagcgccccuguuuugugugaggcacuuuucuacaaugugaaccagaaaaugaguuucccauccugggaagcuugccuuugaguuaggggucaucuaccauguauugcugaguaagaugagcaagggucagaauaauauguauaauaucccauuguguaaaaauagcacacuggggagagacgugcuugucucuguguuuauaugaauguauaugugcuugggagacaaucuagacaucacccuuaucagugacaauuugcccaggcauauagauguuggauaguauaaagacuuggcuuuuacuuuuucuuuaauacaccuuuguauuuuuugaaauuuuuuacuagcuuauaucuucuuucuaauaaaugauuggaaagggaagucauggaacuaaaaauaaaauguaguacaccuaaauauugacagugaaaggugucagcuauaugcuggugagugaaaaaaagaugcagaguccuuuuuaguaugaucccacuuuaaauguuuuguuucuuauuuaacacauauuuguugagagcguacuaugugccagaugcacaagguuacuuggaaugcaacagugaauaaacauaacaaauagaucaaugggauacaugaauaugggauggcagaaaguuccacguggagucaaagggcaggcaagggaguauagugucagcauggacaugggagguagugaaucaguuucaaagagggugaccagaaagucucuuagguaaaucugagucuaccugagggaggugagugcagugcuguucacauaucuggagguacaguguuccaggcagguggaacagccuuaugaaguccuccaauggggcgugucuggcuugcuugaggaauagcaaggagccagaggggcuagaguaauuuuaugauuauuaugugcuuggaaaaaaaauaagaagaaaguaucauacuucagaguuuuggggaagguuagcuaguggaucaaggaccccacaauuccuucuucaaaaccauugaccaucauuuaggguuucuauuuuauacaagccuaaugguaggacuucguauuauauaaaacggauuucaucauuggaauaaucccucagccaaaacaaacugcaauuuauauugggaaagcagggaaucacauuauuuaucuagguguacagacuauuaguggaacaaaaagaagcauauauucugguauuuagaguaacuauuaacaacuuuaauccauuuuguuagacuuuaaauuauuuggaauuuauuuguuugacuacauuaauuagagacauuuaucaugucauaugccuuauuaugucauccuccccuaagaacaugauaguugaccuuacacugagauuuauaaaauaggaaugcugugaagauucaugguacagcuaaaaaugcuagacuucaguucuagggcugugcuaucuaguacaguagccauucaccacuggugccuacucagacuugaaauauggcugguccaaauugugacguaaaacugaaaguguaaaaugcgcccuggauuccaaaaacuuagagugaagaaaagaauguuaaguacuuaauuuguaaauguuuacguugauugccuguuaaaauaauaauauuuuggauauaauggauuuaagaaaauguuaauuucaugucuuucuuuuuacuuuuuaaauaguacuacuagaaaauuuaaacuuauauguaaauuauauuauauuucuguuggguagcacuaggcuagggcauggguuuuuuguguggcccaugaguuaagaauguuuuuuacauuuuuaaaugguuaaaaaaggccggacgcaguggcucacaccuguaaucccagcacuuugggaggcugaggcggauagaucacuugaggucaggagcucgagaccaaccuggccaacacagugaaacccccuucucuacuaaaaguacaaaaauuagccaggugugguggcaugugccuguagucccagcuacuugggaggcugaggcacaagaaucucaugacccaggagauggaggucgcagugagcugagauccugccaccgcacuccagccugggugacagagcaagacuccgucucaauaaauaaauaaaugcuaaaaaaaaaauugugacaugaaaaguauauacaacgcaaauuucagcaugacaaguaaauucuaaugcuuuucauugauuugccuugcaaaaaauuguacucguauguuauauuuugaauuuugucaguaaaaaauguguggaaauuuguuuucccuccgcuuaaguaaauaucugcauaauauccucaauuuugcuacuuaucccacaaagccagaaguacuaacuuccuggcucuuugcagaaaguuugcugacuucugcucuaagggguuagguuagaauuugggcuuucaccagauauuguuggauguccucgccaagucccuaauaacaguaucuccaaggcaauuucauuauuuguaacuaaggauaguaacugauuucaggguuguuauaagaacaaaugagaaaucgucuguaucuaagggcuuuggaaaugguaaagaaauguagcucauuuuuaacugcaauaccaagaacauaguaaaaauagggaaaaaguagguucagguuuccguugucaugaccuggagaaguuaauaugcacaugccuuuaaugagaugugcuaaaugcauacauggcacuguuacuaauagccuuuccugugcucuuuucuugaaguugaacgaagaagaagauuuaacauaaaugaccgcauuaaagaacuagguacuuugauucccaagucaaaugauccgugaguacaaucgcguguuaaucugcaucauauauuuuucguaccugaauguuuuuucauacguuguaaaaaaugcaguuguaaaaacuaaaguaaagaagucuccccucucccuuugguucuauuccuaaauucuucuuacaccuuucuuuugguuagucucaucaagcuaaaauuucaagacaaaagcauugaauugugcaaaaggauuguuggacacuagauguuuugguugugaggagguggcuuucugaaaccuaagaauucuuugcaaacaaauacugagcuuaaaaaaaauuuccuuuaaugguucaugcagaacagaacuuucaauaguuguuaaagcuagauuuguugacuguuugcucuuugacuuguacaguaccucuaaauaggcacugaugaacagacauuagagacuuaaaguuuaaugauacuccacagacaaaaagggucaauuauuuuuaugaaaacuugccuacucuuuguauguuuuaccauuguaggggaaaaaaaguaguguuuuaauccucuuauuaaguacaggucagcuaauuuagauuucagcuuuuggucucucuuuacccacccuguccccuucagagauaacagcuguaaagaugauuuucucaagucuuuccuaccagccuauaguuaccugcaacaucagcagauaggacaacaaacacacaguuuuuauccauuagaaauuggcccauuugaagcaaggggcuagaaaauguauacauuuuaauggcccccacaggcauucugugaaauuagccuuugaauaugaccuuuuagcuaccuaauaaaauguaaagaugaaaucaaguauuauucaugccaggcuuauuaaauuugcuguucacguuacuguuagaggauuuguaacaaaauaaaauaaaaccauuaccuauugugaggugguuuugaugaauguacaagcacaauuccaucuucaauguuuugcuuucccagguuucaaggaaaggcauuuucaaacccgaaacauuucagauucucaguucugcagcacaaauuuauccuacuaaagggcugugaccuucauuuccuauagucagucuugcaugauaguugaaauugaauucccauuuuccucuucuuuaucagcuuucacuuuuuagcauauucuuuuaaacuguagcaugugaaucucuuuagcaacauauuaugaaauuauggggcugcagugaaagccucuauuugcauaucuucuuuccccguuguauuagaauacuugcggguuuauaaucugaacugauaaugaucuuuaauuguaggcauuguuuuaagacaaaacagacuauaaucuauauggugguuucccacaccagguuucuagaaugugccuuggggcugcuauagagacacagucuuacagacuggggucucagcccgguaccuuuucucccaccagagcaagucugcauuuguugauuuuauauaauggagaucuauauucacuauucugugaaaaaagagucccucuuauuaccaaacaaaaaaaaaguuugaaaacccuuucuuaaacucagaagcauaauugauugauuggaucucacaaggaagcaaaacccaagauaauugguugaaacaaucacuucuuuuaaacugagugacccuucaaauaucccaauucugauuucucuucuugcuggccuaugugaagcaucauuuauuuuaacuacauuucucucuggcugcuaaaguuacuucucuuacuuugaucuuagcucugaauauuaagucucugcgcucacuguggguaucucaggacauuccccuggguugccaucuuugguguucagaccccagggaucaacuccagggaauucucugggggcuggaacugucccucuuaugggagaacuucuguguuguucuucauguaacccagaugaggaucaauuacuuggugacuuguuuaaugacccuccauucaccgguuccaccugauacuuguagaugaggaaauggacaaagagaggcuagauagccugcccaugauaauccuugauuaaaaaaaaaaaaaauagaaggaugcugaguuuaugccauaaacaauuuaguagugagaucucacagaucuguuuuaccaucguuuauucucacugaguuaacuuuuguaguuuuagaaaccuauaacucuuuaacauaguguuuaaggaaacugacuuuguaaucaacagaccuaacuuuaaguccugacucugccauauaguacuguguggccuaggacaaguugaauugugucuguuucaacaugugcacagucucucucuuacaaggugcuugucuggguuaaguaagacaauguguacaaacugggugggcaacacuaggcacguggcaaacacucgugaauggcagcuauaauuaauguaugauuauuuuauuuuuaaaauugaaugcuuuuaaaaaugauacaauggacuuuggggacuugcggggaagggagggagggggugggaugggggugagggauaaaagccuacacguuggguacaguguacacggcuugggugguggguguaccaaaaucgcaaaaaucaccacuaaagaacuuauccauguaaccaagcaccaccuguucccccaaaacuauugaaauaaaaaaaaauuuuaaaaaguucaaaaagaaauggagugcuuugaauauugaauuuucauugagccucaaauccuaaaaauaucuguuuuccuccauuuucaucgcagagacaugcgcuggaacaagggaaccaucuuaaaagcauccguggacuauauccgaaaguugcaacgagaacagcaacgcgcaaaagaacuugaaaaccgacagaagaaacuggagcacgccaaccggcauuuguugcucagaauacagguacgcagccugaguuguguaaaguuuacugcuuuuuaccgacuucaagacaguagaaacagggauauaaugagccauaggggaguugacuuacgugauccuaacacagucaauccuuauuauuuguggauucugugugugugaauuugccuacuuguaaccccaaagucaguaucuguggcacuuccacagucauucuuggacaugugcagaguggcacguuugagcugcccauggcacgcauuuccaggugaggucgaaugacccugccugagguugacugucugcugucuuguuucagcucucauccucuaaacaagugcuccuuucguggucuguugaguacuuucuacauuuuugugguuucuguuggugauuucgcuguuuaaaaugacccccaagcauaaugcuaaagcacugucuagaguuccugagggcaagaaggccgugaugugcuuacagagaaaauacauguguuggauaagcuucguucaggcaugagcuacagugcuauuggcugugaguuuaauauucaugagucaacaacauauauuacauaaggugaccuucaacagaaacauacauaaaacaagauuaaguguugugacuagggucucacaggaaccuaacuuguaauuccccugggaacagugcuucaguguucaccaauucaguguucacagugacuuuguagaacauaaaaaaaauaaguacugacuauaccacguuaaacaagaagaugccuuaguauuuguaggguccgggaagcaguugauggucaaaaucuguguuuacagggaacuugggaacacccagaggaucuuauauuaaggacauaauuccuggagauaguuauaaauaguggaauuauagcauauauaucuuuaacuuaaacuauacaccauuagaagaagacauacuaauuuuauuaauaugugccauuugugcgucauccuacucaguggguauaugcaccaguguaagccggagauggggaauuccucuuugguaucaacuccuggaacuucucucaggggcuuggcgucucuuguugagugaaagggcacuacuuccucugaaaugauccucaaaaacagacucccuguuauggaccaaaggggguuugugaggguaauuuuaauuugcugacuuugaacacaaccuaucuguaagagucagugacaccauaucuucuucuugaguaggcugacccaccuuuuacuagauuuugccauaaagcaaggguugucuuucaacuuuuccagugcaacuauucauggaguuauuuuacgaaacagcaaugagaaguaugacacccuagcgaccauuguguuucaccuaguggugcuccucccggacguugaacuuuucaaacagagcaauucacuuauaauaauggucuccagucuucugaaugcuuauauuuugaaaugccacaucucucauucacugcagugauuccucagcugugggguggggaggugggaagccacuucccuguuggggugcauuuuagauucuggguagugaaguagagguaguguguaauuugaaagcccuccuuuccccuccccuccucuacuuuggcuuuuguuguugguuuuauguucugucucuucaauaaguagcuauagguauuuaaucucucgaacauagucugccuauuuauaaaagcagcuugugggccgggcacguggcucacgccuguaaucccagcacuuugggaggccaaggcggguggaucacaagaucaggaguucaagaccagccuggccaagauguugaagccccaucucuacuaaaaauagaaaaauuagcugggcaugguggcgggcgccuguaaucccagcuacucgugaggcugaggcagagaaucacuugaacccgggaggcagagguugcagugagccaagaucgcgccacugcauuccagccuaggcgacagagugagacuccaucucaaaaaaaaacaaaaaaauaaaaauaaaaauaaaaccagcuuguggccgggugcggugguucacgccucuaaucccagcacuuugagaggccaagguggguggaucacgaguucaggaguucgagaccagucuggccaacauggugaaacccugucuuuaccaaaaauacaaaaaaaaaaaaagaaaagaaaagaaaagaaaaauuagcugggcauggugguggaugccuauaaucccagcuacucaugaggcugaggcaggagaacccgggaggcagagguugcggugagcugagauugugccauugcacuccagccuaggcuauagagcaagacuccgucucaaaaaacaaacaaaaaaaagcagcuuguacuaauguguuguuuccuucuacaaguauuaaaauguaauaacuauuuugaaagagaagcuagguuuuguuuuauuuuaggguuccaaacauguauauucauaugaaauacgaauauugugaaauaugugcauuggaaauuccauggugacgauaucuugguuuucuuccagugacggugugaggcagccuuuagaacuuuugcauaucacagaaaacauuauuaauuaggaaagcucugugaugcaauuaagccagaguucucuagaugagauuuaucaccuuauuuagaaaucugaguaaugcuuuaaucgcugauaaauauuuuuaauuagacaacaaaggauuagagugagauguuugccucucuuaauccaacuuuauuauucuuuuucugaaaagacaaucugccuguguggagguacuguucuuauuagcauguugguguagauuuacaagaguccauguuuucaguaugggccuaagggcuuucuuucauuuucacucuaagugaugcaugcaaaaguuuucacagaagaaagagcaugaauccuuuaugucaguggaacugccauuuuauuaaauagcccagggcuuucaaauggugccugaagaaacuuguguuucuggagauuauguaaaggaacuugaagguacuugugugacaugucaagcuccuggcuuuuacucauauuguauccaaagaaggauuuugcagacccaaaaaccuugaauuuagacugaaacguggcuuugcaggcacauauguuucucagcuugugggcagagguugagaggccaugucauauggagaguccuuccccucucugauaaggaaaggugacuugcuucaaauuuauauucucuugcuauauauuauuguuucacaaccguggaagggauagcauuggaauggagaagcagaaugcuuaucaggaaucaauuaaagucugugugguucauuuuaggagugcccagggauacacucagaaaggaaaaagggaaagagcuugcuuggaaggcauuuugcaaugaguuacagggggaaucaaggguauuuaggaaguguauuacccagcuagugcugcuguagugaaaugccacugacugggugguaaacaagaguuauuuucucauaauucuggaggcuaguuguuguccaagaucaaguugucagcaggguuggucccuucugaggccucucuccuuggcuuguagaugccugucuucucccuguguguucacauggucuuuuuuccugugugugucugucccaaucuccucuucuuacaaggacaccaguccuauuggguuuaggcccacuaguaaaaucucuuuuuaaauuaauugccucuuuaaaggcccuaucuccaaauacagucacauuccaagguacuaagguuaggacuucaacauucaaauguuuuccaggacacaauuuagccaauaauaggaauguaugugaggaaggaaaggaaaaaaauuguucaucuuauagaugagaacguacuuguugaguuaaaaaaauacuuccccuuugccauggugagaugggcuaaaugaugcuucuaaaacuuuaguuacuggcauagaacuuucacagcuuuugcuaucacuacccaaauuuuuuacuucauggcacucuuaguguuuuagcaaucuuuuuaccaucccccuagaccaaaagaaauaccuacucuuuuuguuagguccgaacaacuuauuaaguauuuagguucuaacaacuugguagccauuugaaaaaauaaaacauauaaauugaaaggaaauagcauuuuuauuuuguuauuaaauaaccauauuacuuacuaacuggaugugugugucuguugggcacugcacgacuucuaaagucuuggaaucagauuggacaccaucaccccaucgcccuuguuucccaggccacaaugauguucauguggcacuuguuuuccuucaaucacagcaacugccaaaagcucaacuuugcaaugauaucaugugguugaaaaguauauagcacagucugaugcuagaagagaacuaucuugaguuuaguaguucucagguaguauugccauugcccuugaaauguuaggcuaucuccagugcucugugaguucauugcagcacacauggggaccucagugcaaagcugaaggaccaugaaagcugaaggaccaugaacucuuuacugaauauguuucuuuuuucuuuucuuuuuuuuuuuuuuuuuuuuuuugagauggucuuucacucuucuagcccaggcuggagcgcaauggcgcaaucucggcucacugcaaccuccaccucccagguucaaacgauucuccugccucagccucccaaguagcugggauuacaggcaugugccaccacaccuggcuaauuuuuguauuuuuaguggagacgggguuucaaccauguugaccaggcugaucucaaacuccugaccucaggugauccgccccccucggccucccaaauaauauuuuucuuuuaucagcucgcauuuaaaacuuuauuuuuguauuuuuuaacuuauccucagugugaacauuaauaucugugagagaccaucucuauuuuucauacauaaucaaaucuauaaaacaccuaaaaauuuauuucacauacugccagugguacuucuccuauacuuuagaacauacagagcucauuaauuuaaaagaacaaaaaacuuuuauuuugaggauuuauuguuuuccaaguaucugauuuuuaaaaauagacuuuauuuuucaggacaguuuuugguucacaguaaaauugaaaugaagcugcagauauuucccauacaccucauucccccaagcacgcacagccuuccccauuaucaacauucccuaccagaguggcacauuuauuagaaucaaugaacccgcagugacauuucauuauccuccaaagucuauacuuuacauucccucugguauuguacauuuuguggguuuggccaaaugucuaaugacgcgcaucuaccauuauaguaucauauagagugguuucacaggcuuaaaaguccucugugcucugccuauuucaguguuuuaucuuuacucuuauuauaggaacuugaaaugcaggcucgagcucauggacuuucccuuauuccauccacgggucucugcucuccagauuuggugaaucggaucaucaagcaagaacccguucuugagaacugcagccaagaccuccuucagcaucaugcagaccuaaccuguacaacaacucucgaucucacggauggcaccaucaccuucaacaacaaccucggaacugggacugaggccaaccaagccuauaguguccccacaaaaaugggauccaaacuggaagacauccugauggacgacacccuuucucccgucggugucacugauccacuccuuuccucagugucccccggagcuuccaaaacaagcagccggaggagcaguaugagcauggaagagacggagcacacuuguuagcgaauccucccugcacugcauucgcacaaacugcuuccuuucuugauucguagauuuaauaacuuaccugaagggguuuucuugauaauuuuccuuuaauaugaaauuuuuuuucaugcuuuaucaauagcccaggauauauuuuauuuuuagaauuuugugaaacagacuuguauauucuauuuuacaacuacaaaugccuccaaaguauuguacaaauaagugugcaguaucugugaacugaauucaccacagacuuuagcuuucugagcaagaggauuuugcgucagagaaaugucuguccauuuuuauucaggggaaacuugauuugagauuuuuaugccugugacuuccuuggaaaucaaauguaaaguuuaauugaaagaauguaaagcaaccaaaaagaaaaaaaaaaagaaagaaagaggaaaagaaauccauacuaacccuuuuccauuuuauaaauguauugauucauugguacugccuuaaagauacaguaccccucuagcuuuguuuagucuuuauacugcaaacuauuuaaagaaauauguauucuguaaaagaaaaaaaaaaugcggccuuuucaugaggaucgucugguuagaaaacauaacugauaccaaccgaaacugaagggaguuagaccaaggcucugaaauauaaagucuaaucuugcucucuuuuauucugugcuguuacaguuuucuucaucaaugagugugauccaguuuuucauaagauauuuuauuuugaaauggaaauuaauguccucucaaaguaaaauauugaggagcacugaaaguauguuuuacuuuuuuuuuauuuuauuuuugcuuuugauaagaaaaccgaacugggcauauuucuaauuggcuuuacuauuuuuauuuuuaaauuauguuuuacuguucauuugauuuguacagauucuuuauuaucauuguucuuuucaauauauuuguauuaauuuguaagaauaugcaucuuaaaauggcaaguuuuccauauuuuuacaacucacuggugguuuuccgcauucuuuguacacccaugaaagaaaacuuuuaugcaaggucuugcauuuaaaagacagcuuugcgaauauuuuguaaauuacagucucacucagaacuguuuuuggacacauuuaagguguaguauuaauagguuaaaaccaggcuuucuagaaagaauaaacuuacauauuuauuuuuaggacaugaaaauagcaauauucuuggagauugauaaccauagcauuaauacgcccauuauggucauuuaaauugggguuuauuucagcaaacuuguugaauuuauuuuuaagaaagaaauacuguauugggaaguuacuguuacuugauaacaauguuuuaacaagaagcaauguuauaaaguuaguuucagugcauuaucuacuuguguaguccuaugcaauaacaguaguguuacauguaucaagccuagauguuuuauacagaugccauauaguguuaugagccaggcuguugaauggaauuucucaguagcagccuacaacugaauagcaaguggcauaaagcauauccauucagaaugaagugccuuaaauauagcaguagucuuuuuuggacuagcacugacugaacuguaauguaggggaaaguuucaugaugguaucuauagucaagacgaacauguagcauggugccuauguagacaauauaagagcuuccaauuuuccuucagauauuuuuaauauuaaauauauuuuagugacagagugccaacuucuuucaucaggaaaccuuauucaggaggguuuuuaaaaaguguuuaaaugucaaaugugaauuggugaugggugauggaggguucagagaggagugaucgucagaugugugaauggacgguuuaggugaaaauaaucaacugcauaguucccaugcacgcugggcaaugagaauccuuggaaacauuggugaugcuaucaguuuuauagcuuuauuucuuaaggggguagggaaaauuaguucccauucuuucaacccccuuaacuguauagcucuuuuccuagaauagugacgcaaaucugcaugaacagcuaauuguaccauaguguucauugauacaaucauagcauugucuauuuuucucuucauauuuauaugggggggagggcgcuggaugcaaaaguugaagaucgugaugcuaugauguuaguuuuccuuagcugauuuugaggguuuuuaaaaauaaagcaagguugacuaaccuacggccacgggaacaggaccaugguuaagcaaccauauagaaagcuuuguugaaagaaaguauggcaucuuguaccacugcccugacugucacaacuccuaaccuugccauugccugccucccccuccccuucuccuuaagagacaauuucugcagguggcaggugagcaagcccaggagaaugcugcaaucuugggggugguuuuauuuauuucuuuuuugccaaauagaguguggauucauuucaggggcuagcuaagccaagaggcagugguuugggcuuguuguuuguaacaagaaaaugauccacaccacucccccgauucccgggugcagaauuguaacucgggguugggccucuauauggagugaccaaaaugccaaaauuguccaucugccucugaguagggcaauggaaauaccaaaccuucugacuuugccaaaaagcauacaagcaaccuggucauacauaggaugacaaaauucuuucugguuguuuuuaaacaauaaagcaauaagaacaaauacaauacauaggaaguuaaaagcacaaaggaaugaacuuauuaauauuuuugaaaaaugcacugggaaaaaguugaugucaauaacaguauaaaacagcccuauuucuugauaaaaaaugacaaaugacugucucuugcggaugcuugguacuguaauguuaauaauagucaccugcuguuggaugcagcaauaauuucuguaugguccauagcacuguauauuauggaucgauauuaauguauccaaugaaauaaucgacuuguucuugauagccucauuaaagcauuugguuuuucacauaguggu

SEQ ID NO: 21237 - RNA, 31056 nt, Homo sapiens
agaaacuuuguuuuucaaggacaggcaccugucaaaagacauuggauacuguaauggcuacagucaguaaggcacuuuauuuccccaaaguaggcugcaggcgaagggaugcaggcugcagcuacagcaugcacguacacauuugcugauggcuucucaaaaccugagccgagaauagggucugauagcccagccaaguuuaaaagcagacacacacgaauguaguaucguugugccugaaaugaccauucuggguuguuuagaauccagaaucaucaaaagccaugugguaugaggaaguaauaaauauccucuugaaucuucuuacccuauuuugcacaaauggauggcugcaugaacagcucuuguaaauugcucugaguccacaccaauagaaaccugcacucauucuauagcuacagaggguuuguuggcuuaaggggacuuuaucaucucagcauuaauuucccuuuuaaagcuauucucaagguuggacugucucagagauaaacaaagaggaauccuuuuggcuuagaagccaacuggcuuacucagacuuccuccccuuccuaccuccaauucccacacuaccaauauuaucuucuugaacuagaaaaucaauuauuuacaugacauaaggugcaagucuauuucuucucccagcccuguccccuguggcccauggagagaaaauuccccugcccucuuggagagagucaucugauccugccuuauguucuuaaccuuucagucccagagcucccagggcacagucuggagaggcccuagaggugcuagacugcagggaagcgcagcuccgucugaagaguugccaauccugcuagcaaugggaugcagcgugaugcugucaggguugucuucuccucuggcuuugucacuuaagccaugugugccccugaccuggcugauaagaggcagaacagagccuccaguacagagcacauagaccaaggaugacccaguaguaaggcaugcugugcucuccagugggguccugaggcaguucaaaauaaggccuccuggaagaacagccccuucuucaaggagcucgccucucagcacgcaugggguguucugcggagggaacugcccuuggcuuucuccugcaggcuucuuggcuguuauggacccgcauggaguuuaauuaugcuuagcauauauuuuuggcauacuaggauuucuucccccuaggauuuggccaaaagaggggaaggaucaaaauuuggcaggcugggggaacaacucggcccccacugauggagaaaaaaacaaacagauggaaguaaagacgagauagaaacacaacaagguagaaaaagaccaggauaauuuggaaccccuuuagugggagguaagaaaaagaagagaaagaacaacaacaacaaaaagagcaaguucaaauccaagggggagagcuccucuggaacaaaacuccuaccaaagagacuaagagcuaaggagagggcaaaauccaggauuccuucuuguguuuaagcaggagcaggcagaaaagccuaacaacccccgacuuucccaucggcagccccacacccaucaucacacaaggccccaaggaugggaaagagaaaagcuagaaggacccaggggccucgggacuacaggaagaguggaaaguuacagacuguaaauagagucggguaggcuugugcccuuccuuauuuguccgguucuuucauuugcugcuucuguuuaagcucaagggucagucaccaugaaaugaauuugcaccucgguuucucuuuaggcuccaagauucccaagaacuccaggguucccgcuuuccccauuccgugggacuccuuggggcccaggagagugugcugagcaaagcuggcucuugagaaaacucuggcuagcuuacuugcuggcugcuccacuucccucuccaaaacuucagaauucaccacccauugucccaccagaaauccccuagaauuuuagggucaugcuaacucacaaaguccugaacccuucuaaacacacuucccaagagacugacucaucuggaauuucaccucuguagagaagcagccucuucaccucccuucaacuaucaucccauacuuaucugaccuauuuuucuuauccugccaauucagugugauugaaaacccgaccguuuaguaccgcucagcagagggccugggcuugcauagugcuugccugcgcaguuugagacagaggagggagaaggaagcaccauaaacgcugcuugcugcagguucaucuacucgcagauucagaccuaggaaaccugcagagaugauccuaaacacaagguguccaugccaggggaggggaaagacggaggggaaaaacuucaagaugaaagggcccuuugcagaugaagccccgcuuuugaaaaagcuccaagaugaggaucuccaaacagccugguggaauucuuuuuagucuguuuccugacaccugguaccuaagugcaaauuacgacaucugagccuaccgcauaaauguuuguacugaacgucugccuugaaggggagggaggaucccuugguucaauguauuuuuuccaucaugaugaggauaccagggucuaacugggagcccgauggccuccaugaccaaaaaggucccugggagugagaccgcccugccuuccaccugagagggagucagcccugcucacacugcuucuguauuccucaugcgaaugggcucccaagcagaaacuguacgguugugagguauuaugaaaacaaaagcgugaaucauugccuuuuguaguuauugauuuuguccaguaaaccugagguaaagaauacuccgucuuugaagaaugugaucagaggaaaaaaaaaaaaccaaaaaaccaaaaaagaaaaaaaaaaacaaccaugaauaugcuaccagaagaaaacaaacuacggaagggcuuuuccaguacgaagaacucauaucucaaccaucuacuucaggacuuggaauuuaagcaguaaaauaauauauuauaaaaauguuuauaaaauagcagcacacucugugaaacauuacagcuagguacugucaacgugaauaaggauggaugacuuuagcuucuuagcagcgcaaaaaaaaaaaaaaaccaaacugaacaaaacaaaauuaaaaaaaugagagacccuuagauuguuuuccgucuucaacccucauacuaugaaacaaggcagaaucuguguauaaaauaauucuucaaauagcccuguucugauuuuucuuuuuuacuuaaaaaggcaaauauuuuaacaaauagcuucauuaccugucaauuacaauugugcaaaaaaaaaaaaaaaaguuguugcuccaaccucuuugcuaacugaaugccucuaagaaguggagaggaagaaaaauucaaguacgcugaauacaacuuugcaauaaaauuaacaacaacaauaaaaaaaaaaaaacggaaaagggaacaaaaugccacacccugauguucagccaucuaucuuugcaccagcaauaacuuuucuuuccauguccaaaggagaaguauagagaugggaauuaagauccuucugugccaucagaaugguaacagauuuuaguuuacaggcuugucugaggaauguugugaugggaaugucagcaggaaggggugucucuugaguccugguaggaacaccagaacuguguaccaaagaacgccagauaccagaagcgaagaguaacccagacugggggcaggaagggagggggcaaaagagaagaggggaggaguauucagcaugacuugcauaaaccaucccaucuaucgcucgggaacaauuuuucaaagugcuuuucgaauggaaugguuuauaacaaugcuaaacugugaaccagacaugccaaucagcaccaaaaauuaguuuuuuucuaagaagaaaugccaaggccacauuacccuuuuaaauacaauaacagaaaagacuccauucuggaucccacccuuggucuccaucugccuccguuucaugugaguuuugguuauggcccauagcuacauuuccccauuagauagcaauaugguggugucugcaaugaacugcauuuggaagaagaagcaggaugucacagaacaugaaacccaggagccaaucaccuguguccaacuggcaaaauaaaacaucuuuuuuuagguagcagcuacuguagacagcaagaggacauuaauguagagauccaacuacacuccugacuuaguaacagguggcugagagcaaaggugcuucuccaucccaaaugguucaaucauguugagagauuguuuuguacuccuuccccaucaugucccuccuuauuucaauuccuucuugaguucauugcuuugcaaucuaaucaugccauaaauggcguacacaguuccuugaaauuauacuacaaggggguguaugugcuagcucauaacaugaaaaaaaaaagucuccucuaauuuguucccauauugcaggcauacauauucucuaacuacucugcagguuuuccuguaagcauuuuacuauuacuuuuacauaaucaaacaauaacuguucgcauauacaagggauucccuuaugcuguacuucaaauaggcaccaaaugcuuuuuauuauuccguuuucguaggaccuuuuucucucacuucuaaaagaucuuuaaauaugaucuaggugggggcagaauuuuuuuuuuaaguuucacccuaaaacacaaagaacaaaaacaaccagaaagaagaagagaccagauuauggacgcgucucucucuuucggcccaacuggcauccucacaggucgauaucccgcacgucuguaggggugcuggcuugguccaguucauccuccgacuuggauccgucacguugguccugacgguacugcugcaggcuauugaggagcaccgccucaaucugcuccuggcaagcuuugagacaauccuagaacaaugguccagaccagaguuguuaguaagaggaacaggacauagagcauccuacggagaaaacaugcguaauuuagcuugcauaagucugugcuaguuuccaguagaaauaaaugugaaguaaaggagggauguucuuaaagugccaaggaaccucacuacuccaggugggguccaugggcuggcagcaucagcaucaccugcgagcuuguuggaaccgcagaaucucagucaacccaggccgagcuauucagaaccugccuuuuaguggagcccaggugauuggcauucugagaagcacuggccuaaaugauggucacuuauggaugccugguaaucaaggggccgaccagaugcuuucugccuggggaagcugggaaguggcagagaaaaggggaaggcuacuagaagugcuaugacauuagcaaacucagcccgagaacuagauaagaaggaagccaaugaaccaacguacugacccucacauaaacuguaaauacuuuuucucacucugucccccaggcuggagugcacuggcacaaucucggcucacugcaaccuccaccuuccggguucaagcgauucuccugccucagccucccaaguagcugggacuacaggcacccgccaccgcgccuggcuaauuuuuguauuuuuaguacagacaggguuucaccauauuggccaggcuggccucgaacuccugaccuugugauccgcccgcaucggccucccaaagugcugggauuacaggcaugagccaccgcgccucacuguaaauacuuaaaaaaaaaaauccccaacuuuuucugcuucuuuaccauuuccuuaacucucauaaagauauaaugcagaaugucuacaacauucuggaaccuugagccauccaauuugggaauaagcaagaauaugcagccuugcuuuaguaucagucuauauuguagggguaauugacagugugucugccccaggcaggagcuucucuuaggcagaugacaugcaaugcaaugacaagucauggguaucacuagacagggaccguugcuggugcuaguaagagggugcaaaccguagacuugcuucuaacgggcauuuucuagccucucuccucugcaaaggugccuuugugcacucucuuaagaagcacauacauaaggcaaauauguuaaauugaaccucccugugucuuuucauaguuuaauauaaacuucccuuuuguuucuuuuacugugcaauucuccccacccagagguuucuauuuugccaagcccaaaagcauucucuuuauuucccaaagaucuaaaacacagcuggccaggcauauuggcucaugccuguaaucccagcacucugggaggcugaggcgggaagcugaaaccaggaguucgauaccagccuggacaacacagcaagcucccgaucuuuaaaaacaaacauauaaauaaacaaaauaaagcuggaacuaaccacuaaggaacaaaauuuccauaccccuaaauuuuccuuuccuaucucucaucuaucccacauuucaaacuacagcuuucaaugaaaacuaagauuaggaacaaccacagacuaaaggccaaaggcagagacgaaauaucaccuggaacaaugaaaugaggaagggugguaucugcugcccacccacuauacuugcagguggcaccuaaguuauuuaacuuuucugaucucaguuuccccacaaaauaaucagaguaaagggcaacugagaugauacugauauaugugcagugcuaaguggagcucaauaaaugaucgugauuauguauaacaauaaacugguccuggaaccuaaagaauucagauuucuuugaaaugagguauagauucgcauuuagucaagacuaaugaagcgugugucaagauccugacaaucuuuagucaagacugugugucugggaagagugcugaacaugacagacgugacgcagcagcaggagucuccgugccacccugaacgaggcugaaauggagucgggcgcuggccucugggacuugcuaacaccucucagacguuccuguggcaucuccugguuacaucccuuacccuuacccuguccgaccuguugagcugaaugaaugacgauaaaucacauggggcucaccugccucaucccuguucggcucuuccccaaguucuucccucaaggaccauguggcagcauuauccucauagguuaucacucacuaggugcgaaaaguuaagguauaauguuucuuuucuuuucuguuuuuuuuuuuuuuuuuuuuuuuuuuugagacagaguguugcucugucgcccaggcuggagugcaauggcacaaucuuggcucacugcaaccuccaccucucggguucaagcaauucuccuuccucagccucccgagcagcugggauuauaggcacgugccaccacgcccagcugauuuuuguauuuauaguugagaugggauuucaccagauuggccaggcuggucuugaacuccugaccucagguaucugcccgccuuggccucccgaaguacugggauuacaggcauaagccacugagcccggccugaaaguauaauguuucuaggggcacuugcauuucaguagauguuugaaaaccuuaaauccuaauaaucuaaaaaauuuaauacuaaauauagaaucaaaaugaauguggggguuaaggcacaaagugacaacggucagaacugcuguggaaugucccuuaggcagguucuacaucagagaggaauggcaagucucauaccaucaguuuuucuucuaagcugggauagacauggacagcccuuucuccacuugagcaccgugugaaggaguucacuuaaaugccagaaucaucguggugugagaugcucacuccacgguacaugggcaggagcugagacccagaacagcagcuucaaccccacauuccagccauccuccgucacccccugugcucacucacugagugaaacguuggaccuaacagucuaaauugauauuuucuucuuucucuguuuuuuuguuuuguuuuuuuucuugcaaagaagaauccauugaauccaggaaguucacguguaauguuccuccacuguacagggacuugagaagcugcugaaggggauguuuacaauuuuuuuuuuuuuuuccccaagaggcagagggacuaaaucggaguaucuccauaccauagaggcagugacuauauacuuguucccaacugaauaccuguccauggaagacaaauccuacccaaagcauaaggccuaagagcuuuuguuaucuaaaagagauggcaggauucucggcugacugagggaacuugcgugugugugcgugugcacacgaggcgugguagacaauagcucugaaccauuacauuaaaaaagaaaugcccguuaggcguagcgaugcgguuccuuuaaagaggguuucgcauggcacagcccuuggugaauacuuuccaagucgcaguuccuguggaagaccuugcuccucaacaaaaucccucucgccucccggccgauccugccuugcucuccuuccucacgggcucuauucuggcccccggcaaggucaucuggguuaauguaucuuuuaccgcaauaauauggccaacuugggacuccauggccaucggugaauuaaccauugccagccaugccagcaugacccuccacauagggagaccaggcuccagaaagcgaaagaacucgguuucaggccaugcgcgucuucccuuuggaguucccaguguccccacuuuuucugcuaucagcccucccuuccagcagccugagaccuuaaaggaacaguucugagaaaacccuacagggaggacugggaugucuggcugucacuucuacuggacuuucagagccacgggacuugaggugacaugugcgugcacaguaguguuuuauguaaguuccagccaagagugggugcccaggugucccacauaaaacagaggaagguuucauagauagacaaaacugcauacucucucuuuagucacauuuuaauuucaauccaaaucaucacugacuugacuacggccagcuuuuguuuuguuuuuugagacggagucucacugucacucaggcuggagugcaauggugcgaucucggcucacugcaaccuccaccuccuggguucaagcaauucuccugucucagcaucccaaguagcugggauuacaggugcacgccaucacccccagcugauuuuuguauuuuuaauagagacaggguuucaccagauuggucaggcuggucucgaacuccugaccucagaugauccacccgccuuggccucccaaagugcuaggauuacagacaugagccaccacacccagccuggccagcucuugacugaugaccccucugacuggaagauaaaaggaugaccaaggcagguacacuccaugaaugaagaauucugaacucccuuccccacccucuucuagacuuaccuugugguaaggcaggacgcuaacccucucugcagucuccaccuaaccuuccuucagguuccacuuccacgaaacuugacaaugaucagcuugacuuucgacuacacaaaucccucauucuaguucagcaagacuaaaagggcaaaagccugucuuguauaaaugauguugaacgcuacucucugaugguggaaagagaacuuggccucucccuuccaugagacagagcucaugccuugcauaugaauaccuuuguuuagcauggcaggggcccuuuuuggacuugggaagggcauauaaauucugugugcuggugggaagugaaggcagaggagauggugcaguggugcugauaccugcaacuggacaugccaacuccacaucgcccgggucuugcccaaagcaggagggcaggagaaugcaugggauugggguggggguagagaugagggcagccaccuggagagaggaagaccuccaccuuaaauccaaccagguugcuucuauuagaggaucaagcugagagaagaguggaguuagugcuuccaaaggggcuggauuauaagaagacauacacaaauaaucacagacuuggagaauuuggagguccaaagggccucuggaaaucaaauagccaaaugcccucguuucccagcuagggaauggagcguggagaguugacguggcuugucccagugacaucuggcugaaagcucagacuggcuuuagaaagggcaagccuccaauuucagaacuccuuuuuccuauauaccuugacuucuaagcucuaaguaaagacauacagaccagagaaucuccaagaaaaagagacagagcccaaguggcuggaaaaacacgaaagcgccucuaaucaaaagguguuacacgcaugucaaguguggcggcucuaggacaucagcuuuccugcagccuccaaagcaccagccauuguguuaagaugccccaaauuaagcugauuaaaagggaagccauaaugcucgucugucagccuggacaggugguacccuaccgcgcuggcggucgggcagaccuccaacuucuaugaugauaggcccccucccuugcccccuucccuccuggcugcccccgcccccaagccuggagcccucacagcaguguuugugaucuucagcucguuacaagggccucugacuuccucugcuugcuggcucgagcuccgcgcccugcacccuccucugccuccaugaaugggcugacggaacuccuaccauuagcccucaguguaacugcaccaccucauugucaccacacacgcacugcacucaacagggggacaaagggcugaaugagccccagacccgcggccaacucaggcagagacaacuuaggaaacuaucucauucuuccuuucuucacaggcuguuuggcuuauuuccuugcauaccaaaugaggcccacagaaaaaugaggcaggagagggaggcaucagcccccgauucuauuccaccuccccacccccagcuuccagcaacacuucacaagguuccugaccacaggcccugaagaguccacagaagacagaaucuguaacaguggaggcuugaaaaugacauguggggcgaggguggcggcacuuccagcuacggagcagaaacacacaaugcuaaaccccaugaaucacacacauguggucgaaacugagacuucuuccacggcgccuccaccucccugcuuuuuaauagcucauugauaaccaggaccguaaaaugccaggaugacccuaaggaagggauauccuggaaucuucucugggcaauauuuaagaaugugucuagggacagggacgagaguugaaacacucccuauuggguacuguguacacugucugggugacggguucgacugaagcccaaaccucagcaucacacgauauauccacguaacaaaccgcacauggauccccugaaucuaaaguuuuguuuuuugcuuuuuguuuuuaaagaaugugacaaagaguuuugaugugacuuagacaaaaaaggauaaauauaaggaacagaugacuagagucuuucuucuguuaaguaucuugcaauaacuucacaacaccuuuauggccugugagccuccauuccauuuuuuaguuagugaauuugugcaacugugucauaugaaaaugaagccacuucauuuaaccuacucuaagauaagguuggggaaaacucagaaggcucggaaggcccugacacagaauugaaguuaaagaaaagacacagcuuuucaaaggacauggacagaccagugaaucggaaacccacuggaaacccaucugccugccuuuguccuuugcuccuuccuuccucuucccuuccucucuuaagcaucacucccaaugacucugccaggggcucuggauaaagagcugaggaaaagcugggccuuauucaagagguucuauagacaaggaagcagugagaucaaugcuggcacgcagcccgacuagugugcagaggggauggaagaggaccccgauucagcccaaggaagcagggccauggucaccggggacccaggccaguggcacccuccccucucaaaccuacccaggcacuggacacccccaauagacguccccccuacagccaaacugccucucuggcuguuuuuagcaacucuuacgauuggaaggaaaaaguauuuaaaauauaccacucucugagacguuuauucccuauaaaacugucaggccccucacucagcuuucucuuuggaaugaagcguucugguuuauuuuggcaaccagacggagcaacaaaggccgacuuucucagagccgcaugcgucccucauaucaaagcuaucugcuccuggccaaugaaccacagagacucgccuggccaucucacaagaaucagggggacccucuuuccacagcucgauccccgacaacccacgaccuaacccccaaaguaacagagagcauugcaagcuugaagaaaucagaaacagcaagguguguaggagcugacauauaacuucaggggcucugggggaaacugucagcucuuccugauucccguuugucaaugcacuagggccagggggcaaaaugugguccuguguauuucacuuuuccagggaagagcucaacaucaaccuaugggcauuucauagcguggcccgagaauguuucagacauacauacauacauauauauauauccauuuauguauguguguguauauacauauauacacacacacauuuuacuaucauaaauacacauaaugucaaauuucccuuuucagccacuuuuaaauguacaguggcauuaaguacauucacacugcuguguggccaucagaacucuccaucuacagaauuguuuucaucaucccaaacugaaacuccguacgcauuaaacacuaacuccccauccucuccucuccccagacuccugggaaccucuauucuacuuucugucucuacgaauuugacuauuccagguaccugguauaaguggaaucauacaguauuugucuuuuugugucuggcucguuucacuuaacauaguauuuucaagguucgcccauguuauaacauggaucggaauuucauuucuuuuuaagguugaauaauauuccauugcgugcccauacauuuuguuucucuacucuaagaacaguuucuaucaccaaguuuucucugcugggaggccggcauucuacguuaggccugaugagcuccuucuuuuggguugauuuccuacugcauuuaggguucguaacacguuacguagcacaccuuuguuuacguucuuaauuugcuaggguuuugcacgcuuuacucuugcuucaucauacaacugcuaaguuccuugaaggcaggaaucucauccucuauuucccagaugccaccauccaccccaacuucuagcaacaacugggccuucaguaaagacuuccagaaacgaaugaaggaaauacaccacuucgugacucgugaaaugguaaacagagcucaggaagcacaacucaccucccuccaaacacuaauguguucuaaauucuaguccuuuuauuuuucuucccucugagcgucagcuuuucagagaacacaggcugauggaugggaggagauuuagcacuuggaaaggugcauaaacacacacacacacacacacacacacagccuagcccagagcugcuugaaccuuuccacuaaaaacauuuucagggagagcgaaccagccuccggggugccagagguaagccuggaacuuccugagggcucagauuuuucuuugaaaaaguguuaugaauuguacauuucaccgcguucacucuugguuuuuaaauaugaacauguucaacccagguccaccggugugaaugaggcacacacaggcagccccaguuaggaaacacggcgugugcccauuauagaaaugagguaucaacuugaccaacaguuaggauuuauaggaggacaccccuaaaccagcuucguacccacuucauauccauuuaacagaguuggccagcugacuuaaauggacuggcuacguaguaucagaaaaaggcaaacaguuuccccagaugagaugacggacugacuugccugcggucucgaaaagccaagagacucagcagcaacucccaggagggaaauuuccaccacuguccaugugagaucaguaacgggggacaaagggaggugggaaaaggcuggagccgguaggguggucagcccaucagagcaggucuaucaacaucgggggaaaagguuacaaugccugggggcaggaggagggggguggccgcuuccaacuccugucacugacauuuuugucuccaggcauugaggaagggcuugucuuaaacuggcugagaguccuauuuguaaggcagccuuaauuggagacauucagaaaaggaggaaagcguaccauuucuauaaacguuaagucccguccacgauuuuccucuggaggauuagaaaagcauucuucaugcugcacuggagggagguuuucagucuguguucuggaguccucguuuaaaaagcguauguuuggagcccgcauuuuaaaaccauaucuacgaacuaucucagaggaggaccccggauuugcuccgucagcaucucccugcgccauuucucugagcugggaacaaaugccagggaaaauccaggugggcgggcgaggaggccggcgagcugcagccgugggcucucugagguuuaaccugucccguaucccucgugcaggccucagccauaggccuauaaaccacaugaucccuuaacucaauaaaagcccgcagagggcaucugaauccccccggaccauccagagggugucaucgugaagugcccagcauucuucagccucuccauggugaugcaugagggcucagggccaacaccccucucucagguugacuuuaaaccccaggguuuuuuuucaaaccaaaagaucccaggagcggcaacaaggguggagugggaaguuuccagggggcagucggagccuggggguucuagccccagcucagccacugcccaccccgcuccuggcugguuacuucagucccuguccugcccguggaaaacgaaggaauggccucucugaccucuuggcaccauccugucucggacgggcuaggacugcagcuuccugcugauugaauucagaggcucacuugacccuggucucucucaaaaccuuucuucucaggagcuccaaauucuggcaacaggaaguuaacagccucugggccguccacagggcacacagaauggggaagcuccguagcuaauaauaguuucuugaguuuguauggcacuuugucuuuugaaagcacuuuguaauccauuacugcauugaacaaaagggaagagagagcggggaggggucgagagguuugccagggacggacaccguucucacaguggggcaccucuugugugucugcuccauccacugcagcugaguccuggcucuccuuucuccucugugcgccuuacagccucagcgugugaaagcagacacggcagcucuucgcugccgggcagaggcagccuggcagcguguacaaauauggcaaugaagcaacaauucagacccacugagaagcccacgccauaaaggaacaucgguaaacagcccucccacccccacccccuucaucugcuugcugaguuuucuuccguauuuucccgugcacagcuuuucagaaccuuaagagggggugucaccugcugaacuuugcacucccuuggaugucgaucuuaggaaacaaaccagaaaaauaccucugacacaacauaaucaaauccgucgucuccuucccugagcugagaagagacaucuggacuuagccaagaaggugguggccaccuaccacgucuguguuggugaucuuagccagcagcucagucagggcaucacaagugagcgagcucacuuccucauccugcuggagcccacagauggcugcucccacacuuccaguugcgaucaucgacgguggguacauggcaaacuuaaagucugcaaggaaugagaggcagaaggucagggcacagaacgaauuuggauccuggagcucccgagacugcagagacucagaaacaggacggcagcaggucagcggcgcgagugaccccgugcccuacaggcauguccucccucgaguucuuucacaaggagccuguguuuauuugccaucaccauggcuguuccagauuaaacgaaggagacugaggcagggaaggaagacagcuuaucuaagcgcacacaaugaaugcacagaggauucaagguccccaauccccagaucccagucauauuaagcaugucugaguuaacauucuugacccugguggggggagcaaggugagcgagucauagucuccucuagaggugauggugggaacagagcagagaaugccugagaccagugcagacaagguaccccaugggccaugcaagcaggacagaccaggggcuccagaugugagaaggagggaaaguacaaggagaugggagaaacgggcaaaaucuaugcauaaugcuaauucagaugggaucuuguuauagucucuggacaggcauugaggauuaauaugacccccacccaaaaaaaaaaaaaaaagguuugaucuaaaaaaggaaaugagagaagcagcaaugcagggagugggcgagugggggcugaguuccacccaguucccaaccucuggcccaacagcaagaacccucagaacauuagggcagaggauucuaacccuaacauagggcucuaacuaagcacugaagauuaaucauugcauccgaaucagaugggugacucgguuucgauguuaugacucaugagacugaaggccccauuuuauugcuaagagaaaaaaaugugacuugcuacagggaagugcagaaugaggauaauaaaucagaggggcuugaaccccguccacugccaugcuagagggcuccucuuggaagaccagcccccuuguguuccuccgagcacuccuucagaggggcuggguggccaugauccagcagcugcuugguccaucgaggggaaauaaagacagccaacuucuccuguuacagcugcugacagcuaccaaugaccaccacaugcaguacgcuacacauuacguccuguuuaauuuacccaucagccacagaagaugcacacgagcgucacccuaaugguaugggugagaacccugagacuuuugagaguuuaaguugccccugcucguguugacagauauuaggguggguauaguugcagccaucacgcuagugacgguccuggagugcagcaagucuuccaaagcguacucuuucucguuuuagcauugcucuagugagcuuacuguguguagacauggaaggggcacgugggggcaggagacacagcauacagggaaccgugggucacccuucaacuuacagcaaaaacaaucagguuaaaucuacaaaaaccagccccucuccuauuuccccuuccuccuguacacacucuauuacaaacacacuuucuacagcagcucuuuuaauggucagcccauugccccagcaucaaguuagcagcauuguuagacaccguggaucccugagccaagcacagcccuccccucccaucaugaacgcagagcaaaccuggccaucugccugucuccuuggcuuuuucuccauugcccucucaccaucuccaccucuugagggacguauauaauggugcugcgcccacgccugcuguccacccgccccuccuacgccuucucugucgccaugaacagugugacaaagccagccucccugccucuugcucugcuguaggucucuuccacaugggucacaggagaguguuucucugcccaauaaccucguuagcuccccccugugacauucauaacacaagcggggcagccggcccauggcccugggcccacaaaggcccgggugggagcaucugccagggaagaggcaggcaaguauccccggcccucccuucccucugccauaggccucagaccgggaagcacaccucacacaugcccaucucugcugucccacugcuagcaaaaccaacucuuauuauuggcauacgaaugaacuucuggaagccagcaggcauagggggaacaggugcaccgguugcacagggagacucuaccucccuuuuuguuuuacuaagaagauuuucaggggaguccucuuggggacacuguccaaucccacagaauuggggagcacuaugugcaugaacuugacugccucucagcagcucagaguggcaccaaaggagcaguguguucccacagccagaggagagacgccgcuggagacgaggacggcggccgugcugcccucuguugcccgcuacacagaagacgagcaucuuccucgggaucccugagcaugccccaccucuccuccagguuagucaaauacugaggcaacaucagcccuccagcuagguccagacgugggacugugggcaagucacuuccucuuuccaagggcuugguuucccauuugucuaauaacggguugggugagauaaguguuuuucuaacuucuagcugcaacucauuaaugggucaugaaaugcauuugugggucgugaccagcacuuucuguuguuguucuccuuuaaccaaauagaguaggauagaaaguaucaggcucaccguaugucguuaagaguaaauauuguucggagaaacuuuuguaucaguuugauauacuuguacaaguauccugaguuguguuauaaaauguguuucuuccuacauggcuuaggucaagaguuuaaagauaguaagcaggauaaccucccaggugccuuacaggucuacuuugcucuuacuugaggaucuggaaugggaaugacucccaaggagaagaacaaugaggagacaauagaauggaucacggugucuaccagccggcaaauucacaaagcagcccucuccacagagcggcgcuacuuccccguggcaccagggcugccccaggaccacucucaaggacaucccccucucuacugguaggggauacugaacagagagaaaaacaaaaaaaucaaacaucauuucaucugugcacuagcuuccuagcuguaauuagccaacccccacccucaacuguggaaagcuccaccuacccaaugcagccauuccuggaaaccaucagcuuugucgcuaugacaggauggagaaauggucacaauauccacucagaagaaggaagcggaaaaccaaauugcaugcaugcaugcgacgaugaagauuacaaccauggguaaauacauacauauaugccuauggaugaacuggaaggaugcacggaaaauaaaagcuguucuguuaggugggagaaacacagaugaguuuguaaaauuuguacguaauauuauuuuaacaaauaaaaaccagguacaaauuucucagcagucuguuaagucucuugaucaaaaaugccaacaagcaauaugcuggugcagaaggcacgcucaggggugagggugugcccucgccaucguuaauugcccaccuggagaggugagaugcuggugacuuccugagauccuuccuccugcagcagagagagaggcaaugaaccgaucagcgauccauucugaucgacucaugacaaugugcuccucccuguuccaggcagcauggaggacuccccccaaaacguacaauauucagacuucuuaaggcugggcaucaaugcauuagauaguagaggauggugugcuauaauggcuaggucuguacuacuauauggauaacuucugaagaaacuucucaaagaaagggggcucuugaaggcugggcgcaguggcucacaguguaauccuagcacuuugggaggccgaggugggcagaugaccugagguccgaaguucgagaccagucuggccaacacggugaaacccugucuguacuaaaaauacaaaaauuagccaggcaugguggcacgcgccuguaaucccagcuauucuggaggcuugggcaagagaaucacuugaacccgggaguuggagguugcagugagcagagauugugccaugcacuccagccugggugacagagcaagacugucucaaaaaaaaaaaagaaaaagaaaagaaaaaaaaaaagaaaggaggcucuugagugaagaggagcauuugagacacuucucagaagacucuucagggagaugggaaggauuuggagaguagacucaaaaagcuccaagcuggaacguggagugcacggagcuugggcagccuccacuccugccccaguccccaccagacccaggagggccuuucuccagguugcugcaucuggagaucugaagagagcaggagcagccacacgccuugccaugggcaacagaggccgucccagggccuagggcuccagcuccccuccaaccaaagcagaccucuggagaacacagcucacugguucagaguauuagcucuggaaucagaaggagguggaaucuccaucccaccaccuaccaagugugugaagaugagcaaguuaccugaccucucugaguuuucauuuucugaucugcaaauaaugacaacagcaauacccacguuguagugcuguucugaggauucacuuaaaauaauccuuguaaaagcacagugccugguucaagguaagcaaugaaugucagccagcauccuccccaaccugccccuccucugcucucacuccuaguacuuccugcaggacugugguggggaguuccgacuggagaugcucuccagcgucuggagggaugaggagaaaggcgcccagcaucccuggauugcaggcagaugcagggagcaggccaagcaggccaggaagaaugagggcucugugcuuccuggagaaucugucacuauccaguuguguaugugucccagaaaugacaucaucgaguccccaaagccuccugcugcuuugcagaacugggagaaagugcagccccacaggggaaugaaaagaaccccaugaacacucagcgaauggaagagagaaguuggcaacucuaacccagcacauuccacaauucauugagaugcaguucacccgagccaaggaacgaugcccagauaaccaggaacacccgacauucccgccucccuccuggcaaaaugguggaggcaaaggacacaccuuaggggaaucccagcuggacccacaggcgccaggggcagcucugcugugggcugcaugcuugcuuaugacggcggugaugauggugagguauuaauaaaaaggagcuugaaauucaucuguuucaaacaucuccuuuuacaggugaaucaaugaagucuugggagaugaagugaucuggcugaugucacucacugugaguguugggccugggauccggaugagacuuugagacucuggaugcagagcucuucguaacuuacuggaagcugaccagcuccucaaagucaccucccauauaccacucaggaggacagggcagccuuucacgucggaagugggagaagagccccaaagguggcgcucuggcucaggaaucaaaggaauugggucccagccgcagccccggcaccagcaagcacaaaaggcuuauccucccaaggaugcccugggagccucugggggucccgcugggcucccucaccugggcaugggcccugagaagugcuccauuucaucaacuugguaucugcacuucuugguaggauuuuaccaaauaaagaguucagagcuaaguaaguuuaaaaccacggaauacaugguccugcccaguacauuuagcacccaucauuuuggcuaugguggccgaggucuuggggugcaggggugauggcuuugcuucuguucaccaauagggggagagagauacgcacucugacgcugaagaagaaagggaaggccaggucaggcuuuccccaucucucuucuccaaccugcagucagguggaaguucaaagggccagaaccagaguguucacaggccagggacgucacugggcacgcaccucaucugccacccccauaagaggaccagcauacccuguccuuguggggcagggcugccauggcaagggaaugcccaugcaacugcaaggccugcugggaggagcuggggagggggcugguuggagggcgaugagcagccugcuacccauucaucuuacagccagagggaagagcgauggcaagcaccacacugccuggcugcuuguccccacagggcaugcuaacgacucccccucagucccaugaccucgcggcuucagggguagcucagagacuugcagauggaaagacggguuuccauucuuccuucccagcacccaucaaggcgaaaucucccacucuagaucaagggccaagucaucgaacuucucugggccaccacugucucccucucacuuggcgauggaaucugagggaacaccuguagguaaagccagggaaggggcuaggacagcacaauggguucuagucaacaauggggcucuggccuuggcguggggaggccuggggguggcuaccguguguggcacaaauaccaaggugcagcaucuuagggugggcuucuagugaagaaagaggggaugugggugccuggagagggagggugagcaccucccccuacccggugccagguguaaacucaaugccauuggcucugcuagacuaacuggaaucauccaccgagcaugguaucacaucucaacaaucucccagugccagagugcgaacccaggucaucuccaauggccuucuuuccucgcuugcagaccuggguguucuaucagcagagcggcaaccagggaagcuauggcucaguucugcuuccccaguuuuggaaacuccaggaacaggaaugcuaggagcuguagucaggaagaucccccgcccaacccacccaugccugcacugcccaggaccugcugcagagggauaccagcagcuugcggcccuugcucuuccagaagccauuuuaggcugagcagggaaggaaggagggcuccucuccgccuugccaccaucuuaauccagagccccauaaagcaagaccgccacuucgccacacuuacgcggccccucuauguucuccugcucucccuuccccuuucacacacaaauacgcuccccacacacugcagaaccacugccagcucuuucacaaccagcuuuucccaucaaauagcugcacggccugaggguuggcggccaucucucgggacccccacccuccacccacuguggaccuccgagacccuggccgcagguguuucaucagcuccaggacggaacauccaggacugcgagaaaaggagggaagugugcgauuugaggagcaggugagggcaacagcucggguuggggaaucugcaucuccuaccucugccucucagucacucugugcccgcuacuggccagaguccuggguccuugcccauucaucacacccuggccccacaaugcacaaucgccucuccauggaagguguuuccuucaagaaaagcggccuucgguguuuguacugugaggccgacuguuguaaaacuccacgcagccaggauucuaugugacucagucaguugcacaaacccaagugcagaugagggaaagcaacuucuuucgauacaggccccuccuuuccagacccaggaaacugccgaggaccuaccugugcucugcccugucaacgccugaggcuuagugccuagcacaccauuuucaugugguuuggggguguccuuuccuagucccugaccaaagcuaguucaaggcccccaaaacacagucuuuauaacugccucuguaucccucugggccucuguccucagucucugaaucccaggcucccuacucuggccccggagcuggcagccagcccaaagaucugggcaagaaggccacgggugggggaugggauccccgguuuucgagaaugggucuagacggaaucuggggaucugcccacaccccgguaacuccacccagcaccccuaccccaaucagagaucagagaggaggaaggggcaguuagaccccaaaagaucuguuagucaagagacaguguugagcagagcucuggcuaucaacagcugggcagugggggaguuuagggucgggggucagcuguccuugggccagagagaaagaacuggcugaccccucccccacagugaaucaugaugagagaggaaggagacagccgagccugggagacaaaaugacaggucacuggaggacugaccucucgggcccgggccagacagcagaagggaaggaagccagagugaccacuauccaaaaggcagcagggguccacagggguccuaagaaccgcccccagggcugcaggaaggauaacggacucucccaccaaggggcacagggcgcaugugcacgccaugaggccuggccugcauccaggagaacaggacuacagaaaaccagcaaggggaaaccugugcccuagaugaacaggcagggggccgggaggacuccacacucaagccugcaagugcagaacacacagguccugcuagaaacacguaagggcagccagaaaaggaaagccaucauauccacuuuagucggaacaguuaaaaucagggugaaaaucggagaugguagcauuuucacaauuagugaagguccaaccuacacuucgguuuacaaagcacguccacgugcaucaccucuuucugauuuuaauuuuccuagcugcucugaaaaggcuguaggaugauguaucaauaggcuuguuuuggagaugaagaagcucggguucagagagguuaagcagccaauuaaaggucacucacugauaugcagcaaagccugacuuuuugacugugagcacagggcauaugcacuacaucguacguuauauaaucauccguuccguagaacucaccaguaacauguaacaacauccugaaaaaaguuaccacgugaguccaccuagcgauuuaacuacucuuggcaaauuugaggugaagcacaccgaaaggucuucccaagugaucagcuuuuuaccuaagguuucugauugucaaaacaugaacuccugacaucucucccuuggaugaguaagguuccagggucucugccauggccacuaccaagaaaaaaaaaaacaaaaaaccaguagacacuggccaaggcuguuuaauaagacaacagcaaaccacugccuuugguuuauuaggaaacuacaaaacaaaugggccaguaggaaugauguaucaauugugggauccacgugguaggcggaauugcaacguuaaaggcugcggccaaaaucaaaacaccuccacaugaacugagggcaucagaacccagcgcucagaaaguaaagccucaccgaaagccaaccagguucccucccgcgcccaguggggcaaacagcuagagaagcaaacagcuagaaggccauaaaugcccuacaguaaaaaaaaaaaaaaaagaauuucuuuggucucccuuaccacuaaucaaggcaggcagcauauuuaucuugacguuguuccuuuaaccuguauuugcccccaucccccucgagauuuccucuugggcuuaucuccaagccauccuuuuccuuaaaagauuaaagauuugaacacaaccagugagcaguauauguaaucuucaaagagcacuuuagccaucauaaagaauauuuuaacaggcacuaauuuuuuuugccuuaaccacaccuguccucauaaaccauuuaugaguuuagcagagaaagcgaauauauaaagcucagauaaagaaaaagcaacccaggaaugaaacuucagacuuuagacuacucaagaccaccccuccuccaaacuccugaacuaaaaugaaaguuccuacggccuuuugccucuccccggacaucucccaaaagagcucccccaucucccuccccggcucaagccucaucuuaccgguggcacacagagcaaugaaggucugagcaugcuugcggaucagagacagcuucucccgcugcuggggcagcuugcgcaagaugugcucaaugaagucaugaggagugacagcugccagguuccacuucaacuuccccagcaccaccaguucccacuccuggaggggaaggcaggaagagaagaggagaaucuaaauuccacaggcugaccugguguagggggcuggggguugggcuccagaccaguuuuaaggccgcucauuaggacguggcugcuagauuguaaggcgggcccauuugucaaugugccccugaagcuuugaaguuguugacagcucuucuuaugcuucaaaugucaggcuccacugaaaauaaugagagcccagguagcuguugccaagauucuauuuucuucuacuucguuuccacuccagcuccccuuacccccucccaacccugacuugcaggcaauacugcuucccgcccacccagaaagcugaaccuacaaugagauacggccaaggucauuguggcccuuucaugguaauuuauuguauaugucucuaucaccgaauuaauagucuuuuuaaucuucauggaaaaaugaugcacacagauaaagcucaaaauaagguuccuuggcccaacuccuuggcaaccaauuagcuugcuuuuacuuagugccaaaaagugccuuuaucucucugcugcucaaacuccccuuuuacauaucaggcagaaauucuggggaugugacacucagcccuuuccccuaaauguuucacaggccauugucaucaugacuaaaggaccacauggucauuagcaaccucauuuugcagauggaggugaucuggggcaaggugagggugccugcucagugucacagcaucccucagugcaaguguggggaccacacaacccugucucuugggucucucaccagcaacccaccugaaaaagaaccuuguuucccucuuucacugagauacuuacgggaaacugugcucaaagggaaacgguccaaaauaaaacauuaaaaauaucguaugugcuaccagaaaauaugccuauccacugagcugucaucagaagaaugagaggcagggccuguuugccaaugcacccucucucccauucaccuggagaaccuggaaucucuuucauuugcuaaaccagcaaccagagcaccagucccacagcuguggggcugggggugauucccuuucccucccaggccucagccuucucauuuguaaaauaggacucuuccaaaucccaacuucugggauaaagggaauaggaaaaagccaaguuuguuuguagcaauauauugcuuggcuaguccuggaaagauuuggguguccugaagaacaucucaauucaccauccucucgaaacaaaugaaccauaugaagaugauuuuuccugcucucucaugagaaaaacaaauugguucccaauucuaacaauguuuucuucauaagcuuuaaaaucugccuuggcuuucuguguacagccgggguaaagcaccccaauaaacuacuaaaccaccaucaucuucaaagauggcuugaaaugccagcccuuccucuucacaggguaaugcgaguacgaaccacuggucuugcaccguuauuaaaggaagcagaucucccagaagaaagcaccuuucuaggccucucggaccaaaccagaagcagcuaaaaccuggcagcgguucaaaggugaagucauucaggccccucuccacauucucggcaauuccucccccaaccuugugcaugucuuccacuagauggcagcagagccccagaaaggaaggcuccucacaaagagcucaguucaagaagccagccucagcccuguggacuuugugcgggcccuaccagugaggagggggaggggcgggaaggagggggugcuuuucugaacagugcaaagaggggugugcaaaccaccgaaggugggccuuggagccgcuauuccaugcgguacagcugcaauauggucgucuuauaugucaagcugcagggaaaaggaguuagaucaggugggaaaaagguucccugguagaaaagcagagauaagacaggaucccugggguuguacagaggucacagucccacuggagguaggaacccaggccucggacuccuucagugaaaggccacauuuugacuuugcucaaaagucaaugaacugauauuuagugaacagcuauuauguguugguaucuugagacuuuguagauauagagggcauuaccuuugaacuccaaguuuuuaggagacaccacagccacauaccuaucaugugaacacguucucagacuauuuuuggaaauuuggaauuuaauuaaaauauuaucacuguuaauuaaaauauuccaugcguccccuacacacaugcauacacaauugcaaaugagucucaccaacccaaaucuccaugaggaucuuauucacagauguagccucagugcugggcacggagccugggcacauaguaggaacacacaaaaaauaaacagugguuuccuauuaaaugagcuaucgcccauaaguggguaaauucuauugguggggucauucuggaucccaagaauuugcucuggcaguggugauagaaggcauauuguuggccaggggaaagcgggaaucgcagaaaggaagggaggaaggggccggucauuaccagcagcuccugaggcuugauggaguugucgguguaaaugcacagcuucuccgcggucagcgggcuggucucuuugaguuuggaggccaggaacaugcagacagcacccaggaguugcagaugggacuucggagucgggaccccagccaagaaacgguccagguaauucauggccagagggaagaccucuucuucgcacuucuguuccucacagaccuauaaugggagugggaaaggguuggggggcggggguggagagcauagcaucagcaaaagagaaaaagaauaaaaaagcguaaucuaucgaaacaaaaaaaauuaauuuuuuuuugugggagggggaggggaccagaaugcgugauaagaauaaagaacaaagaugaggaaacuggagugaaucagaauagcccaucagugcuuugguauucccagggauccuauaaaagggggugaacuacagcuccaaaacggggagucggagaagugcgcagcagccgcggcagcuccgcgacgcucccuuuggcuacuccuucgcgcacucuaacucacucacucuuuuuuggauuucgucaucuuuucaaaaaaucaauaaaaauauucuggaggcuccggggguccacuucuuggucucauccggauccccagauccuccucuaucauucccgacaauuggaaaaaaugucugggggggucccugcggcccaggggccgcuuuugggggggcgggugaggagagguggggaagagagggggagggaggagaggaggaagagcgccgcagccucggcagcuggagucggagcagggggggaugguuucaaaaaauaauuaaaaaucgaggaaauauccuagaaaagcccuuuuggcgugaaaaccccaaagaagagccaggcuucccgaaacagagguuucgggugccagaaaggucuguauuccgaccccuggggcuuuggaucccgggaggaaacuugaaggggugagcgccgcggcgggaguguccggcugcggcccacaaggacagaaacuagggaacgcggugacgagcgaggggaaagacgggagcagagagcccuggaaagaggcacggggggcucccaccucuccuucaggggugacccgguauccccccuacacacacccccucccccccuuccuaccccacccaaaucuccgcaccgaggaagcuggaaaaccaaacuguaaguaaucuucgugagguggggggugggggagagggcacgauuagaagugggguggccgggauaauggggugcgaggguaagcgggcgacguuucccagccuuuccaaagggaguuugcaaagcaacauggcgaaaccacggcagguccagagcugugcauacgugggcacacggcucgcugggcaaagacuuggagugaggggcaagaagcgguucuuuuggguuccccugaaacacgcguuucuucaaugggacuuccggggcucccgaauuccccguuucucuccuucucccuccucccuccaccuccccggugaagugccagcgcggagucgcgaccacaggcggggaccugaggccaagacgaauuugcucuggccuuuugggggggguugccuuucuacucggggucccgauuucaggccccgacucucuuccuggccgcagcgcaagcagccgcggcggcuucgcaaaagacaggucgcgaggggggugggaagaagaggcagccacaugcaggaacacgcgcgcgggaugcuccccuacccccgcccaggacagccucgcuucucccagauuuuccuccccccucugccuccccaguuuaucuggagaggaacagaaauaaagccacgcgucucgccagaaggcgcgcgguaaacucccgcacaggagccgggaggccggcgcggggauugcccucucccagguuuagggcuccggccggggacccgagcauccggagggguccuggcuccuggcgagcgccaccccccgaccuaccuccagcauccagguggccaccauucugcgcauguaggguuggauguccuucugcacgcacuugaaguaggagcacugcggaagguagcgcuccucgauggugagcagguucugcaggacgcggucgucucggagcagguugcggucccgcacggcccugcggaccggguccaccucguggcacagcagcuccauggccagcccggcggccccucucccuccugcuuuccccggccuggaaaaagguuuuucuguuuuuguuuuuuggaaggggaggggagagcguuccccugaccuccuuccuuuggcuaaauaggggguuuucgggggagaggugagggcagagagagaagguggagcagaagggaggcgaggauuggguggugggcgagcagagccucggggcugccucacucgcaccgguccuccccuuaaaacuggucucgcucuccccugcucgcucuucuccgcucugaagcg

SEQ ID NO: 21238 - RNA, 31056 nt, Homo sapiens
cgcuucagagcggagaagagcgagcaggggagagcgagaccaguuuuaaggggaggaccggugcgagugaggcagccccgaggcucugcucgcccaccacccaauccucgccucccuucugcuccaccuucucucucugcccucaccucucccccgaaaacccccuauuuagccaaaggaaggaggucaggggaacgcucuccccuccccuuccaaaaaacaaaaacagaaaaaccuuuuuccaggccggggaaagcaggagggagaggggccgccgggcuggccauggagcugcugugccacgagguggacccgguccgcagggccgugcgggaccgcaaccugcuccgagacgaccgcguccugcagaaccugcucaccaucgaggagcgcuaccuuccgcagugcuccuacuucaagugcgugcagaaggacauccaacccuacaugcgcagaaugguggccaccuggaugcuggagguaggucgggggguggcgcucgccaggagccaggaccccuccggaugcucggguccccggccggagcccuaaaccugggagagggcaauccccgcgccggccucccggcuccugugcgggaguuuaccgcgcgccuucuggcgagacgcguggcuuuauuucuguuccucuccagauaaacuggggaggcagaggggggaggaaaaucugggagaagcgaggcuguccugggcggggguaggggagcaucccgcgcgcguguuccugcauguggcugccucuucuucccaccccccucgcgaccugucuuuugcgaagccgccgcggcugcuugcgcugcggccaggaagagagucggggccugaaaucgggaccccgaguagaaaggcaaccccccccaaaaggccagagcaaauucgucuuggccucagguccccgccuguggucgcgacuccgcgcuggcacuucaccggggagguggagggaggagggagaaggagagaaacggggaauucgggagccccggaagucccauugaagaaacgcguguuucaggggaacccaaaagaaccgcuucuugccccucacuccaagucuuugcccagcgagccgugugcccacguaugcacagcucuggaccugccgugguuucgccauguugcuuugcaaacucccuuuggaaaggcugggaaacgucgcccgcuuacccucgcaccccauuaucccggccaccccacuucuaaucgugcccucucccccaccccccaccucacgaagauuacuuacaguuugguuuuccagcuuccucggugcggagauuugggugggguaggaagggggggaggggguguguguaggggggauaccgggucaccccugaaggagaggugggagccccccgugccucuuuccagggcucucugcucccgucuuuccccucgcucgucaccgcguucccuaguuucuguccuugugggccgcagccggacacucccgccgcggcgcucaccccuucaaguuuccucccgggauccaaagccccaggggucggaauacagaccuuucuggcacccgaaaccucuguuucgggaagccuggcucuucuuugggguuuucacgccaaaagggcuuuucuaggauauuuccucgauuuuuaauuauuuuuugaaaccaucccccccugcuccgacuccagcugccgaggcugcggcgcucuuccuccucuccucccucccccucucuuccccaccucuccucacccgcccccccaaaagcggccccugggccgcagggacccccccagacauuuuuuccaauugucgggaaugauagaggaggaucuggggauccggaugagaccaagaaguggacccccggagccuccagaauauuuuuauugauuuuuugaaaagaugacgaaauccaaaaaagagugagugaguuagagugcgcgaaggaguagccaaagggagcgucgcggagcugccgcggcugcugcgcacuucuccgacuccccguuuuggagcuguaguucacccccuuuuauaggaucccugggaauaccaaagcacugaugggcuauucugauucacuccaguuuccucaucuuuguucuuuauucuuaucacgcauucugguccccucccccucccacaaaaaaaaauuaauuuuuuuuguuucgauagauuacgcuuuuuuauucuuuuucucuuuugcugaugcuaugcucuccacccccgccccccaacccuuucccacucccauuauaggucugugaggaacagaagugcgaagaagaggucuucccucuggccaugaauuaccuggaccguuucuuggcuggggucccgacuccgaagucccaucugcaacuccugggugcugucugcauguuccuggccuccaaacucaaagagaccagcccgcugaccgcggagaagcugugcauuuacaccgacaacuccaucaagccucaggagcugcugguaaugaccggccccuuccucccuuccuuucugcgauucccgcuuuccccuggccaacaauaugccuucuaucaccacugccagagcaaauucuugggauccagaaugaccccaccaauagaauuuacccacuuaugggcgauagcucauuuaauaggaaaccacuguuuauuuuuuguguguuccuacuaugugcccaggcuccgugcccagcacugaggcuacaucugugaauaagauccucauggagauuuggguuggugagacucauuugcaauuguguaugcauguguguaggggacgcauggaauauuuuaauuaacagugauaauauuuuaauuaaauuccaaauuuccaaaaauagucugagaacguguucacaugauagguauguggcuguggugucuccuaaaaacuuggaguucaaagguaaugcccucuauaucuacaaagucucaagauaccaacacauaauagcuguucacuaaauaucaguucauugacuuuugagcaaagucaaaauguggccuuucacugaaggaguccgaggccuggguuccuaccuccagugggacugugaccucuguacaaccccagggauccugucuuaucucugcuuuucuaccagggaaccuuuuucccaccugaucuaacuccuuuucccugcagcuugacauauaagacgaccauauugcagcuguaccgcauggaauagcggcuccaaggcccaccuucggugguuugcacaccccucuuugcacuguucagaaaagcacccccuccuucccgccccucccccuccucacugguagggcccgcacaaaguccacagggcugaggcuggcuucuugaacugagcucuuugugaggagccuuccuuucuggggcucugcugccaucuaguggaagacaugcacaagguugggggaggaauugccgagaauguggagaggggccugaaugacuucaccuuugaaccgcugccagguuuuagcugcuucugguuugguccgagaggccuagaaaggugcuuucuucugggagaucugcuuccuuuaauaacggugcaagaccagugguucguacucgcauuacccugugaagaggaagggcuggcauuucaagccaucuuugaagaugauggugguuuaguaguuuauuggggugcuuuaccccggcuguacacagaaagccaaggcagauuuuaaagcuuaugaagaaaacauuguuagaauugggaaccaauuuguuuuucucaugagagagcaggaaaaaucaucuucauaugguucauuuguuucgagaggauggugaauugagauguucuucaggacacccaaaucuuuccaggacuagccaagcaauauauugcuacaaacaaacuuggcuuuuuccuauucccuuuaucccagaaguugggauuuggaagaguccuauuuuacaaaugagaaggcugaggccugggagggaaagggaaucacccccagccccacagcugugggacuggugcucugguugcugguuuagcaaaugaaagagauuccagguucuccaggugaaugggagagagggugcauuggcaaacaggcccugccucucauucuucugaugacagcucaguggauaggcauauuuucugguagcacauacgauauuuuuaauguuuuauuuuggaccguuucccuuugagcacaguuucccguaaguaucucagugaaagagggaaacaagguucuuuuucagguggguugcuggugagagacccaagagacaggguugugugguccccacacuugcacugagggaugcugugacacugagcaggcacccucaccuugccccagaucaccuccaucugcaaaaugagguugcuaaugaccaugugguccuuuagucaugaugacaauggccugugaaacauuuaggggaaagggcugagugucacauccccagaauuucugccugauauguaaaaggggaguuugagcagcagagagauaaaggcacuuuuuggcacuaaguaaaagcaagcuaauugguugccaaggaguugggccaaggaaccuuauuuugagcuuuaucugugugcaucauuuuuccaugaagauuaaaaagacuauuaauucggugauagagacauauacaauaaauuaccaugaaagggccacaaugaccuuggccguaucucauuguagguucagcuuucugggugggcgggaagcaguauugccugcaagucaggguugggaggggguaaggggagcuggaguggaaacgaaguagaagaaaauagaaucuuggcaacagcuaccugggcucucauuauuuucaguggagccugacauuugaagcauaagaagagcugucaacaacuucaaagcuucaggggcacauugacaaaugggcccgccuuacaaucuagcagccacguccuaaugagcggccuuaaaacuggucuggagcccaacccccagcccccuacaccaggucagccuguggaauuuagauucuccucuucucuuccugccuuccccuccaggagugggaacugguggugcuggggaaguugaaguggaaccuggcagcugucacuccucaugacuucauugagcacaucuugcgcaagcugccccagcagcgggagaagcugucucugauccgcaagcaugcucagaccuucauugcucugugugccaccgguaagaugaggcuugagccggggagggagaugggggagcucuuuugggagauguccggggagaggcaaaaggccguaggaacuuucauuuuaguucaggaguuuggaggagggguggucuugaguagucuaaagucugaaguuucauuccuggguugcuuuuucuuuaucugagcuuuauauauucgcuuucucugcuaaacucauaaaugguuuaugaggacaggugugguuaaggcaaaaaaaauuagugccuguuaaaauauucuuuaugauggcuaaagugcucuuugaagauuacauauacugcucacugguuguguucaaaucuuuaaucuuuuaaggaaaaggauggcuuggagauaagcccaagaggaaaucucgagggggaugggggcaaauacagguuaaaggaacaacgucaagauaaauaugcugccugccuugauuagugguaagggagaccaaagaaauucuuuuuuuuuuuuuuuuacuguagggcauuuauggccuucuagcuguuugcuucucuagcuguuugccccacugggcgcgggagggaaccugguuggcuuucggugaggcuuuacuuucugagcgcuggguucugaugcccucaguucauguggagguguuuugauuuuggccgcagccuuuaacguugcaauuccgccuaccacguggaucccacaauugauacaucauuccuacuggcccauuuguuuuguaguuuccuaauaaaccaaaggcagugguuugcuguugucuuauuaaacagccuuggccagugucuacugguuuuuuguuuuuuuuuuucuugguaguggccauggcagagacccuggaaccuuacucauccaagggagagaugucaggaguucauguuuugacaaucagaaaccuuagguaaaaagcugaucacuugggaagaccuuucggugugcuucaccucaaauuugccaagaguaguuaaaucgcuagguggacucacgugguaacuuuuuucaggauguuguuacauguuacuggugaguucuacggaacggaugauuauauaacguacgauguagugcauaugcccugugcucacagucaaaaagucaggcuuugcugcauaucagugagugaccuuuaauuggcugcuuaaccucucugaacccgagcuucuucaucuccaaaacaagccuauugauacaucauccuacagccuuuucagagcagcuaggaaaauuaaaaucagaaagaggugaugcacguggacgugcuuuguaaaccgaaguguagguuggaccuucacuaauugugaaaaugcuaccaucuccgauuuucacccugauuuuaacuguuccgacuaaaguggauaugauggcuuuccuuuucuggcugcccuuacguguuucuagcaggaccuguguguucugcacuugcaggcuugaguguggaguccucccggcccccugccuguucaucuagggcacagguuuccccuugcugguuuucuguaguccuguucuccuggaugcaggccaggccucauggcgugcacaugcgcccugugccccuuggugggagaguccguuauccuuccugcagcccugggggcgguucuuaggaccccuguggaccccugcugccuuuuggauaguggucacucuggcuuccuucccuucugcugucuggcccgggcccgagaggucaguccuccagugaccugucauuuugucucccaggcucggcugucuccuuccucucucaucaugauucacugugggggaggggucagccaguucuuucucucuggcccaaggacagcugacccccgacccuaaacucccccacugcccagcuguugauagccagagcucugcucaacacugucucuugacuaacagaucuuuuggggucuaacugccccuuccuccucucugaucucugauugggguaggggugcuggguggaguuaccggggugugggcagauccccagauuccgucuagacccauucucgaaaaccggggaucccaucccccacccguggccuucuugcccagaucuuugggcuggcugccagcuccggggccagaguagggagccugggauucagagacugaggacagaggcccagagggauacagaggcaguuauaaagacuguguuuugggggccuugaacuagcuuuggucagggacuaggaaaggacacccccaaaccacaugaaaauggugugcuaggcacuaagccucaggcguugacagggcagagcacagguagguccucggcaguuuccugggucuggaaaggaggggccuguaucgaaagaaguugcuuucccucaucugcacuuggguuugugcaacugacugagucacauagaauccuggcugcguggaguuuuacaacagucggccucacaguacaaacaccgaaggccgcuuuucuugaaggaaacaccuuccauggagaggcgauugugcauuguggggccagggugugaugaaugggcaaggacccaggacucuggccaguagcgggcacagagugacugagaggcagagguaggagaugcagauuccccaacccgagcuguugcccucaccugcuccucaaaucgcacacuucccuccuuuucucgcaguccuggauguuccguccuggagcugaugaaacaccugcggccagggucucggagguccacaguggguggagggugggggucccgagagauggccgccaacccucaggccgugcagcuauuugaugggaaaagcugguugugaaagagcuggcagugguucugcaguguguggggagcguauuugugugugaaaggggaagggagagcaggagaacauagaggggccgcguaaguguggcgaaguggcggucuugcuuuauggggcucuggauuaagaugguggcaaggcggagaggagcccuccuuccuucccugcucagccuaaaauggcuucuggaagagcaagggccgcaagcugcugguaucccucugcagcagguccugggcagugcaggcauggguggguugggcgggggaucuuccugacuacagcuccuagcauuccuguuccuggaguuuccaaaacuggggaagcagaacugagccauagcuucccugguugccgcucugcugauagaacacccaggucugcaagcgaggaaagaaggccauuggagaugaccuggguucgcacucuggcacugggagauuguugagaugugauaccaugcucgguggaugauuccaguuagucuagcagagccaauggcauugaguuuacaccuggcaccggguagggggaggugcucacccucccucuccaggcacccacauccccucuuucuucacuagaagcccacccuaagaugcugcaccuugguauuugugccacacacgguagccacccccaggccuccccacgccaaggccagagccccauuguugacuagaacccauugugcuguccuagccccuucccuggcuuuaccuacagguguucccucagauuccaucgccaagugagagggagacagugguggcccagagaaguucgaugacuuggcccuugaucuagagugggagauuucgccuugaugggugcugggaaggaagaauggaaacccgucuuuccaucugcaagucucugagcuaccccugaagccgcgaggucaugggacugagggggagucguuagcaugcccuguggggacaagcagccaggcaguguggugcuugccaucgcucuucccucuggcuguaagaugaauggguagcaggcugcucaucgcccuccaaccagcccccuccccagcuccucccagcaggccuugcaguugcaugggcauucccuugccauggcagcccugccccacaaggacaggguaugcugguccucuuauggggguggcagaugaggugcgugcccagugacgucccuggccugugaacacucugguucuggcccuuugaacuuccaccugacugcagguuggagaagagagauggggaaagccugaccuggccuucccuuucuucuucagcgucagagugcguaucucucucccccuauuggugaacagaagcaaagccaucaccccugcaccccaagaccucggccaccauagccaaaaugaugggugcuaaauguacugggcaggaccauguauuccgugguuuuaaacuuacuuagcucugaacucuuuauuugguaaaauccuaccaagaagugcagauaccaaguugaugaaauggagcacuucucagggcccaugcccaggugagggagcccagcgggacccccagaggcucccagggcauccuugggaggauaagccuuuugugcuugcuggugccggggcugcggcugggacccaauuccuuugauuccugagccagagcgccaccuuuggggcucuucucccacuuccgacgugaaaggcugcccuguccuccugagugguauaugggaggugacuuugaggagcuggucagcuuccaguaaguuacgaagagcucugcauccagagucucaaagucucauccggaucccaggcccaacacucacagugagugacaucagccagaucacuucaucucccaagacuucauugauucaccuguaaaaggagauguuugaaacagaugaauuucaagcuccuuuuuauuaauaccucaccaucaucaccgccgucauaagcaagcaugcagcccacagcagagcugccccuggcgccuguggguccagcugggauuccccuaagguguguccuuugccuccaccauuuugccaggagggaggcgggaaugucggguguuccugguuaucugggcaucguuccuuggcucgggugaacugcaucucaaugaauuguggaaugugcuggguuagaguugccaacuucucucuuccauucgcugaguguucaugggguucuuuucauuccccuguggggcugcacuuucucccaguucugcaaagcagcaggaggcuuuggggacucgaugaugucauuucugggacacauacacaacuggauagugacagauucuccaggaagcacagagcccucauucuuccuggccugcuuggccugcucccugcaucugccugcaauccagggaugcugggcgccuuucuccucaucccuccagacgcuggagagcaucuccagucggaacuccccaccacaguccugcaggaaguacuaggagugagagcagaggaggggcagguuggggaggaugcuggcugacauucauugcuuaccuugaaccaggcacugugcuuuuacaaggauuauuuuaagugaauccucagaacagcacuacaacguggguauugcuguugucauuauuugcagaucagaaaaugaaaacucagagaggucagguaacuugcucaucuucacacacuugguagguggugggauggagauuccaccuccuucugauuccagagcuaauacucugaaccagugagcuguguucuccagaggucugcuuugguuggaggggagcuggagcccuaggcccugggacggccucuguugcccauggcaaggcguguggcugcuccugcucucuucagaucuccagaugcagcaaccuggagaaaggcccuccugggucugguggggacuggggcaggaguggaggcugcccaagcuccgugcacuccacguuccagcuuggagcuuuuugagucuacucuccaaauccuucccaucucccugaagagucuucugagaagugucucaaaugcuccucuucacucaagagccuccuuucuuuuuuuuuuucuuuucuuuuucuuuuuuuuuuuugagacagucuugcucugucacccaggcuggagugcauggcacaaucucugcucacugcaaccuccaacucccggguucaagugauucucuugcccaagccuccagaauagcugggauuacaggcgcgugccaccaugccuggcuaauuuuuguauuuuuaguacagacaggguuucaccguguuggccagacuggucucgaacuucggaccucaggucaucugcccaccucggccucccaaagugcuaggauuacacugugagccacugcgcccagccuucaagagcccccuuucuuugagaaguuucuucagaaguuauccauauaguaguacagaccuagccauuauagcacaccauccucuacuaucuaaugcauugaugcccagccuuaagaagucugaauauuguacguuuuggggggaguccuccaugcugccuggaacagggaggagcacauugucaugagucgaucagaauggaucgcugaucgguucauugccucucucucugcugcaggaggaaggaucucaggaagucaccagcaucucaccucuccaggugggcaauuaacgauggcgagggcacacccucaccccugagcgugccuucugcaccagcauauugcuuguuggcauuuuugaucaagagacuuaacagacugcugagaaauuuguaccugguuuuuauuuguuaaaauaauauuacguacaaauuuuacaaacucaucuguguuucucccaccuaacagaacagcuuuuauuuuccgugcauccuuccaguucauccauaggcauauauguauguauuuacccaugguuguaaucuucaucgucgcaugcaugcaugcaauuugguuuuccgcuuccuucuucugaguggauauugugaccauuucuccauccugucauagcgacaaagcugaugguuuccaggaauggcugcauuggguagguggagcuuuccacaguugaggguggggguuggcuaauuacagcuaggaagcuagugcacagaugaaaugauguuugauuuuuuuguuuuucucucuguucaguauccccuaccaguagagagggggauguccuugagagugguccuggggcagcccuggugccacggggaaguagcgccgcucuguggagagggcugcuuugugaauuugccggcugguagacaccgugauccauucuauugucuccucauuguucuucuccuugggagucauucccauuccagauccucaaguaagagcaaaguagaccuguaaggcaccugggagguuauccugcuuacuaucuuuaaacucuugaccuaagccauguaggaagaaacacauuuuauaacacaacucaggauacuuguacaaguauaucaaacugauacaaaaguuucuccgaacaauauuuacucuuaacgacauacggugagccugauacuuucuauccuacucuauuugguuaaaggagaacaacaacagaaagugcuggucacgacccacaaaugcauuucaugacccauuaaugaguugcagcuagaaguuagaaaaacacuuaucucacccaacccguuauuagacaaaugggaaaccaagcccuuggaaagaggaagugacuugcccacagucccacgucuggaccuagcuggagggcugauguugccucaguauuugacuaaccuggaggagagguggggcaugcucagggaucccgaggaagaugcucgucuucuguguagcgggcaacagagggcagcacggccgccguccucgucuccagcggcgucucuccucuggcugugggaacacacugcuccuuuggugccacucugagcugcugagaggcagucaaguucaugcacauagugcuccccaauucugugggauuggacaguguccccaagaggacuccccugaaaaucuucuuaguaaaacaaaaagggagguagagucucccugugcaaccggugcaccuguucccccuaugccugcuggcuuccagaaguucauucguaugccaauaauaagaguugguuuugcuagcagugggacagcagagaugggcaugugugaggugugcuucccggucugaggccuauggcagagggaagggagggccggggauacuugccugccucuucccuggcagaugcucccacccgggccuuugugggcccagggccaugggccggcugccccgcuuguguuaugaaugucacaggggggagcuaacgagguuauugggcagagaaacacucuccugugacccauguggaagagaccuacagcagagcaagaggcagggaggcuggcuuugucacacuguucauggcgacagagaaggcguaggaggggcggguggacagcaggcgugggcgcagcaccauuauauacgucccucaagagguggagauggugagagggcaauggagaaaaagccaaggagacaggcagauggccagguuugcucugcguucaugaugggaggggagggcugugcuuggcucagggauccacggugucuaacaaugcugcuaacuugaugcuggggcaaugggcugaccauuaaaagagcugcuguagaaaguguguuuguaauagaguguguacaggaggaaggggaaauaggagaggggcugguuuuuguagauuuaaccugauuguuuuugcuguaaguugaagggugacccacgguucccuguaugcugugucuccugcccccacgugccccuuccaugucuacacacaguaagcucacuagagcaaugcuaaaacgagaaagaguacgcuuuggaagacuugcugcacuccaggaccgucacuagcgugauggcugcaacuauacccacccuaauaucugucaacacgagcaggggcaacuuaaacucucaaaagucucaggguucucacccauaccauuagggugacgcucgugugcaucuucuguggcugauggguaaauuaaacaggacguaauguguagcguacugcaugugguggucauugguagcugucagcagcuguaacaggagaaguuggcugucuuuauuuccccucgauggaccaagcagcugcuggaucauggccacccagccccucugaaggagugcucggaggaacacaagggggcuggucuuccaagaggagcccucuagcauggcaguggacgggguucaagccccucugauuuauuauccucauucugcacuucccuguagcaagucacauuuuuuucucuuagcaauaaaauggggccuucagucucaugagucauaacaucgaaaccgagucacccaucugauucggaugcaaugauuaaucuucagugcuuaguuagagcccuauguuaggguuagaauccucugcccuaauguucugaggguucuugcuguugggccagagguugggaacuggguggaacucagcccccacucgcccacucccugcauugcugcuucucucauuuccuuuuuuagaucaaaccuuuuuuuuuuuuuuuugggugggggucauauuaauccucaaugccuguccagagacuauaacaagaucccaucugaauuagcauuaugcauagauuuugcccguuucucccaucuccuuguacuuucccuccuucucacaucuggagccccuggucuguccugcuugcauggcccaugggguaccuugucugcacuggucucaggcauucucugcucuguucccaccaucaccucuagaggagacuaugacucgcucaccuugcuccccccaccagggucaagaauguuaacucagacaugcuuaauaugacugggaucuggggauuggggaccuugaauccucugugcauucauugugugcgcuuagauaagcugucuuccuucccugccucagucuccuucguuuaaucuggaacagccauggugauggcaaauaaacacaggcuccuugugaaagaacucgagggaggacaugccuguagggcacggggucacucgcgccgcugaccugcugccguccuguuucugagucucugcagucucgggagcuccaggauccaaauucguucugugcccugaccuucugccucucauuccuugcagacuuuaaguuugccauguacccaccgucgaugaucgcaacuggaagugugggagcagccaucugugggcuccagcaggaugaggaagugagcucgcucacuugugaugcccugacugagcugcuggcuaagaucaccaacacagacgugguagguggccaccaccuucuuggcuaaguccagaugucucuucucagcucagggaaggagacgacggauuugauuauguugugucagagguauuuuucugguuuguuuccuaagaucgacauccaagggagugcaaaguucagcaggugacacccccucuuaagguucugaaaagcugugcacgggaaaauacggaagaaaacucagcaagcagaugaagggggugggggugggagggcuguuuaccgauguuccuuuauggcgugggcuucucagugggucugaauuguugcuucauugccauauuuguacacgcugccaggcugccucugcccggcagcgaagagcugccgugucugcuuucacacgcugaggcuguaaggcgcacagaggagaaaggagagccaggacucagcugcaguggauggagcagacacacaagaggugccccacugugagaacgguguccgucccuggcaaaccucucgaccccuccccgcucucucuucccuuuuguucaaugcaguaauggauuacaaagugcuuucaaaagacaaagugccauacaaacucaagaaacuauuauuagcuacggagcuuccccauucugugugcccuguggacggcccagaggcuguuaacuuccuguugccagaauuuggagcuccugagaagaaagguuuugagagagaccagggucaagugagccucugaauucaaucagcaggaagcugcaguccuagcccguccgagacaggauggugccaagaggucagagaggccauuccuucguuuuccacgggcaggacagggacugaaguaaccagccaggagcggggugggcaguggcugagcuggggcuagaacccccaggcuccgacugcccccuggaaacuucccacuccacccuuguugccgcuccugggaucuuuugguuugaaaaaaaacccugggguuuaaagucaaccugagagagggguguuggcccugagcccucaugcaucaccauggagaggcugaagaaugcugggcacuucacgaugacacccucuggaugguccggggggauucagaugcccucugcgggcuuuuauugaguuaagggaucaugugguuuauaggccuauggcugaggccugcacgagggauacgggacagguuaaaccucagagagcccacggcugcagcucgccggccuccucgcccgcccaccuggauuuucccuggcauuuguucccagcucagagaaauggcgcagggagaugcugacggagcaaauccgggguccuccucugagauaguucguagauaugguuuuaaaaugcgggcuccaaacauacgcuuuuuaaacgaggacuccagaacacagacugaaaaccucccuccagugcagcaugaagaaugcuuuucuaauccuccagaggaaaaucguggacgggacuuaacguuuauagaaaugguacgcuuuccuccuuuucugaaugucuccaauuaaggcugccuuacaaauaggacucucagccaguuuaagacaagcccuuccucaaugccuggagacaaaaaugucagugacaggaguuggaagcggccaccccccuccuccugcccccaggcauuguaaccuuuucccccgauguugauagaccugcucugaugggcugaccacccuaccggcuccagccuuuucccaccucccuuugucccccguuacugaucucacauggacagugguggaaauuucccuccugggaguugcugcugagucucuuggcuuuucgagaccgcaggcaagucaguccgucaucucaucuggggaaacuguuugccuuuuucugauacuacguagccaguccauuuaagucagcuggccaacucuguuaaauggauaugaaguggguacgaagcugguuuagggguguccuccuauaaauccuaacuguuggucaaguugauaccucauuucuauaaugggcacacgccguguuuccuaacuggggcugccugugugugccucauucacaccgguggaccuggguugaacauguucauauuuaaaaaccaagagugaacgcggugaaauguacaauucauaacacuuuuucaaagaaaaaucugagcccucaggaaguuccaggcuuaccucuggcaccccggaggcugguucgcucucccugaaaauguuuuuaguggaaagguucaagcagcucugggcuaggcuguguguguguguguguguguguguguuuaugcaccuuuccaagugcuaaaucuccucccauccaucagccuguguucucugaaaagcugacgcucagagggaagaaaaauaaaaggacuagaauuuagaacacauuaguguuuggagggaggugaguugugcuuccugagcucuguuuaccauuucacgagucacgaagugguguauuuccuucauucguuucuggaagucuuuacugaaggcccaguuguugcuagaaguugggguggaugguggcaucugggaaauagaggaugagauuccugccuucaaggaacuuagcaguuguaugaugaagcaagaguaaagcgugcaaaacccuagcaaauuaagaacguaaacaaaggugugcuacguaacguguuacgaacccuaaaugcaguaggaaaucaacccaaaagaaggagcucaucaggccuaacguagaaugccggccucccagcagagaaaacuuggugauagaaacuguucuuagaguagagaaacaaaauguaugggcacgcaauggaauauuauucaaccuuaaaaagaaaugaaauuccgauccauguuauaacaugggcgaaccuugaaaauacuauguuaagugaaacgagccagacacaaaaagacaaauacuguaugauuccacuuauaccagguaccuggaauagucaaauucguagagacagaaaguagaauagagguucccaggagucuggggagaggagaggauggggaguuaguguuuaaugcguacggaguuucaguuugggaugaugaaaacaauucuguagauggagaguucugauggccacacagcagugugaauguacuuaaugccacuguacauuuaaaaguggcugaaaagggaaauuugacauuauguguauuuaugauaguaaaauguguguguguauauauguauauacacacacauacauaaauggauauauauauauguauguauguaugucugaaacauucucgggccacgcuaugaaaugcccauagguugauguugagcucuucccuggaaaagugaaauacacaggaccacauuuugcccccuggcccuagugcauugacaaacgggaaucaggaagagcugacaguuucccccagagccccugaaguuauaugucagcuccuacacaccuugcuguuucugauuucuucaagcuugcaaugcucucuguuacuuuggggguuaggucguggguugucggggaucgagcuguggaaagagggucccccugauucuugugagauggccaggcgagucucugugguucauuggccaggagcagauagcuuugauaugagggacgcaugcggcucugagaaagucggccuuuguugcuccgucugguugccaaaauaaaccagaacgcuucauuccaaagagaaagcugagugaggggccugacaguuuuauagggaauaaacgucucagagagugguauauuuuaaauacuuuuuccuuccaaucguaagaguugcuaaaaacagccagagaggcaguuuggcuguaggggggacgucuauuggggguguccagugccuggguagguuugagaggggagggugccacuggccuggguccccggugaccauggcccugcuuccuugggcugaaucgggguccucuuccauccccucugcacacuagucgggcugcgugccagcauugaucucacugcuuccuugucuauagaaccucuugaauaaggcccagcuuuuccucagcucuuuauccagagccccuggcagagucauugggagugaugcuuaagagaggaagggaagaggaaggaaggagcaaaggacaaaggcaggcagauggguuuccaguggguuuccgauucacuggucuguccauguccuuugaaaagcugugucuuuucuuuaacuucaauucugugucagggccuuccgagccuucugaguuuuccccaaccuuaucuuagaguagguuaaaugaaguggcuucauuuucauaugacacaguugcacaaauucacuaacuaaaaaauggaauggaggcucacaggccauaaagguguugugaaguuauugcaagauacuuaacagaagaaagacucuagucaucuguuccuuauauuuauccuuuuuugucuaagucacaucaaaacucuuugucacauucuuuaaaaacaaaaagcaaaaaacaaaacuuuagauucaggggauccaugugcgguuuguuacguggauauaucgugugaugcugagguuugggcuucagucgaacccgucacccagacaguguacacaguacccaauagggaguguuucaacucucgucccugucccuagacacauucuuaaauauugcccagagaagauuccaggauaucccuuccuuagggucauccuggcauuuuacgguccugguuaucaaugagcuauuaaaaagcagggagguggaggcgccguggaagaagucucaguuucgaccacaugugugugauucaugggguuuagcauuguguguuucugcuccguagcuggaagugccgccacccucgccccacaugucauuuucaagccuccacuguuacagauucugucuucuguggacucuucagggccuguggucaggaaccuugugaaguguugcuggaagcuggggguggggagguggaauagaaucgggggcugaugccucccucuccugccucauuuuucugugggccucauuugguaugcaaggaaauaagccaaacagccugugaagaaaggaagaaugagauaguuuccuaaguugucucugccugaguuggccgcgggucuggggcucauucagcccuuugucccccuguugagugcagugcguguguggugacaaugagguggugcaguuacacugagggcuaaugguaggaguuccgucagcccauucauggaggcagaggagggugcagggcgcggagcucgagccagcaagcagaggaagucagaggcccuuguaacgagcugaagaucacaaacacugcugugagggcuccaggcuugggggcgggggcagccaggagggaagggggcaagggagggggccuaucaucauagaaguuggaggucugcccgaccgccagcgcgguaggguaccaccuguccaggcugacagacgagcauuauggcuucccuuuuaaucagcuuaauuuggggcaucuuaacacaauggcuggugcuuuggaggcugcaggaaagcugauguccuagagccgccacacuugacaugcguguaacaccuuuugauuagaggcgcuuucguguuuuuccagccacuugggcucugucucuuuuucuuggagauucucuggucuguaugucuuuacuuagagcuuagaagucaagguauauaggaaaaaggaguucugaaauuggaggcuugcccuuucuaaagccagucugagcuuucagccagaugucacugggacaagccacgucaacucuccacgcuccauucccuagcugggaaacgagggcauuuggcuauuugauuuccagaggcccuuuggaccuccaaauucuccaagucugugauuauuuguguaugucuucuuauaauccagccccuuuggaagcacuaacuccacucuucucucagcuugauccucuaauagaagcaaccugguuggauuuaagguggaggucuuccucucuccagguggcugcccucaucucuacccccaccccaaucccaugcauucuccugcccuccugcuuugggcaagacccgggcgauguggaguuggcauguccaguugcagguaucagcaccacugcaccaucuccucugccuucacuucccaccagcacacagaauuuauaugcccuucccaaguccaaaaagggccccugccaugcuaaacaaagguauucauaugcaaggcaugagcucugucucauggaagggagaggccaaguucucuuuccaccaucagagaguagcguucaacaucauuuauacaagacaggcuuuugcccuuuuagucuugcugaacuagaaugagggauuuguguagucgaaagucaagcugaucauugucaaguuucguggaaguggaaccugaaggaagguuagguggagacugcagagaggguuagcguccugccuuaccacaagguaagucuagaagaggguggggaagggaguucagaauucuucauucauggaguguaccugccuuggucauccuuuuaucuuccagucagaggggucaucagucaagagcuggccaggcugggugugguggcucaugucuguaauccuagcacuuugggaggccaaggcggguggaucaucugaggucaggaguucgagaccagccugaccaaucuggugaaacccugucucuauuaaaaauacaaaaaucagcugggggugauggcgugcaccuguaaucccagcuacuugggaugcugagacaggagaauugcuugaacccaggagguggagguugcagugagccgagaucgcaccauugcacuccagccugagugacagugagacuccgucucaaaaaacaaaacaaaagcuggccguagucaagucagugaugauuuggauugaaauuaaaaugugacuaaagagagaguaugcaguuuugucuaucuaugaaaccuuccucuguuuuaugugggacaccugggcacccacucuuggcuggaacuuacauaaaacacuacugugcacgcacaugucaccucaagucccguggcucugaaaguccaguagaagugacagccagacaucccaguccucccuguaggguuuucucagaacuguuccuuuaaggucucaggcugcuggaagggagggcugauagcagaaaaaguggggacacugggaacuccaaagggaagacgcgcauggccugaaaccgaguucuuucgcuuucuggagccuggucucccuauguggagggucaugcuggcauggcuggcaaugguuaauucaccgauggccauggagucccaaguuggccauauuauugcgguaaaagauacauuaacccagaugaccuugccgggggccagaauagagcccgugaggaaggagagcaaggcaggaucggccgggaggcgagagggauuuuguugaggagcaaggucuuccacaggaacugcgacuuggaaaguauucaccaagggcugugccaugcgaaacccucuuuaaaggaaccgcaucgcuacgccuaacgggcauuucuuuuuuaauguaaugguucagagcuauugucuaccacgccucgugugcacacgcacacacacgcaaguucccucagucagccgagaauccugccaucucuuuuagauaacaaaagcucuuaggccuuaugcuuuggguaggauuugucuuccauggacagguauucaguugggaacaaguauauagucacugccucuaugguauggagauacuccgauuuagucccucugccucuuggggaaaaaaaaaaaaaaauuguaaacauccccuucagcagcuucucaagucccuguacaguggaggaacauuacacgugaacuuccuggauucaauggauucuucuuugcaagaaaaaaaacaaaacaaaaaaacagagaaagaagaaaauaucaauuuagacuguuagguccaacguuucacucagugagugagcacagggggugacggaggauggcuggaaugugggguugaagcugcuguucugggucucagcuccugcccauguaccguggagugagcaucucacaccacgaugauucuggcauuuaagugaacuccuucacacggugcucaaguggagaaagggcuguccaugucuaucccagcuuagaagaaaaacugaugguaugagacuugccauuccucucugauguagaaccugccuaagggacauuccacagcaguucugaccguugucacuuugugccuuaacccccacauucauuuugauucuauauuuaguauuaaauuuuuuagauuauuaggauuuaagguuuucaaacaucuacugaaaugcaagugccccuagaaacauuauacuuucaggccgggcucaguggcuuaugccuguaaucccaguacuucgggaggccaaggcgggcagauaccugaggucaggaguucaagaccagccuggccaaucuggugaaaucccaucucaacuauaaauacaaaaaucagcugggcgugguggcacgugccuauaaucccagcugcucgggaggcugaggaaggagaauugcuugaacccgagagguggagguugcagugagccaagauugugccauugcacuccagccugggcgacagagcaacacucugucucaaaaaaaaaaaaaaaaaaaaaaaaaaacagaaaagaaaagaaacauuauaccuuaacuuuucgcaccuagugagugauaaccuaugaggauaaugcugccacaugguccuugagggaagaacuuggggaagagccgaacagggaugaggcaggugagccccaugugauuuaucgucauucauucagcucaacaggucggacaggguaaggguaagggauguaaccaggagaugccacaggaacgucugagagguguuagcaagucccagaggccagcgcccgacuccauuucagccucguucaggguggcacggagacuccugcugcugcgucacgucugucauguucagcacucuucccagacacacagucuugacuaaagauugucaggaucuugacacacgcuucauuagucuugacuaaaugcgaaucuauaccucauuucaaagaaaucugaauucuuuagguuccaggaccaguuuauuguuauacauaaucacgaucauuuauugagcuccacuuagcacugcacauauaucaguaucaucucaguugcccuuuacucugauuauuuuguggggaaacugagaucagaaaaguuaaauaacuuaggugccaccugcaaguauagugggugggcagcagauaccacccuuccucauuucauuguuccaggugauauuucgucucugccuuuggccuuuagucugugguuguuccuaaucuuaguuuucauugaaagcuguaguuugaaaugugggauagaugagagauaggaaaggaaaauuuagggguauggaaauuuuguuccuuagugguuaguuccagcuuuauuuuguuuauuuauauguuuguuuuuaaagaucgggagcuugcuguguuguccaggcugguaucgaacuccugguuucagcuucccgccucagccucccagagugcugggauuacaggcaugagccaauaugccuggccagcuguguuuuagaucuuugggaaauaaagagaaugcuuuugggcuuggcaaaauagaaaccucuggguggggagaauugcacaguaaaagaaacaaaagggaaguuuauauuaaacuaugaaaagacacagggagguucaauuuaacauauuugccuuauguaugugcuucuuaagagagugcacaaaggcaccuuugcagaggagagaggcuagaaaaugcccguuagaagcaagucuacgguuugcacccucuuacuagcaccagcaacggucccugucuagugauacccaugacuugucauugcauugcaugucaucugccuaagagaagcuccugccuggggcagacacacugucaauuaccccuacaauauagacugauacuaaagcaaggcugcauauucuugcuuauucccaaauuggauggcucaagguuccagaauguuguagacauucugcauuauaucuuuaugagaguuaaggaaaugguaaagaagcagaaaaaguuggggauuuuuuuuuuuaaguauuuacagugaggcgcgguggcucaugccuguaaucccagcacuuugggaggccgaugcgggcggaucacaaggucaggaguucgaggccagccuggccaauauggugaaacccugucuguacuaaaaauacaaaaauuagccaggcgcgguggcgggugccuguagucccagcuacuugggaggcugaggcaggagaaucgcuugaacccggaagguggagguugcagugagccgagauugugccagugcacuccagccugggggacagagugagaaaaaguauuuacaguuuaugugagggucaguacguugguucauuggcuuccuucuuaucuaguucucgggcugaguuugcuaaugucauagcacuucuaguagccuuccccuuuucucugccacuucccagcuuccccaggcagaaagcaucuggucggccccuugauuaccaggcauccauaagugaccaucauuuaggccagugcuucucagaaugccaaucaccugggcuccacuaaaaggcagguucugaauagcucggccuggguugacugagauucugcgguuccaacaagcucgcaggugaugcugaugcugccagcccauggaccccaccuggaguagugagguuccuuggcacuuuaagaacaucccuccuuuacuucacauuuauuucuacuggaaacuagcacagacuuaugcaagcuaaauuacgcauguuuucuccguaggaugcucuauguccuguuccucuuacuaacaacucuggucuggaccauuguucuaggauugucucaaagcuugccaggagcagauugaggcggugcuccucaauagccugcagcaguaccgucaggaccaacgugacggauccaagucggaggaugaacuggaccaagccagcaccccuacagacgugcgggauaucgaccugugaggaugccaguugggccgaaagagagagacgcguccauaaucuggucucuucuucuuucugguuguuuuuguucuuuguguuuuagggugaaacuuaaaaaaaaaauucugcccccaccuagaucauauuuaaagaucuuuuagaagugagagaaaaagguccuacgaaaacggaauaauaaaaagcauuuggugccuauuugaaguacagcauaagggaaucccuuguauaugcgaacaguuauuguuugauuauguaaaaguaauaguaaaaugcuuacaggaaaaccugcagaguaguuagagaauauguaugccugcaauaugggaacaaauuagaggagacuuuuuuuuuucauguuaugagcuagcacauacacccccuuguaguauaauuucaaggaacuguguacgccauuuauggcaugauuagauugcaaagcaaugaacucaagaaggaauugaaauaaggagggacaugauggggaaggaguacaaaacaaucucucaacaugauugaaccauuugggauggagaagcaccuuugcucucagccaccuguuacuaagucaggaguguaguuggaucucuacauuaauguccucuugcugucuacaguagcugcuaccuaaaaaaagauguuuuauuuugccaguuggacacaggugauuggcuccuggguuucauguucugugacauccugcuucuucuuccaaaugcaguucauugcagacaccaccauauugcuaucuaauggggaaauguagcuaugggccauaaccaaaacucacaugaaacggaggcagauggagaccaagggugggauccagaauggagucuuuucuguuauuguauuuaaaaggguaauguggccuuggcauuucuucuuagaaaaaaacuaauuuuuggugcugauuggcaugucugguucacaguuuagcauuguuauaaaccauuccauucgaaaagcacuuugaaaaauuguucccgagcgauagaugggaugguuuaugcaagucaugcugaauacuccuccccucuucucuuuugcccccucccuuccugcccccagucuggguuacucuucgcuucugguaucuggcguucuuugguacacaguucugguguuccuaccaggacucaagagacaccccuuccugcugacauucccaucacaacauuccucagacaagccuguaaacuaaaaucuguuaccauucugauggcacagaaggaucuuaauucccaucucuauacuucuccuuuggacauggaaagaaaaguuauugcuggugcaaagauagauggcugaacaucaggguguggcauuuuguucccuuuuccguuuuuuuuuuuuuauuguuguuguuaauuuuauugcaaaguuguauucagcguacuugaauuuuucuuccucuccacuucuuagaggcauucaguuagcaaagagguuggagcaacaacuuuuuuuuuuuuuuuugcacaauuguaauugacagguaaugaagcuauuuguuaaaauauuugccuuuuuaaguaaaaaagaaaaaucagaacagggcuauuugaagaauuauuuuauacacagauucugccuuguuucauaguaugaggguugaagacggaaaacaaucuaagggucucucauuuuuuuaauuuuguuuuguucaguuugguuuuuuuuuuuuuuugcgcugcuaagaagcuaaagucauccauccuuauucacguugacaguaccuagcuguaauguuucacagagugugcugcuauuuuauaaacauuuuuauaauauauuauuuuacugcuuaaauuccaaguccugaaguagaugguugagauaugaguucuucguacuggaaaagcccuuccguaguuuguuuucuucugguagcauauucaugguuguuuuuuuuuuucuuuuuugguuuuuugguuuuuuuuuuuuccucugaucacauucuucaaagacggaguauucuuuaccucagguuuacuggacaaaaucaauaacuacaaaaggcaaugauucacgcuuuuguuuucauaauaccucacaaccguacaguuucugcuugggagcccauucgcaugaggaauacagaagcagugugagcagggcugacucccucucagguggaaggcagggcggucucacucccagggaccuuuuuggucauggaggccaucgggcucccaguuagacccugguauccucaucaugauggaaaaaauacauugaaccaagggauccucccuccccuucaaggcagacguucaguacaaacauuuaugcgguaggcucagaugucguaauuugcacuuagguaccaggugucaggaaacagacuaaaaagaauuccaccaggcuguuuggagauccucaucuuggagcuuuuucaaaagcggggcuucaucugcaaagggcccuuucaucuugaaguuuuuccccuccgucuuuccccuccccuggcauggacaccuuguguuuaggaucaucucugcagguuuccuaggucugaaucugcgaguagaugaaccugcagcaagcagcguuuauggugcuuccuucucccuccucugucucaaacugcgcaggcaagcacuaugcaagcccaggcccucugcugagcgguacuaaacggucggguuuucaaucacacugaauuggcaggauaagaaaaauaggucagauaaguaugggaugauaguugaagggaggugaagaggcugcuucucuacagaggugaaauuccagaugagucagucucuugggaaguguguuuagaaggguucaggacuuugugaguuagcaugacccuaaaauucuaggggauuucuggugggacaauggguggugaauucugaaguuuuggagagggaaguggagcagccagcaaguaagcuagccagaguuuucucaagagccagcuuugcucagcacacucuccugggccccaaggagucccacggaauggggaaagcgggaacccuggaguucuugggaaucuuggagccuaaagagaaaccgaggugcaaauucauuucauggugacugacccuugagcuuaaacagaagcagcaaaugaaagaaccggacaaauaaggaagggcacaagccuacccgacucuauuuacagucuguaacuuuccacucuuccuguagucccgaggccccuggguccuucuagcuuuucucuuucccauccuuggggccuugugugaugauggguguggggcugccgaugggaaagucggggguuguuaggcuuuucugccugcuccugcuuaaacacaagaaggaauccuggauuuugcccucuccuuagcucuuagucucuuugguaggaguuuuguuccagaggagcucucccccuuggauuugaacuugcucuuuuuguuguuguuguucuuucucuucuuuuucuuaccucccacuaaagggguuccaaauuauccuggucuuuuucuaccuuguuguguuucuaucucgucuuuacuuccaucuguuuguuuuuuucuccaucagugggggccgaguuguucccccagccugccaaauuuugauccuuccccucuuuuggccaaauccuagggggaagaaauccuaguaugccaaaaauauaugcuaagcauaauuaaacuccaugcggguccauaacagccaagaagccugcaggagaaagccaagggcaguucccuccgcagaacaccccaugcgugcugagaggcgagcuccuugaagaaggggcuguucuuccaggaggccuuauuuugaacugccucaggaccccacuggagagcacagcaugccuuacuacugggucauccuuggucuaugugcucuguacuggaggcucuguucugccucuuaucagccaggucaggggcacacauggcuuaagugacaaagccagaggagaagacaacccugacagcaucacgcugcaucccauugcuagcaggauuggcaacucuucagacggagcugcgcuucccugcagucuagcaccucuagggccucuccagacugugcccugggagcucugggacugaaagguuaagaacauaaggcaggaucagaugacucucuccaagagggcaggggaauuuucucuccaugggccacaggggacagggcugggagaagaaauagacuugcaccuuaugucauguaaauaauugauuuucuaguucaagaagauaauauugguagugugggaauuggagguaggaaggggaggaagucugaguaagccaguuggcuucuaagccaaaaggauuccucuuuguuuaucucugagacaguccaaccuugagaauagcuuuaaaagggaaauuaaugcugagaugauaaaguccccuuaagccaacaaacccucuguagcuauagaaugagugcagguuucuauugguguggacucagagcaauuuacaagagcuguucaugcagccauccauuugugcaaaauaggguaagaagauucaagaggauauuuauuacuuccucauaccacauggcuuuugaugauucuggauucuaaacaacccagaauggucauuucaggcacaacgauacuacauucgugugugucugcuuuuaaacuuggcugggcuaucagacccuauucucggcucagguuuugagaagccaucagcaaauguguacgugcaugcuguagcugcagccugcaucccuucgccugcagccuacuuuggggaaauaaagugccuuacugacuguagccauuacaguauccaaugucuuuugacaggugccuguccuugaaaaacaaaguuucu

SEQ ID NO: 21239 - RNA, 10382 nt, Homo sapiens
caugcgagcgggcgccuggcggcggcggcggcggcaccagcgaucccagcagcggccacgacgcggacgcgccugcggcccggggagcagcagcagccacagccacagcagccgccacugcaguuagagcggcagcagcagcgacagccacagcagcagccgccgcggagagcggcgcucggcgggcgcgcccuccugaaggaagccgcccgccccccaccgccgcccccuccggcguguucaugcccccggggugagugugcgcgccccgaauccucuccggcggcgaucggccaggccggguggacucccuggaggaggugacaggagugcaggcggagagcagugugggcgcccugccuccccacaccgcgccucuccaaaccccgcgagggacccugggccagggucgccgggugagaggcggcucggcguuggggcgccggucugggcgcacaggugccucggcggucuggcggguuuguuuacaaacaauggggugcgggcucggcagcgcccccuggcggccagugcggccccggggaagagggucgaccccaggggugccccagcccccaaaguccgggaggggcgggggggcggcacggaggggcggccacacccagggcgcgcgcccgcugggggcggcgacggggggcggcucgcgggccguggagucugcggcuccugcgggcgggggcugcgccccagcaacagccgguuauuggccccgcgcucgccuggcgggcggggcgggcgcacguggcggcgguggggggggcugugacagcggaggggggugucugggaccgccgugggagcgcgcgugugcgggguuguggaucugcaggugucucgccugggugugugcgcgugucuggcuccgaguuugugcuggguucugcagggagugguggugucgauccagaggaauguugggguuucugacccgucggggugucugcgugaguccccgcgccuguuugugugggguucugucugugggugcccugcuugugggguggguggaccugcguguguugucggugagaguugucugugugugcuguuccgggaugauacugggggucuguggugccugcgugugcugggguguggagguuguaguguguguguguugcuggagugagcuguuuguguguuuaugugugugucuugcccgagcgugcgauaugugugcuugugucuugccuguguguuucugucuuggcugaggccgucucuguaucuccggggcaugugucuuuugcccagcguuugugaugcugcgccugcuaaaugcaaaugucuguuuucuguccaggugucugugugaguugucaggugugaguguguguguguauguauguguguggugggggguuguuucagucuggguuuggcuugugugucuggcaucagcgucugggauuugaggacccaggaucuguggggucuaugcaguguagacgguggguguugcuggcagccucuggaugggguugugucugagccuguguguguguguguguguugggucugaggggcuugucacugugaucggcuggcucaugugugucaugugggcugcguguguguaguguuuaugucagucacgugagaccaguguuuucugugggugcgcuaggugugugugcugcugggcugugugggauuagaguuagcuguaggguguguguguguguguguugcugacaguuggugaugauguuugaggguugcgugaggaggguggguuggugucuggugguguguugaggucugauggcaugugucugugugugccugaucuacguguguccugagaguuggugacauguggguguguuuuggggguguugauguauguguguccgugggugucuguuuuguguugauaugugaguccagaggugugcaggucuuaucucuggagugaguguguguguguggagaggggcauguuugggaacugaggcagugccuagcuuguguguguguguuuguguuugcaaaggcugcauuguguuugcaugugccccugggcauaucaacagugggucagugugugagacuuugacaguuuggauguguggggauggauugugccagccagugugcgcaguauguagagugcuugugauggucugucuggaugcuccugcuuuggucggggguguguguguauuguguguacugaguagugauguccgagacuggggccaucucaguguuugugugcaagugggagguggggugggcggucaggcuggccagucccgugugaguccuugugugugugcugugggggccucgcugugccucacugcccucccugugugcccgucgcuguguugggaaaguuguccccaccagcccaugcugugagucccaaguggagugaguuuguguugugggacugucacagcccucauacacacaccugcuagaccccuccauccguccugugugagcccuguccuugcugugagagccguccugugcccccugucccuccugugugcccaucaccguaugcacgggaggcucuccaggccagccaggacccgguggugucaucccccggcugggcgugucucuguggggccgucacccccuccgcaugcacacacaccuccacucuucuccaucuggguccuaaccccggguaggcuggagguacagugggcccugguacuucccugcugaccugcuccuccucccgugucccgcaggccccagggagcgccauggcccgcgcacgccaggagggcagcuccccggagcccguagagggccuggcccgcgacggcccgcgccccuucccgcucggccgccuggugcccucggcaguguccugcggccucugcgagcccggccuggcugccgcccccgccgcccccacccugcugcccgcugccuaccucugcgcccccaccgccccacccgccgucaccgccgcccugggggguucccgcuggccuggggguccccgcagccggccccgaggcccgcgcccggacggugagugcccgccccgcccccggggugauaggagccgggaagagagagggcuggagacucggaggaacuggagaagugggagaggacggggggagguggcgggcccagccgggccacugggaggguguggccaauguggucuuuguguugcaagaagcaggaagacggaggcuggggguggagggggaggucaagugggaagucccuccuggaaucugacugcaguccccgaauugcagcccacugucucuuccgggccuggggcaacagcugcaucccagcuccccucccccagucuggguccucuagacccccuggaggauuccuguugcagggagagugggccgagcgggaggacugucaacucuggccucuggggaggggucgagaggccuuuugcuuuuauuugcaucucuuuggccaggggcuguccucagcagucccggcggaggaaggagagggggaggggccauuguguugggaaguccccucggggaggugggggagucuuggggagggaaggguuaaagguccccugccugaugggcuguuaacccuguggugcccguggagccccaucccugccggcaggcgcucuagggaaaguguguccugguuucccaucccccaucuugucccggcagcccaaggggagcgaggaaagagaaaacuucccuaacucaguuccuggaagcccuggaaggggacaccgauuucaaggccaaggucacagauguggaaacugaggcccuggcuguaggccuuagggaacccucaggccaggaccuggugggacgggagggcaggagccuccuagggcgcucagaaguggggggggggggggggcaggaaggcaucucccgcgucccagccccccaggcccgcgcucugaagcugccacagucucuggccuucuggucucuaggccucugccacauccggagguguggcuucccugugguuggacacgagagggcaggagaccugaggcuugugaucuggguggggucagucacuguaucccugugugaccuugggauacucccuaagggcgggccucaguuucccugccugucacauggaaaaggcaaaauguggccccuuuggaaaauagaggucguuaagccugaccacccccggggucaccucucuggccgucuaccuuccacacugacaagggccguggggacguagcuggccagacaggugaccccagagcggcguccccagguacuucuugcuuucuggugccuguggaggagaagcugagaaauugacucacuagcgaugggaucacuagaaaugaggcggggagcaguggcugggaaagaggggagcaggccgagacaccucgaggccuggagggguggugggugcugaccgcgccccucugccucuccaagguccucagcccucgcucucgcuggcggagcagcaccuggagucgcccgugcccagcgccccgggggcucuggcgggcggucccacccaggcggccccgggaguccgcggggaggaggaacagugggcccgggagaucggggcccagcugcggcggauggcggacgaccucaacgcacaguacgagcggcgggugagugcugggggugggguagacggcaggugggacuuccgccggaggagggggcggcaggcggcccccgccagaugugcggcagcugcugcccugcgcggcugggucgcuccgcggacaggcaggugggggguaagugggugggggggaaucgcgcgcccgcagagccgcccaaggacuccgcgccgcggcuggcauagccggagcccgagccagggccagggccagggccagggacuaggccgccgaggaguggagcugcgcgcccguggcccgcggccgcggggacugagggcggcgcugggcggcgcggcucauauaucccgggcuauuuauagccggugagucagcagccgcgccgcgcccgcccccugccgucccucucgcgcggcccgcagcgccacacaguuucccgggcgccggggcgggccggggaccgcaggggugggcucgcagccccgccccgcgggaggccccgccccccagccccuggcacggccucgauuuuuuaaaacaaauauucgaagcccacagcagagaaugggaaaucacaaacaucaugcgcccaccaggcagcucuguucaguuugaacauuacacccgcauugcuugcuuauuaagaaaccaaacaaaaccgcagaaacgcauguggugaagcuccuuacucuccccaucccuucccccuccuugcauccaaaggaaaucucucgaguuggccucucucaaccccugcagguguugcuuuuacuccguauuuaccaggccagaaccagggcuuagaaucauggagcauucuuagcuuagcguauaugacauaguuuuuguuucuccccagaauuccuuuuucccucaauauuaggcuucagauucaccauaugggcaaaagagcuuccauucaucuauguucagccaggcacgguggcucacuccuguaaucccagcacuuugggaggcggagauagaaggacgcuugagcccaggaguuccagaccagccugggccacauaaugagauccccguugcuacaaaaaauacaaaaauuagccgggugugguggcgcgggccuguagucucagcuacuugggaggcugaggugaaagggucccuugagccaaggaagucgaggcugcacugagccaugaagggucacugaacuccagccugggggacagagcaagaccaucucaaaaaagaaacaacaaauacagccauuuucggccuggugcaguggcccacgccuguaaucccagcccuuugggaggcggaggcaaguggcucacuugagguugggaguuugagaccagucuggccaacauggugaaaccucgucucuacuaaaaauacaaaaauuaaggccgggcgugguggcucaugccuguaaucccagcacuuugggaggcugaggagggcggaucaccugaggucgggaguucgagacaagccugaccaacaugaacaaaccccgucucuacuaaaaauacaaaauuagccaggcgugguggcacaugccuguaaucucagcuacucgggaggcugaggcaggauaauugcuugaaaccgggaggcagagguugcggugagccgagaucgugccauugcacuccagccugggcaacaacagcgaaaaucugucucaaaaaaaaaaaaagaaacaaaaaguagcugagcaugguggcacacgccaguaaucccagcuacuugggagacugaggcaggagaaucucuugaacccaggagguggagguugcagugagccgagaucaggagaucaugccacugcacuccagccuggaggacagaaugaaacucugucucaaaaaaaaaaaaaaaaaaagucauuuucacugcuacauaguauucuguuggauaaacauaguauccuuauucauuuucucauugauggauauuuaggauagauauguauuuuuauuuuauguuuagagacagggucucacugucucccaggcuggagugccgugguucaaucacagcucccugcagccuccaacuccuggguuuaagggauccucccgccucagccucccaaguagcugggaccacaggcagauccaccaugccuggcuaauuuuuauuuuauuuuuuuguagagaucaggucuuucuguguuacccaggcuggucucaaacuccuggccucaagugauccuccugccuuggccucccaaauugcuggaauuaugggucugagcuaccucacccagacuauuuuuaaauguauuucagauuuuauuuuauuuauuuauuuuuugagacagaguuucgcucuuguugcccagguuggagugcaauggugcaaucucggcccauugcaaccuucaccucccggguucaagugauucuccugccucagccucccaaguagcugagauuacagaugccugccaccaugcccagcuaauuuuuguauuuuuaguagagacgggguuucacuauguugaccaggcugaucuugaauucccgaccucaggugauccacccaccucggccucccaaagugcugggauuacagguguaagccacugcgcccggccauuauuuauugccuuuuuuccucucccaaucaugcauauuuccgggugcgcucuuguguuucuagaguagguaccuggguggucugcccaccauccaccuuacuaggugauugcuagcuuucucaccagguggcacccacagcagugugacagugguggguuuuguaacuuacaccaauccgaugugcccccuuugccaccaucuccuggccccaagaguugcuagggaguguugaggaggcugggcugguaccaggcgacucacuaccagguagcaugaggacgaugaggaucauuuaaccuucuguaaagugaguuucuccuuccccugcaccugaagggaaggagguuaggugguccccacuuagcacagagccugccuguggagcuacagggaguggcagaggauugcagcucucuguacacuuaaaaaaaauuuuuuuuuugacacggagucuugcucuguugcccaggcuggagugcaguggugcaaucucggcucacugcaaccuccgccucccggguucaagcgauucuccugccuuggccucccuaguagcugggaauacaggugugugccaccaggcccagcuaauuuuuguuguuuuaguagagacgggguuuccccaugguggccaggcuggucuugaacuccugaccucaggugauccaccugccuuggccucccaaagugcugggauuacaggcgugagccaccuugcccagccauuuuuuuuuuuuugagauggagucucgcucugucacccaggcuggagugcaguggcgccaucucggcucacugcaagcuccaccuaccggguucacgccauucuccugccucagccuccggaguagcugggacuacaggcgcccgccaccacacccggcuaauuuuuuuguauuuuuaguagagaugggguuucacuguguuagccaggaugaucucgaucuccugaccucauaauccgcccgccucggccucccaaggugcugggauuacaggcgugagccaccgcacccggccuguauuuuuuuuuuuuuuuuuuuuugagacagaguuuugcucuugcccaggcuggagugcaauggcacgaucucggcucaccgcaaccuccacuucccagguucaagcgauucuccugccucagccuucccaaguagcugggauuacagacaugugccaccaaguccggcuaauuuuguauuuuuaguagagaugggguuucuccauguaggucaggcuggucucaaacucccgaccucaggugauccgccuaccucggccucccaaagugcugagauuacaggcgugagccaccgcgcccggccuguauuuuuaauagagacgggguucuaccauguuggccacacuggucucaaacuccugaccucaggugauccucccgccuuggccucucaaagugcugggauuacagcuauaagucacugcgccgggccucuguacucuuuuuaguauugccuuuaauuuuuaccagucgggagccuuuccuaggaccuagccuccugccugcccacuuccuaggauguuggagcugagaggguccuagagaccaccuuguuuucauccugccacuggagagggggcagggguuucacucggcguugccuagaggugcuucuguugaagccucugcaauggggggggcucuucccaguucuccuccuuccacagauuguucuagaacugccaagacugugggcacccugcuccuuucuccucaucuugccagcccuguagggaggggcaggauagguugcaguccauccuucagccccuugggggaugucuuucucaaauguacaacagagacggggcagucacagcuaaugugccacgcacucgcuuggugcccagcucucugcugaaggcauuccguguuuguccucugccuccaggucucauguccuggaugaggaugugaccuccgagacauggacauuagcccaggcggggggaggagcuggaauagggugggcgagacugucgccucgcugccccuggagcugaccauccccacucccaucaccauacucaguccccugcuaacugccccuucucucucuuuuccccagagacaagaggagcagcagcggcaccgccccucacccuggaggguccuguacaaucucaucaugggacuccugcccuuacccaggggccacagagcccccgagauggagcccaauuaggugccugcacccgcccgguggacgucagggacucggggggcaggccccucccaccuccugacacccuggccagcgcgggggacuuucucugcaccauguagcauacuggacucccagcccugccugucccgggggcgggccggggcagccacuccagccccagcccagccuggggugcacugacggagaugcggacuccugggucccuggccaagaagccaggagagggacggcugauggacucagcaucggaagguggcggugaccgaggggguggggacugagccgcccgccucugccgcccaccaccaucucaggaaaggcuguugugcuggugcccguuccagcugcaggggugacacugggaggggggggcucuccucucggugcuccuucacucugggccuggccucaggccccuggugcuucccccccuccuccugggagggggcccgugaagagcaaaugagccaaacgugaccacuagccuccuggagccagagaguggggcucguuugccgguugcuccagcccggcgcccagccaucuucccugagccagccggcggguggugggcaugccugccucaccuucaucaggggguggccaggaggggcccagacugugaauccugugcucugcccgugaccgccccccgccccaucaaucccauugcauagguuuagagagagcacgugugaccacuggcauucauuuggggggugggagauuuuggcugaagccgccccagccuuaguccccagggccaagcgcuggggggaagacggggagucagggagggggggaaaucucggaagagggaggagucugggaguggggagggauggcccagccuguaagauacuguauaugcgcugcuguagauaccggaaugaauuuucuguacauguuugguuaauuuuuuuuguacaugauuuuuguauguuuccuuuucaauaaaaucagauuggaacaguggauacucuuucugcuugccuuccc

SEQ ID NO: 21240 - RNA, 10382 nt, Homo sapiens
gggaaggcaagcagaaagaguauccacuguuccaaucugauuuuauugaaaaggaaacauacaaaaaucauguacaaaaaaaauuaaccaaacauguacagaaaauucauuccgguaucuacagcagcgcauauacaguaucuuacaggcugggccaucccuccccacucccagacuccucccucuuccgagauuucccccccucccugacuccccgucuuccccccagcgcuuggcccuggggacuaaggcuggggcggcuucagccaaaaucucccaccccccaaaugaaugccaguggucacacgugcucucucuaaaccuaugcaaugggauugauggggcggggggcggucacgggcagagcacaggauucacagucugggccccuccuggccacccccugaugaaggugaggcaggcaugcccaccacccgccggcuggcucagggaagauggcugggcgccgggcuggagcaaccggcaaacgagccccacucucuggcuccaggaggcuaguggucacguuuggcucauuugcucuucacgggcccccucccaggaggagggggggaagcaccaggggccugaggccaggcccagagugaaggagcaccgagaggagagccccccccucccagugucaccccugcagcuggaacgggcaccagcacaacagccuuuccugagaugguggugggcggcagaggcgggcggcucaguccccacccccucggucaccgccaccuuccgaugcugaguccaucagccgucccucuccuggcuucuuggccagggacccaggaguccgcaucuccgucagugcaccccaggcugggcuggggcuggaguggcugccccggcccgcccccgggacaggcagggcugggaguccaguaugcuacauggugcagagaaagucccccgcgcuggccagggugucaggaggugggaggggccugccccccgagucccugacguccaccgggcgggugcaggcaccuaauugggcuccaucucgggggcucuguggccccuggguaagggcaggagucccaugaugagauuguacaggacccuccagggugaggggcggugccgcugcugcuccucuugucucuggggaaaagagagagaaggggcaguuagcaggggacugaguauggugaugggaguggggauggucagcuccaggggcagcgaggcgacagucucgcccacccuauuccagcuccuccccccgccugggcuaauguccaugucucggaggucacauccucauccaggacaugagaccuggaggcagaggacaaacacggaaugccuucagcagagagcugggcaccaagcgagugcguggcacauuagcugugacugccccgucucuguuguacauuugagaaagacaucccccaaggggcugaaggauggacugcaaccuauccugccccucccuacagggcuggcaagaugaggagaaaggagcagggugcccacagucuuggcaguucuagaacaaucuguggaaggaggagaacugggaagagccccccccauugcagaggcuucaacagaagcaccucuaggcaacgccgagugaaaccccugcccccucuccaguggcaggaugaaaacaagguggucucuaggacccucucagcuccaacauccuaggaagugggcaggcaggaggcuagguccuaggaaaggcucccgacugguaaaaauuaaaggcaauacuaaaaagaguacagaggcccggcgcagugacuuauagcuguaaucccagcacuuugagaggccaaggcgggaggaucaccugaggucaggaguuugagaccaguguggccaacaugguagaaccccgucucuauuaaaaauacaggccgggcgcgguggcucacgccuguaaucucagcacuuugggaggccgagguaggcggaucaccugaggucgggaguuugagaccagccugaccuacauggagaaaccccaucucuacuaaaaauacaaaauuagccggacuugguggcacaugucuguaaucccagcuacuugggaaggcugaggcaggagaaucgcuugaaccugggaaguggagguugcggugagccgagaucgugccauugcacuccagccugggcaagagcaaaacucugucucaaaaaaaaaaaaaaaaaaaaauacaggccgggugcgguggcucacgccuguaaucccagcaccuugggaggccgaggcgggcggauuaugaggucaggagaucgagaucauccuggcuaacacagugaaaccccaucucuacuaaaaauacaaaaaaauuagccgggugugguggcgggcgccuguagucccagcuacuccggaggcugaggcaggagaauggcgugaacccgguagguggagcuugcagugagccgagauggcgccacugcacuccagccugggugacagagcgagacuccaucucaaaaaaaaaaaaauggcugggcaagguggcucacgccuguaaucccagcacuuugggaggccaaggcagguggaucaccugaggucaggaguucaagaccagccuggccaccauggggaaaccccgucucuacuaaaacaacaaaaauuagcugggccugguggcacacaccuguauucccagcuacuagggaggccaaggcaggagaaucgcuugaacccgggaggcggagguugcagugagccgagauugcaccacugcacuccagccugggcaacagagcaagacuccgugucaaaaaaaaaauuuuuuuuaaguguacagagagcugcaauccucugccacucccuguagcuccacaggcaggcucugugcuaaguggggaccaccuaaccuccuucccuucaggugcaggggaaggagaaacucacuuuacagaagguuaaaugauccucaucguccucaugcuaccugguagugagucgccugguaccagcccagccuccucaacacucccuagcaacucuuggggccaggagaugguggcaaagggggcacaucggauugguguaaguuacaaaacccaccacugucacacugcugugggugccaccuggugagaaagcuagcaaucaccuaguaagguggauggugggcagaccacccagguaccuacucuagaaacacaagagcgcacccggaaauaugcaugauugggagaggaaaaaaggcaauaaauaauggccgggcgcaguggcuuacaccuguaaucccagcacuuugggaggccgagguggguggaucaccugaggucgggaauucaagaucagccuggucaacauagugaaaccccgucucuacuaaaaauacaaaaauuagcugggcaugguggcaggcaucuguaaucucagcuacuugggaggcugaggcaggagaaucacuugaacccgggaggugaagguugcaaugggccgagauugcaccauugcacuccaaccugggcaacaagagcgaaacucugucucaaaaaauaaauaaauaaaauaaaaucugaaauacauuuaaaaauagucugggugagguagcucagacccauaauuccagcaauuugggaggccaaggcaggaggaucacuugaggccaggaguuugagaccagccuggguaacacagaaagaccugaucucuacaaaaaaauaaaauaaaaauuagccaggcaugguggaucugccuguggucccagcuacuugggaggcugaggcgggaggaucccuuaaacccaggaguuggaggcugcagggagcugugauugaaccacggcacuccagccugggagacagugagacccugucucuaaacauaaaauaaaaauacauaucuauccuaaauauccaucaaugagaaaaugaauaaggauacuauguuuauccaacagaauacuauguagcagugaaaaugacuuuuuuuuuuuuuuuuuuugagacagaguuucauucuguccuccaggcuggagugcaguggcaugaucuccugaucucggcucacugcaaccuccaccuccuggguucaagagauucuccugccucagucucccaaguagcugggauuacuggcgugugccaccaugcucagcuacuuuuuguuucuuuuuuuuuuuuugagacagauuuucgcuguuguugcccaggcuggagugcaauggcacgaucucggcucaccgcaaccucugccucccgguuucaagcaauuauccugccucagccucccgaguagcugagauuacaggcaugugccaccacgccuggcuaauuuuguauuuuuaguagagacgggguuuguucauguuggucaggcuugucucgaacucccgaccucaggugauccgcccuccucagccucccaaagugcugggauuacaggcaugagccaccacgcccggccuuaauuuuuguauuuuuaguagagacgagguuucaccauguuggccagacuggucucaaacucccaaccucaagugagccacuugccuccgccucccaaagggcugggauuacaggcgugggccacugcaccaggccgaaaauggcuguauuuguuguuucuuuuuugagauggucuugcucugucccccaggcuggaguucagugacccuucauggcucagugcagccucgacuuccuuggcucaagggacccuuucaccucagccucccaaguagcugagacuacaggcccgcgccaccacacccggcuaauuuuuguauuuuuuguagcaacggggaucucauuauguggcccaggcuggucuggaacuccugggcucaagcguccuucuaucuccgccucccaaagugcugggauuacaggagugagccaccgugccuggcugaacauagaugaauggaagcucuuuugcccauauggugaaucugaagccuaauauugagggaaaaaggaauucuggggagaaacaaaaacuaugucauauacgcuaagcuaagaaugcuccaugauucuaagcccugguucuggccugguaaauacggaguaaaagcaacaccugcagggguugagagaggccaacucgagagauuuccuuuggaugcaaggagggggaagggauggggagaguaaggagcuucaccacaugcguuucugcgguuuuguuugguuucuuaauaagcaagcaaugcggguguaauguucaaacugaacagagcugccuggugggcgcaugauguuugugauuucccauucucugcugugggcuucgaauauuuguuuuaaaaaaucgaggccgugccaggggcuggggggcggggccucccgcggggcggggcugcgagcccaccccugcgguccccggcccgccccggcgcccgggaaacuguguggcgcugcgggccgcgcgagagggacggcagggggcgggcgcggcgcggcugcugacucaccggcuauaaauagcccgggauauaugagccgcgccgcccagcgccgcccucaguccccgcggccgcgggccacgggcgcgcagcuccacuccucggcggccuagucccuggcccuggcccuggcccuggcucgggcuccggcuaugccagccgcggcgcggaguccuugggcggcucugcgggcgcgcgauucccccccacccacuuaccccccaccugccuguccgcggagcgacccagccgcgcagggcagcagcugccgcacaucuggcgggggccgccugccgcccccuccuccggcggaagucccaccugccgucuaccccacccccagcacucacccgccgcucguacugugcguugaggucguccgccauccgccgcagcugggccccgaucucccgggcccacuguuccuccuccccgcggacucccggggccgccugggugggaccgcccgccagagcccccggggcgcugggcacgggcgacuccaggugcugcuccgccagcgagagcgagggcugaggaccuuggagaggcagaggggcgcggucagcacccaccaccccuccaggccucgaggugucucggccugcuccccucuuucccagccacugcuccccgccucauuucuagugaucccaucgcuagugagucaauuucucagcuucuccuccacaggcaccagaaagcaagaaguaccuggggacgccgcucuggggucaccugucuggccagcuacguccccacggcccuugucaguguggaagguagacggccagagaggugaccccggggguggucaggcuuaacgaccucuauuuuccaaaggggccacauuuugccuuuuccaugugacaggcagggaaacugaggcccgcccuuagggaguaucccaaggucacacagggauacagugacugaccccacccagaucacaagccucaggucuccugcccucucguguccaaccacagggaagccacaccuccggauguggcagaggccuagagaccagaaggccagagacuguggcagcuucagagcgcgggccuggggggcugggacgcgggagaugccuuccugccccccccccccccccacuucugagcgcccuaggaggcuccugcccucccgucccaccagguccuggccugaggguucccuaaggccuacagccagggccucaguuuccacaucugugaccuuggccuugaaaucgguguccccuuccagggcuuccaggaacugaguuagggaaguuuucucuuuccucgcuccccuugggcugccgggacaagaugggggaugggaaaccaggacacacuuucccuagagcgccugccggcagggauggggcuccacgggcaccacaggguuaacagcccaucaggcaggggaccuuuaacccuucccuccccaagacucccccaccuccccgaggggacuucccaacacaauggccccucccccucuccuuccuccgccgggacugcugaggacagccccuggccaaagagaugcaaauaaaagcaaaaggccucucgaccccuccccagaggccagaguugacaguccucccgcucggcccacucucccugcaacaggaauccuccagggggucuagaggacccagacugggggaggggagcugggaugcagcuguugccccaggcccggaagagacagugggcugcaauucggggacugcagucagauuccaggagggacuucccacuugaccucccccuccacccccagccuccgucuuccugcuucuugcaacacaaagaccacauuggccacacccucccaguggcccggcugggcccgccaccuccccccguccucucccacuucuccaguuccuccgagucuccagcccucucucuucccggcuccuaucaccccgggggcggggcgggcacucaccguccgggcgcgggccucggggccggcugcggggacccccaggccagcgggaaccccccagggcggcggugacggcggguggggcggugggggcgcagagguaggcagcgggcagcagggugggggcggcgggggcggcagccaggccgggcucgcagaggccgcaggacacugccgagggcaccaggcggccgagcgggaaggggcgcgggccgucgcgggccaggcccucuacgggcuccggggagcugcccuccuggcgugcgcgggccauggcgcucccuggggccugcgggacacgggaggaggagcaggucagcagggaaguaccagggcccacuguaccuccagccuacccgggguuaggacccagauggagaagaguggaggugugugugcaugcggagggggugacggccccacagagacacgcccagccgggggaugacaccaccggguccuggcuggccuggagagccucccgugcauacggugaugggcacacaggagggacagggggcacaggacggcucucacagcaaggacagggcucacacaggacggauggaggggucuagcagguguguguaugagggcugugacagucccacaacacaaacucacuccacuugggacucacagcaugggcugguggggacaacuuucccaacacagcgacgggcacacagggagggcagugaggcacagcgaggcccccacagcacacacacaaggacucacacgggacuggccagccugaccgcccaccccaccucccacuugcacacaaacacugagauggccccagucucggacaucacuacucaguacacacaauacacacacacccccgaccaaagcaggagcauccagacagaccaucacaagcacucuacauacugcgcacacuggcuggcacaauccauccccacacauccaaacugucaaagucucacacacugacccacuguugauaugcccaggggcacaugcaaacacaaugcagccuuugcaaacacaaacacacacacacaagcuaggcacugccucaguucccaaacaugccccucuccacacacacacacucacuccagagauaagaccugcacaccucuggacucacauaucaacacaaaacagacacccacggacacacauacaucaacacccccaaaacacacccacaugucaccaacucucaggacacacguagaucaggcacacacagacacaugccaucagaccucaacacaccaccagacaccaacccacccuccucacgcaacccucaaacaucaucaccaacugucagcaacacacacacacacacacccuacagcuaacucuaaucccacacagcccagcagcacacacaccuagcgcacccacagaaaacacuggucucacgugacugacauaaacacuacacacacgcagcccacaugacacacaugagccagccgaucacagugacaagccccucagacccaacacacacacacacacacaggcucagacacaaccccauccagaggcugccagcaacacccaccgucuacacugcauagaccccacagauccuggguccucaaaucccagacgcugaugccagacacacaagccaaacccagacugaaacaaccccccaccacacacauacauacacacacacacucacaccugacaacucacacagacaccuggacagaaaacagacauuugcauuuagcaggcgcagcaucacaaacgcugggcaaaagacacaugccccggagauacagagacggccucagccaagacagaaacacacaggcaagacacaagcacacauaucgcacgcucgggcaagacacacacauaaacacacaaacagcucacuccagcaacacacacacacuacaaccuccacaccccagcacacgcaggcaccacagacccccaguaucaucccggaacagcacacacagacaacucucaccgacaacacacgcagguccacccaccccacaagcagggcacccacagacagaaccccacacaaacaggcgcggggacucacgcagacaccccgacgggucagaaaccccaacauuccucuggaucgacaccaccacucccugcagaacccagcacaaacucggagccagacacgcgcacacacccaggcgagacaccugcagauccacaaccccgcacacgcgcgcucccacggcggucccagacaccccccuccgcugucacagccccccccaccgccgccacgugcgcccgccccgcccgccaggcgagcgcggggccaauaaccggcuguugcuggggcgcagcccccgcccgcaggagccgcagacuccacggcccgcgagccgccccccgucgccgcccccagcgggcgcgcgcccuggguguggccgccccuccgugccgcccccccgccccucccggacuuugggggcuggggcaccccuggggucgacccucuuccccggggccgcacuggccgccagggggcgcugccgagcccgcaccccauuguuuguaaacaaacccgccagaccgccgaggcaccugugcgcccagaccggcgccccaacgccgagccgccucucacccggcgacccuggcccagggucccucgcgggguuuggagaggcgcgguguggggaggcagggcgcccacacugcucuccgccugcacuccugucaccuccuccagggaguccacccggccuggccgaucgccgccggagaggauucggggcgcgcacacucaccccgggggcaugaacacgccggagggggcggcgguggggggcgggcggcuuccuucaggagggcgcgcccgccgagcgccgcucuccgcggcggcugcugcuguggcugucgcugcugcugccgcucuaacugcaguggcggcugcuguggcuguggcugcugcugcuccccgggccgcaggcgcguccgcgucguggccgcugcugggaucgcuggugccgccgccgccgccgccaggcgcccgcucgcaug

SEQ ID NO: 21241 - RNA, 7185 nt, Homo sapiens
auucauaagacucagagcuacggccacggcagggacacgcggaaccaagacuuggaaacuugauuguugugguucuucuuggggguuaugaaauuucauuaaucuuuuuuuuuccggggagaaaguuuuuggaaagauucuuccagauauuucuucauuuucuuuuggaggaccgacuuacuuuuuuuggucuucuuuauuacuccccuccccccgugggacccgccggacgcguggaggagaccguagcugaagcugauucuguacagcgggacagcgcuuucugccccugggggagcaaccccucccucgccccuggguccuacggagccugcacuuucaagagguacagcggcauccugugggggccugggcaccgcaggaagacugcacagaaacuuugccauuguuggaacgggacguugcuccuuccccgagcuuccccggacagcguacuuugaggacucgcucagcucaccggggacucccacggcucaccccggacuugcaccuuacuuccccaacccggccauagccuuggcuucccggcgaccucagcguggucacaggggccccccugugcccagggaaauguuucaggcuuuccccggagacuacgacuccggcucccggugcagcuccucacccucugccgagucucaauaucugucuucgguggacuccuucggcaguccacccaccgccgccgccucccagguaaguuuuugauaguaggggugcugcuuuguagguuuuauuuuuuaagucaagggugaaaagaauaaaccccaacccccacaaaaaggcgcaucagaacccuagaucugagauggaaaaggcucacagcgcacuuugcaaacugcaaagagucgggagauguuugcaauugguugcgugcguggagcgcaaggagggaacgcggcagggaggguaggcuuuggggcgaggugggggugggguggguaaugcgcugcucaaugcaacguguaugcgguagcggggcugagaacuuugagccggccccgggacugcccccugcucgggucccagaccugaagcuagcgcaguuaggcaggugggggaaaucccggggaagcuuccagcagucucuuuuccuuuccuccuccuucggagcgcccacuucggugccgggucgcccuccacccaucgggaagaggggccucgaacccucagccgcgcugccuccgccuccugcgcggagacguaacgggggacccgugcguaacggcugacgcgcuggaauccuccgucugacgcggggcacgcacggcgcgcggcgcccccuucguccgccccgccccugacgucccgggagcguucuauuuuggaacgccggggccacguugcuaagggagggggcagcccggcguuucgauuggccgccggggcgcacgccuuggccaaucagcuuucccuuccuauuuguagggugcauuuuccuuccccccucucuguccccggaacccgugguuccuuggcggcugggucucuuuucggcgccucuagaggcagagggaggggaucccugucgugacaagagcgccugucugcgacccaauggaucugcgaggcccuugcggggaucuagucccugggcucucaggagaagggggugucugcuugugugcuggcguuucuuggagagauacgguggcugucacccucuucuccaggcacacacagacacauucccacucccucugcuccucaugcccgguuccuccggugugucccaagacaggacuagaaccgcgaaccgaagggcaaccagccagguggucuccaggagcuccgcccccucuggguucccaggacucugauuggucggcgagccagcccuucccucaccacgccccccgagagaguaguuaagccuucagagcaguuccaggaguccauuuacgggaggggggagaugagcgcugcugaggcuugggggcucaggucccgcaccauucccccuccgcgacaaucugagagagcuccagugguuacuuuuaucuaccuguccguucacccuaaacugucacucgucagucucacucugagaagagacaguaacuugaaacguuguucuaaacuccuaggcccgucccccaaacacccuuuugacugggacccccgccccugcaugggaccucgcgcagagggggguguguaugugugugaguguagaggaaggcuuggccuaaggccucuccuucucccuccccuugccucuggggugggggugggguguuguggcuguguguguggcuguggcuccgucccggggguucugucacccggcuguguccagccuccucuccaccccccauaccuaagagucaccaacccggggugugauucaccacccgcuggaaccgugcaaccuuuccccgaggaagaaggaggagguagaagccaguugagcagaaauccucucauuaaccacugcgucacgguguaguggaaggguggguguuguggcuuuuucccugugacacacacauccacacucgcucacccugugcucacucacggggucgguguguguuauguguguugggugugugugugucggugucuuuguuugugugucuacgccuguguguguaugugucaccccguaggagugcgccggucucggggaaaugcccgguuccuucgugcccacggucaccgcgaucacaaccagccaggaccuccaguggcuugugcaacccacccucaucucuuccauggcccagucccaggggcagccacuggccucccagcccccggucgucgaccccuacgacaugccgggaaccagcuacuccacaccaggcaugaguggcuacagcaguggcggagcgaguggcaguggugggccuuccaccagcggaacuaccagugggccugggccugcccgcccagcccgagcccggccuaggagaccccgagaggagacggugaguaagggacaucagaacuuggccuggguagggggaagcaagagaggcaggaaguuucuuaugaauggaggggggcuccacuaaggccucaguguuacagaaaccccaagauccuugcuacacgagcgaggaccggaggcuuguuuuuuggcucuuggggguucugaaagaaguagagguucgggauggguggaggagugcuguauccccaaaucucauggccucuaucucccugacucagcucaccccagaggaagaggagaagcgaagggugcgccgggaacgaaauaaacuagcagcagcuaaaugcaggaaccggcggagggagcugaccgaccgacuccaggcggugaggacaggcccuggggugggagaggggauguugaggggagcucucuccccauucucugcccccucuccaccuguacccuuauccuggguugagaacuagacguuccacacauggaacuagguacugcuguggccagacuggguagcccagggcacaaacacagacccccauggacuuaagucaacuccuggucccccccccauuuccugaccccacggacuacucuccuagccuucauuucaucccaaggggccacauggggcccuugaggagaggggcgcccccaucauuucucccaucuggucuucagcaaguaacaacccauuuugccucaguuucuccaucucugcaaacccucaucaaaucucccgggcucuuucuacccuuaacacucuggaaagccugugaaaugaaauuauuccaccuccugcccuagccacccacagcucuccuggugcugguggcaucccccaaaacccacucccuuccuacguccucccuuggucugagaguucccugcuguaugccugcagggugagcuguuacuccuugagggaacaagggaauugucaacuuuccuucucuacuuuuucucuuccccgggagguagagagggagggguaauagaagggaacacauuaaaaacacauaacaguggcucaugccugugaucccagcacuuugagaggccaaggcaggaggauugcuugagcccaggaguuugagaccagccugggaaacauagggaggacuugucucuaccaagaaaaaaaaaaauuaguugggcaugguggugcacaccacuguggucccagcuacuauggaggcuuuagugggaggaucgcuugagccgaggagguccaggcugcagugagccaugauugcacuauugcacuccagccugggggacagagcgagacucuggcucaaaagcaaaacaaaaccaaccacauaacgauuguucauucauucaacaaaccuccugcacaccagaaacuuccccauaaaccuggccccuucuguaccauccuuuggacagaugggggaaacugagguuccuggaaggcaagacccuugccccaacucccauggccaccaggacuccaucucaggagguguuuuuucucagcccggggcugccuuccagcagcaaguccaagggagccaugacccgaguuucccggucacugacaugcuuuuuucuccuuccucucucucuucugugaccuggccucccuggccucaggagacagaucaguuggaggaagaaaaagcagagcuggagucggagaucgccgagcuccaaaaggagaaggaacgucuggaguuugugcugguggcccacaaaccgggcugcaagauccccuacgaagaggggcccgggccgggcccgcuggcggaggugagagauuugccgggcucagcaccggcuaaggaagauggcuucagcuggcugcugccgcccccgccaccaccgccccugcccuuccagaccagccaagacgcaccccccaaccugacggcuucucucuuuacacacagugaaguucaaguccucggcgaccccuuccccguuguuaacccuucguacacuucuucguuuguccucaccugcccggaggucuccgcguucgccggcgcccaacgcaccagcggcagugaccagccuuccgauccccugaacucgcccucccuccucgcucugugaacucuuuagacacacaaaacaaacaaacacaugggggagagagacuuggaagaggaggaggaggaggagaaggaggagagagaggggaagagacaaaguggguguguggccucccuggcuccuccgucugacccucugcggccacugcgccacugccaucggacaggaggauuccuuguguuuuguccugccucuuguuucugugccccggcgaggccggagagcuggugacuuuggggacagggggugggaaggggauggacacccccagcugacuguuggcucucugacgucaacccaagcucuggggauggguggggaggggggcgggugacgcccaccuucgggcaguccugugugaggauuaagggacgggggugggagguaggcuguggggugggcuggaguccucuccagagaggcucaacaaggaaaaaugccacucccuacccaaugucucccacacccacccuuuuuuuggggugccuagguugguuuccccugcacucccgaccuuagcuuauugaucccacauuuccauggugugagauccucuuuacucugggcagaagugagccccccccuuaaagggaauucgaugccccccuagaauaaucucauccccccacccgacuucuuuugaaaugugaacguccuuccuugacugucuagccacucccucccagaaaaacuggcucugauuggaauuucuggccuccuaaggcuccccaccccgaaaucagcccccagccuuguuucugaugacaguguuaucccaagacccugcccccugccagccgacccuccuggccuuccucguugggccgcucugauuucaggcagcaggggcugcugugaugccguccugcuggagugauuuauacugugaaaugaguuggccagauuguggggugcagcuggguggggcagcacaccucuggggggauaauguccccacucccgaaagccuuuccucggucucccuuccguccaucccccuucuuccuccccucaacagugaguuagacucaagggggugacagaaccgagaagggggugacaguccuccauccacguggccucucucucucuccucaggacccucagcccuggccuuuuucuuuaaggucccccgaccaauccccagccuaggacgccaacuucucccaccccuuggccccucacauccucuccaggaagggagugaggggcugugacauuuuuccggagaagauuucagagcugaggcuuugguacccccaaacccccaauauuuuuggacuggcagacucaaggggcuggaaucucaugauuccaugcccgaguccgcccaucccugaccaugguuuuggcucucccaccccgccguucccugcgcuucaucucaugaggauuucuuuaugaggcaaauuuauauuuuuuaauaucgggggguggaccacgccgcccuccauccgugcugcaugaaaaacauuccacgugccccuugucgcgcgucucccauccugaucccagacccauuccuuagcuauuuaucccuuuccugguuuccgaaaggcaauuauaucuauuauguauaaguaaauauauuauauauggaugugugugugugcgugcgcgugagugugugagcgcuucugcagccucggccuaggucacguuggcccucaaagcgagccguugaauuggaaacugcuucuagaaacucuggcucagccugucucgggcugacccuuuucugaucgucucggccccucugauuguucccgauggucucucucccucugucuuuucuccuccgccuguguccaucugaccguuuucacuugucuccuuucugacugucccugccaaugcuccagcugucgucugacucuggguucguuggggacaugagauuuuauuuuuugugagugagacugagggaucguagauuuuuacaaucuguaucuuugacaauucugggugcgagugugagagugugagcagggcuugcuccugccaaccacaauucaaugaauccccgaccccccuaccccaugcuguacuugugguucucuuuuuguauuuugcaucugaccccggggggcugggacagauuggcaaugggccguccccucuccccuugguucugcacuguugccaauaaaaagcucuuaaaaacgcau

SEQ ID NO: 21242 - RNA, 42416 nt, Homo sapiens
agcucguugauauacaaaguuuuaugugaccugagccccucuggaggcaccagaguccacacucuguacucagaaggugagggauuggcucacgggggcaacauggcccgaaaggugggagaucguccauccccugcgggaaaggaggcaucccuaaugcauugcacaggcuugaagggggcacacccccacaguuggggaggaggaagcaaugauagcuaagaaggagaggggcaccccaaagaauacuacaguauaggguuagaaccuugaaauugcaccuaauagucuagaccuguggaccuuuagaaucuuagaaacuuagaacauuugagucuuagaacuacagugccuagaacuauaagauuuuagaaauguggauucuuggacucuuaaccaugguccuagagaggcagaaugcagcaaagaaccuaaagguguccaacauuagaaauuauuagaacuuuggugucuaguuagucacaacugagugugagagucuuauaacuuagaugcuuaggauccggaaucuuggaccaauggaaucuagagugccuugaaacagaacagaccguuagaaucuuauuuaaucaucuagaaucuuggagcaucugaucuagaaucuuagacacagagaaucuaagaucuuagaguaagucuuagaauaucacaucuuagaacaccggaccuuagaaacuccaucuuuagacucuuggaacuuuugaauugcagauucuagagcuuucgacccuuaggaucuaggaucuuauacaagagaaucuauuaucauaaagccucagaaacuauaauugaucaucauuagaaucuuagaacuugagaagauaacauuuugaagccuuaugaucuagagccuuacagccagagaaucuagacucucagagccuuagaacaucacauuuuagaauccuaggccuuagaaccuccaugucuagaacuauagaaucuuuagaaucuauaaucuuacauuuuaaggacucugaacucuagaagaauaaacaucuagacucauagagccuuagcuccuaaaaucagaaucuuagaacuuuagaaccuaaaaccuugaggcuuuaucaaaaauguuagaaccagaaaaucuaaaaccacauaaugucagagcuuuagaacaguaggucuuaagguugagugcaguggcucaugccuguaaucucagcacuuugggaggcugaggugggcagaucacuugaggucaggaguuuuagaccagccuggccaacauggugaaacccugucucuacuaaaaauauaaaaauuagccgggugugguggcacacaccuguaaucccagcuacuugggaggccaaggcaggaaaaucacuugaacucgguaggugaagguugcagugaggcgagauugcaccacugcacuccagccugggugacacagugagacucuaucgcaaaaaaaaaaaaaaaaaaaaaaaaaaaaaaaguaggccuuagaaccuuagcacuuuaauagaauuagagacuuuggaauuucagguccuuagaaccaaagacucacagcaucuuugaaaccuagaaccuuugaaucuagacucuuuaaaccuuggacucuagagucuuggaauguuaacaccugggagggcuucagauauugcaauccaaccccuuccuuuuacagauggugaugcuacugcuuucaaggugaugcuacugcacagagaaggggagggaccugucugggauggaggugggauagguaggaagacagggcugcaaguggggauaaggcguggggugggaaagugggaagguggaguuuuccccaguggcagugcuuagcuuggauccugagagggaguaccagguggaggguugucucaggcaccauccuccugcccuggggcugcuggggagccccuaucagcaggcugagcggggcuagggguuguggaagggcagaggacauagcguccagcaggauggaccucagccgcagugaggcagcuacaggaauccuuagggucuggcuggguuggggggucagcuccuccugcagcuccaggggguucaggauaaccuccacccucauccauguugacauagaggauuucgucaggcuccugggcaggaggcaaggccuucaguguguucuccaaaucuucccgcagcucuguaaaacuuggccgguccuggggauuuagcucccagcaccgcgacaucaaggcauaccuagggcagcaaaaugaggggugggagauugagcagggacucagaaggggugcauucuggaagccuggggacauuuuaggacacucaggggacugggggcauuuuagaggguuauagggagccucagcaguuugaggccaucuauggggauuugggaauucccaagaauuucugaguuggguccugggagacucaggagcugggaagggucucgggaaaccugucuguauauggaguaguauucugaugaggguuugcuagaacagaccuuccagcuccccagaacagacuugcaucaaagccuggcuaugccacuuacaagcugugcugguuuaaaauagguccauaaauucuuugacccuccucccugcaaaagacggagaauaaauccucuccucuugagcaugggcaggacuuagugacuugcuucugauuuggcagaagugauggugugugugacuucugagacuaggucauaaaaggcauguggcuuccucgcacuuucuccuggguugccauguugugaguaagcucaagcagugccacaaagggguccacauggcaacgaacugaagccuccugcuacagccaugugaguaagccaccuugaaagcaauccuccagucccaaccuucagaugacugcagcccccagugauaucuuuguaacuucauuagagauccugaaccaaaaucacccugcuaagcuguucccaguauccaacuuucagaaauugugugagauaauaaacguuuguuguuuuaaacuacuugauuuggggauauagauaacaaacacaccagcugugcaaucuuuggcaaauaaaucacccucccagacugggcguggaggcucaugccuauaaucccagcacuuugggaggcugggacggguggaucaugaggucacgauaucaagaccauccuggcuaagguggugaaaccccaucucuacuaaaaauacaaaaaaaauuagcugggcaugguggcacacgccuguagucccagcuacuugggaggcugaggcaagagaaucgcuagaaccugggagguugcagugagccgagauggagccauugugcuccagccugggcgacagagcgagacucaagucaauaaauaaaaauaaauuacccucccuguaggacuggguuuucuuaucugcagaaugggaaucauaaugauaccuaucuacaucacauggcugugguaaggaccaaaugauuugacacaugccaggcaccuaaaacagugccuucuagucaguuauaugaaaauguuagcuguuauuuuuacucgucucagcucuuggaguacccaagguggacugaggagucugacgccccaggcugucuccuccugacccaaagucauccucucuuuacccucaaagugcuagcuaaaugucacggccuucuccgcauacuccaauauugcaaaguuugguaagcauucccugaaggauccugcaaauaucucagaggagaccugagucuggagaaggccaauaaaacaaacugaaggguuuugcagagagucucagguguugaggagcaugucggggaagcauggugugcucaggagucuggaaugagaagucucugggagugcaugucccaaaggcagggccgccagguaagacugugcuguuauucacuacccaaggauaccuggcuuggggguggggagccagggggcugauucagcccacacagacaaaggaggaaagggugccuuuagcugauuugcaccccacugguuagugauggcccuacucagagcauuggugaggggcaagugggucacucagcauucucagggauucugucuggguuauagagaguccuggaccugugagggccaucuggggguagucagggguuuggaaugaauucuggguugggggagaccuaaggguccucacaguccauccagacaguccgcaggcugcuucaggcgauuucccuggcgcagauagucauaaaucucgcuguucuccacgcccggauaugggguuuggccucuuguggcaaucucccacauugucaccccgaaggaccacugugaggggcagagggaauuagacagucucuccugcacagaaucacccgcaccaauacccagguucauggguacacccacacuuauguacacauguucacaaccauccucugggagcaucacaaguauucauagaaacauaauacuuuagccgggugcgguggcugaugccuguaaucccagcacuuugggaggcugaggugggcggacugccugaggucaggaguuugagaccagccuggccaauauagugaaaccccgucucuacuaaaaauacaaaaauuagcuaggcaugguggugggcgccuguaaucccagcuacucgggagacugaggcaggagaauugcuugaacccgggaggcagagucugcagugagcugagaucaugccauugcacugcagccugggugacagugcgagacuccaucucaaaaaaagaaaaauauauauauauaaaaaauacuugacacggguauacacaugaauaaguaacuuuuguggaugcauacacaugcucaccaucacacacauauacacacuucauggacacaugagcucaugugccacucugcacacccuggcuguccacauucuaugagugugcgcacaugcacgcauaaucacugcagcuucuucuaaccuaaacugucuacauugcuaccaugcacacgugggccuguauuuauccugggcauguacacaccacuauucagagaugcccaccauaccccaagacaugcccagcccauguggacaagccccugcaaagggaagcccacaugucccugugacccuugcauccacagccacccaggcauagugugugauggucaggccaugcccucccaugguuccccacucuuggcgggagugcaccuaccacaucgcucuugcugguguagacacggucagcuagacucucaauggcaauccacuugacuggcaucuuggcgauacgucccuggcgguaguaguccccauuguagaucuucuuggagagcccgaaguccgccacacacacggacauguucucauucagccuguuuggauuggggaaaggaacagggucagggcaucagucaccuccaccaggaagccugcccuggcucucagacacaucugcaccuccuccccucacuguccuggcugcggguggggaucugucuccuaaaccuucaucccaguccagaagggaacugcuuuacuucuuguucacucugucaagugaggaugggacaaagggcuuccucaggacuucccaauuuuggcucuuugcuagauucuaagguccuuccuuggguuugauuccuugaugaaauuuuuuuuucuugaaguauacuguacauauggaaaugugcacaagucauaaguaagcagcucacugaauuuucacacacacacacacacacacccauguaaccagcacccagauuaagaaacagaacauggcugggcaugguggcuggcgccuguaaucccagcacucugggaggccaaggcagguggaucacuugaggucaggaguuugagaccagccuggccaauguggugaaacucugucucuacuaaaaguacaaaaauuagccagguguguuggugcacaucugaaaucccagcuaccugggaggcugaagcaagagaaucaguugaacccaguaggcggagguugcagugagcugagaucacgccacugcacuccagccugggcaacagagugagugagacuccgucucaaaaacaaacaaaaaaaaaaacaggcacaguggcucaagccuguaauuucagcaccuugggaggccaaggugggaggaucacuugaggcuaggaguucaagaccagccuggaaaacaaagcaagacccugucucuacaaaaaaauuuaaaaauuagcuggacaugguggcacaugucuguaguuccagcuacuuaggaggcugaggcagaaggauagcuugagccaggaguuggaggcuacagugagcuaugaucaugccacugcaccccacccuaaaggacagaguaagacucugucaaaacaaaaaagaaaagaaagaaaaaaagggaaagaaagggaaagagagagggagggagggaaggaaggaaggaaggagauaaagagagagaaagagaaagaaaagaaagaagaaaggacagagagaaaaagaaagaaaagaaagaaaaagaaagaaagagaaaaaaagaaaagaaaauccacaggacauucauaugauggaauaccauaccacacagcaaagaaaaagagcaaacuaccccuacacagauccaucucaaaaacaucaugcugagccauagaagccagacacaaagcaguacaaacugcaugaucccauuuguaugacuuuucagaacaggcuaaacuagcacugagaagucaggauaguggguaccacuuggcgguagugauugggaagacgaagaggcaugaaggagccugcuggggcuaagaaauauucuuuaccuucaucuagugguuacaugggucuauacccauaaaaauucaucgagcugagcugcauguguauauuuuaguguauguaaaauauacaucaauuuuuuuuuagaugggaucuugcccuguugcccaggcaguagugaagugauaccaucauggcugacuucagccucaaccuccugggcucuagcaauccuuccaccucagccucccaaguagcuggaaccacagguauacaccaccaugcccagcuaauuuauuuuuuguaaagacaggauucacuauguugcccaggcuggucuugaacuccuggguacaagugauccuccugccucagccucccaaagggcugggauuauagaugugagccacugcgccuggccaagacuaauauucuaacucugugguuccauucccuccaccuucuacccuccccuuacccucuauucuggcuuuugggggauuuuuuguucuuucuuuucuuuuuuucuuuuuuuuugagauggugucucguuguuguuacccaggcuggucucgaggcucaagcaauccucucaccuaagccuugggaauggcugggacuacagguuacuauuuucuuuuuucuuucuuucuuucuuucuuucuuuuuuuuuuuuuuuuugagacagagucuugcucugucgcccaggcuggagugcagugaugcgaucucggcucauugcaaccuccgccuccuggguucaagcaauucucguguugggauuacaggcgcacaccaccgcaccaggcugaauuuuguacuuuuaguagacaggggguuucaccaaggcuggucucgaacuccuggccucaagugauccacccgccucggacucccaaagugcugggauuacaggcgugagccacugcaccccaucuggcauauuuucugcuuguccauugguggggaguuugauuuucuuauccaguguggccgcuuccaaagggcagccccaggcaagacacccagcauggagugggacagagaugcagcucacguguccccacccccaucggucaccucagccccuuugcucaccucaugcugugcacugagcccaccuucuggucucuucccucuccgcauccaaaugcuccuuccagaucucaguucaggacucaccuccuccaggaagccuucccagacccccuuacugacuuuccugguccugaguucugaccugcccucagcgggugucuagcccugcuuccauccuaagaaggagggagggaacucccucagggagugcaggagcaguuggggggggggggucccugaaaggcacucacaugcaguuccuggccgccaggucccgguguaugaaucucuugguacucagauacuccaugccacuggcgaugucugccaugaacuucacuagcaucugagugggcagguacuggggagccaaggcaggugggaggagaggucaacagaguccuugaugcgaucccuccucccuccaucccucugugcaagccuagcucugcccgcagugguuucccauggcccugacaauucaacccaaccccucuccauggccugcaagguccuauaaacuugcuccagccuuccucuuggacuugauugccuauguucuugcccuugacugacacucccaccagacuccugucuggucuucagacaaacgaugaucauucccaccuccgagccuuugccuaugcugugcgcucuguuggggucgcuuccugcccagaucuccagacaucuccccagccccaacuccuucacggucaccuccucggcaagaucuuccacguccacccaaauucacugccuggccuccuuaucuuccauccuacuguauuuccuuccuagcacuuaaacauuuaaaucaucucgcuuagguauuuauuagcuuguuuaucauccgccccuccccugcuggaagaaaugcuccaggagagcaagcuccuggucaccguggucuucccagggucugagcagcacuggguaccugauagaugcucaguuaauauuuguagacugaaugauuaaacgccccuuaccacuggcugguccccgagccgggaauagaggaggaagcuguguaggucuccauguuucaugaaagguaagaugaccacaggugcugggaagcucucucguucagaacccuggaaacagacaccugagccccccagguagcccugucacuccugcugggcagaaggggaagccaagccccccaccagccagccuccagccucuccuucucacuacccauccaaucuggccaccauauuguuuggggguaguggcaguggcaaggaccaagcugcagagaagcuguuuccagcagaguucccagggacguuuccggagcccuccuggggaccucagcuauuucugggaaugaucagaggucacauuccaagcugagggagacuaggagggggaagccugcugacccugaaggagcggggagcaggaagccuggaaguuugaucuucccagggccagaagcagggcucuucccucugcuauggcccccauggggcuuguagaccccuugaaucugccccucucucaccgaugagccucaugacguugggauggucaaauuccuucaugcagaccgcuucacucaggaaauccuccagcucugaccucgugcagauggcaacuugagggagagagaaaggucgugaggaggaggggaggagagggaggacucucccuccaccuccacuccaucaucaucaucaucaucaucaucacucaucuucaucaaacaugauuaguaaguaccaggcaccauacucagcacuuuauaugugauauguguaugugugugugucuguguguguguauauaauauauauauauauauaaaauauauauuuucuuuuuuuuuuuuuuuuuagauggagucucacucuguuguccaggcuggagugcagugguuugaucucgggucacugcaaccuccgccucucggguucaagcaauucuccugccucagccuccugaguagcugggacuacaggcgugugccaccacacccggcuaauuuuuuguauuuuuaguagagacgggguuucaccuuguuagccaggaugguuucgaucuccugaccucacgaucugcccgccucggccucccaaagugcuaggauuacaggcgucagccacugcgcuuggccaacuuuauauauauuaacucauuuaaucuucucaggugcuacuauuaucauucccauuuuauugguuuuuuguuuuguuuuguuuuguuuuuguuuuuguuuuuuauuuuuauuuuuugagacagggucuugcgcugucacccaggauggaugcaaucacagcaaacauagcucacuggagguuaggcucgaacuccuaggcuugccuuccugaguagcugggaccacaggcacgcaccaccaucccggauaauuuuuuuuuuuuuuuugagauggaguuucgcccuugucccccaggcuugagugcaauggcgcaaucuuggcucacugcaaccucugccuccccaguucaagagauucucguaccucagccucccgaguagcugggauuacaggcaugcaccaccaugcccagcuaauuuuuguauuuuuaguagaaacgggguuucaccauguuggccaggcuggucucaaacuccccaccucaagugaucugccugccuuggccucccaaagugcuaggauuucaagugugagccaccaugcccagccaauuuuuugagagggagucuugcuauguuguccaggcuggucucaaacucccagccucaagugauccucccaccucggccucccaaagcacugggauuacaggcaugagccacugucccuggccuaucucuauuuuaaagaugaagaaagcaaggcacaaaaagguuaggagucugccuaagggaacacacagcuuggagguggaagaggcagaucucaaacccgggcagucuggcuccaggguccaccugcucacaacugcccaggcugcuucccagcacuucccuaccugcccuggggacccaaacaaguaucaucccauuuaacaguucaggacacuguggcucacagaggcaaaaugacuugcccaagguugcacggcugagauucagacccaggccaagacuauaaccagugggaggcugaguggggaggaucgcuugagccucagagguugagacuacagugagcugugauccugccacugcucuccagcaugggcaacgagcaagacucugucucaaaaaacaaaaaacguaggcugggugugguggcucacaccuguaaucccagcacuuugggaugccgaggcagguggaucaugaggucaagagauagagaccauccuggccaacauggugaaaccccgucucuacuaaaaacacaaaaauuagcugggcgugguggcgcacaccuguagucccaguuacucaggaggcugaggcagaagaaucgcuugaaccugggaggcagagguaguaguuagcugaggucaugccacugcacuccagccuggacagcagagugagacuccuccucaaaacaaaacaaaacagagcaaaacaaacaaaauaaccugguacacaggaggugcuccauaaugaacgaaugaguggguaaugacuucauagcccaagcuuuuaagcccuguaauucagaaaggaucauucucuauucaccaccagccccaaucugaaugcccuaugcuucuccuucccugugugugaagaacuuagcccuggacuuccugugcuguguaacccugaaauggcuccugcccucucugauaauggaaauaauauaguccuacuccacauuaacaagcauguccuacuugccacccucagcaugaagugcuuugccucaaaacagcuuuggaagguggggacauuaggguccuuuuuuccagaugacaggugggaggcucagagagggaaagucauuugccugagaucgcauagcugguaaaugauucagccagguaugccucauucuagagcuucuccugcuccacuauguaucacagugggccggccccugaaaacuacauuucccaggcucccuuuccuagugguuuccucuugggauuugccaaugggagguaggcccuuaugggagacuggcagguagcggggagaaagggagaagccaggguauuucacccucucucugcuucugguauucccuugguggugguugugucgcccaugugugcguguguguguuuuaauuuuuuuuuuuuuucagacggagucuugcucugucgcccaggcuggagggcaguggcacgaucucggcucacugcaaucuccgccugugagguucaagcgauucuccugccucagccucccgaguagcugggauuacaggugccugccaccacgccuggcuaauuuuuguauuuuuaguagaggugggguuucgcuaugcagaucaggccagucucgaacuccugaccucaugugauccacccgccuuggccucccaaagugcugggauuacagacgugagccaccacgcccagccauguguguuuuauuuuuuuaagacaaagucucacucugucacccagauuggagugcaguggcaugaucauagcugacugcaaccucugccgcacagacucaagugauucucccaccucagugucccaaguagcugggacuacaggcgugugccaccaugcccagcuaauuuuuuguuacuauuauuauuuuuuuuuucauagacaugugguuucaccauauugccuaggcuggucucaaacuccuggacucaagcgaucugcugccucggccucccaaagugcuauucuggguuuuuagcucccacagagcagccucuaacucugugauaccagcuccugccuggugucccuagcuguggauucugguaacaccacuugcucccucuacccuucaggccuagcgggggaagugacuuccugcugcugcucaucucugguuucccucccugcccccaguuguuccuucaacccgucucccaccuuuguacuaaucuccccauauucaauuccuucuauugagguaccuggcaggggcuccauugccuaucuggaaacaccagaaguucuaagcuauggcuaacuugcuugcucucuucugucucaggggcauagggaaggagcuggggguccuacacaugugcacguaacucacucuucaucgucuucacagccaccuugaggauggagucguccugguugagcuggccuuccaucacagcuccaaacucuccuguggggggccagagggagacacugaccucagagggcccguggggacuguauuuccuauaguugggugggaguguggaagugcaggaucucagaaguucagaaggauguguguaugcugccgggggacucacccucucccagagucuuccccagggccaccuugugccgguccaccaucacaucccgcagcuucuccuucagcucuucacugaugcccaggcuguucacugcaugcaagguugggguggacagagucauggagcagggcugacauucaggugacauucacccaccaguagggauagauccauuguugaaacacugacauacuucugcacugauuuaaaauuagcaacugcccugagcaccccucuacuuccaccccagcuccuccucuggacccccugaaccuucccucaaagggaacucaagggguaaagccuggccacgcucuugcuccagugggcacccugaugggucagugcccugcuguaccaguuguuaaaaauauuucuuuugcugggcacaguggcuuacgccuguaaucccagcacucugggaggcagaggcagguggaucacuugaguccaggaguucaagaccagccugggcaacauggcgaaucucugucucuacaaaaaaauacaaaaauuagccgugugugguggcacaugccuguagucccagcuacuggggaggcugaggcaggaaaaucacuugaacccaagagacagagguugcaaugagcugagaucgcaccacuucacuccagccugggugacagggcaagacuccgucucaaaaauaaaauaaaauaaaauaaaauaaaauaaaauaaaauaaaaauauuucuuuuugcuggaugcaguggcucaugccuguaaucgcagcacuuugggaggcagaggccgguggaucacuugaguccaggaauucaaaaccagccugggcaacauggcgaauccccgucucuacaaaaaaauacaaaagcuagccauguguggugguacgcgccuauagucccagcuacucaggaggcugagguuggaggaucacuugagcccagggguggaggcugcaguaagcugagcucaugccacugcaccccagccugggugacagagcaagaccccaucucaaacaaaacacacacacaaaaauauuucuuuuuauugaaguauaaucugcacaaaucauaaguaagcaacucaguggauuuucuuuucuuuuuuuuuuugagauggaguuucguuccuguugcccaggcuggagugcgauggcgcaaucucggcucaccgcaaccuccgccucucagguucaagcgauucuccugccucagccucccaaguacaggcaugugccacuacgcccagcuaauuuuguauuuuuaguagagacgggguuucuccauguuggucaggcuggucuggaacucccgaccucaggugaucugcccaccuuggccucccaaaguguugggauuacaagcgugagccaccacgccuggccaacucaguggauuuucacaaaucaaacacaaauguguaacuagcacucaggccaagaacagaacaugaccugcccuccugggguagccacuuucuugauuucuguuacaaucgauuaguuuugaaauauuauaaaaauggaaucacauaguauauucucuuuugugucuggcuucuuucacucaacaugaugucuaugaaauaguuuuaauuuaguuguugaguguaauuguaauuuauccauuuucuuuguuauauaaucauucucaaacaaauugacaucaggacaccuuuacauuguuagaauuauugaggacuagaaagagcuuuuguuuauguuacauauauaucaauauuucuguauucaaaaauaaaacuagcugggcacagugguucacagugguucacccagcaacuugggaggccaaggaaggaggaccaguugaggccuggaguuggagaucagccugggcaacauagccagaccccaucucuaaaaaaauaaaaaaauuuuuuuugaaaccgagucucgcucuguugccuaggcuagagugcaguagcauaaucucagcucacugcaacuuccgccucccagguucaagugauuccccugccucacccuccugagcagcuggaauuauagguguacaccaccacaccuggcaaauuuuuguguuucuuuuuuuuuuuuuaaauagagaugggguuuugccauguugcccacacugguuucaaacuccuggccucaaaagaaaaccuaucagguuuauuuaauuuuuuuuuuuuuugagacagucucacucuguugcccaggcugaaguccagugguacaaccucagcuugcugcaacauccgccucccggguucaagcgauucucuuuccucagccucccaaguagcuaggauuacaggcaugcaccaccacacccagcuaauuuuuguauuuuaguagaaaugggguuucaccauguuggucaggcuggucucaaacuccugaccucaagcaauuugcccaccuuggccucccaaaguggugggauuacaggcaugugccacuaugcccagccugauaaauuuuuaaaacaagaauauacaagcacaagguccaucagcugucagaguguuggaugacaucaucccacgucagggagccucuggaaaacugcgcugaaugcuaaugagagaaugagaaagcaaaagggcaaauaaugucuugguaauaguaugaaaauagauuugaccuuaugggcccccugcaaaggucucagggaccacaggggaccaggcucacacccugagaauggaugcuguauguuacucaguuaaaucacugggacaucguugcuucuuccuucucuucuuaaauaaaugucuuucccagcccuuuccaaacaucccccuggggcccuggcggcuuucucgcuguaugcuaggaagagaccuagcucuuccauuuucuuucuggauuucaguuucccuaacuggaaagaugagauuccuuuuuuuuuuuuuuuuuuuugagacggugucuugcucuaucacccaggcugaagugcaguggcacgaucucggcucacugcaaccuccgccucccagguucaagagauucuccugccucagccucccaaguagcugggauuacagauuacaucuggcuaauuuuuguauuuuuaguagagacagggucucgccauguuggccaggcuggucucgaacuccugaccucaagugucugcccgccugggccucccaaaguguugagauuacaggcgugagccacugcacccagccgaaagaacagauuugacugggccucugagauccccuccucggcugagaccuugcauggcuuuccagccuucuaauggagagucuauaguucuaagauuuuaugauuucaaaaguauaaggguguagaguacaugcauauaauuuuucaggccaagaucgauucuaucucucuaccaauuuauaauuccaagagguaguagaguguggcaguucagaguauagacuucaggccaggcgugguggcucacaccuguaaucccagcacuuugggaggcacggguucaggaggucgagaccagccuggccaauauggugaaaccuugucucuauuaaaacuacaaaaauuagccaggcguuguggcaugugccuguagucccagcuacuugagaggcugaagcaggagagucgcuugaauccaggaggcggagguugcagugagccaagaucaagccacugcacuccauccugggugacagagcaagauucuaucaaaaaaaaaaaaaaaauaguauagacuucagagcaaaaguaccuggguucaaaucccagcuauccaauuuacaagcuguguggccuugggcaagugacuuaaccacucuaugccacagcuuccucaucugugaagugaaggugauaagaaacccaccucuggcugggcgugguggcucacgccuguuaucccagcacuuugggaggccaaggcagguugaucacuugaggccaggaguuccaagaccagccuggcuaacaaagacaggguuaguaaaaccccaucuuuacuaaaaaugcaaaaauuagccagauguggugccaugcacuuguaaucccagcuauucgggaggccgaggcauaagaaucacuugaaccugggaggugaagguugcagugagcugagauugugccacugugcuccagccugggcaacagagcgagacucugucucaaaaaaaaaaagaaaaaaaaagaaaaaagaaacccguguccuuggguugcucugaggguuaaacgaggagauacauguagaaugcuuagaacagagccugccacauagguagugcuaggguugccugugauuuuuaucacaucaucaccaucuaaucucaacauuauuucaucaucaucaucauuuucuucuugucauuaucuucaucauuaucaucaucauuacaucuucuaagauccaauggcucugagguuugguguuucuuuucuuucuuuuauuuuuuuuucuuuuuugagacagggucuugcucugucacccaggcuggagugcaguggugugaucacggcuuacugcagccuugaccucccugggcucaggugauccuccuaccucagccucccgaguagcagggaguacaggggcacaccaccauaccuggcuaauuuuuuuuuuuuguagagacaggguuucaccaugcugcccaggcuguucucgaacuccugggcucaagugauccucccaccucggccccccgaagcgcuaggauuacaggcaugagccaccacacccagccuugguguuucuaagauuuacugugucuaagauucuauuccuugaaaguucuuugugguuccacaaaucuguuauuucuagggucugugguucugacauucuaguaucccaaggccuuuagaaacuuuuggcucacacauguacagaagcccagcaggccagauucucuacagccuuuagauccaggccagggcaguggggcauaggguucacuuacagguagcuucagugguccgacgacuguaggacuugcgcacgcgguaccugacuaccaguucaccucuuuccacuguugguucaaacacuucucugggggggagggggaguaggugagggcagggaaaaaccauguggaacccccuacucaaccagcaguugagcaagcaccaucucagccucaagcccugccugcccucugugcuaacauuugcugagcaugccuugggcagcuaccuucugccuuccauucauuccacacacccccuugcccucauucuuuuuuuugaaaacaggaucucacucugucacccaggcuggagugcagugaugcgaucucagcucacuguagccuccaucucccggguucaagugauuaucgugccucagccucccaaguagcugggaccacaggcgugugccuacacuucccgcuaauuuuugcauuuuucaguagagacaggguuucgccauguuggccaggcuggucucaaacuccugaccucaagugauccaccugcuucagccucccaaagugcugggauuacaggcgugagccaccacgccuggcuucccuugcccucauucugauucuuagucaucacuccuccugcaccagccuccucacuggccucccugccuccagccucuccaucccaggccacacagccuccccaugugguuccaacucacccauaacgggucuccuucuuucgccgguggacaaggaagagagccaagaugaggacacaggcagcggccacgacugcuccuagcaguacauaccaccagggccacgagaaggcaggaguugaagguuccuucacuaucaggggguaugaggaacaggucauggaugaagccuuggauccagcucucugggacccaaaggggugaugugggagggaggcagaaggccucggcaaagaugugcacauacuugaugaggugugugauggaugcauucacauaucugaaugggcugggcuggacagggcaugcaauggaugugauacaagugcagguuaaagcagaagugugugaaaguuguaggaugggugaguuaagagugggauggaggccaggugugguggcucaugccuguuaucccagcacuuugggaggccaaggcggguggguuacuugaggcaaggaguucaagaccagcccggccgacaugaugaaacccugucucuacuuaaacaaaauauauacaaaaauuagcuggggugguggugcacaccugcaaucccagcuacucgggagcugaggcaggagaauugcuugaaccugggagguggagguuucagugagccgagacugggccacugcacuccauccugggugacagagcaagacuccaucucaaaaaaaaaaaaaaaaaaaaaaaaaagagagugccaggauaguucaggugguagagcaucagacuuuuaaccugaggguucaggguucaagucucuguuugggcguuugcaguuuuccuuacuuuaagcuaccaaauauuaugccaccaagauccaaaaaaacagaagaguggaauggauauuugaggagugugcagugaguguggaaugggagggagagauguguggaacgcguuaugagugugccaagagggcuagaugaacaugagauggguguggagaaaucucaagcagcauagguuagugugagaaaugugaugauugugcaagaaggguggacuagaguguagauaagcaggugaguggggaagaagauccuugcaguguaggauggugcaugaagcgugugcaaggagggcggacuaaggaacaucuuuugaagagaaugcaaugacuacaaaaggguuuucuuugucucuuuuuuuguuuguuuguuuuuugagacagggucucacucuuucacccaggcuggagugcaguggcccggucucagcucauugcaaccucugccucccaguuucaagcaaaucuccugccucagcuucuaaguagcugggauuacaggugugcaccaccaugcccagcuaauuuuuguauucuuuuuuugguagagacaggguuucaccaugucuccugaguagcugggacugcaggucugugccaccuggcuaauuuuuuuuucuuuucuuuuucuuuucuuucuuuuuuucuuucuuucuuucuuuuuuuuuuuuuuuugagacagagucuugcuguguugcccaggcuggaguauaguggcaugaucuuggcucacuguaaccuccgccucccagguucaagcaauucuugugccucagccucccgagcagcugggauuacaggcucgcaccaccaggcccagcuaauuuuuguauuuuuaguagagauggguuuucgccaauguuggccaggcuggucuugaacuccugaccucaggugauccaccugucucaggccucccaaaguacugggauuacaggcgugagccauugcacccggccacaaugguuuccauaaagccaggaaugagggugaaauaaauauccaaaggggcaugguaagcauauacaggguuggauggcugcuggaaaaguugggggugugugaagugggaagaguauucgugaagucuuagauacaaggagugagcaaggaauuuuaaggauguaauugcagugugagagaagugugcagugagcaugcaaaagauguuagaagggcagaugagaaguauggggugcacagaaaggggguguaaaaagggcagggguggaauggaguguguaagaaauaaagaucauuaugugcugaguaugcaagggguucagggugagugugcagagugagauggguugggauuagugaagggugagggaaugaugucuauggagugugcaguaagcaugcaaggagaaucaggugugggaaaguuguggacaauguuuuucaguguuugcaauguggaagguaugguaagugcauacaaggugugcagaguuugugaaugagaaguguguugugcaaugggccuuuggggucaugugggaggaacggauuauaaugggauauaugugaaaggaggguggaauaagcguggaaagcguaugugaagaaauguaggaagggaugugaggaguauugaaggcuaguggguugaguuacaagagugaaccauaauagugcccagaggggacaauggguguaggaggaauguuugagaauuguuagagaaauauuugagagggauggaugugaggaggauaccucauucauccauccauccaccuuucuacccauccauucauccacucacaaauccauccaucuguccauccauccauuuauccaaccauccauucauccauccauccauccauccauccacccaucuacccauccauauauccacucaccacccagucaucuuuuguucauccaccuauccacccaucuauuaauccauugacccacccacccauccacccuccauauauccaaccauccauccauccacccuccauauauccacccacccauccauccacccauccaucuacccauccauuuauccacucaccauccagucauuuaucuguucacccaccuauccacccucuauucauccauuggcccacacacccauccauucuccauauauccacccauccauccauccacccauccaucuacccauccauuuauccacucgacauccagucauuuaucuguucacccgccuauccauccucuauucauccauugacccacccacccauccacccuccauauaucuauccauccauccauccaucuauuuguucauccauccacccacucaucugucauugccugaauaccuacaaugugcuaugcuaggccauuauaggcaccuccaucaaggaccacacaaacucaagaaguagguuagagugaugaguuagagaaacaugaaagggaugugcaaugaguaugcauggugacagugcccccacuagguguugaggguagggaaggaggagaugggguguggaagcccuuacccagcugguggacuggcugugcuugcccugugagaagaaaggacagagaggagaugugcucagagaggacaagacuggcguggcacggguaagggaguaaggguguggcacggguaagggagugaggguguggcacgaguaagggagugaagguuuggcacggguaagggagugaggguguggcacggguaagggagugaggguguggcacggguaaaggagugaggccguggcacagguaagggagugagggguuggcauggguaagggagugagggcagcucucaguaaggcucaggguaggaacagggccuaaguugcgguaacacugaaagguacaaggaguaagucagggcugucagggagagacaggguugaagcagguugggcauggcuuuggacuuaccugggcgccaggccuccagggguacugggaggcuccaggguccauccccagcagcaguguaggcugccacacacacugucagauuggacacagacccgucccccugcagcuccagggucaccucuugccuuagcccuauguccauuagcaccuaggagguccagaaguggcaucaggguagaaccuuaccccccagcuguuaagccuucacucucgggcucaaugccccaucucuuucucaaaacgcucuccccauccuccaacuccucauccuuccucguccuccccuucaucucucauccucauccuuuaaccuguaucccuccauccccuucuagcuucccuuuccauccucccucccuaugucaggguauugcuagcccugauaggagugccuuugugaaaaucaggaaaagguaccccuuccccaaggugcuauauaacuaucugcuguaaaaucguuauauaguaaauaugagucugcugaaaugcuuuugcagugguucaaaaacagccauuccccaugcccucccuuagacccccuuauucuccccagaaugugaaugugaaccuucccugaaugugcccccuaggcauagagcaauuguguacuacccaaccuucacaaccaucuaugucugcccugauauguucuccucccuccuccccaagccacuccacuccaaucccaccagcagcacccaccucugggguguccuggccuugauacgccagccgguacccuaacaggguacccugcaggggcgcccggggcucuugccaaugcacgaaggccuggcucccauuccgcguagcacuaauguucucaggggggcccaggggcacuggaggacagggaagaggggaagcuggcacccccaccucuuccugacccccuccccuguucccaggaagugggugcagggugccaagggcacacacgugggcaacucgugcaggccucccaugagaggaagcacaggggagagaagggcugggagagaggccagcgggcagugcugcugaggggucagagauuggaugggaaggagauugaggccaugagggguaaaggagugaaaggggacaauggggguggcacugauauaagcaagguccgguggggcaguggugacgugucccuccccaacccuucuuaccucccuccggcgucuccacaggaagccaguggguccaggaugaggggcccuggcugcuggugcaugccacgcggaugugauaaggggugugaggauggaggcugccuagccgaagcugaugggggggcacggaugcuugcgaggugaggggcuccucuggggggucugguucucccgccuggaugcccaucccaucguuugacagcacagccugaggagaggcaagggugugaggacgggacagccaagcaaucacacgagauggucacacagcucccaguggugguggucuggugugacuacacaacuuuucaagggugcguguguguugcagugccaugcuaggauaacacgggcaccuggauuugcaaagcaaggagaucauuuggcuguauacaaugugguucugucaccacuuccaaaagccaccucuggcaagacucuucccucucugagccucaguuuuuuccuugggcacacggggccuuagaggaucaagugccuuacaggauuguuuaaagauuaaguguaguuaugcccaaaggaugccacagugcauggcggguggucagcaccgauaauaauagugugaugacaauaauaacgcaaauagacugggcacgguggcucccgccuguaaucccagcacuuugggaggccaaggugggcgaucacuugagguuaggaguucaagaccagccuggccaacguggugaaaccccaucucuuccaaaaauguaaaaaauuagcuggaugugguggcgcucgccuguaaucccagcuacucgggaggcugcgauaggagaaccacuugaaccugggaggcagagguuacagugagcuaagaucacaccacugcacuccagccuggguaacagagcaagacucugucucaaauaauaguaaugaucaucauaauaauagcacgauacugugaggccccauuuauaugacauuauacuacaggcaaaagcaauguucuagaagcagaaggguggccaucucuggggccugagggagacuucuuggggacuggaagggucugugucuugauuuggauggugguuacauggugaauauguguguuaaacaaucucaaagguguccaaucuuuugacuuucuuggaccacaguggaagaagaauugucuugggccacacauaaaauacgcuaacacuaacgauagcugaugcguuaaaaaaaaaaaucacaaacaaaucucauaauguuuuaagaaaguuuacgaacuuauguugggccgcauucaaagccauccugggccacauguguuagacgagcuugaucuagagguacacugaagauuaugcauguuauacaucucauuucuuuuucuuuuuuuuuuuuuuuccuuuuuuuggagagggagucuugcucugucgcccaggcuauagugcaguggugagaucuuggcucacugcaaccuccgucuccuagguucaagcaauucuucugccucagccucccaaguagcugggacuacgcguaccaccacgcccgacuaauugccguauuuucaguagagacagcguuucaccauguuagucaggcuggucucaaacucuugaccucaggcaauccgcccgccucagccucucaaagugcugggauuacaggugugagccaccgugcccggccuaugagucucauuucaucaccugagcuggagugcaguggcgugauuucggcucacugcaaucuccgccucccagguucaggcaauucucaugccucggccucccaaguagaugggauuacaggcgugagcaaccaugcuugacuaauuuuuuuuuuuuuuuuuuuuuagacagagucuugcucugucacucagguuggagugcagugguacaaucucggcucacugcaaccuccgccuccugggcucaaguaauucuucugcuucagccucucgaguagcuggggcuacagucaugugccaccaugccuggcuaacuuuuuuguauuuuuaguagagacgagguuucaucauguuggucaggcuggucuugaacuccugaucucaagugauccgccccccucggccucccaaagugcugggauuacaggugugagcuaccacacccggcuuuuuuuuuauucuguguagagaaaggguuucaccauguugcccaggcuggucucaaacuccugaccucagguaauccaccugccucggccucccaaagugcugggauuacaggcgugagccaccucaccugacuauguuauauauuaucuuaauaaaaaaagauaaaacacguccaacauguacugagugccuuucuuagcccuugacaaaucugaauucauuuggcccucacaucaauccuguuguccugugguaagcauuaugcuuauucccacuguacagaugacaacacugaggcccagagagacggaaucacuuguucaaggucaucaguuugucacugaugaagcugggaccuaaaccccauccuguccccagagucuuugcucuacuggcgguaagaauaucaguaaugguaacaauaccucuugucugugcacagaggcaguuuagccuagugcugaggagcacggaugcuggaucuggggcucaaauccaggcucuaucauucccuagcugugugccucagucuucucaccuguaaaaugggaugacaguggcuccccacuucacaggguugacugaauuggggcauguaagcauuuagaagacugcuugugcauacugucauuuauuaucuaucuaucuaucuaucuaucuaucuaucuaucuaucuauuuauuuauuuauuuauuugagauggaguuucgcucuuguugcccaggcuggaguacaauggcaugaucucggcucacugcaaccuccgccucccagguucaagugauucucuugccucaaccuccugaguagcuaggauuacaggcaugcaccaccacacccggcuaauucuguauuuuuaguagagacaggguuacuccauguuggucaggcuggucucaaacucccuaccucaggugaucugcccgcucagccucccaaagugcugggaucacaggcacgagccaccgugcccggccugucacuuauuauuuuauguguguuuccuggcaacaagugucaagcucugcauagcggcacagguucccauaccuauuccacccgaggaauggcacacucagaguggagggggccaccacugguguacacaucuguauagcccugccacauggaaccacaaaacccccauaaccacacaauucacagccacgccucaggaauggugcagccaagggcuuccccuucacccuggagacuccagccauacagccacacaguaugucaggaaggaguuuacugccacagggugugggcucuaaagccagauuccuuggaucuaaguccuguguuggauguuguuugcugugugaccuagagugagugucuuaacuucucugagucucaguuucugucucuggaaaaugggcaucacaguucuuacuugucaggguauaagguuuaaugacaugaugcauauaaacugcuuugcacauuauaauuaucaacagcuaacguuuguuuucuuucuuucuuucuuuuucuuuuuucuuuuuuuuaggcagggucucacucugucacacaagcuggagugcagugguguaaugacagccccaccuaauuuuuuaauuauuuggagagauggcguuucaccauguuggccaggcaggucucaaacuccugggcucaagcgauccaccugccucggccucccaaaggucuaguauuacaggugugagccauggcacccggccuagcaaauauuucuugagugccaaauauguaccaagcucucugucaagcacauuacuggaugaacucauugacuucgcacuaccacccuauggggucaauuucuuuucucauccccauuuuacagacagggaagccaaggcccagagagguucagcaacuugcccaaagucacacagcccccauggagggagaugacaccaccaugagaccuggggaggagugggggcagaugguggguacgaggagggggugaggcugucaccaugccugcucucugaccugcagugacagacaggaagaggaaccucuaccaggacagagaggagauggguacagacaguuggucuccccaugccugcucccacuucucuuuucccugggacggcugugacccucccacuggaacucuucagcccuagcccaugugcagcaggaagugagaccuggaaagggaagaggacacacuucugcuuuccuggggacacuuggugauguggguagagugcaacuuaugccugaccuggcauuugaggucucccaaauccagcuggccucugggauugaaucucagcuucggcuuucuagccccggggaggggaggaggaugggaggaacugaggcccagagagggggccccucucugggccucaguuccucaccuugaaaacgggaagauuaauagccacuguuuuuuguuuuuuuuuuucucagacagagucuuacucugucacccaagcuggagagcagagguucaauccugccucacuguagccuugacugccaggcucaggugauugucccacuucagccucccgaguaucugggacuacaggugugugccaccacacugagcuaauuuuuuugaauuuuuuguacagaccugccucagccccccgaagugcugggauuacaggcgugagcuaucaugcccagccaauagccacuauuuucuagguuuaaaacgacaagcagaugggguugugcucagagcauguaaguauaagacaauuccuguuuaaucaagcacugacucuaaacauuuucucagggcccagcgcggugccucacgccuguaaucccagcacuuugggaggccgaggugggcgggucacuugaggucaagaguucgagaccagccugaccaacauggugaaacccugucucuacuaaaaauacaaaaauuagcugggcgugguggugggcgccuguaauaccagcuacucaggaggcugaggcaagagaauugcuugaaccuaggaggcggagguugcaauaagccgugaucacgccacagcacuccagucuggguaacagagcgagacucugucucaaaaaaaaaagaaaagaaaaaacaaaaaacaguuucuaaggagguuaggagcaugacauggguuugaugugaccuuggacaaucugguuaaccacucugagccuuaguuucuucaucuggaaaauggguguauccauagacccuccuucacaaacacacgagcaggugugcguuaaugcaagacccggugcacagcggacacucaguagaaauuggucauucuucauuacugucaucuaccaucauaggcacuguccaccccccaucuccaacuuucuaaucucagagaacuucagaccagaauuaggccuuauauuuacagaucugugaguuuuguuuugguuuugguuuucuucuuucuuucuuucuuuuuuuuuuuuucuugagacggaaguucgcucguguuacccaagcuggagugcaauggcacgaucucggcucacugcaaccucugccuccaggguucaagggauucuccugccucagccuccugaguagcugggauuacaggugugugccaccacacccggcuaauuuuuuguauuuuuaguagaaaugggguuucaccauguuagccaggcuggucucgaacuccugaccucaggugauccaccagccuuggccucccaaagugcugggguuacagguguaagccaccacaccuggccugguuuugguuuucuuauucuaggagcaacuugagggcagaggcugggucuagcucaucuggguuguaauauauccuucuagcgaauauucccuacucuaugucugguccugugcugggcaagaaugaggagccaguggugacugggacagcuccagcccugcccugucagagcucacauuccaguaggggacagacccauccccagacagugaccacacagaguggccagggcugggaugggagaaguggaggguucuggguauccaguggugacagaaauggcuccagacucugcugucucagggcucccacucuggcuagaguuaacaucacuaauacugaaaauaauuaaaacagcugaucauuuucauuuuguuaaauuuuuuuuguuguuguuucuuuuuuuuuuuugagacagagucucgcucugucacccaggcuggagagcaguggcacgaucuuggcucacugcaaccuccgccucccagguucaagcaauucuccugccucagccuccccaguagcugggacuacaagugcgucccaccaggcccaguuaauuuuuguauuuuuaguagaaaugugguuucacuauguuggccaggcuggucucgaacuccugaccucaagugauccgcccaccucggccucccaaagugcugggauuacaggugugagccaccgcgccuggccaauuuuguuaaauuuguuuccuauguucuauauaccauuuuaaguugguaauuugcauucacucauugaauuuucacacuaagcauaccagguaggcacuaccauuauguccauuuuguagacaagagagcugagccccggacagauuaagccaccuacccaaggucacacagccagaaggugguggagcuaggauucgaacccaggacaucuggcuuaaccccccaggcucuacugcuucucaacaguggccgagaagugguggguucccagggagaggauggggguuguggauguggguggaaggaggccugagacugaaaugaaccaaguuugggagucucaccugcagggugcagugggucaggggguagaugccgcucaggccuggaguccaagccaccuccagcuccguggguuggcgggagaccagguggagguuacggggcugcugggggagcacuguggacaaacgggagagauugacccuggggagccuuugcucaaagcucccuacccugcucucugcccccacucugaccccggacccaaaccccacccucugacgcccagcuccccaccucccaacucugucaccugugaugguggcugugcgggauguggugacccccuuggcguuaugggcuucgcaggagaaagaggaugucuuguucagcccuagggagucauaugagggaaggguccaauaucagagaggggcaggaagggcuccggggccaugccgggccacuccuaccauggccugccugaccaggggcagugcagcccacacaggcacuugccugaagggaggguuagcagaguugagggcaaugaguuaggaacacagccuccauccccaaacacaaggauggcuugguuucagcccuaaccucccgccacacagacacacauaguacagacacacacagacacacacaggcacaggcacaggcacacacacugucucacacacacauucuuacaccccagagacagacacacucauacacacacauagacacacauacucacacagaaacacacaaagacacacacagccacacacaggcacaggcacacacacucauacacacagacacacagacacagacacacacaaagacacacagccacacacaggcacaggcauacacacacaaaaacacacauacacaaacacacaugaagacacacaaccacacacagucacaggcacacucacucuuacaccccagauagagacacacacucauacacacacauagacacauaugcucagacacacacacaggcacaggcgcauacacacacacacacacauucuuacaccccagagagagauacauacucauacacacacaugcucacacagacucacacacagucacacacaggcacacacacacauucuuacaccccagagacacauacucauacacacacauauaaacacauaugcucacacacagacacagacacagacacagaaacagacacagccacacacacacacugugucucacacacacagauucguacaccuagauacucacauacucauauacacauauauagacacacacagaaauacacgugcucauauauauggacauagacacauauauacauacucacacauagacacacaaaagcauacacagacacacacacacaaggagacacacaaacaugcacacacucacaugcacaaacacaggcacccucacuaacucacaaggacacaaguaugagcacacacaccugcuagacacacuuagggaaacuggcccauggcuguacaucaauggagacaugucuguucaucucuaagcucgccuccuaccaaccccucucccacucucccugucacacgcucuucuccggccacacuggccuccagugucucuggaacacauacaugaagcauguuuccacuccaagaacugugcacuguucccugugcucaaaacagucuuccacaaaugucuacaugacucgcacccucuucuuucauuuuuguuccucaacaacaccucucaguccgcuaggccuggccacccuguuaauauuggagcuuggccaggcauagugacucaugacuguaaucccagcacuuugggaggcugagucaggaggaucgcuugaggccaggaguuagagaccagccugggcaacguggugagaccccaucucuacaaaaaagagaaaaauuagcugggugugguggugcacaccuguagucccagcuacuugggaggcugaggugggaggacuaccugugcccggggagguggaggcugcagugagcugugaucacaccacugcacuccaaccugggugacagagugagacccugucucaaaaaaacuaaaaauaauaaaaugaaaaauaaaggcugggcacggugguucaugcccguaaucccagccuuaggaggccgagguggguggaucaccugagguccgaaguucgagaccagccuggccaacauagugaaaccucgucucuacuaaaaauacaaaaaauuagcugggcauaguggcaggccccuuuaaucccagcuacucaggaggcugaggcaggagaauagcuugaacccgggaggcagaggcugcagugagcugagaucacgccauugcacuccagccugggcaacaagagugaaacucugucucaaaaaaaaaagaaagaaaagaaaagacaaagaaagaaagaaaaaauacaauaaaauuggagcuaauuggagcuuccucuccaaaucuauccccuucccgcuuuacuuuuccucuuugguucuucucaucacccaacauacuuuaccuguuacccaaguaccuugcccauugucaguuucucccacuagaaugucagcucuaggagggcagggguugugucuguuucguccccugcugugucaggauggccuggcacacaauaggugugccauaaaugcuuguugaaugagugagugaaauuguguucagcuauguacuuaugagcauuccugggcauagguguagaaauaugagcauguguaauuccauaggggaguucacguauugugucuugacuguuuuuuucuuuuguuuuuugagagucuugcucuguugcccaggcuaaagugcaguggcaugaucuuggcucacugcaaccucugccuccuggguucaagccauucuccugccucagccuucugaguagcugggauuacaggagcgcgccaccaugcccggcuaauuuuuguaauuuuuaguagagauaggguuucaccauguuggccaggcuggucucgaacuccugaccucaagugaucugcccaucucagccucccaaagugcugggaucacaggugugagccaccgugcccggccuugaguaacuguuuucgagugaagguggauugccuucccucccuaacguggugguguugguguugguaugaccagcgugcacacacagaagcacguacaauuacagagacaaacacgagagacacagaccugcaagcacacagagauacccaacacaaaccgcuauacaacguacaucagucccccuuuauccgagguuucacuuuuugagguuucaguuacacuuggucuaaaaauauuucaauggaaaauuccagauauaacuccuaaguuuuaaauugcaugccguucugaguacugugaugaaaccucaugccaucccacucugguuggccuagaacgugaauccccccuuuguccagcaucucagugcuguaucugauaccugucuguaagucacuuagcuaucagaucaacuguccugguacugcagugcucaagugcagaguucaagaaacucuuauuuaucuaaauaaucgccuggccgggugcuauggcucacaucuguaaucccagcacuuugggaggccgaggcggguggaucacuugagauuaggaguuuaagacaagccugggcaacacagugaaacccccgucucuacuaaaaauacaaaaaaaucagccgggcaugguggcgcgugccuguaaucccagcuacucgggaggcugaggcacgauaacugcuagaacccgggcugcggagguugcagugagccaaggucgccacacugcacuccagccugggcgacagagagagacucugucuaaaaaaaaaaaaaaaaggccccagggugcaaaauagugauggcugcaauucggauaggccaaagagaagccuuaaagugcuuccuuuuaagugaaaaggugaaaauucuccacuuagaaaaagauaaucauauauauauguacugagguugcuaagaucuauaguaagaaaacaaucuaucugcgaaauugugaaggaaaaagaaaguuauguguaguauauacaggguuuaguauuauucauuguuucaggcuuuugugggggcucuuagagaacguauccuggugaauaaggggaaucccccaacacagauacacguagaaacauagacaccccccucccccagcacacacacacaaugucugcgcuaggauguaagaaggaccaaguuuuucguuuuguuuuuugagacagguucuugcucuaucucccaggcugcaguacaguggcacaaucacggcucacugcugccuugaccuccagggcucaagcgauccuccugucucauccucccaagcagcugggacuacaggcggccaccacacuuggcuaacuuuucaauuuuuuuuuguagagaagaggagagucucaccacguugcccaggcugcucucaaacuucuggccccaagcgauccucccgccucggccucccaaagugcuggaucgcaggcagagccacucggugcccggcccugggaccaagucuuguaagugcgacugcaguucugcguguuguuuacgcgugugcuugugcaucuguguuuguguuucugagcugguauguuugugacccugcguguaucuguggaugguguguacgugcauguguugaguaucuguguacgugucucucguguuugcuccgugcguguacgccucuguucccaccgcguuggcaagggaggcucuccauccgcagacacaaaguuuccuuuucuccgucagcggagggaguggaauggugcaaagucugcagaggccggaaaggggaggguaggggagcuccucagucgcggcuuccuagguggccguucccagacaaggucaggugcccgcucccgcagccuccgcgcccugaaggccccgcgcccgcagcccccgcgccgcccggaggagaaacaguacagucccgggcgggcggcccgagugggggcggggagccugggucggguccagccaccuggcacguggggccccgccagggucagcgcgcgggagcuggcgccgccggccggagaagcccuggggcuggagguggguucuggagccgggucccguuccgaccgcagcauuccugcccccgcgugagucaccgggggcaccuccccaccccagcgcuuccggccggcuucgggggcgcggagccagagccgggaucccccuucccaggccccaacggccgcaccuugagugaaggggacaggaggaacugggaccccuuccccuccagaagguucuugcuuuaccgcaagacgacaggagcaggccgauuccagaugugcuuuccagauguccugaccauccccccacaaccccugcucuccgccccagcuuuuccagagaaugagagggauggaaggaggaggggcacgcccugagucagauagagggacagacgcacacaaacggacgaaauuccuucacacagcaaacccccccacacacacacucacaaugaaucacacuuaaacacacaggggcuguuauuagcacagaagacgcagcgcuugguaaguuaacggcacacagauaugcaagggcugaugucacaaacacagugacacaaaaacaccgugacucacacauauacacgcgggcugacacugauguacauucauaaagagacauguaugcauacaagccaacgugggacaaacacauaaacacacagucacacauguacacauugauuacaaacaccuagcgacgcaauguacaucuaggcugaugccaacacacacagaaacuuaaaugucccuguauauucagagacacacaccacguaacagcguacauggaguugagguggacagauagauacacaccaggacacaaugaagggucauuuugaccugcucagacacagacacaccgacgcguacaccucacagccaagccuccaucuacgccauaagauggagcuggaugcgcccagguuucauguucacccagacacagacugauacaaaaacacauuugcgcugggugcgguggcucacgccuguaaucccaguacuuugggaggccgaggccgguggaucacuugaggucaggaguuugagaccagccuggccaacaugacaaaccugucaugaaacccugucuuuacuaaaaauacaaaaauaagccaggcgugccuguaaucgcagcuccucaggaggcugaggcaggagaaucccuugaaccccggaggcggaaguuacaguaagccaagaucgugccacugcacuccagcuugggugacagagugagacuccgucucaaaacaaaaaccccaaaaaacaaaaaaacacaguuucguagaugcgcaggccugaugcagacacacaaggauggagacacugccauggacacauagauugacacagagacacaucuauacgcugacugguaagcauccuuaggucauguacucagaggcagcaggggccagugcacacacagggagaccagagagaagcagagggugcuguuacacacacacacacacacacaggucugugacuacagucauacaccaacaugcuuacccugugacauauacacacacgccacagagacaucuauggacacacacagaaagcugguaagaggcugaggguugagagcaguggcucacgccuguaaaucccaacacuuugggaggccgaggcgggaggaucacuugaggccaggaguucaagagcagccugggcaacauggcgagacucugucucuaccaaaaaauucaaaaacuaucuggguaugguggcacaugccuauagucccagcugcuugaggggugggagggugcugagguaggaggauugcuugagcccaggagguggaggcuacagugagccaugaucacaguacugcacuccagccuggguuacacagcgggagcuuaucuugaaaaaaaauaagggggaaaaaaggugguaagaaacacaaguuauccauggacacguucugauucugcaagggaacacaagcucucacuaggacacucucacacccauagcugcacaccugugggcugacacuaccaccuccauacagagaggugugcaccauagccccaaacccacuacccuccaggcacacuuuacuuucauacagugagucccagcugugaacacacaaacacaaaaaagagggacagacacaggcugacacugguacacuccaucaugcgcacacacacagacacccacacacgggcaaccccuaagaaacguagagagagagacaugcuauaaagauccaaacacauauugggacagaauccaagcugaaggaaauauauuuagucacacacacacacacacacaccacacaugggacauccacagaaguccacccucgccaaggcacacccucacacagagguugugcugacggauacacuaacacucagauccagaacacacagauauccagacaccccaccaccaccacacagacaugcacagauccucacaccugugcagcccccauuucucucccuccccuccccuucucaugggaccugccaggcugacucaugcccgauccccaacccuggucccuacucagccacucgagccaugggccugagucacuccucuggggucagcaugcucaccaggucuuccuugcaacucagggucccaggaaugcugagaaugugagcuccucccuccacccuggagacccccagucagaaggccccuccucauuccagcagagagaggcagcagguugggagugcgggaagcugaugcccuccaggcugcagccuccuuccuuuacagagccucugccaucugcuccucugucuuuccuccuucaguagggagaacccccugaauccagggucccccagugaugccccugaccacugcauaacccugagcucgguccuuccucgucugcauggugcagaagggaaugguccccaagaaggagaggguuucugucacuccaacuucccuguccugucuuucauuuuguuuuguuuuucguuuugagacagagucuugcucugucacccaggcuggagugcaguggugugaucucggcucacugcaaccuccaucucccggguucaagcgauucuccugccucagccucccaaguagcugggacuacagaugcccgucaccacgccuggcuaauuuuuguauuuuugguaaagauggaguuuugucauguuggccaggcuggucucgaacucccagccucaagugauccaccugccucagccucccaaagugcugggauuacaggcgugagccaccaugcccggccucucuguccugucuauguucaucuugggucacuguggccugucccuuccaguguaugucauucuaucucucucugucucccacuuucuuuuuuuuuuuuuuucuuuugagauggagucucgcccugucgcccaggcuggagugcaguggcgcaaucucggcucacugcaagcuccgccucucggguuccugccauucuccugccucagccucccgaguagcugggacuacaggcgcccgccaccacgcccggcuaauuuuuuguauuuuuaguagagaugggguuucaccguguuagccaggauggucuugaucuccugaccucgugauccgcccgccucagccucccaaagugcugggauuacaggcgugagccaccacgcccagccucugucuccuacuuucuuccugcucucucuucuuuggguuccaucuccccaguggggaccgggcuggacauccucccuuugacugaggccagcaggcuuguuagggcaggaggugggccgguuguggagggaggcggaggagaggagggcacgguugauuccggugcccugcuugggucaagggcugacaaaggggcaccaggcccacacgcacucgagccauggaacagcucagaggaaacccaggacaaagaauucuauucagagagaggccggggugaauggagggagagagaagcagagagacagagagagagacacauacaaagagagacagaaagacacacacaccaagagacagaaagagacagaaaaaggcauacggagagaaauaagauagguagagacagagaggcagagacagacucagagggagaaacgagagagacagacagugagggacagaaggacagucagacacucacgcagagguagcaauguucccuugcuccugacuucagcccugcccggcccccuauucggagcugacccacauccccggacucaccuggaacaugcaggcugcgcugggggccgugaccuggagccguggccagggggacagcauccuggagccagaguagguccacgggcucugggggucccugagcuuggcagcucagguugaaggggguguuggcggccacaguccugucuucgggcuccuccaggaaguaaggcaagccuagcggggugggcagugguagaggcuggggucccucugaggccccaagaugccugacucaccacuaggaugcuguaggcuuugggcagcaaacccacccugcagggucauugacuugccuuaucugauccccgagggcaccugagccauacccaacacacacgugaccccaauaucugauuccucccaugucagaccccccacgauagcugagcuccucaugucucucuuccagaaugucugacagcucauccucaucucauucuauggaugagaaaaaagagaccgcuggggucguggggacagggguacguugcgugccucugacgccuuaucugaagaccagaauggccuccugugaccugauggugucugaugccuaggacauccaacuacccccaagaagucuuuucacccagaacauauaaucccccagccuuggcaccauaacuuauauggacucccagcuucuugaccacccaaaacucugacauucuuaggcuguaugacgcuagguucauccugaauccuccagcacccuuugaccuugaccccucaggauuccugacuucccacaaccuaugagcgccacauguccucugaccccucaggaccccugaccccagagcucacccuccagcccaacauagccaggcugggacacgaaggucugaugucccagaaacaccaaacacugguacugucccgugucggaaagcugcagggaggugauucugacagggcaagaggagagacagagagguucagggucagagcuggacacugggagggggucugucagaacggaaagaggguguccagucuggaagcucaugacaaccacgaaguauguccuauuauuaacucauuuugcagaagaggaaaacgaaaccuagagguuccaucacaugcucaaagccgcacggcugacaaguggucaaacugggguucccacccaggugggcuuucugcccucugugugacggaggugggagugggauucggggauguggccacacaccugagcuggcugaccacuauccagucauccuguucauccucacccaggggcaccugggucugggugcuguccgcgagcuccaggaucuguccaucccgaagccaauguaccucggggggcucucccugaaccuggagcugacaccgaagggugcccgugaguccccgggcaccugugauauucccuggguugcccacgaagggacuuucuucagccugcgugccuggaggggagaugggaagaguuagcuuaggaaccccccagcuccuuccggcccucaguuccacccuguccuugccugcccaccggcggccaggaccccgccaggcccuuaggccgacauaguugcagagugaccucagagugggguggagggcggaggcucugagaggaggacgggagcccucccaagggacugggaucuagcguccaucccgucgggaaggaggcucgggaucuggcagccucccacgcccugcacugccuggcagggccagccccugcccccuccguccucucuuaggucucuagagacuuaacaggucgcgcuggugcugguggauggaggggaagaaucagggguugggggagagagauaaggguggugguggggggagauaagggugguggcggagggagaagccagagaaaggcaggggagaugagacagagaggagcacagauacaaggcaagacagaaaaaaugaagaaacagcccucaagagagaagaaaaggugggggcggaggggggauacagucacagagggaggcugagaagagagagagagacucagagagcagggagagauaaaggcagagacugugaaagagagagaaacagagacccacagagauagcagagcuggaggcagagacagagagacaaagugagagccuccuccccagagauggaguggacuggugggguagggacaaguggcgggucaggggggugguguuggcagggagaagcguuuucccccagggcuccagagcccuccucaucccacugccugacucggugccccuucggaaagauuucuuccuuccuggcgacccucagcucagccccucuccccauggcccccuucucagguccagcccccaccccugcccucagcuucuccuugucugucugucucuccggguccucucuucuguccccccugcccuucaguuccucucucagucuuucucucccucugccgcacuuggugucucugagucugugucucccucccuugaagucccuuuucuguggucccaaggaaacucccuaagccagcccaggccccccacaccugccaucaucccccaccuccuaccccugccccagccccuccgaggggaucccugccccaaggagcccccaucacucaccccugggggccaugcacgcccagccgcacagcgccaagcaccaggccagcgggacccugcccauccuggggcaccgccacgccaugggugccaaacuuuccucagaaguuguugggcucccagc

SEQ ID NO: 21243 - RNA, 4813 nt, Homo sapiens
cgguggcgacaugagcagcggggcggcguccgggacagggcgggggcggccccggggcgggggaccugggcccggggaccccccgcccagcgagacacacaagcugguggucgugggcggcggcggcgugggcaagagcgcgcugaccauccaguucauccagguagugggcccucacccgggagggugucccccgggacccagaacugagcccuuggggggauccccgagaccccuuuucccccuugacccaucacugagacccuccuauaaggcccucuaaucuuaaaagauccccacagauuguaaccuaaacucuuggagagccuccauccccugcacgggggacccuuccuucugcacucgcaucccgagacccacuauucccucucccagugccuaagaccccgcuuaccugcugaccuggcuuugagcaccuccugggagcaugcuaaauacaaaauacucaccccauucggacccuaagcacucccaggacccccaccacgcccuuggugccaccuuccaccacccugagcccuaucucccccaaaucccaguccccaacuuccccucuaagccauugagagccuuccugggagaaugccagugcccagcaccuuugagauuccaccacguucgauucuuuuuuuucuuuuuuuuuuuuuuugagacagagucucacucacucugucacccaggcuggagugcgguggagugcaguggugcgauguuggcucacugcaaccucugccuccuggauucaagcaauucuccugccucagccucccaaguagcugagacuacaggcgagugccaccaugccuggcuaauuuuuguauuuuuuaguagagacgggguuucaccauauuggacuggucucgaacuccugaccucgugaucggccugccuuggacucccaaagugcugggauuacaggcaugagccaccgugcccggccccacguuugauucuuagccccuuccaugacugcccccagaaucuagaaauucuacccagacccuggcccugagacucuucugggacuacccaguccuaagagaguccugcucuccgacccgagauuuaaaaagacauccugccccuuggccauuccagaaaucuccaagaccccaaguccugacaaucccccauucccggaggcccaaaccuccacucucccaccccacccccaaggaaaaccagccccuccuccaucccaugcuuucuccgcugcaacucccugagccccucucagaaacccugaauagcucucaaaucaucuccauggaagaagcccccagauucuuggcacccccagaaagaucuauuccuugggaguuucucugaccccauaaaugaacucaauguuucuaagacuguauauacuauaaccucccaaaaccccugagccaccuccgggcuggcucccaguucucagcccugagcuucucacgcugugcucugaggucacgccccuaacuacccccagagccacaaucccucccagggcuugauccuuacagccucccuccaggacaagccccucaccaagcaccccucuaaccgacagaugcagccuucagaccccuagccuccacaucacccccuuuccugaaauuccaccccagcccaggaaaccuccuccccauuccugagggagguccucccagcuucaaagaaauccuagaaaagugucuuggccugacaugcuaccgcagaggccccggggccccaggacaccccccucacccccaccaagagaccccuucaagggccugggaggaagcccugcuuguguagagaaaggccccagcccugggccccuugcacccagaggcagucccagagcuggccaaaggcuuggcuggcagcgggcaggacccaggcaggaagggaggggcuggggcccgaggguggggcagccucuccgcagccggauuggaaccgggaccuuccccugggaggagacgcuggaggccgccugagcaggagaaggagacgggggaggaggagacgggggaggaggaagagagggaggaagcagaagaggagggagagauauaaacaggcagucuggacaacaacgccuccgauaacugauacauucaauauuuaaugggguuuugcuccgaaucuugccagugcuggauggaguguagugcuguucuuagccuccuuuuucaaaugaggaaacugaggcucagagaggggaagugauuuguucagugucacacagcuaggauguaaucacgaugugggacauguaccuuauaccagaaagagaggaccaggagugacucagagagaagaagacugguaggagggguggggggcagggaaaggggggcaggggagcagcuacccaaagagaaggggacagagacccagagagagagaguaauagagacucagagagacagaggggacagagacccagagaaaagggggcagagacccagcaacaaggacagacaucuggagagagagagaaggacagggcagggcgcaguggcucacaucuguaaucccagcacuuugggagacccaggcgggcggaucaccugaggucaggaguucgagaccagccugaccaacacagccugaccaacacaucucuacuaaaaauacaaaauuagccaggugugguggcgcaugccuguaaucccagcuacuugggaggcugaggcaggagaaucucuugaacccaggaggcggagguugcagugagccgagaucucgccauugcacuccagccugugcaacaagagcgaaacuccgucucaaaaaaaaaaaaaaaaaaaaaagacucagagagacagacgggacagagacccagagaaaagggggcagagacccagcaacagggacagacauuuagagagagagggacagagacugagagaggcaucccaagggcagggcuucguccugucugccggggcacugcaguaacuauccucuccccaccccgccaguccuacuucgugucugacuacgaccccacuauugaggacuccuacacgaagaucugcaguguggauggcaucccagcccggcuggacagugagggcggcaaggauggaugauggauggggguggugucagugggggcugagggcucuugggggugacugcggggagccugguccccacgauggccccucucccugucucugcaguccuggacaccgcgggccaggaagaguucggggccaugagagagcaguacaugcgugcuggccacggcuuccugcugguguucgccauuaacgaccggcagaggugacagggguugcugguggcggagcaguggguggguguggggaggaccugggcucugcagcuggcuggaccucaugccuccggcuucacucgcaguuucaacgaggugggcaagcucuucacgcagauucugcgggucaaggaccgcgacgacuuccccguuguguuggucgggaacaaggcagaucuggagucacagcgccagguucgggacaccccucuuucuggggaccccaucucagucugggaggcuccuuccagcacaccugucccccaucagcauccuccucuguuccugcagugcugcgacugccacugucacacagcucaccuagauggguuacccccaaacuggaccuucaggguccccggcaucaccgagcagagggccuagcaugcaaguguccucaggagaggcugcuggacggaacaaaggacauucaccccccguccgccagcucucuuugccccuuccucgcauuccucccuuccagccaaccucccaccagccccagcaccuccccugcucauggccggcccccuccauggcuccccaguuccuccccaggugccagaugccccgcacaguugcgccccuccuuucccugcucccaucacuucccccacaacgauuuccacacagaacucauccaucuggcaaaggcucuggggauuuccaggcuuugggguuccgccugccucugccgggaacacccugacuucccugccugcccacuccugguuaucuaaggcauagcagggcaagugcccacgaagccugcccccaucccuuacuuagaagacaccaagccccugcggcaucucccuccauaaucucucaggagcucuuccucuuugaguucucacagugggucaccucuccuagaguauccagccugccugucugucucucuggcugcggucacccugagugcagggaccugacucccccguguccccccuacccccaggucccccgaucagaagccucugccuucggcgccucccaccacguggccuacuuugaggccucggccaaacugcgucucaacguggacgaggcuuuugagcagcuggugcgggcuguccggugagccaaguccccuuccugucguccuuguccccagcccuuccacuccaaacucacuggcguuuucccacaggaaauaccaggaacaagagcucccaccgagcccucccagugcccccaggaagaagggcgggggcugccccugcguccuccuguagcccaggcaagagagaagcaaccaccacaagcucucgggacuagcugccuucgcaccuugcugugugaccugaggcccucacugagccucaauuuccucaucugggucucccaggacacaucacauacccacccuuacuuccuggccucuucugggcuacugccacugugugccuucugccaacgccuccuguccccaccuaagccuggugggggugaggggcuccgggucacugcuguauauaacuccccucccccagaaaaauaaaugucacugccaac

SEQ ID NO: 21244 - RNA, 10802 nt, Homo sapiens
aacugcuagaacgaaccauucgcauauggagggggugacccaccaucucagaacauuaaaaaagggaaagaauccccuggugaacuacagugaaagucuuauugagcauuuaaauggaaauaaaaauauucaguggaccuaaugaagaguagaugacuuucccuucuguccccuccccgacaggcacucaugguaccggcgccggcgcagcugugacugucgcugcagacggaaacugacuggggucaauucaagucaugcaggcugugagaaacgcggggucgcgguuccugcgguccuggacuuggccccagacagccggguaacaaaugacugcccccucgagcccaccgccaccuccaggacuaugcuccuacucgugucccuugagccacccgggccccagugaccguuaggccguggcccucaccgagcuuuucuucccagcagggucguggccagaacgccggccgggaccaucugcacaggcgcucgacagcuccaagacgcugcggccaagcagaaaguugaacagaacgcggcucccagccacaccaaguucaggugagccccacuuggaccagcccucuggagacccgcaaccccugacucuugcccgacacccuccagagucagaaccagugaauuuucagcuaugucacuugcuauccgugggaccuuaugcaaauaaaucugagccucagccuucucaucuaaaaaugcggauaaugcugagagagguugugagaaucagaugagccgugguacagaguaaauguucagugaacauucguuaaaucaaugagugaaugugagauauccauaacauguaucagcguucuuuucuucugagauggagaucuuuucagaccaauaaccuucccugccuccaaaacaaaauggggagguagagggcgcuagcgauggaacagauguuccugcacgucuuacggaugguccaggguggguuuugugcucagcccuaggaacuggcaucuugcuucccaccagugccaccaccucuguaugcuguauacacauccacuuaacuucacauccauuuaacaaacauuuaccaagaaucuacuaugagugagacaccaugcuaggugccgugaauacagauacaaaagaucauuccuccccacaaguaguucacagucuuugagggaagacaaacaugcaaacauuuuaaccauaaucugcucaauaauauaauggagguaagcauugguuggaaguaugaaaucauaagugucuaacuccuggccgggugcaguagcucaugccuuuaaucccagcacuuuaggcggccaaggugggcgaauuacuugaggucaggagaucgagaccagccuggccaacauggcgaaaccccgucuccacuaaaagcacaaaaacuagccaggcgugaugucuggcaccuguaaucccagccacucaggaggcugaaguagaagaaucgcaugaacccagggagcggagguugcagugagccaagaucacgccacuguacuccagccugggugacagauugagacucugucucaaagaaaaaaaaaaaaaaaaagaauaagugucucauuccugaggaaaucaggcaagaccauggagaaaagaacauggagcucagaagugaaugggaguucaucuggacaaguugaagugggucauuggagacaaagguaaccaucuguguaaaggcaugugguaugaaaaaacaugguguguucagguguguaugugauggcagaugaggccaacaagacaagaaggcaucagaaugccaggggucuugucugucacacuggagcuuuuacgcuguccccacugaaggcagugaggagcugcugaaagcaucuaaaccaagauucuguuguagucauuucuucaacaaugccaggcacuguucagaguguuggggauauaucccugaccaaacagacaaaaagcccugcccucauagaacuuaaauuccaguggguagaagacaguaaauagaaaacaaguaaaauguaggaguauaacgguuggaaaggggaagugggggucaagcaggccugcauagccacauucuguaggacuuuguaggccguugugaggacuucagcuuuuacugugaaugaaaugggaggccaauggaaauugcugaauaaaggguugacaugaucuugcugacaagaucuuguaagcucuuuggcugcuguguugauauuaaaccauuggagagcaagaauggaagcugggaaaaguccucuaagcaguuagaagacuauugaaauaauccagacaagaaacaaugguggcuuggaccaugguuauugccauggagguauuaugaauggucugacauauuuugaagguagaacaagcaggauuuguuaauauacagugugagaaaaaggagcgaaggaagaccccaaauuuuguuggccuaaacaacuggaaagacggaguugucauugauuaagauggggaagacugcaggaguuuggaugggaguuguuaagguugagauucuuaauaaacauucaaguggagacacaauguagaccauuagaaauggagcucaagggccgggcgcgguggcucacaccuguaaucccagcacuuugggaggccgaggcaggcggaucaccgggucaggcauuuuagaccaaccugaccaacauggugaaaccccgucucuacuaaaaauacaaaaauuagccaggugugguggcgugggucuauaaucccagcuacccaggacgcugaggcaggagaaucacuugaaccccggagacggagguugcagugagccaagaucgugccacugcaguccagccuggacgagacuccaucucaaaaaaacaaacaagcaaaaaaagaaauggaguucaagagucagacuucagacuuuagcuagagauauacaguugggagacaucauagagaugauauuuaaaaccaugagaugacaaaaucauuaauaccauaaauguagaugaagagaagagguccaaggacugaacccuggggcgcuuucacauuuagagauuugggagacuaggaagaaccaucagaagagacaaggaacuuccagagagguaauaggaaaaccaggagagaacauuuguuuuuuaauuuggcucaagguggggagaucagcugugucaaaugcugcugaugugauagguugcuagaucaauaacagaauugccuauuauauuuaguaauguggaguuaguuggauuaaagcauuuuugguggagugguagaggcuaauaucugauugaaauggguucaaggagaauagaagcagaggauaggaagaaacagcaaguauagucaguaccuuaaaguuccuuaagagggcucugcuauaagggaauagagaaauggacaauagcucccaggagguggguucaagagguuuucgaggguuguucuguuauuuuuucaguuuggaacauaacaauauguuuugccauugggagcagugcaguauagaggggaaaaaacaagugauacuggagugggaacauugcgggaacaguguccuucaggggcuaauacacaaguggagcacuguaacaggagagagcgcaaaggcugugggcacagauguucaguagugggagcugggagaaagucugauugcuucuauuccccuguggaggucauccgcucagcaaugaggaagcagggaguuggagguuagaggagacaaaagaagcuauaaaagagucaucuaggagaauggaaggauaauugaacaggguaugugcuguaugauugcgaggcaguucuaaucacuucuaaggucaaacccacaggaaagaauauaguuguaaacuuugaauaccaauguguuuuugauuugccuuuuaaaauaccucuagaaaagcagguagggcuggggcgagaguaguccuuagauuauaauauaauuucuaaaauggagucuauuguauuucaaguggcugugguggguacaaacaugaaucugauauauguguguaggccuagaggaacagcaaguuuauuuccagcuccauugcugaaggaugauuguguguguucaaauuuuaaaaagcacagcuuggugagcaaagcucuagacugagacagaucuacuagguccaaggcuuggcuucucuugcuaacccuauuucccuauugguaccuaauuuucaccaucugaaaauaaaaauccuuauuuuccuuaaggauuucuuaaggcauucuuaauuguauuaauaaguuaacuuauuagagaugauaaguuagaugauaacuuagcuagaaauagccagaagacagcuuggacuaagacaguggaagaucuugaacgcaacacaauguguucacaucugauucuauugggacauuugcaacauugauuuccauaccccauccagaaguccagggugaagcuuaaacaucuguaugcuucacagcugacugauguucagccugcauugaaaaccacuggucuaggguagagguuggcaaacuauggucgacugggcaaaucuggccaauugccuguuuuuguaaguaaaguuuuauuggaacacagccuauuaauuuacuguugucuguaccuguuguugggauauaguggaagaguuuaguaauugggacagagaccuguuggcccgcaaagcccaguauauuuacuaucuggcccuuuacagaaaaaguuugcuguccuuuauucuaggggauucuggguuuuuuuuaaugguaaugauaugaguauuauuuuugucucauuuuuugcaauguagaguccagauauugucuaugguugaugaaauaagaaacagagguuugacuguauuuuuuaaauugugggaagaggaaccuacaaaggaucugaaaauaaugaacacggguauaccugcagggacaaggaagauggggaguaugcaugaaaaucccuucucauagcggaaaguccccagaugugucugaagucagcaagucaagaaacagcaucauaagcacagcagucacacaugcggugguggcaccagaaggacugaaaaggaauggugggggcagccacuuaagaagcagcagggggcacagagcuguuauuuuuuaaccauguguuguauuucuuugauuuuuaaaaagucgagacaauuuuaaauaaaaucuuucuucuaauugcagcauuuacccucccauuccaggagaggagagcucucugaggugggcaggaaagaaauuugaggagaucccaauugcacacauuaaagcaucccacaacaaguaagugggaagggaaacacugggcaggucuagcgugagauucuuuccacuucacagggaaagucaggcuuggcccugaauaccccgggguagaagugagggugcuaagugcugcaugauggcgcuaauguagggcaccgucuuccuccucacuugaggaaccaccugccaucuuacacaaguuucauaaaaaugugaaauagggugggcauauccuaguuauaagaauucuuugcuuuccuugagaauaguguuuccugguuuugcucaagaguuggaaggaguguaugaggggcauauggucccaccaugaagguguuuauuaaguguugcugguagggaauggaugauauauaaauuaaaagauaugauucaagauauuaauaugauuuauuaauacacuaaccagaaucuagaccucuaaauagauauugucccuuuaaaguacucaccacucugggccacugugcacuggccuccaccuuguagagcuaaauguggauggugaguuuaaagugacaagacuaguguucuuguguggcuuacagacggggacagugccaagggaauucccaaacauaugcugccaacagaagcauugcugguauuagugacaacuuuacagguuggcccccacuuggaaaugagaucaguauuuggucacagccaacccacccagcaauuuagagaccagcacaagagacuacagucaugggcuaaaguguguggcacagaugaaaugcuauaggauucauuucagcauuugucagauaaauguaaagugacagcaauuggauuucuuuuucuuccccucagacuaauaaggacauaggcuaacugcauuuaagugucuauggucuacucuauacagcacuguuuaggcugucacagagacaagcaauuacgcaucuauucaauauggaaaacccuagaagcucugguagggggaaugucagagccauagccaggauaacaaguggauggcccaagcccggggcugacuccagcaggccuccccuucagucacuucuccugccuccuucugugagcucucagagcucuccagaccagaaauaggaugaugaugacuaaaggggaaaucaaagcauaucugaggauuucuuaaggcauucuuaauuguauuaauaaguaacuuauuagagaugauuaagaaaaaguuguggguggaugcaguggcucacaccuauaaucccagcacuuugggaggaucacuugaggccaggaauuuaagaccagccugggcaacauagugagacccagucucuaaagaaauacaaaaauuagccaggcgugguggcaugcaccuguagucccagcuacuugggaggcugaggugggaggauggcuugagcccaggaguuggaggcugcagugagcuaugauugugccacugcacuuccagccugggcaacagagugagacccugucucacaaaaaaauaaaaaagaaaaaaagagaaaaguuuuacuuguuuaaaauaauuuuugaucauggaauauagugucauaagcaucaaaaguauccaauaugaggccgggcgagguggcucaugccuguaaucccaacacuuugggaggccaaggcgggcagaucaccugaggucgggaguucaagaccggccugcccaacauggagaaaccccgucuuuacuaaaaauacaaaauuagccaggcaugguggugcacgccuguaaucccagcuacucugaaggcugaggcagaagaaucacuugaacccgggaggcggagguuacugugagccaagaucgugccauugcacuccagccugggcaacaagagcaaaacuccaucucaaaaaaaaaaaaguagccaauaugguaauauugcuaauauuuuuuuaagaguccuucuuuuagagcuauguacugaaauauuuacagacaaaaugauaggucugggauuugcuucaaaauaauccauuggugaggggaguggggugggaacaagguuuauagaugaaacugaauuggauaugaguugauaauuguugaagcugguugaugaguccaucagauuucuuauguuauucucuucacuuuuguguauauuuaaaacuuuccccaauacagucauuuucugggugauacuuaacuaacuacucucagauuauggagcgcucuuuaaauuaugugacuuaccaguuuucagucagguuuaggggagaauucugaccuuuccugauacuuccuguaggaguucaaaacauguucaucugagaagcucaaaguagaagcaacugaauuccuuuuucuuucucacccaggcuucuaggggcauagauuagcucucucuuauuucccugaagaagaguuguauccuaugugcuucuucuacuuuucucagcacacagauccagguagucucugcuaguaaugagccccuugccuuugcuuccuguggcacagagggauuucggaaugccaagaagggcacaggcaucgcagcacagacagcaggcauagccgcagcggcgguaaguguguguuccuucugcuuccuucuaguguguguuugcuuucugcauggcucaucacugaguggagaauccucauuauacuacccauucagaagcaaggguuugucauggcagcuuugaugcccugauuggagcauugguuugaaaagguuuagugaaaggcuccucuuuuuucuuucucucagcuucauuagaggugaagcccuuguugguucauucuaggauguaagagccaagauaccaaaggcuugagaaccaaagaccccucaauuuaaaaaccguuagccaggucugguggcaccugccuguaguuccagcuacuugggaggcugaggcuggauggcuugagcccaagaguuugaggcugcagugaacuaugaucucaccacugcacuaaagccugggcaacagagagagacccugucuccaaaauaaauuaaaaauaggccaggcgcgauggcucacaguuguaaucccagcacuuugggaggccaaggcaggcguaagagaucgagaccauccuggccaacauggugaaaccccaucucuacuaaaaauagaaaaauuagcugggcgugguggugcgcgccuguagucccagguacucgggaggcugaggcaggagaaucacuugaacccaggagguggagguugcagugacucgagaucacaccacugcacuccagccuggugacagagcgagacuccaucucaagaaaaaaaauaaaaauaaagaccagugguuugggguugggagagauaugauagucuauuuggagaggacauaguaucguggggacucaugcaauagcaauaccaguuccagugugaacugucguagaccuuuuuuagaagcaaauuggcaaggugcugcuauugguauaguuauugagcaucuacaugugccagacacuuuacauucauuaucuugaaucuucagagacccucaguauuauccacauuuucauaagccaauugagauucagagugugugacuugcccagagccaugcaccgauucaguucacugaucggaacccagauuggucugggaccaaagccugcacaauuucuacuauaguacaggccuuacaaauguucagacucugccaaaccagauguauuuccugaaggaaaaccuugaccuucaaacaagggaaggcaccccaaaauauugauugcauguacuaucaucagaaaucaaaaugcuguaaaugcccaaccauggacagaucauauacuaugaaaagaaguaugucacuguucacaguggcuucugcauggugagucaugaaugauuucuguauauuuucccauuuuuauaaugaacugccuuuauuaucaagaaaguaaauuuuaacucuaacugcuuagagauuuuaaaugauaauacuuuuaaaguggguauuuagguucagccuugaagccuaggguggcgccucauggucugaaauucugcauuugccccccugagaaaaaccugagcaauauuuagaaauuuccauuagguggcggugcuguccuaggcuaaacagaucacagucacgugaauucugcaaccugccaaauucuguggucucugcuggcgccuguccuccacuauagccaucugcccuuugccucccuguuuacuucucuggaugcccuuucccugagcucacacaccccuugcucuaggaggcaguagcaagagauuuggaugcaguaguucucucuccggggcacuaaccacucugcuucucuccagagagcuaaacaaaagggcgugauccacauccgaguuguggugaaaggccuggggccaggacgcuugguaaguuacagugauuuccauaguguacuugccuccuaguaagugugagaauuuggggcuugagagcagaguacagggagaguagaaaacaccuuuuaguggauuuccauguuugcuugaaguucccgucuguuguuucuauaauugaccaagccccucagagcaagccuagaucacuuaguauaauucaucagacacugagugccugcugcgugccacgcacugggaaugggaaggugguuccugggggaacugucacaaacaaaucccuuaggacagacuggugagcgcugugguaaagcaugugcccagaucgcugggagcccaucaggggaucccgaaccuagcagggauaaucuuuccugaugaucauuagcacagauaaucuuuagcuucuucaaagaggugacaucucucugacuuugcaggaauaaugagguaucagggagguggaggcacagcagguacggggggacauugcaggcagagaaaacugccugaguaagcuacagaaguaugauacccaaggugugccaaggucuacaagaagucuuuguucgcagaucguaaagugcaaaguggaaagugguggguacaguuugagaggggaacagugugaaaaccugguuaaaggguuuggguggagaccuuugugagaguagaauaggauugggauuauagguaucaaagccagugagcaucucaccccuccguucccuucucuacgccacccugucccucuccgaacccugccuggagacacuggaucaucauuucugggaccaugucauucuacuuuuccuucuguuccuuccagucugccaugcacggacugaucaugggcggccuggaagugaucucaaucacagacaacaccccaaucccacacaacggcugccgccccaggaaggcucggaagcugugaugggaaggaggccugcacuuggaccugaccucaagccucagcuccagugggaccuuguaaaaugcucccugucagagcucuccagaauaugcuuguuggagauccuucaggcaguaagggagaguuuugccuccuuacacaguggccuuugcuugcaccuccagcuggagaugggugugccccagaaguaagcuuugcaucucuuacaagaggggagcuacaggggcagccguggccuaggcccaaacucugcucugagaaaauaaauaucuguaccaccugu

SEQ ID NO: 21245 - RNA, 10802 nt, Homo sapiens
acaggugguacagauauuuauuuucucagagcagaguuugggccuaggccacggcugccccuguagcuccccucuuguaagagaugcaaagcuuacuucuggggcacacccaucuccagcuggaggugcaagcaaaggccacuguguaaggaggcaaaacucucccuuacugccugaaggaucuccaacaagcauauucuggagagcucugacagggagcauuuuacaaggucccacuggagcugaggcuugaggucagguccaagugcaggccuccuucccaucacagcuuccgagccuuccuggggcggcagccguugugugggauugggguguugucugugauugagaucacuuccaggccgcccaugaucaguccgugcauggcagacuggaaggaacagaaggaaaaguagaaugacauggucccagaaaugaugauccagugucuccaggcaggguucggagagggacaggguggcguagagaagggaacggaggggugagaugcucacuggcuuugauaccuauaaucccaauccuauucuacucucacaaaggucuccacccaaacccuuuaaccagguuuucacacuguuccccucucaaacuguacccaccacuuuccacuuugcacuuuacgaucugcgaacaaagacuucuuguagaccuuggcacaccuuggguaucauacuucuguagcuuacucaggcaguuuucucugccugcaauguccccccguaccugcugugccuccaccucccugauaccucauuauuccugcaaagucagagagaugucaccucuuugaagaagcuaaagauuaucugugcuaaugaucaucaggaaagauuaucccugcuagguucgggauccccugaugggcucccagcgaucugggcacaugcuuuaccacagcgcucaccagucuguccuaagggauuuguuugugacaguucccccaggaaccaccuucccauucccagugcguggcacgcagcaggcacucagugucugaugaauuauacuaagugaucuaggcuugcucugaggggcuuggucaauuauagaaacaacagacgggaacuucaagcaaacauggaaauccacuaaaagguguuuucuacucucccuguacucugcucucaagccccaaauucucacacuuacuaggaggcaaguacacuauggaaaucacuguaacuuaccaagcguccuggccccaggccuuucaccacaacucggauguggaucacgcccuuuuguuuagcucucuggagagaagcagagugguuagugccccggagagagaacuacugcauccaaaucucuugcuacugccuccuagagcaaggggugugugagcucagggaaagggcauccagagaaguaaacagggaggcaaagggcagauggcuauaguggaggacaggcgccagcagagaccacagaauuuggcagguugcagaauucacgugacugugaucuguuuagccuaggacagcaccgccaccuaauggaaauuucuaaauauugcucagguuuuucucaggggggcaaaugcagaauuucagaccaugaggcgccacccuaggcuucaaggcugaaccuaaauacccacuuuaaaaguauuaucauuuaaaaucucuaagcaguuagaguuaaaauuuacuuucuugauaauaaaggcaguucauuauaaaaaugggaaaauauacagaaaucauucaugacucaccaugcagaagccacugugaacagugacauacuucuuuucauaguauaugaucuguccaugguugggcauuuacagcauuuugauuucugaugauaguacaugcaaucaauauuuuggggugccuucccuuguuugaaggucaagguuuuccuucaggaaauacaucugguuuggcagagucugaacauuuguaaggccuguacuauaguagaaauugugcaggcuuuggucccagaccaaucuggguuccgaucagugaacugaaucggugcauggcucugggcaagucacacacucugaaucucaauuggcuuaugaaaauguggauaauacugagggucucugaagauucaagauaaugaauguaaagugucuggcacauguagaugcucaauaacuauaccaauagcagcaccuugccaauuugcuucuaaaaaaggucuacgacaguucacacuggaacugguauugcuauugcaugaguccccacgauacuauguccucuccaaauagacuaucauaucucucccaaccccaaaccacuggucuuuauuuuuauuuuuuuucuugagauggagucucgcucugucaccaggcuggagugcaguggugugaucucgagucacugcaaccuccaccuccuggguucaagugauucuccugccucagccucccgaguaccugggacuacaggcgcgcaccaccacgcccagcuaauuuuucuauuuuuaguagagaugggguuucaccauguuggccaggauggucucgaucucuuacgccugccuuggccucccaaagugcugggauuacaacugugagccaucgcgccuggccuauuuuuaauuuauuuuggagacagggucucucucuguugcccaggcuuuagugcaguggugagaucauaguucacugcagccucaaacucuugggcucaagccauccagccucagccucccaaguagcuggaacuacaggcaggugccaccagaccuggcuaacgguuuuuaaauugaggggucuuugguucucaagccuuugguaucuuggcucuuacauccuagaaugaaccaacaagggcuucaccucuaaugaagcugagagaaagaaaaaagaggagccuuucacuaaaccuuuucaaaccaaugcuccaaucagggcaucaaagcugccaugacaaacccuugcuucugaauggguaguauaaugaggauucuccacucagugaugagccaugcagaaagcaaacacacacuagaaggaagcagaaggaacacacacuuaccgccgcugcggcuaugccugcugucugugcugcgaugccugugcccuucuuggcauuccgaaaucccucugugccacaggaagcaaaggcaaggggcucauuacuagcagagacuaccuggaucugugugcugagaaaaguagaagaagcacauaggauacaacucuucuucagggaaauaagagagagcuaaucuaugccccuagaagccugggugagaaagaaaaaggaauucaguugcuucuacuuugagcuucucagaugaacauguuuugaacuccuacaggaaguaucaggaaaggucagaauucuccccuaaaccugacugaaaacugguaagucacauaauuuaaagagcgcuccauaaucugagaguaguuaguuaaguaucacccagaaaaugacuguauuggggaaaguuuuaaauauacacaaaagugaagagaauaacauaagaaaucugauggacucaucaaccagcuucaacaauuaucaacucauauccaauucaguuucaucuauaaaccuuguucccaccccacuccccucaccaauggauuauuuugaagcaaaucccagaccuaucauuuugucuguaaauauuucaguacauagcucuaaaagaaggacucuuaaaaaaauauuagcaauauuaccauauuggcuacuuuuuuuuuuuugagauggaguuuugcucuuguugcccaggcuggagugcaauggcacgaucuuggcucacaguaaccuccgccucccggguucaagugauucuucugccucagccuucagaguagcugggauuacaggcgugcaccaccaugccuggcuaauuuuguauuuuuaguaaagacgggguuucuccauguugggcaggccggucuugaacucccgaccucaggugaucugcccgccuuggccucccaaaguguugggauuacaggcaugagccaccucgcccggccucauauuggauacuuuugaugcuuaugacacuauauuccaugaucaaaaauuauuuuaaacaaguaaaacuuuucucuuuuuuucuuuuuuauuuuuuugugagacagggucucacucuguugcccaggcuggaagugcaguggcacaaucauagcucacugcagccuccaacuccugggcucaagccauccucccaccucagccucccaaguagcugggacuacaggugcaugccaccacgccuggcuaauuuuuguauuucuuuagagacugggucucacuauguugcccaggcuggucuuaaauuccuggccucaagugauccucccaaagugcugggauuauaggugugagccacugcauccacccacaacuuuuucuuaaucaucucuaauaaguuacuuauuaauacaauuaagaaugccuuaagaaauccucagauaugcuuugauuuccccuuuagucaucaucauccuauuucuggucuggagagcucugagagcucacagaaggaggcaggagaagugacugaaggggaggccugcuggagucagccccgggcuugggccauccacuuguuauccuggcuauggcucugacauucccccuaccagagcuucuaggguuuuccauauugaauagaugcguaauugcuugucucugugacagccuaaacagugcuguauagaguagaccauagacacuuaaaugcaguuagccuauguccuuauuagucugaggggaagaaaaagaaauccaauugcugucacuuuacauuuaucugacaaaugcugaaaugaauccuauagcauuucaucugugccacacacuuuagcccaugacuguagucucuugugcuggucucuaaauugcuggguggguuggcugugaccaaauacugaucucauuuccaagugggggccaaccuguaaaguugucacuaauaccagcaaugcuucuguuggcagcauauguuugggaauucccuuggcacuguccccgucuguaagccacacaagaacacuagucuugucacuuuaaacucaccauccacauuuagcucuacaagguggaggccagugcacaguggcccagaguggugaguacuuuaaagggacaauaucuauuuagaggucuagauucugguuaguguauuaauaaaucauauuaauaucuugaaucauaucuuuuaauuuauauaucauccauucccuaccagcaacacuuaauaaacaccuucauggugggaccauaugccccucauacacuccuuccaacucuugagcaaaaccaggaaacacuauucucaaggaaagcaaagaauucuuauaacuaggauaugcccacccuauuucacauuuuuaugaaacuuguguaagauggcaggugguuccucaagugaggaggaagacggugcccuacauuagcgccaucaugcagcacuuagcacccucacuucuaccccgggguauucagggccaagccugacuuucccugugaaguggaaagaaucucacgcuagaccugcccaguguuucccuucccacuuacuuguugugggaugcuuuaaugugugcaauugggaucuccucaaauuucuuuccugcccaccucagagagcucuccucuccuggaaugggaggguaaaugcugcaauuagaagaaagauuuuauuuaaaauugucucgacuuuuuaaaaaucaaagaaauacaacacaugguuaaaaaauaacagcucugugcccccugcugcuucuuaaguggcugcccccaccauuccuuuucaguccuucuggugccaccaccgcaugugugacugcugugcuuaugaugcuguuucuugacuugcugacuucagacacaucuggggacuuuccgcuaugagaagggauuuucaugcauacuccccaucuuccuugucccugcagguauacccguguucauuauuuucagauccuuuguagguuccucuucccacaauuuaaaaaauacagucaaaccucuguuucuuauuucaucaaccauagacaauaucuggacucuacauugcaaaaaaugagacaaaaauaauacucauaucauuaccauuaaaaaaaacccagaauccccuagaauaaaggacagcaaacuuuuucuguaaagggccagauaguaaauauacugggcuuugcgggccaacaggucucugucccaauuacuaaacucuuccacuauaucccaacaacagguacagacaacaguaaauuaauaggcuguguuccaauaaaacuuuacuuacaaaaacaggcaauuggccagauuugcccagucgaccauaguuugccaaccucuacccuagaccagugguuuucaaugcaggcugaacaucagucagcugugaagcauacagauguuuaagcuucacccuggacuucuggaugggguauggaaaucaauguugcaaaugucccaauagaaucagaugugaacacauuguguugcguucaagaucuuccacugucuuaguccaagcugucuucuggcuauuucuagcuaaguuaucaucuaacuuaucaucucuaauaaguuaacuuauuaauacaauuaagaaugccuuaagaaauccuuaaggaaaauaaggauuuuuauuuucagauggugaaaauuagguaccaauagggaaauaggguuagcaagagaagccaagccuuggaccuaguagaucugucucagucuagagcuuugcucaccaagcugugcuuuuuaaaauuugaacacacacaaucauccuucagcaauggagcuggaaauaaacuugcuguuccucuaggccuacacacauauaucagauucauguuuguacccaccacagccacuugaaauacaauagacuccauuuuagaaauuauauuauaaucuaaggacuacucucgccccagcccuaccugcuuuucuagagguauuuuaaaaggcaaaucaaaaacacauugguauucaaaguuuacaacuauauucuuuccuguggguuugaccuuagaagugauuagaacugccucgcaaucauacagcacauacccuguucaauuauccuuccauucuccuagaugacucuuuuauagcuucuuuugucuccucuaaccuccaacucccugcuuccucauugcugagcggaugaccuccacaggggaauagaagcaaucagacuuucucccagcucccacuacugaacaucugugcccacagccuuugcgcucucuccuguuacagugcuccacuuguguauuagccccugaaggacacuguucccgcaauguucccacuccaguaucacuuguuuuuuccccucuauacugcacugcucccaauggcaaaacauauuguuauguuccaaacugaaaaaauaacagaacaacccucgaaaaccucuugaacccaccuccugggagcuauuguccauuucucuauucccuuauagcagagcccucuuaaggaacuuuaagguacugacuauacuugcuguuucuuccuauccucugcuucuauucuccuugaacccauuucaaucagauauuagccucuaccacuccaccaaaaaugcuuuaauccaacuaacuccacauuacuaaauauaauaggcaauucuguuauugaucuagcaaccuaucacaucagcagcauuugacacagcugaucuccccaccuugagccaaauuaaaaaacaaauguucucuccugguuuuccuauuaccucucuggaaguuccuugucucuucugaugguucuuccuagucucccaaaucucuaaaugugaaagcgccccaggguucaguccuuggaccucuucucuucaucuacauuuaugguauuaaugauuuugucaucucaugguuuuaaauaucaucucuaugaugucucccaacuguauaucucuagcuaaagucugaagucugacucuugaacuccauuucuuuuuuugcuuguuuguuuuuuugagauggagucucguccaggcuggacugcaguggcacgaucuuggcucacugcaaccuccgucuccgggguucaagugauucuccugccucagcguccuggguagcugggauuauagacccacgccaccacaccuggcuaauuuuuguauuuuuaguagagacgggguuucaccauguuggucagguuggucuaaaaugccugacccggugauccgccugccucggccucccaaagugcugggauuacaggugugagccaccgcgcccggcccuugagcuccauuucuaauggucuacauugugucuccacuugaauguuuauuaagaaucucaaccuuaacaacucccauccaaacuccugcagucuuccccaucuuaaucaaugacaacuccgucuuuccaguuguuuaggccaacaaaauuuggggucuuccuucgcuccuuuuucucacacuguauauuaacaaauccugcuuguucuaccuucaaaauaugucagaccauucauaauaccuccauggcaauaaccaugguccaagccaccauuguuucuugucuggauuauuucaauagucuucuaacugcuuagaggacuuuucccagcuuccauucuugcucuccaaugguuuaauaucaacacagcagccaaagagcuuacaagaucuugucagcaagaucaugucaacccuuuauucagcaauuuccauuggccucccauuucauucacaguaaaagcugaaguccucacaacggccuacaaaguccuacagaauguggcuaugcaggccugcuugacccccacuuccccuuuccaaccguuauacuccuacauuuuacuuguuuucuauuuacugucuucuacccacuggaauuuaaguucuaugagggcagggcuuuuugucuguuuggucagggauauauccccaacacucugaacagugccuggcauuguugaagaaaugacuacaacagaaucuugguuuagaugcuuucagcagcuccucacugccuucaguggggacagcguaaaagcuccagugugacagacaagaccccuggcauucugaugccuucuugucuuguuggccucaucugccaucacauacacaccugaacacaccauguuuuuucauaccacaugccuuuacacagaugguuaccuuugucuccaaugacccacuucaacuuguccagaugaacucccauucacuucugagcuccauguucuuuucuccauggucuugccugauuuccucaggaaugagacacuuauucuuuuuuuuuuuuuuuuucuuugagacagagucucaaucugucacccaggcuggaguacaguggcgugaucuuggcucacugcaaccuccgcucccuggguucaugcgauucuucuacuucagccuccugaguggcugggauuacaggugccagacaucacgccuggcuaguuuuugugcuuuuaguggagacgggguuucgccauguuggccaggcuggucucgaucuccugaccucaaguaauucgcccaccuuggccgccuaaagugcugggauuaaaggcaugagcuacugcacccggccaggaguuagacacuuaugauuucauacuuccaaccaaugcuuaccuccauuauauuauugagcagauuaugguuaaaauguuugcauguuugucuucccucaaagacugugaacuacuuguggggaggaaugaucuuuuguaucuguauucacggcaccuagcauggugucucacucauaguagauucuugguaaauguuuguuaaauggaugugaaguuaaguggauguguauacagcauacagaggugguggcacuggugggaagcaagaugccaguuccuagggcugagcacaaaacccacccuggaccauccguaagacgugcaggaacaucuguuccaucgcuagcgcccucuaccuccccauuuuguuuuggaggcagggaagguuauuggucugaaaagaucuccaucucagaagaaaagaacgcugauacauguuauggauaucucacauucacucauugauuuaacgaauguucacugaacauuuacucuguaccacggcucaucugauucucacaaccucucucagcauuauccgcauuuuuagaugagaaggcugaggcucagauuuauuugcauaaggucccacggauagcaagugacauagcugaaaauucacugguucugacucuggagggugucgggcaagagucagggguugcgggucuccagagggcugguccaaguggggcucaccugaacuugguguggcugggagccgcguucuguucaacuuucugcuuggccgcagcgucuuggagcugucgagcgccugugcagauggucccggccggcguucuggccacgacccugcugggaagaaaagcucggugagggccacggccuaacggucacuggggcccggguggcucaagggacacgaguaggagcauaguccuggagguggcggugggcucgagggggcagucauuuguuacccggcugucuggggccaaguccaggaccgcaggaaccgcgaccccgcguuucucacagccugcaugacuugaauugaccccagucaguuuccgucugcagcgacagucacagcugcgccggcgccgguaccaugagugccugucggggaggggacagaagggaaagucaucuacucuucauuagguccacugaauauuuuuauuuccauuuaaaugcucaauaagacuuucacuguaguucaccaggggauucuuucccuuuuuuaauguucugagauggugggucacccccuccauaugcgaaugguucguucuagcaguu

SEQ ID NO: 21246 - RNA, 89967 nt, Homo sapiens
ccgacgcggcgccuucgcugccgcccugcgagagcgcgagcgugcugcaccucgggagcuggcggcugagcugccaggagcccagcccagcugaaucgagcggagccgguggagcaggggccuuguggguacccgguugggcagggagaggugcggcucugcgacggaaacaaucgccagagaugccggggcuagccuuccccaccagguaaugccggcccugccuggggcuccccuagcugggccggguucugggggaucuccgccggcuuucggagaguggugacacgggguccaguagauuuugaggggugucuuacuuuccucuuaccuuaagggacccuaaaugagagaaagggcugaggguggaaccuuuagaugagcccacccagggcuaggccugcacuggaaucagagcucugcccagggaagggugugaaggggaagcugcgccuuuggggaaccgcucagccucagaagcucugcuccuuugcaagcgcccuucugcuugguggccaacguggugcuuuccucugccuuggcuuagucgcuggccugcugggacugugggggcuuuucuguguuaagagguugagugaacugggagggaggagaccuggggggacugguccuauucagacauccucuguggcuugaguugccauaucugugcagugaaggacuugacauuguuuguuacucuggcuuuuccagacugucaaaccaucuuuuggagaggugagcugguuuaaagugcuaaaaugggcugcagagaugucccccucaacacuguagaagagaggagaacuugggaaguagaccuugguauccugucuuccagccagccuuuugaauggcaucuuggugguucuucagggacaaagcagagacugagaaugcugaugcuuauuuuagugugaugcguagguguguuagguguagggagguaggguugggaaguagaaggucaagguauguuaaugauucuaaacuggccaguuuuucuguccuuagguauaaaguugcguuaaacuagacucucuucucuggagccccuuccuuauucugcuaaguuaaugacagaccuggcugugguaauaucuuaaucacuauaauucuuuccuucuuuauuaccuggcaccaagaagcucaugucaggcccgauaauaaccuacuuugauuauuuuggaccucuuuccucccccuaguuuuuucaugacucuacgucuuccucuccucacuuuucuuucuauuuccuccuccugaucauuuuuccugcccccugccuaccuuuucucccgccguccccuucacccuuccuccuccccucaugcuuccccuuuuguauuucucccccuguguagccagucuuuccuucccucucuuggauccucccccucuugauuaggcuuucuucucuuuucuaaaauuuuugguuaagcuuucuuauuauuaguagguuacugguuuguagagaccuuuuccuguguuuaugagguccaaacauuguuuucuaccuaacucacuugcaucuagcuuuuaccuccaaauucuaucuuccccaggaccauucucucucuuuacugccucugugccuugccuugggccugccaacaagcacucccucuuccugcauuuguuucccaucuuugcugguggugguggggcagcaagcagguaggcaguagggaauaagcaagaugggaaguggggggccugagugggaggagagcaagaaugucaaguagugcugggcagaggcucaaguucccuuuagugagaugagugacugggaggaccagaaacucuggcagcugugagauagugcugaucuggaggaaaggagguagcccaggaaagaagagggaggauagcagggauggguuggagggacaggaggaggaggaggccuggaggagaagacagugcucuuuugaagaagaggguggccuggacaagauagugguuauuuguguguagaaagagaaagauuauagucugggaaaggggacuauauagguuaauuaucuuccccuuugaugacuggcuuuuugaacugauuucuacucagcaaauuuuuuuuuaguuaaaaauuuugaaagaauuuaccauguuuaucauguuuaaguguacaguucaguuucaguaaguacauuuauaucuuuuuuucccccuucauccuccucacucccuuuccuggccuuugguaaccaccagucuacucuguaucaucaugagaucuacuuuuuuuaccuccuacauaugagugagaacaugugauauuugucuuccuguaccuggcuuuuuuuuuaccugaaaaaaugguauccagugucauccauguugcugcaaaugacaggauuuuauucuuuuuuauggcugaauaauauuccguuguguguauauauacauauauacacaaauauauauuguguauauacacauuuucauuuuggcuauuaugaauagugcuacaggauucaugggagugugauaucuuucauauauugauuugcuuucuuuuagauauauacucaguaauggaauugcugaaucaugauaguucuauguuuaguuucugaggaaccuccaugcuauucuccauaguggcucuacuaauuuacauuuucaccaacagcauaugaggguuccucuuucuccccauccuugccagcaucuguuauugccugucuuuuucuuuuucuuuucuugagacagggucuugcucuguugcccaggcuggagugcaaugguacgaucauggccuacugcagcuucaaccuccuaggcucaagcagucuccuaccucaaccucugaaguaguugggacugcaggcacaugucagcaugccuggcuaauaaaaaaaaaauuuuuuuuuuuuagaaguguggucuccuuauguugcccagagugguugugaacuccugggcucaagugaucugccugccuugcccucccaaaguguugggauuacaggcaugagccaucgugcccagccuuugccugucuuuuugauacaagccauuuuaacuggagugagaugauaucacauuaugguuuugauuuguauuucucugauguuagugauguugagcauuuuuuucauguaccuguugguuauuuguaucucuuguuacgaaaaauguccguucagaucuuugccaguuuuuaaauuggauuacuuguuuuuuuugcuauuaaguuguuugagcgccuuauauauucucguuauuaauccuuugucagauggauagcuuacaaauauuuucucccauuuuguggguugucuccacuucguuaaucaacggaauuuuugugagcacuguccuuaaagugggggaguuagagggaaagcagagaugagaacgacaagauuacuguuuuauuggcacucacugucagaauguggaguguguguguguguguguguguguguguguguguguguauuucuccauaguggcucuacuaauuuacauuuuugucaacaacaugaggguuccucuuucuccccauccuugccagcaucuauuauugccugucuuuuucuuuuucuuuucuugagacaggaucuugcuguuuugcucaggcuagagugcaaugguacguacgaucguguguauguguguguauguauauauguguguguguauauauguauguacaauauucacagagcuuugaauauugcauccauccauuaucaaauauuucugaaccaucuacucuaugcuaauuaugguacuagguugguggcgauacaaaaauugaaacuggccucaguuguugcucucaaaugcagaucaaggaauguggacgcucaugugguaaguauuguagaaggaagcacaaggggcugugauaaugcagaagagggcacuuuugauuuagcaagacaguggcagagcuaggaccuaaacuuaagucuucucugaaggugauaucuauucucuuauacccuguuaucuccugaguuuguguauacauacaguguacaaagaguuuuccuauauccucuuuucugccuacuuuuggggcuagacucuagguacugcugacaugaaaaaaagaacaaucccauguggcaggucacugugccauagccaaacaaacacucauuaccuuggaagggaaacagacuucgucccuguuaacuucuggcucgaggccacuugggugacuauaugcugagcucccucucugagucauuugaucucuuccuuccuuuccucccuguuccauuuacuuaaauucaauuucuggcggguugcagaguccagagaccagaugcagcuaggcuaggcauuuucgcuuccacuggccucuauagaauagggauuuaacaccucauaggguuggugaggaucagaugaaauaaugaaugcgugaaaaugcuuuguaaagugcuauauagauaucauugugguuguucccgagugcauuuucaagccgugaaaaauugcucagaugcuauagccugaaagccuaggguugccacugacaggcaagaauaggcacucaguauagacaccaagauuuacuagacccuuucucugcccucgaaaaacucacagacuaauaggagaggauugaaccucaauccuccgugaguaaaggaaaaggagugggguagauagggcuuuaggacugguaauuuaguuccauggucaaacaaaaaccacgaaguaugugcuuuauuuaaggucgaacagauaguagguggcaauuauaaaagauacuuuuagugacuucuuaugauguaacacaaaaaggggaagggggacuuaaaaguagauugacuucaguucaaauccugguucuaccacuuacuguuaccugauuuuuaaucuuuuuaagcuucauguauaaaaauggaagauauucauaccuacuuugaaggguuauuauaaagcuuaaaaauaaucauauaaaaaaauaauaauaauuauauaguaggcacguaauagcuauacuuauucuacaaguccccugacuccuaggcuguuaagggccccucuucuggauucaugcagcaccuaugucuuuccucucaccaaucaauagugccaguuaccauauuguauuguuauugugguuaauguaucugccuuucccauuagucugugagauuuuugagggcagggacagggucuaguaaaucuugguguugauacugggugucuacucuuuuuuuuccuuugaaaucguaucucugucuguugcccagccuggaguguaguggagcaaucucagcucacucacugcagucuugaccuuuuggcucaagcaauccucccaccucagccucuugaguagcugggacuaccggugccugccaccacaccuggcuagcuuuuguauuuuuuguagagacaggguuucaccacauugcccaggcagaucucaaacuccugagcucuagugauccacccaccucagccuccccaaagugcugggauuacaggcaugagccacugcaccuggcuuugagugcuuacucuugccaaguccuauuuaguugcugaguauacuuugguaagcacagcagacuuacaaaagcauaucguugcuccuuuacaaagcuuaucacuuauugagggagauauauaauaaguaaacaaauauaauuacaacucaugaugaugcugugaaaaccaagaguuccguuuggucuuguuagauuugagguacugaugagaaacgcagguggaguugucuaauagaugguuuuuaggcugaagaaagcuguuuggucuagagaucaaaacuugggcauuaucaacguauuaauaauauguaaagccaugagaauggaggaaauaaucuugggaaaaguguaguguaucaguaaggaagguuccgagcaaggaaggucccaagccuuggauguguggaugauagcuggagaaggaggauucugcaaacgagguaggaguagacagaaagauggaaggaaagccaagugaguguacuucccuagaagacaggaaaguagaguauuugaaagagaagagaggucaauugcguuuaaugcugccaagauacugaguaacgugaggacagaaaaauaaggauuugauuuggcaagauggggauaauugauaaucuugacaagacugcuuuugaugaaaugguagauuguuaguuggcagacagaaggggaggaaguggagauaguuuaaguagacaguucugagaaguuuugcuaugaaggggagcagagaaauaagugguauuuggaggaggaugugggugucaagggaagggugugugugugugugugugugugugugugugugugugugucugucugucugucugucugucuuugaauaggagaugccaaaacuuguuuacauucacccaguauuucucagaucaguccagaaauuuagauaccaucuuaauuuuucuuuuuuuuuuuaaucacaugcuguaucuaaucuuuaacucauuugacucuaccuucaaaauguaucugccuuugaauuacuucucucccccuauugccaaucaucuaagccaccauuaguuuucaccuggauuauugcaauaacucccuaauggucucuccacuucugcauuguuccccugcagccuguucuccucugcugcuagaguggucuguuuaaaaacauaaaucagaucagugcucaaaacccuucagugucuuuccacacuugcugaaaagccaaauuuauuguggccuauaaaguuccacacugucugaccucugguuacaucucugaucccagucgcuuaccauauuucucuuuguuuacucaacuuuagucuugccagucuuuuugcuguccuacaugcccaguguauucucaucuaagacauuuguacuuauuacuccuucgcuuaaaaugcuuuuccagauauuacuaugauuugcugucucauuuaaaugaggucuuaaguaacuguuucucagagaagccugucuugauuaucuucuuuuauguaccaugccccaugcaugcgccucccccucauauucacacauacacguggacuugauauuguguauuuauuuguguauuucucugucugcaucucuuacuagaccauaaacucuaugagcacaaggccuuucucuuauucaacuagauuaguauugguacuuuguagaugcucaauaaauguuuguugaaugacugaauauaucuaacagagagggaaagguugacauagcugaaagagcagauuauuccaggugagaacgagugaaggaauacagggauaagagagaauuggcuucggaugagaggaagaacaccuccuucauuguaacuggaaggaagaaggagaaaauggaugcagauacagggaggcacauagauuugaggguaggaagauguaguucuucugccaagauuucuauuuucucauugaaaguaagcucauuggccgggugcaguggcucacaucuguaaucccagcacuuugggaggccgagguggguggaucaccugaggucaggaguucgagaucagccuggccaacauggugaaacccugucucuacuaaaaauaaaaaauuagccuggugugguggccugugucuguaguucuagcuacucgggaggcugaggcaggagaaucacuugaacccccgagguggagguugcagugagccgagauugcgccacugcacuccagccugggcgacagggugagauuccaucucagaaaaaaaaaaaagaaagaaaaaguaagcucauuagcuaaaggaaagggcuaguggaaaauccaguugaauucccauuugagguaggguaaucauauguaggaaagugucuuagccuauuuuguguugcuaugauagaauacgacagacuagguaauuucuaaagaaaagaaacauauuucuuaaaguucuagagcugggaaguccaagguaccugcaucuggugagggccuucuugcuguguuauuccgugguagaagguggaagggcaagagagcaagaguaacaagggaagugggggugaacucauccuuuugaucaggaacccacucucuugauaacuaauuuacuccuaugauaaugacauuaauccauucaugaggccagagcccucaugacccaaucaccuuuuaaagaucucaccucucaacacuugcagugaggauuaaguuuccaauacuugaacuuuggggacacauucaaaccaaagcagaagguaaucauaacuuucaagugaaagcaguuaacuggguuuuguaauguucucuaggacauuuggcugcuuaaguauaaugacaguugggagaaaguugaguucaacuauccuaaagcuaggauuuugccaguuaaauuuuggaaaaggagggaagggcaagggguugaugguuuuugauguuugaguaauuuugauggaucaugauuagauaaagagaggaaaaaaaggcaggggacugcuggauaguuuauuggagcucaaauugaagucuaggaauuguaguggaaauucuugagcaagguugucucuggaguauauaugauucauucuauguauuggaauuguugcacauuuuggugauaagguccuggguguaaucaugagaguauuggcuaacuuggacuggaggucagaaaauggaguggccaggguguugacaugaucaucauuguggcuguugaagucaccuagaaugaugacuagagggguucagaagaagauugaaccuggaacuaaagccuuucagugggagugaccagaaagugaauaguagucugcaaagaugugcgauagcagccaguggaagcuacucaaaggaaaauauagguuuuuacaagaggaagagaaagacaugguuuggaaauggcacugaaaauuaaggacuacacugauagguaggguguaagagggaaaacagcuuccaauugagagggcuuguagagaagccucuucuucagggcauagccagauuucuuuuaagguaaaggagcaagaguguagccaguggcaaaugagaaguuccagagggaacaguggaaggguuccagagucaccauagggggagggaauuuggucagguuagaggguucacagaaaaguuuggagaugagaguuugagugaucaugggugacugaaguaaaugaaaacuguaggacugauugauugauuuaguccuaauuaccuuuuagaggugggaggacugucccauuuucaugcuaugguuuuugacacuuugagauaaacuuuuccauugaggcagcauguggcaaugugggaaaucaggacauguucaggcagagauuggcuggaaggucaaccaacuaggagacaguacgauagauuucauuguuuccugggagguugaacgaaguggccccuuuaugguuccuuccagcucuccgauuguaagggccucaacuuuaugaggccuuacaggccucaaccuguaaggcaggucauccaaugggagguuuggagguuugaagguuaaauuucaauuuuugccugaauuauugggaauaacucaacugggguugcagauuaggaauuucccaagaugguaggcagaggauuauaagaccuguaaauauugguuucuggaaguaacucuagugacugucugcaaggugguaggagugaggaaguugcguaggugcggauggggguggggaggauuagagguacagagccagccuaagagaacuucagucugucacucuaaauuucucugccguuuccacuucacuuugcugccucucauucuucucuaauuguaggaagccucccagauacagucacuuguucauucugucucaaauuacguaauuaguguagaaagagaguuuucaagagaauaaucagaagcuaguaauguuuuuaucacucuuucauuuagugaucuuagguaaauugcauaacccuauagguuccagguucccauaaaauaaagguguuuauuuuauaaaaauaaaacuggcugauucuucaggauccuuucagguccuguguuuuuucugcuaacccaggcugccuuagucagugaaccuuggcuaauuaccagguguguaccagcucagccuagggauauagagauuaaacaaacuucaguuuuuucccuugaguuauucauggccuggugaggacaagaagcauggauuaugguugauauaaugaaguuuggaaauuguugcauagaaguacacauagaaugcuguuacauuucgggagcagaaguagugggaucuguuaaauuugggggcuucugugaagguuucauaggggaagugagucagguugggccuugaagaaugaguaggaguuugcuuggcagacaaguuggggcauuuuaggcagagaaaacagcauaggcaaaggcaggaacaugaaagcauagugagcuggaaugacauguuuagggaauaguagagaugaaacuaaaaagauaggugggggaaagaacaaauauuuguugaacauuuauuuugugccaggcagcaugcuaggugcuuuuauauaugcuuguuaauucucgugauaacuuuauaaaguagguagucuuguuugcguuuuaccuaagaggaaacugaagaucagaaaguaaaguagcuuuccuaaccacccagaaacagccaacaguuuuccucacuguugcucuagcagguguugcuaaaccagagcaaguggccaggcugcauagugggaguaucuuugacauguuagaaggacaucccucagcaaauucaagacugcagcauuccaguccccugccaaagaaaaccuccuggcacaauauaauuaaagaucagauucucauaaccaggcgucaagggcauacaguacuccccaguucuggauggaguguuggucaugccaguugcagcugcugugagcuguuuggacuaaaaagugugauuaguauauggaacagguuuuauuucuucuucucgaguuaauauuagagguuaucuauuccuuuccuuugccucuagagucagcaguguagugugguguagugguucuaucaccacacaggccuaauuucagguuccugccucugcugcccacuagcuguaugacccugggugacuggcagcaucuuugaagcuuugcuucuucuucuucugacuuguuuacuguucugucuucagcacuucaugcauagcuugucaaacgguagcugacgaauuaauauuugcacugaugaaugagaaaaaugauaccaaauagauuuccaaguuuucaguaaacuccaaagugugaucuaauguuagugauuauuaaaacagccccaaauaaugcuuaaauccuaguuguaaaaaugguuaauccugaagguuuucuguggaaacuguuucuagaauuuuagcaacucucuuaggcaguguggaagacucucuuaaacuccaggucucauugugugacuuggacuaagcaccagaauucguuuaucuucugugaugcuuaaucccauuguaugaacucaaggcaucacugaguccucagugcagauggguagcagauggucuccuccuccaggcaauaccucuuuucucauugucaucucuccacaaccuuguuuuuuaauuaaaagccccaucuuuuauuuuuaacauggggcauuuauugcacaauucuagagcugcuuagaauggaccauuuuucugucuagugcucuacguggugcagaacauaaaagaccugcugugaucugcacugucccacuuuuucagucucccauuuuaguccuuuauguugcauucugccacacuguacucucacauuuauguuauucuguggucuggaugcauuugccaucaucuuucuccaugaaaaucauucacucauuuuuugucucuuuucuuugggccaagcacuauauacuaaugccuggaccuacuccagaccaauuaaaucagcgacucuagggguagaguucaagcauuaauguuuuccuccucaacauuuuauuagguaaaauuucaaaaaucagaagaaucuuacagugaguaccuguguacccaccaccuagauucuccuaccauuaacauuuucauauacuaacuuuaucauauccauuauauauugacauguauauuauguuauaacccuguuaaucuuauuucuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgccuggcuaauuuuuuguauuuuuaguagagacgggguuucaccguuuuagccgggauggucucgaucuccugaccucgugauccgccagccucggccucccaaagugcugggauuacaggcgugagccaccgcgcccggccaaucuuauuucuuaaaaaugcauuugaaaauaaauuacagauauuaauauacuucucccugaguacuucagcacugguguaaaacuucagcaccagugagcuuuaagaaaaaagcucacaggggauucuaauagccuagaguuaaagaccacuagucugaccuauuuguucuuuaagcugcuacucuuaauaccaccucuuuucugaaacuucacugaucacucaaauucaauuuaacauuucuuucauguguguuuggacauuuuacuguuuguacuguucuacagcacuauucacaauuggccuggcauugugguuuucuagguucugccuucugcuaacuagauggugauagccucuagggucaggucauauuuuauucaugaucugucuaucuaccuaucuaucugucuuccuucaucuauuuguucuugguuucuagcauacauagcaccuuauauauuuuuauauguaagcugaacugcacuugaacugcacuugaaugaagagccugcaacugcagcaaaagguguacauaccuuucauauguguuugcuuacauauucuguguuuauauuuuuuugauuggaggaauaagaauucauuuaucuuuucuggcacuuagcucaugguagacuuuuaguaaaagucaaguccagccuaaaugugcuaauaacauuuuuauauuugccauuggcuagauuugacugaacuaaucauaaaucagaaguagcggaacacaaaggggcuagaauuaccucaagaacaguauaguuggaaaauccuuuggcagagaguuuaaagaugaggucugauuaaacaaacaaacaaacaaaaaacuaaagauagaccuaucguaugauccagcaaucccacagcuggguaucuacccacaagaaaggaaauugguauauugaagagauaucugcacuccuguuuguugcagcacuguucaagauagcugagauuuggaagcaaucacagugucuauuuacagaugaaaggauaaagaaaaugugguguauaugcacaauggaguacuauucagccacaaaaaagaaugagauccugucauuugcaacaacauggauggaacauguacaauggaguacuauucagccaccaaaaagaaugagauccugucauuugcaacaacguggauggaacuggaggucauuauguuaagugaaauaagccagggacagaaagauaaacaucgcauguucucacuuauuugugggaucuaaaaaucaaaacaauucaacuaauggacauagauaauagaaggaugguuaccaguggcuggaaaggguaguggagggcuaguggaaagggagggaugguuaauggguacaaaaaaauagaauaaauaagaccuauuauuugauagcacagcagggugacuguaaucaauaauaacaauugcauauuuaaaaauaacuaaaagacuauaauuggauuguuuguaacacaaaggauaaaugcuugaggggauggauaccccauucuccaugauaugauuauuuugcauugcaugccuguguccacaauaucucauguacuccauaaauauauacaacuacuaugugcccacaaaaacuaaaaauuaaagaugagguuugaguuuugcugggaaggauaaguaaaauuucuaucaguuuaaagaggguucuaucccuacucuaccuauaaauugcugugugaucuuagguaauuuccucuugcacucuggacuucaguauuccuaccuguaacauuaggcagucagguuggaugacuuccaaagaagccuuuggcuuugauguuaugugcaucuuaaaauaguugauuaacuugguuuuguuuuauaccggugacuguggaauccaggguaauaagaguagaaagagguaguuguuggugagcacauuccuucucugaaucccugucuacuuugauucaguauguaaaguaccuuacacacaguggcuacuugaaaaguguuuucuuucccgucuuucuacuguagcacuguaucuuuaugccuuguauagcaugcuucaaaagaggcacaaaucacuuccccuccuugguugccucuugaccaguauuaagucuagagacugcauagcgagaaacaucaaauuacaggucauaggugaugggacuucuacaggggcgauggcuuauaaauugcagagccaggacuuaaaccugggucuccugacuuuaauuccaguaaucuuuuaaaauauugcccuaccuuuugaaaccucacagugauccugcauuuauuauagagucauucaguugauucauaauuaaugcuucaauauaauuaguugcucauaaauuguuagguucccugagccucuggggcauugguaaaaugugaucgcucugucuuucucucugucuguuguauucauuuguuguccaggauggauagaauggugcuaucugagcuguuauaauguuggccucaugccuagcuuuauauugcagcacgucugaggcauugguuuuucauccuuccaaacuuuuggucuacagagacuauuagaagauuaagguguguauacucacuuuauucaaaaguugagcauguuuguuguuuuggaccuguuuuccuguaaacaaaguuuaaaaugguacagguuuuaaaaugugcuaauuauuuugaugaguguagauauacaaaaugaccauuggaggaucaaugaggguaaaaagaggaaagacuuguggagaaccuauaagaaagggcuuguuggagggcugcagggaagcuggaaaguaguauagaaaccuuaagcaaguucagaaggaagugauuaagaaagcacaaaauuguguucugugaguauaguugaagguccuggaaauguuuggcauugagaaaauagauuugggaggucucaaaagaguauuucagguaucuaaaguucugucuggggaagagauaguggucuuuucugaauagcucuaagauacaagauuuaguacuaacagauggaaguuuuuucuuuguuuauucauucguuuguuuauucaacaaaucuuuauugauuaccuguucugugccaggcgugguguugcagaucgagaaauacauaggacaugaacuuuguucuugagguguuuauagucuaugucuagcaggggagaggggugaaagggaaagcaaauguguaaacaaauuauugcaaugcaguguaagagcuuauuauaagugauaacucauuaaaugagauggcugaagauagaagagacagucuuuggagauuuuagauuuccugucauugcaacuuuucaagcauagacuggaugaccuaggcuggaauguaguaaaagaauugaaauauuagauuccaaugcuuauuuuagguuuuaaguaauaauggaaucucuuugaaagugaagaucuaucacagaauucuccaaacauaguaaaaggacugagaaauggagaaaagccuguaucaggaagguuggugaaaccuuuguuggcauaaucgugggcugugggccugaaauggaguuacauucaaugaagcuguugguugaaggaccugggaggcagggaaggacuugacuaggguaucagauggcugcagggaguguaauuuuggaacuggcagccuggagugggaagguacacuugagaacugagacaguaaaaguucucuugcgggagcugagggacuugaguuacaguugggagggaaaacaaagguaaaucugggaagagaaacuggaagaaauggauaaaaagaacaucagaguuaaucugcauuaacaagauuguccuugcuugcuugauuucuuuuguucaaaaagagaaggagcaguugguuugccaaaggugggucaggaugaauuaugcaaagaagugggguuaggguuuggccuugauggaugaguaagauuuuuaucagucagagaagggagaaaucauugacaggaaacacguugggguguguguuugugugugugucuguguguguguauaaguaaauaagaauacaaguacaguggaacagauuucugagguuugaauuaguuugaauuaggcugugucuagguguaguggcuuaguugauaaggcagguugaugucagauagugaaggaccuugaauuuuaucuguacuaaacuuccuaaaggcaagguauauaucuuuaugcaaaguuugauuaauuaaaauauuugaguucacuaugagcuagauacuauauaaagcauuguuggauugcaaagaugacaaaauugggcccaacauuugaggaacauucuggcucccagggaagacauaccuauaaacaauuguaauagcaauaauagaagggauaaccuggaaaguuacccauugcuuugggaauauggaggagggggcaccuaacuucuugaagugaugaggacacauuuccaaauggguucaaggaagaaauaacaauugaauuaagccuugaaggaugagugaauucauaguugaagcauagggaaauugguauucuaggcagaaggaucagcaugcacaaaagcauagaaguguaaaagcuaugggauauuugaagaaguuggagaaguuggguguggauagaguguaagggaaauuagagugguaguggugggaaaugaggcuaauuggugcauuuggucaaauaacagagggccucuaaaagcaagcuaaaaacaucagcuuuuauccugagaugucaaugaaggguauuuuguuuuguuuuguuuuguuuuugagacagagucuugcucugucuccaggcuggaaugcaguggcgugaucucagcucacugcaaccucugccucccggguucaagcaauucuccucccucagccuccugaguagcugggacuacaggcgcgcgccaccaugcccagcuaauuuuuugcauuuuaguagagaugggguuucaccauauuggccaggauggucucaaucucuugaccucgugaucugcccaccuuggucucccaaagugcugggauuacaggugugagccacugcucccagccagugaaggguuuuaaaaguagaagaguaguguguucuaagguuacugacagcuccuggauaaaggauugaggaaaaaacuggauguggggggauccguucuuuauuagaaauuguuaaaaaaaaaaacuccuauagauuuuauucauaguauuuuaaguaauugaugccuaaagcgguaguauucaaaucugacuggcauugggaucacuaauuuucaaaauacagaauuaggucuuaacucagccguucuaaaucaaaauuuauggaggccaagccaggauaucuauauuucuaaaagcucuugguaauuauugugcugguuuuuugaacccauuauucucuaaagcacuguuguguuuaacuccaaagagcuuauauuuuaaauagucaugguuaaauguauaauuucuacugcagcauggaagacuaaugagcaauauuuuuaacucuggauacauucauauguauccauugucaaggacguuuauuuaagauaauaacauuuucauuaaaacuauugauaacaugugauaggaaaucccccccaucuuuauuuauuuagagacagagucucccucugucacccaggcuggaguacaguggugcgaucuugguucacugcagccuuugccucccauguucaggugauucuccugccucagccucccuaguagcugggauuacaggcacccaccaccacgccuggcuaauuuuuguauuuuuaguggagaggggguuucaacauauuggccaggcuggucucaaacuccugaccucaagugauccgccugccuuugccucccaaagugcugggauuacaggcaugagccaccgcgcuuguccuauccccuaucuuuuagauuuuauucuacuguuucucagaaguaguggagauuuugccaguaaauucugcaccauauaggacaggaugguuacugcauugaccauuuuauauuuagaagaagaaagccaagcacaguggcucucgccuguaauuccagcugcuugggagacugaggugggaggauugauugagaccuggaguuugagaccagccugggcaacauagggagacucuugucuccaaaaaaauuuuuuuuaauuagaugggcaugguggcgcaugccuguagucccagcuacucuggaggcugaguggggaggaucucuugagcccuggaguuugaggcugcagugagcuaugauuguaccacugcacuccagccugggguaacagagcaagaaucccaucucucucucucucucucucucucucucuuuuuuuuuuuaaagaacaagguagaauuucagaggagggaaacacuggagagauuauauagucucagggguuagccaacuuuugcuguaaagggcaagauaguaaauaauguaaguuuguggacauacaaucucuguugcaacuacugaacucugccagcaucagguaaaaaaaaaaagccauagacaauuuauaaaugaauggguguggcuguguuccaauaaaacuaucuacaaaaacagcagcuuuccugacccuugauacaguccauucccaagagggaaaguguaacuugucuaagguuauaaaauuagagguuggcagagaacucacuauguggaaugcuguuagcaguuuuauuuaaucuucacauagaugaauaaaugaaaccuaagagguugaagaauuucucuaaaguuaguaagugguacugggauucacacuuaguuuuugcuaggccaaauuucugcuuucaacuacaucauaaugguuuuccgugcuuugcaaugucucagaaugggaaugcaaagaaaagcaagauauugugauuuuucauuagugcuuggcauauaguaggcauuuacaucagugaguguuagcaauaucauggugugcaguggaaggacuugagcuagacccugaaggaagggcuguauaauuuugauucuuugcaauuuuuuaacauguauuuccuuuuggucaaaaauaauaaaagaguuauauuguucuuauuucugauucuaguagcugcugcugguggugacaaugucaaauaacggccuagacauucaagacaaacccccagccccuccgaugagaaauaccagcacuaugauuggagccggcagcaaagaugcuggaacccuaaaccaugguucuaaaccucugccuccaaacccagaggagaagaaaaagaaggaccgauuuuaccgauccauuuuaccuggagauaaaaguauaguauuugauuuucuucucaucauuuauaugcuuuaaaaaaauuauuuuggguaaccuggauaaaagaucuguugucuuugacuuaauuuuccuuuaauguuuucuuucugguuaaauauuucccuuucucccuacaguggcugaagcaaaauggaaaauagaccuauuuuuauacucuauuaacuauaucugagcaaaacuguaagagaauaauuaugcucuugccagauuugggacaaucugaagugauuuauuuauuuuuaaauucuuaaacuguuuaugaagccacaaaauguaagaaaaauugaaaugucuuuauuuggaauuuuuuuccccccgaguuaguuucaauuggaaauguuuucuuuccaaaaucuugauugccuuuucuuuauuccagcuuccuggucccacuuucagguuuggggacuacguaucaguaagaauggcaaguaacagcugagaaaaggaugcagagauaacuagcauucagcaugaguuuacuaugaauaaauuauccugggcagccucauuuccuuuuuauugauaaaacuucuguuaauagaagaguaaucauaugaugaauaguggugauuuuaacacugauuuuaacacuguugauuuaauaguguauaugaaaaagucaccaagauccucguagacaagguuguaaaauaaagguuuugguguccacaacaaaagaugacuuuuguuugguaccaaaaauguugauuuaaguggcuguugcucugaaguaaaguucuccuuauauuugugggcccuguucuuauggcaugcuaaagauacuggcuuucuguguguaaguaguuaccaugagcuucugguuuagauggagcugggucaccacuuaccagcuuucugaucuuaggcaugucaguuaacugcuuugaccuuuauuuaguuuccuauuuuaaaagugagauaucauuucacaggguuguugugaagacuacauacaaaguuccuaauagaguaccuuccacacagaagguauuugaauguuaguucucugucucuuuacuccuuugucucugucucuuuacuccuuuguugaugaauagaaacugggaggcauagcugguagacuacaugguaaaaucagaacugagauucugaaacaguagggcagauacaacaagcacaaugguagauugcggaaaauaucucauguuguagaaaaauauaauugccuaacuacggaucaggggagaugguagaugguagugucauuagcccaauagggaacauagaaagaaggaacaaauuaggaguguuggugauuggagagcagggaagaugauuauuuuggacacauugcauuuguagugucuuuauauagauaugucuuauaagcagaucucauguauuguaaaugucguacaagugaaaugagaaauaauaaggacuuuuaaugaguacauugggcuuauaucguuauguguaugaguccuucuacuucaccuucacuucccuuuggguuugguggcuuuggguagaaaagaaggccaggcacaggggcucaugccuguaaucccaacacuuugggaggccgaggugggaggauugcuugagcucaggaguuugagacuagcccgggcaaaauaggaagaccuugucucuacuaaaaaaaaaaaaaaaaaaggagucgggcaugguggcgugugccuguaguaacagcugcuugggaggcugaggcaggaggauugcuugagccugggaauuugaaucugcagugagcugugaucaugccacugcacuccagccugggugacagagugagauccugucuuaaaaaaauaaaauaggccgggugugguggcucaugccuguaaucccagcacuuugggaggcugaggcggguggaucaccugaagucagaaguucaagaucagccuggccaacauggugaaaccccaucucuacuaaaauacaaaaaaucagcugggcaugcuggcaggcgccuauaaucccagcuacucaggaggcugaggcugggaguaucacuugaacccgggaggcggagguugcagugagccaagguugcgccauugcacuccagccuaggcaacaagagcuaaacuccaucucacaaaaaauaaauaaauaaaauaaaagauauggguaaggugcuuaaccuugauuuccugacuaauucauucauauaguagcugccaacuuccuugguacaagggcuaugaucugagacaguguuaaaugcccugcagucuucuuccacauauguagccacuuuguuuaucccucaauuuagauguguauuuauuuuuaauauuguaucuuaucaaccaguguucuugaucucuauaaauaggcuuucagcccaagugucuacauguagugaaagaggacuuuuuaaauuaaaaaguuuaaauuguucuugcugacucaaacuagaaagguaauaagauucucauccaguaggcaucaucaaaacuaaaaacauuuauguuucaaagggcaucauccggaaagcaaaaagguaacacacagaaaggagaaaaauuucccaaauuacauauuuuauaauggauguguaucuaaaauaugugaagaagaacuauugcaagucaacaaccgaaagacaaguaauuuuaaaaugggcaaaauaucuaaauagacauaucuccaaagaacauauacaaauggccaagaagcacaugaaaggauucucaaaucauuagccaucagggaaaugcaaaucaaaaccacaaugagauaccacuucacacucacuaggauggcuauaauaaaaaagauaauaacaaguguuagugaggauguggagaaauugcaacccucauaauugcuggugggaauguaaaauggugcagccucuguggaaaacagucuggcaguuccucaaaagauuaaacauagaguuaccagcaguacaugaauguuuauagcagcauucauaauagccaaaaagcagaaacaacccaaauaccccaucagcugaugaauagauaaauaauaaaauguggaauauccauacaaugaaauauuugguaacaaagacaugaaguucugauccgugccaugacauggaugacccuugaaaaugcuguguuaagugaaagaagccaguuacaaaggaucacauauaguaugauucuauuuguaggaaauguccagcauugguaaauucauagauagaaaguagauuagcgguugccuugggcugcagagagggagaggcaauuaaaacuaggagaugauuacuaagaggggugggguuucuuuuuguagugaugaaauguucuaaaauugauuuuggugauaccuguccagcucucugaauauauuaaaagccauugaauuuuacacuucaugggugaauuguuugguaagugaauuacaucucaauaaagcugauuuuuaaaaaagaagauuccagucugaaacagcagauggaagcagagccuucagacaucauuggaaccuggagggacaaucuuaugugcuaaaugggaaagugggggucuagauauugggauuauaguauugguucuuccauaaauuggcugucugauuugggucaauuauuucucuguagacgucagugccuucaucuagaaaaggagagagagcaguaggcaugugcaguuucuuuuagcuuuagaauccuauaacuggccaggcacgguggcucaugccuguaaucccaccacuuugggaggccgaggcggguggaucacgaggucaggagauggagaccauccuggcuaacacggugaaaccccgucucuacuagaaauacaaaaaauaagccgggcgugguggcgggugccuguagucccagcugcuggggaggcugaggcaggagaauggcgugaacccaggaggcggagcuugcagugagccaagauugcgccacugcacuucagccugggcgacagagcgagacuccgucucaaaaaacaaaauaaaauaaaauagaauccuauaauuacauaaaugugauguugcaaaggcgugguuagaucaggcuugucuauauaggugaaaagaaacuaggccauuguaaaguacuuuauucaaugauacagcuguagaaaauccuaggcuaaaucuaaguaaccuuaggcuaaaucugaucugaaaauacaucucauagccucaagaucaaaacugcaucucugcaggcugaaaacauagagguagaaaacauacagaguuauaagaaguucuugcaaaaugaucuaacuaucuuucauccuuugguuacagauuuucuauauuugcccugggcacauagguuucaucccuuugcuuuaagacccuugauggcuauaacuaaugcauacaucaaaaugaaagaagucugagguguuuuucuuuuguuuggagccuuugaucaaccaguaagcuacucaacuuaguccuauaaggauacacagcaguguugguagucuuugaagugguauaugcccuucauguaguauuugagcauuuauaccagcugcauagaguuaugucuggaacuggacuuauaacacagauugaguccagccacugacauuuguuaacucugauuuauuuuuuaaauuucauuccaauauccucacuucccauucauccuauaucauuaguaggcuuuugucauuugacauaguagauauaaaagcauuuucuaaacuaaaaugcaauacaaauaggagguuuguuuuuuaaaaauggaaaccucauuuauuguuuuauuugauaccuacaacaacucauuuuuaguuggggaggcuaaggcuuagagaaaaguaaguugcucaaggucucacaaguggaaagugggagagcugaguauggaacuaagucuuccuaaauuaucuguuccauuguaacauaacuaucucucuuaguuguucucaacccugauuacauguuggacucacuuauggugcuuuuaaaaaauacagggcggggugcaaguggcucacgccuguaaccccagaaguuugggaggccgaggcgggcggaucacuugaggucaggaguucuagaccagccuggccaacauggcaaaacccugucucuacuaaaaauacagaaauuagccgguugugguggcaggcaccuguaaucccaacuacucaggaggcugaggcaggagaaucgcuugaaucugggcggcagagguugcagugagccaagaucaugcuacugcacuccagccuggguaacagagugaaacuccauuacaaaaaaaaaaaaaaaaaggcugggcgugguggcucacaccuuuaaccccagcacuuugggaggccaaggcggguggaucacuugaggccaggagcucaagacuagccuggccaacauggugaaacccugugucuacuaaaaauacaaaaauuagcuggacgugguagugggcaccuguaauuccagcuacacagaaggcugaggcaggagaauugcuugaacccaggaggcagagguugcagugagcugagaucacaccacuguacuccagcaugggugacagagcaaaauucugucucaaaaauaauuaauuaauuaauuaauacugauaccugcauuccacccagaccuuuggagucagaauuucuagaggaguugucuugggucucuagagagauuuuugggagaugagaaagaagaaugaucuguaggcuguaguaaugguugagauuugagcugccaguggguagaaugucuuugggcauuaccuaaugcugaccucucuagcauggccucaguaugugccugggggaugcauaaaugauuggaaagagaagcuguaauugagggccuguaauaggugaugcugaguugcagaauuccaugugggaaagccugguuccugugguuaggaucuggagccuuugguuuauucuaagaagucuuucagcauuuaguuugaaaucuuuuucuggcugcauuuucacaagcaaaguggaauucucugagcuugggaagaguuuagcaaaguuaauuuuaacauuggacuaugucaguguuuaucucuccaaguuuggaacguuuuacugccuugagcucagauuagcucaguggagccaaugagaggugcugcuuaaaaaucauuuuuuuaaaaaaggccagugauuugugcugaaacuuugauggcuauaccaagacaugggauuuugcagugucagccucauuucccaugcuaucagaaagccaaguggucuaggucaaagauaggguuaaaguugggaugggugagguuggaagcuucuuuucccgcuuuauuuucucaaucccaagaucucuagauacaugaaaucaagaugauucuuuccucuuucucaccucaaccacaguuucucugucuuaaugaaugggcugagaaaccuaacaguuuuuuauauuaaugacaacucauguuuguaaaguucuuuaguuuacaaagcacauauauuuccuguaacuuaaagaauucuuuuuuuuuugagacagucacgcucuguuguccgggcuagagugcaguggcgcgaucucagcucacugcaaccuccaccuccuggguucaagcaauucucccugccucagccucccgaguagcugggauuauaggcaccugccaccacgccuggcuaauuuuuguauuuuuuaguagaggcgggguuucaccauguuggccaggcuggucuugaacuccugaccucaggugauucacccgccacggcugcccaaagugcugggauuacaggcaugggccacugcgcccagccaagaauucuuaacaucguuguaggaauccuuauuuagauauaagucuucugucaguuauauauguuacaaauaucuucugugcucuuagcuuuuauuagauuaaguaaauuccccuguaaucuuagacagaugcuuggcaugaugugagauagaauuuuaauguggucaaauuuauuaauuauuuccuuucuaaugcuuugugguucuauuuuugaaaucuuuaccuacucagagacaugaagguuuuucuauugaguuuucuguauucacguacaugagcacaugaucuguaaauuguaauaguucuuuuucuuucuuuguaauccuucuccuuuuacuucuuuuucuugccuaauugcacugguuaauaccuucaguacuaugaugaauagaaguggugaggaggaauacccuucuccuguuuuuaaucucaggaaaagcuuucagcauuuuagaauugaguauaauguuugcuccaguuuuugguaauuaccuuuuauuagauuaaguaaauucccuuguaauccuaguuugcuaagaguuucuaaucaugauugauaucacauuucagcaaaugcuuuuuucugcauuaauugaauugauuauauauauuuucuucuuuauuuucuuaauauaguaaauuacauucacuuuuuuuuaaaaaauugagauauaauucacaugccauacaagucaccaucuuaaaauguacaauuccgugguuuuuaguauauucauaagauuguacaaccauuacaacuaauuccaauacauuuucaucacuccagaaagaaaccucauacucauugcagucguuccucacuucucccuucuccccuggcaaccacuaaucuacucugugucuauggauuugccuauucuggacauuucauauaaauggaauuacacaguauauugcccuuugugacuggcuucuuucacuuagcauaauguuuucaagguucauccauguuguagcauggaucaggacuucauuucucuucauggcugaauaauaguauauggauguacugcauuuuaucuauucgucacuugagggacauuuggguugccuucacuuuuugacuguuaugaauaagcuaaugugaacauucacauacaaguuuuuguguagacauaaguuuucaucagauuccugcagacauacuucuagucaucauaaaaaauuugcaacugcagcaguagucccagggauacuauaucccugggauaugggaccaucaggauccuagguuugcuuuauuuucuccauugugucuucccucaguccgaagcucuuagugccuuccugccugcagucaugugcuuugugaaucugguaagaguuuaugaaauuugguugacuugcugagcagguggaaagauggaagaaagaucacacugcuuacuucuuuuggccucugcuuauucuguuucuuuuggaaaugcccuuucccaucucggucuggcuaaccccuguucauccuuuaugacuucuuucagguauuaucuucuccagaagagugguuuauuacuuaccuucuucuguacacagagcaugcaccauuguccuauuuugcagauugaagacuugaaacucagacuuucccugggucacccagugaguuacuggcaaaaauaauacugaauccuuccucugagauucuuuccacuaacagaaauuucuuuuaauucccugaccucagcuguuuagcuccuggguuuguggugaugagccagugagacagugacuggcagagcuuggugaagggcuguacacaggugaaggggaugauuguuacuuccaagaagggauuaauuggguuccagguggcucugggacuguaugacuucuccauuucucuccuguauuccugccucuugaauccuguuuucugcuggugauccccaacuggugaauacucagucuaaauauuacacaguaccaggccgggcgugguggcucaugccuguaauaccagcacuuugggaggccaagguggguggaucacccgaguucaggaguucgagaccagccuggcaacauggugaaacccugucucuacugcaaauacaacaaguaacuggguaugguggcgggugccuguaaucucagcuacuugggaggcugaggcagggagaauugcuugaaccggggagguggagguugcagugagcugagaucacgccauuguacuccagccugggcaacaagagugagacucugucucaaaaaaaaaaaaaaaaaaaauuacacaguacccaagcuaaauccugccaccuagauuuccccguuccuuuuacuucucuccucucccacuucaaccaagucauugcuauucuuguacuccgcgucuaaucuauguuaaacuguuauuucaguuaguaguugauaccagucaaaucucaguagggaucagggguauaauaaagagugaaagacuugaucagguagacuacaguccugugcucugugaaucaggacaagucaacuuacaucccugggccucuuuccucagggaaugggaucauggucucuagagucacucccuaauauuuucuuucuuuauuuuuuugagacacagccucacucugucacccaggcuggagugcagugguacaauuucaguucacuucaaccucugccuccugguucaagcuauucucaugcuucagccuccugaguagcugggauuacacgcaugugucuccacgcccagcuaauuuuugcauuuuuaguagagauggaguuucaccauguuggccaggcuggucuugaacuccugaccucaagugauccgccugcuucagccucccaaagugcugggauuacagacgugagccaccgugcccggccauucccuaauauuuucuagaguguucuucaacuaaguaagccaugugcuguauugaaauucagaaguacagggauuguaauuggaagugguaauuuugguccucaagaagcuuacauuuuggauuuuuaaacuagcaaggaauuauauaagauaggaaaugacuagaugcuuggugguguagcagacucagugucuugggaauuaacaggaagaagaaaggucaggaaauccuuccuggaaaaagugggaccugagccagucuuuaaaagauugcugagauagggagaaggagaagagagcauuccaaacaaggagaagaaaaagcaagcaaaaaguuggaggugggaauaugugagguauauucaaagguugcaggguaaagagugcucaguagaagcagagcugacuuuagcauuacccuguguguucauguauuaaaugauuucauuucucuggaacucuuuucuguaaaccacucaugcuuugagcuaacuuucuuuuugggucuccuuuaccaaaguuucuuaugcauuugacaguucaugccugugauguauuauauaguauaucaauuauauauaauagaaauaauguauaaacaugcauagauauagaaaauaaaaauugaaauaaaacacaaauauaauuguacuucccuaagugacuagaucagagggaauuuagaaacagaaaguaguuccaaagcccugccacauguuccagugcauucuggcuaugagaaagacagauggacuuacgucauaaaggacugcuugacuuggggcccugguauaccccuuagccuucucuuucucaaagcagcugcuucugagagggaaauugccaagugcauaaauagcuuaaacccuagcacuuggcauguaggcaaaugguucucauuaagauacugaagaaugaacguuuggaaucagaccuggguucaaaucccagcucucaguagcuguaugaguaaauuacucaguuuccucaucuguaaaaugacaguaguaguauuuaucucauaggauuguaagaaugacgguaguaauaucuaucuuguaggauuguaagaaugaagaaaaauacuauauugacaucaugguuuguauacauggcaaguucuuaaugucauuucuucuuacuacacugaaguauguuuucuugauucaacuugaaauuuuuuaggggagguaaaauagaaugugaagagccuuggcuuugaugccagacuuuuuggauuuuaauuacuuaaugauuguaggcaagucugcucccaaauuuucuaaucuacaaguaaaacuuaccucaggauuguggugauuguauuagaugauauguaugaaauaccuauuuaaaacugugggaugccaucucaggaaggaaucuuaacugcagagcuuugagaaagcauaguuucuuguuuucauagauucacagaauguaggugcuugagggacccuuaagaucaucuagcucauccucucccuuguuuagaugagaaagcagagauccuggucucucuuucucucucucucucuacacacacacacacacacacacacacacacacacacacucuguggugagguagaggugaaacuggcuugaacucuagaccuuuuuguuuuuuccuucucauuuugcuaccuuuuaucaggguuuugcugggucuguggagguguuagaacuucagaauuucuuuugguuaguguguugagcucccagacagcaggguuuuaaaauaagguucacaggugcuggguaacaaguguugugaaagucaggccagagcugcugaaaugaacauuuauuccugcccuggagagaauuuuugugucuuaggcagauucuuuaaacuccuugcccaguugaguuaaaugucuggucauuuuuuccuuucuucacuuacugucugagcaccuacuuuguccaggugugugcuagccucugggaagcugugauuaauuugacauggccucugcacuuagaauucagucugguauggaagauaaacacuuauaauagucaauuacuauuacauauauugggugcugugggaacagagaggguaaagaaccacccagccuagagaucaaggagggcuucacaaaaaagaugacuuacucuauaucaacuggcuaguuacugguaaaaccagaacuguuaacucugacagacgaucuuuuugccucucccuuuauuuuauuguuuuuuguuuuuuugagacagggccucacucugucacccaggcuggaaugcaguggcgugaucucagcucacugcaaccucuacauccugggcucaaaugauccucuugccucagcuucacaaguagcuggcauuacaggcaugcaccaccaugucuagcuaauuuuuguauuuuugcagagacaggguuuugccauguugccuaggcuggucuugaacuccuggacucaagcaaucugccugccuuggccucccaaagugcugggauuacaggcaugaaccaccgugcccggccaccucccguacuuuaguucaacaagaaauuaagucuuuaaacaugcauugaguaucugcuccaauccagauccguaacugagcucuucuacauaugugaaauauuaauagauagacuuugcccucucaaggagacuacagcucaauaaagagcuaaaauaagccuaaaaacaauaauguuccuguuuuuuauuuccuuuugccuguuucucuugcagcaaauaaaaagaaagagaaagagcggccagagauuucucucccuucagauuuugaacacacaauucaugucgguuuugaugcugucacaggggaguuuacgguaaguccugggucacagaaaggucuuuagucuuuuagaguucuggcugugcacuguuagauucaacccuuucucaucuuccugaugcuucuaucuuugccugagacccugauuacaauuuucucacguucaugagugggacacuuucaucgccaaaauuguauccagagaagccuuuccaucuccguuccuuaaauaauaaaccucuguuaaaugguaggcuugguagcaggcucuguguggggcacugaucaugcaggaacaacauccuauccuaccauccuggagguauagccuggugaaggagcagacaucuuaagaaaugacuaauucaaugagaaagauauuauaaaagaggcuuguguaaacucugagaguauagagagaaaggaaugacuaauaaaugcaucuuuugcugcuagcaagugucaaaguuagcucugauguucuuucaggcuccccugugacugugccuuccuguuagucuugcaugucucucuuacagggaaugccagagcagugggcccgcuugcuucagacaucaaauaucacuaagucggagcagaagaaaaacccgcaggcuguucuggauguguuggaguuuuacaacucgaagaagacauccaacagccagaaauacaugagcuuuacagguaugagaacugcguccagggcagucucagcaagagaugguuuuaaucugggugggaaagcucacaugccuauuagucugggaugagagaagaaaguaguggaaagaguggaaguggcacuuuaacguggaauuuuggaauuugacagccaagaugauggacuuugcaucaaacuugagucuucacucugucacugcacacguuuuuuuaaaaauagcaugguauuauauagagagaacacagguuuuaugcuagaaggucuagauucugaccuuuacuagguucuaccagucacuucauuucuuugcaucucaaaaugggaauuccuaucucaagaggcuguagugagaaaugguugggcgcagugccucacgccuguaaucccaacacuuugggaggccaaggcaagaggaucgcuugaggucaggaguucgagaccagucugggcaacguggcaaaacccugucucuacaaaaaauacaaaaauuagccgggugugguggugcaucccuguggucccagcuacuugggaagcugaggagaagggaucacuugagccugggagguggaguugcagugagcaaggaucacaccacuacacuccagccugggcaacagagugagacccugucucaaaaaaaagagguuauagugagaaauaagugagcugauugaugugagaguucuuuauaaguuguaaaacaucaccauagaaauguagcuaucauugucaucauuauuguuaauauuauuauuaguuauuuaauaacauuaauguaugucuuccucagggaacuaauuuuuauuaguuaaaugaaaaacaggccaauaaagaauaaguuucuuuagauguacccucgguagaagggacuauauuuuucagaguguuuuuaauagcagaauugggauuagaacccaggucuccuaauuccuguaacaucaccuuuugaauuuacuacuugccccuaauaauguuauuuggaggcucuccuuccacagcggaccagcuuuccauuguuuugcaggugugagaaccaaagaaggccuuucuaauaugcuaaauuaauagugggcuaaucuuuuaauuucuaggcucuuuacucauguugccuccuucaaauggcaguauuguugggaaggugagaaccaggaugaacuagugaauuuugaaggaugcuuuccccagccaguaucuggcuuguuucaagggcacagaugguggagaugacaggcugcagcuucacucaugcugcuaugguggugcccaggagagggccaugcaugugcccagcaguauuuccuuccucucgucuggccccgcugagucugucucacuuacuccauugagggacugagucauuucaaggaggaauugggcuggagggcuacugagugggaaaguuuucuagucaggaaauuagaguuuguguuuaaggaacuugucauggaaacaucagguuagaggcugucuuugaaaaccucaguggccaagucuuugcaaggaucuuuccugcauguauguauguaaauaugugcuaguggcauguaaauguguauguaaacagagacauagcccuguggguuugcauauauuuggaauuaaagccuacuuaaguauucaugaacaaagauaaaguccacucagguauucaugaacgaacauauguauaaauauaaacauucagguaauuauguguauguucauucaugcaugcacauaugaauaauauugaguguauauguacagauacguguguacaucuacuuuuguauguauaaauuugugcacauguauauauauguaugcaagaauuuuaauuuucuauaaguugaagacuagggccaacucuaggcaaaauugcauauuugguauagguuuuuuuaagugucauaucucuccuuucccuauuuaccauccucuuauacuauuaguuaugauaauacuaccucauuuguauaugcucacaugugaauuaccucaugugauucuuuugcuggaguccuguggugugaucuuggcucacugcagccugugccuccugggcucaggugauucuccugccucagccuccugaguaacugggacugcaggcaugcaccaccacccccagcuaauuuuuguguuuuaauagagacaguucaccauguuggccaggcuggucuggaacuccugaccucaagugaccugcucaccuuggcuucccacaguucugggauuacuggugugagccacugagccuggcucccucaugugauucuuaugauggccuuagauuggcagggcaaggacuauuaugcucauuuuauauacucaaagaaauuaauuaggcucagagaaguuaaaugacauaccccaagugacucagcugauacaugauggaaauguauuuuaaguugggccuuuaacuccuuugcugccuauaaccgaagcacaaucuuccaugcuaauuuuuuugucaaguauuucuauuuuuucaacacuuaauuuuuuuuuuuuuuuuuuugagauggagucucacucugucacccaggcuggagugcagcagcgcgaucucggcucacugcaacaucugccuccuggguucaugcaauucuucugccucagccucccagguagcugggacuacaggugcaugccacuaugccuggcuaauuuuuguauuuguaguagagaugggguuucaccauauuggccaggcuggucuugaccuauugaccucaugauccacccaccuuggccucccaaagugcugggauuacaggcgugagccaugugccuggcaacacuuaauuuuuuauaccuguuaguagcuaauguaauagggaaaaaguagacuagauugacaacucaacugggucuuagcccuauuuugccacugacuuacgugaccuugaaccaaucuuuuuccuuuucugcaccucauuuugcucaucuguaaaaugaaagugcuggaagcacuuucuguuccaucauucugugcuuuggaauuugauuuugauauauagaaguucaucaccuuuaaagggaguguuuacuuauuuuuauaugacauaacaaguaugccuauuaccaaaauacccaaucuucaaaaauacuagcaguacguaaaguuggggguagugcagugaaggcauaguguuguacucugccaaaguugauagucuauagucuuuuggacaagaaaaaacaaacgaauuauguuuaaaguauauccugaauuuauuucuccagaauacugcuagcuauucuggauuuguuauaagaacaaguugucagagcuugccuuauuuccugcuuuguggguucaugauuugcuguagugucaaagaagcuguaucuagcacuuuuuuacaugauggaauuggaauuguacauucucugggcuugguucuuggugaggaauauauuggauuugguagaauauuuccccuccuuaauucuauuaguggugaauuggcagucaguuuuucuuggacccaggggaauuaaagaacaaaacugaagacauuaccuggucuuuaaacuuacuuucuuccuaagaucuccauugggucucucuuucaaauuuuaugaagucuaagauaccacugauuguaagauguacaauuauuugcauaccaaucaaagaaaauaaagcugccaauuaaaccauaacaugcuuuagaaaguaggacacaccucuguuucagagacguuaaugugaaaaaauguacaucucagaaucagugaaacaugguaauugcuucauugagggagcuugauucuauucuuggaaaacaagacccuaccuuuaauuagacuugacaggaucaauaccucucuuuuccucaaccuuaguccuuuuguccuugugggcaguagauauggauauagaaggauccuuuaugaaagcugaaacuggagacuggccauguuuuggcauggaugacucaggauggugcuauggauucuuuccuuuucuuuuagaaugcagauuuucuuggccauuuaagccugacagugauauagcugaugauguggauacaguucuagcguaguauuuagaaugagaccagaauucaaaucuaauuccucucuuuaaccuguguguacccugggcaaauaacagucaugugccacaacaacagaccgcauauacaaugguggucugauaauuaauauuauaagggaguugaaaaauucuuaucaccuagugauuccugaaguuuaaaauaaauuuagcauagccuaaguguacacugguaauguccuacuuaggccuucacauuuacucaucacucacucacugacucacccagagcaacuuccaguccugcaggcucuauuuaugguaagugcucauauagguguauccuuuuauuuaccuuguaaaccauauuuuuuauuguaccuuuucuauguuuagauauacaaauacuuaccguuguguuacaguugccugcaguaacgugcuguacagguuuguagccuagaaagcaauaggcuauacaauauagcccagguauguagcaggcuauaccgucuagguuuguguaaguacacucuaugauguucacauaaugaccaaauuaccugaugacacauuucacagaacauaccccauugcuaagccacacccaacuguacuuaacaucucugaacuuguuuccaaaucaauaaaaguagauauaauaauaguacucagagccauaaugaggauuaaagaaggugauauguauaaugcauuuagcaugauaucuagccuguaguaccagucauacuauuacuauucucugaaucuggcacgugcuugaccagauagacuucuuuugcuguccagaaaaauuuaacuguaacuguuauugacuaagucccuuguuuuucuuccugugcagauaagucagcugaggauuacaauucuucuaaugccuugguaagucuuuauuuacucuauuuugaugugggcagauguggagguaaggaucaagacagugugguagaggcagagccugagcugggaggcacucauauuagucacuccugcacccuuggccucagaauuccuaucuauccaauaaagaaauuagauauaauaaauaggggguaucccuuucagcuuuaauguccuagaaauucuuucuuugugauaauuuuuuuauuuuuaauuuuuauggauucauaauagucguaaaauguucuagaaauucuaauuuuggaaccagaagguauggcuuuagacucaguuuuaauuuguagcuuugaaccuugggaaagucaguuugccucuuugagcuucaauuucuucaucaauaaaaugaggaugauacacugugcccucaccuggacaugucuucagauaccuacacuuagaagaaaauuuccucuuuggucuauggagucugcaaaaccaagauuaguacuaauuguugaagggagcagauuuuauucauuuaaagucauucauucuguccucugaaguuguaaugaaugcuuugacacucaaauggauguuauagaaaucaugaagaauuggcuggagaguaaacuagaugaucucucugucucucuuaacuuacaaauucuauuucccagggcacuuacagggauaaaaugugauguugauguauuugaaaggguccuauaaauaguaaaaugugaugcauauaagagaauacugcuuuuuuuuuuuuuuuuuuuuaaagagacgagguuuugcucuguugcccaggcgggagugcaauggugugaucauagcucaguguaaacucaaacuccugggcucaaaugaugcuccugccccagcccucugaauagcugggacuacagguauaagccaucacacucagcuuauugagugugaugucaaauugucagacagacaauuuuuuaaaaguuuugguagagaugugguucucauuauguguucucaaacuccuggcuucaagugauccuccugccucgaccucccaaaguguuaggauuacaggugugagccaccacaccugguugcuauuuauuuuuuacaucugauguugucucuuguacauaggugguuaugccauauugauuuacuaaacauuugcaaaagcccuaguuuauccuaugccaaguccggugugaauaagugacauuacagagauggucagacaugucccaguaccuaagaaccucccagucuugagguugaagaccucaagcagccaguucuucaugauuccuguuugugcuugaaggcacagacagacaauuauagugcagcaugcuaaccuucaugaagccaggggcugucucugacuuguuaauuguuauauccuuggcaucuggcaagucuuggcauuugguaaacauuuacugaaugaaagguuggaugugucagagaaagcuuccugaugguaaagucugagcugaaugaguuaguuaucuagagcagggauuaaggggaaaugcggguauuccacacagaaagagaauagcauguaugugggcaaggaaguucaugaggcauacuugcacagggaacugcgaagugguuaugacuagaaugugaauagugaaggaaguagaggugggugaugaggaggauugguaagcaggacagaucauguaggaguuugacuuaucuuaaaggugaugagacgcuuaaagaacuuaagcagaagagugguuaaguucuaacacaauaccgagucaccaucaaaauacuuugaaccaugcuuccaccaguggggacugguuuauucggagucauuuuuacacauauugauuauaaaaaacaauauucacacguucagugccuugcaaccuguuggauccuuucuuacugacucucugaauccucacaggagcuuacugagguaaguuauuauccuuguagaugauaaaacugaaauggaaaagaguuaauggcaauaggcaucugauucccagccuauacugcuuuccccugauuugugcugccuuucaucaaauagaagagaugugauuaaaagaugggaaagaauuugcaaauauaggaucuuugaauaguaaauuauuaaagaagaggcuuuaagccgaauugugcuuuguggcucaaaugucuuuaugcuuuuguaggaagagugauagcuaucaauauugagugccugcgaugcacgguguuaaaaacuuuauguaagcaugauuagccucacaauuacuuauguacaaaguauugucaucuccauuucauaggcagaaaaacagaguuuccugaagacuuauaauuagaaccacauuacaacugagucuugugaaucucaguuuaggguucuuuucacuguggcaaggaacaaaaaaagaugucauugaggucuuauaaaggagacugcaguaaagcuguagcuauguuguuuguuauugaggaggaagagcccugggguucaugccauauggcagggaggauaacaccugcuugguaaaaacuuguacugguuuaguaucuacaauuaaaaccacuaaggcugucaaggacauuguucuccccuaguucagaacauuuguccagcacuagcucagugcucuauauauccuuacuaguuuuacauggaggauauguuuuguauuaugguagcaugucauuauuuuccauguugguuucaaacagaugauuccacuugugaaauaaucaaauauaauugcugccuaagaaauuaagacucagaaagauuaagugacucacucccuacguuugaaugaguuaguaguagaaaccagcacaaaauucugcucuccugagcauucauguauucacucauacccuaaauauugacuuaguaucuucuuuaugccaaaauacaagugacacaaaaaugaacgugcacugucuuaauccuugagaaaaaaaauuaaugacagacuggggagauaagggcugcaagagaggcaugaauaauguacaauaggguuauauuugauggagugauuuauucugcucugaaguacaaggaaguuugcagaguucuugggccuuaaagcuuuguucguuuaacaaacauaaucuuaaagucccuuuuagcucuaaauucuguuaucugugguucacuggucugagaucugacucuaagauuccauggcauuuuaaugccugauucucauuuauaaaaugaauaguuaccacaugauaaguucuuugggugcugagaagucaaggacuaguaagaucucugcucuuggucucacaauuuuugugaugaaucagaacauguaaacaaggauuuauaauauaguguuaaguaagcaucagguaaugauaccaggcagagaaaaaggcagugcuuuccugucugauggacagcaugaacaaaaguuggguuaaggauccaguauguuaggccagagagcuuggacuuugugcuggagcugagggacuauuuuaaguagaagauugauguaguuggauaugugaugucuaaacuaacaucuuagauuucuuuggaaauuggaucaagauaguaaacugaauucaugugcccaucucucuugcuaucucaaauuucuuaauuucagaaaagauuucuuaaaaaccaaauuaaaagcaaugcucugaaacaaaagcaugacauaaaucaacuguugugaggaauucauggaagauagaaagcagaaaaggucagauugaucagagcagaagaagccacagcuuaaaguauguguaagagaagaugccuaggaaaaugaaaguagcuccagagaaaaugggcugaaagaauauauacaagaagcaggaaagagucaugggucaucuucaaggguaaauuaauuuaauucuaccuuugaaacaguaggggcagccuccuccuuacagugaacaaaaggcagcaggugcauuugauucuaagcuaaaaucagcuaauuuucugaagaaaguaaacugccuacuugaggaaagcucuugcuguggguauaggggccucagagagaaacagaggaaccugaguuaacugcaaaauucuaccgcagauauaaagaaaaggaaacaggagaaguagcucugcagugaaggaaaauacauuaaaguuuuccaucccaagaguaaauuucucauacuuuugauaccugggaggaggggaaucucuacuuuuccaugccuacauacccuaaaguaacacuugccaauaaccaucuaucuauaacucacaaacagaucguaucagaccucccauucagaguaggacaguggaaaaacagacuuacauaaguuucagaaaaacuaaugcuaauuacauacacuaaucuauccuucacuuauaaauaugaaugaauagcuaaggaucugcagacauuugagagaaacacaacauuaaagagaggaaccaagauaaggaaggaaaauuagccccagaggaaguagauaagucaggaaauaacuuuuaaaaaaaucuaguauuuucagagaggaucuguagauguuucaucuacaaaaacacccugcuauuagagcaaucagaggaggaaagaauguucuuaguauuaaaaacauaagacauaaauuuauggcugggugcggugcucacaccuguaaucccagcacuuugggaggcugaggcggguggaucaccugaggucaggaguucgagaccagccuggccaacauggugaaaccccaucucuacuaaaaauauaaaaauuagcuagguguggggguauaugccuguaaucccagcuacuugggaggcugaggcaggauaaucacuugaaccugggaggcagagguugcagugagcugagauuaugccacugcccuccaaccugggugacgaagcgagacuccaucucaaaaaaaaaaaaaaaaaaaaagaaauguauaagguuuaaacaacaaaugcauauaagugaauagggaauuaauaauauaaaauauaaaagauagaaaauuugagaauaaaugacaauagaggguuggucagggggauucaagcauaagcagagaacagaggcaguagaguaaaaaaauaaagaaaaaauagaagaaaaaauucccagcugaagaaaggcaugagucuucagaugaagggccuguuaaugaccaagucagauaauugaaaagagauccaagaauaaagagaaaaaucuuaaaagccuccaaagagaauauaguucauguccaaaggaacauuagcaucagacaucucauuagaaauaguggaaaaaacagcaguaucuucagagggaugaggcaaauuguuuagaaccaagaauuuuguaccuaaucaaacuaacauuuaacuauaaggugucaauauaaagguauguuuggacaugugaagaucaagguuuaccacccacagaucacuucugaaaggcuaaauaccaaauaguaacaucaauuaccucugggguuaauggugauuaagaauacucacuuaaaaguauuuuuaccggccaggcgcgguggcucacgccuguaauacaaaaaaauuagcugggcuugguguugugugccuguaaucccagcuacucaggaggccgaggcaaaagaaucacuugaaccagggaggcagacguugcagugagccgagaucaugccacugcacuccagccugggccgcagagugggacuguaucucaaaaaaaaaauaaauaaaaaauauuauuauccagguauuugauuaaaaagucaaguaggacuuguaauaaguagcucucauucugggaucuuccuucaccauugucuuggcaaucccuuugcauuuuuguguugguauuccuauuuuuucuaugccacgccuacauuauuuuuuguuuacuuuugaauuugguggagcauauccucuaguagcuuuaagaaaguaaauggaaaguaaacauuuaauaauaccuuucaggucucaaaauggggcguucucuaugcuacccucacguuuaauuaauacuucagcugcuuauagaauugcagguuacacauauuuuuucaucagaauuuggaaaacauuacacuuuugucaucuagcuuucgguacugcuaaguccaaagccauuuuauuuauccuucucuguaugugaccaaucuuuuuuucuacucagaaagcuuguagggucgucuuugucaccauugcuuagaaauuucacaauuauauuccuauuuacaucuauuuauacugcagggagcuuugugaacucuuucggccuggaaacucugcccucaguucuaggaaauugcuugaauuauuuuguugaugauuucuuccccuugcuucuuuuguuaucucuucauggaaccuccaucauuuagaucuuggaccuuuuuguuuguuuguuuguuuugagacggagucucguucugucaccaggcuggagugcagcggcgugaucucagcucacugcaaccuccgcuucccgguucaagcaauuccucugccucagcuucccuaguagcugggacugcaggcacgcaccaccaugccaggcuaauuuuuuuuuguauauuaguagagacgggguuucaccauguuggccaggaugauuucgaucuccugagguugugaucugcccgccucagccucccagagugcugggauuacaggcgugagccaccacgcccagcccuagaucuuggaccucuuaaacuaauucuccauuuuuuaaaggauuuucucucuuuuccuugcguugguuuuuauucugaagaauuaggagacuuccucaacuucaucuuucagucaauuuaauuuuucauuucuauucucauguuuaauuuucaaucacuuuuuuauuuuaagaaaauauauagcauucuuguuuccagaauugauauauuuucuuaucucuaaggaagguaaugauaggcuuucuuuggauguuuuuuccuuccuguuuagucuguuuuuuccagguggcccuuugccucauuuguuuugguuucacacuuuuauguuagagguuuuccuugcguauucagaggucugcucauauuuaugauugggguaguaaaaagcucacuagaauuuuaagcucauuggugguggacaauucaauacuuuuaauaaauuuauagaguugugccgccaucaccugaaaaaguucccuagugcccuuuuaccauucauucaaacucccaugcucagcccuaggaaaccacugaucugcuucuggucuuuauaaauuugucuuucuagacauuuuauauaaauaaacucauacaacauguagucuuuuguguuuugcuucuuuuacuuagcuuugaacuuuauguuguaacauguaucaguaugguguauuucauuucuuguuauguccaaaucauauucccuuguauggauacacuacauuuuauuuaucuucucaucaguugauguguacuuggguuguuccuacuuuuuggucauuaugaauaaugcaguuaugaacauucacauacaagguuuuguguggucucauuucuucagaguauauaccaaggaauggaacugcuggggcaugugguuaacuuuauguuuaaccuuuugaggaacugccagacuuuuuuccacagugcuggcaccauuuuauauucccacuagcaauuaaugaggguuccaguuucugccuaucuuugccugucccuguuguugucugucuuuuuauuguagucauuuuagugggugugaagugguaucucauugugauuuuauuggauuuccuaauggauaaugauguugagcaucuuuucaugugcuuauuggccauuuauauacaaucuacuucacauuaacaguaacugaaauccaguaaaauauguaaacuuugccccaguauauuuucauucccugccccuucuuuauucuauuacugccauucuuucauauacaugaauguguaugaaucuguauguguauaugugugugugcacguguacguacuguauauauuggaagccuaacaauugcuuuauacaauuauguuuuuuaaagaagucaauggaagaaauaacaaaaaguauuuuuuuagagucuuccauguuaaucuacauauuuaccguuuccucugcucuccauuauuacuuguggauuugaguuacuauuugguauuacuucguuucagucugaugggcuucuuugaguauuucuuguaaaucaggucugauagcaauaaauucucuuucucuuuguuaaucuggaaugucuuuauuucgucuucauuuugaaggauaguuuuguuggguauagauuucuugacuggcaauuuuuaaaaauuucagcuguuugaauaugucaucccacugccuuuugaccuccauuuuuucugaucagaaguuuuuguuuugauuuuuaaaauacucugaucagcagucagcuguuaauuauacugacuggccuuguacaugaugucaguuuucucugguugcuuuaaauauuuucauguugacuuuagcuuuuggcagucugacugugcguuuagguguuauuuuuuuuuuuuucuuuuucuuuuucugagacggagucucgcucugucgcccaggcuggaguacaguggugcgaucuugguucacugcaaccucugccuccugaguucaggcgauucucuugccucagccgcccgaguagcugggauuucaggugcaugccaccacagccagcuaauuuuuguauuuuuaguagagaugggguuucaccauauuggccaggcuggucccaaacuccugaccucaagugauccgccugccucagccucccaaagugcugggauuacaggcaugagccaccgcucccagccaggugugaaucuuuuuguguuuuccuacuuugggauuuaucgagguucuuggaucuguaguuuaauguuuuuaucaaauuuaggaaguuuuauccuuauuucuuuaaauauuuuuucugugucuuuuuuuuuucuuccucagagacucucauuauauguaugcuggugugcuuuauguuguuccacagcucuuugaugcucuguuuuuuucuuuaauuuuuuuuuaccucaguucuuuauauuagauaauggcuauggguccauuuucuuuuuucuuuuuucuuuuuuuuuuuuuuuuugagacagagucuugcucugucacccaggcuggagugcaguggcacaaucucagcucacugcaaccucugccuccugaguucaagcgauucuccugccucacccucuugaguaacugggacaacaggcacgugccaccgcacccagcuaauuuuauuuuuauauuuuuaguagagaugggguuucaccauauuggccaggcuggucucgaacuccugacuucgugauccgcccaccuuggccucccaaagugcuaggauuacaggugugagccaccgcuccccaccuccauuuucaaauucauugauucuucugccauauagaaucccuuguuuagcucucuggugaguuuuucauuuguuauuuuauucuucaacuguaguauuuccauuugguucauuugaaguaaugucuacugagaauuucacucguuguuaggcuuucuuaaaacucuuuaaacaugguuucuuuuaguuuuuugaauguauuuauaucugaguugaaaucuuuauucucuaaagccaacauuuggggacauucagaguuccuguugauugcuuuuuucccccuaggucgugcuuuccuguuucuuuccaugucuuauaauuucuuguugaaaauucaauauuuagauaauauucuguaccaauucuggauacugauagcccccucccccaaaaaaguugcuagcuuuuuuauuuguugguuuuguauuaucuuacuagggauaaaucugugacauagucucugucuguggucauugaugucauugcucaguguuuguuguuuuuuuguuuguuuuuguggugguuuuguuguuguuguuuuguuuuguugcagccuggcuuuccagagauugcuucuauguuugcuuagcugaaucuuuagccaaugauuugacacagauggugcucaaaaacuucaacucuguaaggcuucuuuccucuguugauggaucuauguguagguaggggaguacauuuacuguuuaggccuuuuucaagucuguuccagcuuuuacuuuauguugggcucuuuugaaucuuuuauguguaugcacauagccaggcaugugugacuagcaugaggcuuuucuagcgucugcugugccugugaacagccuuagccagaaauuaguuugcccuacucaggacuguagcuucaggcuaauagagcugaauaguugacccucugccgcuaccaccuuuggaagucacuuccaaugacagugccacugggccugggcauugcccauaucuccagcacaaagugaauguucuuggacuaugcaguuauacccuggucugcccugauggaacccccacacuucuggaguuggggcucggauggaugggaacaucccuugcccagaaugccagagauucuauuuuuaacccaaaguucaggaguuuaucagucauaagcacuucucaauauuuuguugaccuuuguuggauuuccagggaacugaaaugguuuuugucaauuuuguccagauuuauaguugcuuguuggggagaggauuugccagucuucucucucugccauaccuggcagucugcuuauaauauuuuuaaaaagauaaaggacagauuauucugggcuguaauaaaagaugcauuagagaaggcaagacuggggucccaaaaagcaaugaggaagacuuguaaaggauugguaaagguaagagaauauggugccuaagugaaagcagugguuaugaggcuaaggaacagaagguuuaauggaaagaacuuuuugaauccugauacgguuuauuuuccuuuuuaucauacugcuucucauggagggaguggggaaaggauuuuauguuuagucagguaucaauccuuggucucccuaucccaaggaaaaguaucaaguugaucuuguagggugagcauagucuuccuacugggacagaaugcuuagugagcacacccuggcuaccaucucaucuccucucuggguuggguugucacauuucaguggccauuuucaaucuguuugcauuauaucauuccgagcugcccagagccuugaguuuugauuccaguaccuagucauuuucuucuucacuauuuuccuugaccuuaaaacuucuauuugaucaggcagcagccacccaaaauuuccuuaggauauagucuuauccuugacugucuuagcugaaccuuggagccuucccaaggugguuuuuaacuggccuguuaaaaaccugaccuguugagagcugguuuugaucauguugaagauauaauaaagcaaacaagcuuuuauaggauaugaaaaaaaccaucagacccacuaauuuuuacuguagaauguaggcuaaugguuuaagucaguuaauaguacaguucuucgccauuuuggcaucuuccuucacaauccuguucccauuaucuccacuuuuucaauuacugagugccccaucauuuagauauuucauuccaguuuauacuacuauuggauaagacauauucauuuagcaauccuauacugagcacuuucuaaucaucuggccaacaucauuaucauagcuaauauuugaguauuuuaaaaaugaauuuuacauagcuuuaucucauuuaaccucacacuaacacuaaaguaaguacuaauacaggcuguauuucauaacugaggaaagugagagaauuaauaucuuacgcagaacucauaguuuguaagugauaaaggcgugauuugauccuaagcuaguugauuccaaaauguugguuuuuaaguauuauucuauccugccugauaaaacagacaguucaacauaaaaccuuaauuggagagaauuauaaaguagccagugauauuguguuaguaauucuaaugaagaagaaaaagaaaaaagaaaaucaaacuaaaaauugguaucaguggaaaaguacauaaaguauauuccaacagaggacguuugagaucugucacuagaagaacaauugaggaaguugcaagaagaacgaacuuacaaaguaguuacaaagaaguuuccaguguauuuauuccuuauugucaacugguuauaugcuaagaauauacaccuuuaagcaaaugcccaaauugcaaggauauaauccaggguacuauucauacauuucuguaauaaagaaaacccaaaccgguggauaaauuuauauagaaacaccuuuaaaauauuguugaacaauugaugcuaucugaaguuaguaaccuuaaauuaguaacauuaguaaucuuaaauuaguaacauuuguguucuacaguguuuugguucuaguaucuuguuuucaaaaaaguagacaguaucacagauuauauuuaauauucuugccuauuugcaguagaaaacuugccugugaugaauauuuuuguauuuaaggcaguggagaugguauauuaguauauauguaugaacauaugaugaauaaaagugcuauucauacaacauuucaggaaguaauaaauuugguacucuuucuaaaagcuuugaguacucuaucagacuauacuuuaaaagaacugagaaccaagaacccuugaguuuguuagaguuauaggugcaaauuuucuuuggugcuuuucacuauuuuguuauaaaauaggaauuuguauuuuauugccauugauuaaaaaaaccuuuucucuaauuugugagaaacaucuuaauaaagcacuuuaaaaagaaaaaaaauguauagauuacaucacuguucuacucacaguccuccagugguuucuuauucuaggucuaaacuccagaguuuuuauuaccgccucucugacuuuacauaaucugauucccagcuaacuuucugaccuuguuucuuuccuuacuuccccuuacuaacuuuguuacacccacauagguagaauuccuaaggguugugggaacauaccaagcauguuucugucucagagucuuuaacuucuuccaucugcuaggaauauccuuuucucagagagccccguggcuugcucccuuaauucauucaggucacuguuauaugacauuuuauuagagaggcuugccugugccuaucguaucuaaaauaguaucuccccaccuugucaaccaaucucugcuccuauauggagcagacacuuuggugauuguuuuuuacucuauucucuucuagaauguaagucauagaaccagggacuuuaucuguuuuauucuuuauguagccccagagccuagaauggagucuggcacacagugaauggauggauggauggauggcuauauggguagauggaugaugaauuggaaugucuggcuuuuguuugaaacagagauuugugguuauuagacauaaugauaauuuaauugauuccuuacaucucucuagcucuuuaccauuuucagugauuuuaugcucacuuugccucauuuaauccauucaguggccuucugagguaggcagagagcuguagucauuaccccuguuuuauaaauuaaaaaugugagacuuaacuuagacccuugcccaaggacacagggcuaagaaguaaaaaucuggguaauaaccuagaccuuucucucucugacagauguuaauaucacugcccaaagcuaucaccuauggaaaacagaaucuuuuacugaggaagguguugaaauccccuucucuacaguuuuauaaagcaaacaaaccuaguguuuacaguauacaucaggggagcuccagggcuaccugaugaugaagagccuugcugagucaacuguauucccacauuagguuuuuaguuaaauuuuguugaguggaauaguggggagaaaauaaauuagagcagaaaaauaucgaaauacauauuuugacagggaaaggaccucuauugaguuuuggaacuuaaagcgauuuaaggucaucuuucaaauuauaacacuccucuuccuucacauuccucaggugauuaaacuucaaaccaagaggacagauuuauugccuauggucaccacaacugcuuauauaugcccggcacugucaguuuuuaacuuaugcuuugugcuggaggcccuguuaaaaucuaugccaguuuuucuuacuuuaguaugucaaaugugguaaaagacagucucccacagucaguaccucuaguauauuauuccuuaguucuuccauuuaucccguuauucugacucuggaccuuccucuuaggaggcuccaggugucaggcaggaggggcucucauccugucuaucuccuauaccagauggucacuacuuuaggacauggaccaucuuuuucaucuuuguacauuuaugucaacaguaccuaucacagucuuacugagcacaaaguaggugcucugaaaauaccugaaacuguugaauuauaucaguauauauuaaaagauccccauugccucuccaguucuuugcugaucaaaugauagaaucauuugguaucuaucaaaaaucucauauuuuggaggcauuuugucucuuaauucuguguaauaaacaguaaugguaugcuauuuuugccuggaccugcccuaaaaccugccacucuuggcccagcucucuuauaguuugcauggggaaaucagguugucacagauuguaagcagaucuaauuagugguaaguuccauuccaggguagggcagaaacuuagggaaauaguauccagucuggggagaaauucauuguucucuuuagauaacaugauccugaugcugauguucuuuaucuucagguugaggugaggaccccugguaauguaauggguucaggagauuuuugcaaagagaggaaaagggcagggcaaaagccuguuuagacugccauuuaccauaucaggagagaguaagaaauuauagugaugaauuuugaaaaauuagaaacuuuugaucucuucccuacauuucauacuuuauuuccuguucaguguggagagaaaaauucauagaauaagaagguacugugagcuugucuucagggguuggguugggggagaggcagguagaaaagcuguaagcuagcuucccauucacagcuaggcuuugagugggagaaggaagccccaagggacugaguggauagugauggcuaaaagaagagggagaaacagauugagcuucugagacuagcuacacaaaggugagagcuuggaggcuaauguguauuucagaagggauaucaggaugggguuucucgugggagguuuggugauccugauaguuaaguuccauggcagcuggaccagaugcaucuugcuuuucuucuuugcacagaaugugaaggcugugucugagacuccugcagugccaccaguuucagaagaugaggaugaugaugaugaugaugcuaccccaccaccagugauugcuccacgcccagagcacacaaaaucugugagucuuuggggaccuggccaguuuugugauuuauuagaguaaguggggagagggaggaguuggugcugauaccuagaaguuuaauauucugguaggcguccuuagauuuuggagcuggugaaaucacugaacuaccuugacuaaagguacuuucuguaugauuaaagacaaaaaaucauguguuuauuuaucauugguuugcagauagucccaaaguguccuagguaauugauguuuauaccaguccagucucgguucuccacagauaggacaggaagauauauaggauugaugcuacuuagugcaggacuaacauaaauuauuccagucuccagggaagcaacaaauugucuugcuacagaucuuuucuucucuguuaaaugugcaguguucagccucuuagagcauuauugauaauauugaaagacccaagagaauauauaaauacauuagugcuauuaauaugcugggcaucaggagugcauuuugaugccggauguuggcagugauuucuauuuaacuuccuuugagguuccugcaucucugagaauagccauggucccucuaaccuugcuuugaaacaucuagucccugugccuuuuacuuaauuuggcaucacugagcacugaccuaccaucagaugauacucuacuaguguuucuuuguuuaggucuuuuacuaagaugagagcuccauaaugaaggaaccaucuagcacuucugugaucaugaaagaaaaaaaaaagggcuaccucuggaauacagcauucagggagguguucaaacagaaauugguugaaugacuauuggagaugcuguggaggaaauucaaaggaauuauaugaccuauuaggaugagaacuuacaaacagaaucuguggaaucaucucuguaggucacaaaguuaccucaagggaaaaugcgcuucaaaauuggagagucguuaacacugauaugguuuuuuuugguuuguagacauguucauuuaaaacauuuuuuuccccacuaaaccaugaacaccucaaaaaguagaggaaauccauauguauguauuucuagugcuuaacauaguucuuggcaccugcagagguggguaaauaucagaggacaguaaauauugaauuaauuaauuaauugaucuucauagcauuucuuucuaaaaagguauugguaauuccuaauuuauagaagaagcagcugagauuuggagaggugaauugaucugcccagucucuuaguaaacaaaagagccaggauuugaaagcagguaauuaaccccaacuccagguuguuuuccaccauagcacagugguauuuuuguguguacaaaccugugcuaggagccagagaaggagacuauuaaagaaggaaaaggcaagguuucugucuucaaagagauauaucaggacaggcaaaagaggacaaggcauggaaguacagguuuaggugccugggauauaguuugucuacagguacaagaauagaaaauugagaaaucauuaugcuagaguaguaaucaggaaggaagccauugccucugaucucagcgucuuggcuuauugcuguucccacuacuggaauguucucucccauuuccaccuauuaaaagccuguccagucaaaagguagcauggucaagcaguccaaggugcaggauguaguuggcuuuagucucuguggagccauggguuugagucccacuguugccaauggcuuugcaucaucgcagauaaaugaucaucauagauaaaugauccucuaucuuuguagaaaccuauccguccuucaggauccaguugcaggauccuguuuguuuauuuauuccaucaaauauuuaccugaaugcuugcuuucuuuuaguaagugguuagauggaggaacucacggaugaaugacccacauucccuguccuuauacuguuuauggacuaugcaaaagauaauugugauauuuuuaugauaaaaucuguuaaauaccuugaagcaucuccuggggaaaggaaguauaauuuaugaucacuucugaaccucaguaguauauagcuugcuuauuucuuuauaacauguaucacuuucugccuuguaguuaugauuuucucaccuccuuuauaagaaugagagguuggggcagcauuuuguacagggugaggcaacaaauagauucucaguaaauguuuguuauguaaaugaaugaauaggacauuuaauauuuuuaaaagguaaaauuugagugcuuaaugucugcuggggaugagucugauuaccucacauauuaaucaguuuacuccuacagcaaccccaaaagauaguuaucauuauuaucaccauuuuauagaugaggaaacugaaacacagagaaguuaaguaaccugcccaaagucaugcagaagguaagaauaauaagaguugggauuuaaguucaggcagucagguuccagaguccauguucuaaaucaucacacucuacuaccucuugaugaagaacaaaaguaguuccuucccugcaaggguucaggauguaaggagggaguaacucaauagaaguugguguuguacuaguaaugcaaagugcuauuugcauuacuacaggauaugucuuuuaacuuggggaagcauaaaauauuacaaaugaaggggauucuuaccuaauagaauugucuucaacuaauuucuuuuguuacagaauauuucuuuuagcuuggggaauacaggauauuucuuuuagcuuggggaagcauaaaauauuacagaugaaggggauucuuaucuaauagaauugucuuuaacuaauuucuuuugauaguugucuagccucuauugaauaucuuuagugcugagacucucacuucuuuuguuuacagugagaguaaggaaggccauuuuacccagaaugggugggccugggcacagaggaggaguaauauagauuuugacauaagagaaaggaugaguuuauugggguuugcucuguggauguucuaaccucacaucuaggagagguuccccuaugcuaacaaaggcuggucuugccaaaauuuugcacuaauaaugcagguauacacacggucugugauugaaccacuuccugucacuccaacucgggacguggcuacaucucccauuucaccuacugaaaauaacaccacuccaccagaugcuuugacccggaauacugagaagcagaagaagaagccuaaaaugucugaugaggagaucuuggagaaauuacguaaggaauuuguagcuuucugaaccuuucuucguuuuaugacuggucaagcacagagauuugcuggucguaggcuugguccaugcagcuggcuggccaugcuugguaccuuaggcacagacugcuucuccucacccugccccugaaccucccuucccugucucacagcccugguuggauacuauguuaggauggagauguggugagaguguggauagcuuacuuugagggcagggcaucccucaccccuaggcauguauuauagcgaagacaaauaguuuuucucuaaugaauagccuagaaugccauguugagaaagacugaggaccuaguggaaaagggcacugugaucaauuauugauguuuugccauugaccuaggagaagacgcaucugccaucuugguuguaggaaaagagggaagggaaguuaacauuuuaugaaccuauaguauguaucaaaugacaagcaaaauauuuucuugauuuuuuuuaaauuuaauucucuuauuaacccugugaagaaaagcauuaugauccuaauuuuugcaaugaagauaucugaggcucagggaggcuaaauauccugcccaaaaucacgcagcuaaaaagugacauggcugagguuagaacacaguuuuuguuccuguaaguagagcauacugccucuugcugucaaguggaaacuuccauuuuacuuucuuuagcugccagaaauggggguauguuaggguagcuuauuucuguguuucaguaaacugcagaagaauucauguuagaaggaagaacuagguugaucugugggcuuggaagaaucauuugacaagggcuuuaauuuauucacuguaucuacuuacuuccaaaaaggauuugaugugaccgauuuggcgacgucugcaaacuggcauugcuuugugguucucuaguucuuccugauuaauuccuauaugacuuuaaaacaaauuuucacuguuuuaaaaauugcccuuuucuggaucccucauaaaaugacaaaguaagaaaagccacuuaccuagucaucuguuuacuccuguauguagucuuguucucuaaaccagaguuuuuuguuuuguuuuguuuuaacaauaacacuuagaauuaugacuuagaauuaagacuuggccugggaguuaggacacuugaguugaagcuucugcucagccacugacuugugucuuaggcaauuuucuacuguucucuaaaccucauuuuucucauuuuuaaaauagggauguuaauacuugucucauuugcaaaucaaaugagguaauauaugugaaaaguaccaauuccuaguaauuggguauuaauggagagcacauuggaccgggagacuaaaaaugaaacuccuaaucuuagcucugacaccaauuugcugugugaccuugggggggaaguaucuucuucccuucugugggccucaauuucuccaucucuaaaauacaaguuauaaaacccaguggaaaaccucuaugucguugcacuugaaauauucuuuguuguaaaccucuucucuacuuuaucucucuggcuuuuacuuaaaguggaaaucaguccauauaucaccuuucugaaguuuuuccagucuuuuuuuugugugugugugccucuuucuguaccccuuuggcuuuuaucacagcaauuauuauauuuucauggaacuuuaugcuuacuuaucugucuccuccaugaaauugaccuucuugagagcagggacugccuugacugugucauaucucuucauuccuaacacaacauauggcuuggugcguauuaaaugaguaaauauuuacugaauggauuaauuaaaaaaugaaugacuuuuaggaguuuagaaauggaauagcuuacuaugaaucaaagcagucaaggugaugaaacuuuugguugagacuuaugggggaaaagcugagggccuguuuagcaugcuuuuuggcuauuggagguaguucuuuaacccuugccagcuacagggguuggggaaauguggaaccuuuuuuguaucuugauuugggaaaaaaugauucauggucucuguuucuuucaaaggaagcauagugagugugggcgauccuaagaagaaauauacacgguuugagaagauuggacaaggguuaguaggggcauuuucuuucccuggagaaaugacuuuaaagugugugugccggcauauaugauuuugcuuuuuuuuugccucucauaaaccuuguucuucuuucuccacuuuaccccucacccaucuggaguuguuaugugagacugacuugagauuuggcagaauuaugcuuaauaugagagagaugccauuagcugaccauguugcuaaaaauaccccugcagugacagugagagaacgguuuuuuuucuuagcacaaaaccaacuucccaaauuacaacucugcuuuuccggaugaacccuguuuguccuagugcugagauccaccagcacuaauauaaaauggaagacccaaaacuauaaauccuucuacuacugugauaggaccuguuuuucuagguagaugccagaauuuauccuucuugcauucauccuucucuguaucuuauaugcugcccucaguguaaugaauucagcaagucuuaacugaguuccuauugugugcaaggcacuaugaauucagagacaaucucugcuuccaaggaccucaagucaacagaaaaagauaggcaaacaauuguauagucauauguugccuaacaaaggggauauguucugagaagugcauccuuaggcaguuuugucaugugagcgucauagagugaacacaaaacuaaauaguauagccuacuacacaccuaggcuauaugguauagccucuugcuccuaggcuacaagccuguacagcauguuacuguacugaauacuguaggcaauuauaacacaauggugguuguauaucuaaacauagaaaagauacgguaaaaauacagcauaaaagauaaaaaaaagguauauuuauguagggcacuuaacauggauggagcuuguaggacuggaaguugcucuaggugagucagugaguggugagugaaugucgaggccuaggacauuacuguguacgcuacuguagacuuuauaaacccuguacacuuagacuguacauuuauuaaaaaacaaaguaauugugcuaugacguuacaacugcuacaguguuacugggugauaggaauuuuucagcuccaucauaaucuuaugggaccaccaucauaugcgguccaucguugacugaaacgucguuaugugacacaugacugucuuguguuuuuaaaguguuuggcuguuauuuugagugaaagaagcuagauaugaaaaagcagauacugucucauuugauuuauaugaaauucaagaacaggcaaaaguaauauaugauaauagaagucagaauagugguuauuucugggaggaggauguagagugggaauaggcaugaaggaaucuucggggguaaugacuguagugucuuuugaaaguggccauuauuuugagugaaaaaagccagauauaaaagagcagauacuaugucauucuauuuauaugaaauucaagaacaagcaaaacuaauguaugauaauagaagucagaacaguguaguuauuucugggaggaggauguugaguaggaauagucaugagggaaucuuugggggugaucuugguagugaacacauggguguguacauauauaaaaaucaaguuguacacuuaagauuugugcaaauuaaguuauaccucucuauaaaaaaaaaaugagauuucuaaagacccaccaaaagagauaaaauuaaaaagaaacugaaaaagaaaaaugucuggcucucaguguuaguggaaugaaagcauuguugcuaaugaugucauugaaauuuucuuuuuuuuuuuaaauuauacacccaagaauuucugaaaauaaaagauugcauaauauagggagguucuguuuauacagcauucuacaguucacaucuguuauuugcauuuauuguuuaauccucagaacaacucugggcuugaguggaucuuauuuuuuucuaguuccaguguuuuucaaaauagacauacuuuugugaguuugaacugguguaagguauuuaacaccuugagaaaaaaauuauuuugcuuaccucagaguaaugugggaugguauuuccuuuagguagugaaauugagauauuaagaauguagcagaaauguacauggacaagcauaggcaagucagguuucuucucuggacuggaguuucuuccuguaaauuuaaggaagacagauugugaauugaggaccuuuuaccuccagaacuuuugugacuuuuuuuuuuuuuuuaguuacugauauaugagaccuauaaauaggcaacaucugcauaauguucuuuccuugcuuacuugacaggucuguuagugcuaagggaagaaugaaauauuaauuaagcacuuaugcugauguuuccacauugcauaauuuuuaaaauauaacugucacaccaauaugaugaauugguaauauuguaauuuuugcuugcuuuuauuucuccuuuaagaccugaagauuauuauucuuuuggacuuggaauucauaugucuaauuauaugucuauucaaguuagaaauagguauuaagcagugggccuaaguagcuuucuacaacuuuguaaucauggagacaguccccugaggcuugggcauguuuguccuuuaagaauauuacaucuaguaggaucaggaagggauggggauaggaagacagauaccagcuuuauaacagaagauagcuaggggcaggauaaucaggcagugaagaaauaacugccuguacaagucauccaauccuuauuuuauagccaguauguuauagucacaguuucuaggcauguagcuagggucccaacuaaagagugaugauuagggagcuggugaccauaguuucuagcugcaaggcaugcuuacacaugacuuuucccccuggauugaccuggaauuauaaucucagggcuugccuaggaagcagucuuguaauagagcagaauuuuaauuuucuucaaauugcaucauauguaccuaacauauggcauguacagguacaaauauguguuacaaauuacuuaccuacaaauacacaggguuuauggucuuaagcauaaaaugaggguuuuaguuauuuugaauggauuuaguuauuuugaaugaauuauuacuuuccuagcauuauuucugcauuucuuccccccuucucugucuguauauaugaauguguauauacuuaacauacauauguguacacacaugugucaaguggggucauucuuaccuuggggguggggcagagguacccucagaucuucugggagcauguauguuugaaagaguauauuuaauaucauuuuauguuugaaaaaugaaaacuaaaaaccacuuuuauaauacaaacuacagaaaacaaaauucacauauccuguugauggaauaaaugauugaaaaccauuauuuuauuuuaaaggauccaaguguauccuguaauaucagagugggaaggguacuuugagauuagauuauucagugugguucuucaaguuuuuauaguuuuuuacuauuuauaguuuuuuaaaguaaauuuucacuaaagauagcauacauaaguguacaacucaaugaauuuucaaaaagugaacacgccuauguaaccaguacccagauuaagaaaaagaacauuaccgacacccuggaaguccauauuccuuuuugauaaauaaauaagauaugcuggcccacccccaaacacauucugaaauucuccgcagggccccuuucuccccaccugucacccccccaguugaaaaucauagaucuaaucuuaucccuuuuauagaugaagaguuugaagccacaagaaauuagagccacgugccaagggugauggaggagaggagagaagcaagcaggaacaggaaauuaauauauauugagcaucuguuauaugauaugcaguuggcuaaguacuuuacaugaacuaaucaauuuaaauuaucuuguauucucuuauguccacuuuacaaaugaggaaagugaagcucaaagaaguuaaauaacuuucuuaagauccuaccuaguagguacuagguagaaguaccagguuggaauucaggucuccuggccacuagagccuacauucucuguacuaccucuuauagcuucuuaaaugugagaauggaugcugcagggagaggauuauuuuuacugcucuuguuuuugacacucacagauuguguguagaacugcauuugacaaauaucacuuuauugaacacuguguuuuuuucccucuuucuccgccaccuuacuguucagugcuucaggcaccguguacacagcaauggauguggccacaggacaggaggugaguauccaccacccacuguugcuccuuuaguucuguuucuuuuuauuugggauuaauuuuuagcccuuguuaggucaacaggaacaguucuagguuuuuuuuuuuuuuuuugggauggggucucacucugucauccaggcuggagugcaguggcgugaucucugcucacugcagccuccgccuacuagguucaagcaguucuccagccucagccuccugaguagcugggauuauaggaaccugccaccaugccuggcuaauuuuuguauuuuuuaguagaggugagguuucaccauguuagccaggcugcucucgaacuccugaccuuaggugaucuuccugccucggccucccaaagggcuaggauuacaggcaugagccagugugcccagcuggaacauaucuaguuucuuacuguagcauacaaaagccaaauagcaggauaacauuaugaaacuuaagguuuggacuaaggugaaauaguuagauggagggaaguggauggauuugagagauaacuuagcagguagguucaacaggauuagaugauugaaugugaacauuacuuacaagugggugauauuauucaaggagaaaggaaaaagaaauuggauacugccugauugccaaguggauaguugcuuacauaacuuuggggcuugggggagaaaucugaucuacaggagauuuaaaccaugucucuugacuccuaaucuacuggugcuaccuuuacuuuccacugaacagugaaauccucauuuauuuggaggcagcuuuuugucccucucauuucauuaagccaugagaacuauagcuaaagccugcugacccaaggucuuauauucaguagaagaaagauaugaagggaauauagaguacuugagguuuccuugcauuuuaauauuugguugcagaguaggagugucagccaaugaacuguggauggcagcugccccagagaaguucuuacuucaaagaguaccaguacacaauaauugagagaggcaccuccucuuccaaugaaaauagaguugggcuucugugagggaggcugcuagaaacgugcuucuauauuuuuggugguugaaaccacguggcacccuggagaagucaugguuaauagggguagcacauaucucacuaggcucuugugaguuuuuacaaguguuaaagccaaauauuaaggcuccaccuaggguaagccaaguuuuaaaaaucauuauuaugguuaaggauuuauucauuauucuuugaugugagaauccaaagaccuagaugcuuauaagccuuuagcuacuuauauaaccuugggcaagucauuugaccucucugagccugaauuuuauauauuuauaaaaugugcauaauaaaauguccacgaaaguguugaaagaauucaguaaagcaauacaugugaaaaugcauuauaaacuuuaugaacuacauauucauauuuauucauuuuuacucauauacauguguauguauuccacaaagcauuugcuuuaugccacaccuuaugcuaagaauucugugaaaguucacagacauuaaaaucauauguaaauguaagagaccauaauuuccuuuguguacauauaaaagccuuguaauauugacacgaaucugccuuaaaguaaaaauaauggugaggaaggaaggauaauauuaucauggcauuuuaaugauggugaauaugaugcagagauuaaaauaaagaaggcuauaccaauccugaaaagaacucuaugagguagguaauauuauuucuucuuuacugcugaggaauuugaggcucaggguguauagauaacuuuuuuuugcaaaguuguacugucagcaauuaccagggacuggauuagaaucuuugacuccuaauccuguguguuuugggccgcaagagcacaacagagcugagguuagauacuagagucccuucuggccucucaggccucacaguccuugaugggaggcagguaggugaugauggugguuccuggaagcccuggaggcuggcugugugagaagcuggccagaggaaagagaaauuuaaauucauuguaugcgugucuugugguuacaaaacuaugaauggaagggaguccaucaggguggcuaaugcaguguggucaggaaggcuucauuuccugccccagggagaauaaaucuuuauuggaguccaugggaugcucucagucuuugugaguucuugcuuauuggggguuauccagcugagaagggcagaccuagugucucacauauaggaagaauguuagugcugggaagucuuccaguuaacauauccaacaauuauuuuucaaguguguuuuuagagagaauguguacaauagaaagaacagacuggaagaggcuuuggagucacauggaccuguaggcauugauuaugaccuuagaauuuucuuaugagucuuagccucaauuuucuuacugaaaaugcagaucaugauucuuacuuuguaggguugugugugguuagguuuuacugugauaauauaaguacgucaucuagcacagagccuggcacacaguugguauuugauaaacaguagcggugggagaguaguugcugugccaaguacuuauuaaaugcuguuauuacugugauuaccauuuuuguuauugucuaaauuuauugcuuaaauuauuuacuuauaugugaguaaugcauuggccauugucucacuugguauucaaaacaauccugaaaagaggggaaucaagguugagauuaucuucaauguauugaugaagagacugaggcucagagagcuugugauuggucaaggucaguaagugacagucagauccugagcuuaaguccucagaguucaaguccaguucuuuuucuguuacaggaaugcuaucuccuagccuauauagguggggcuuaggugaaggacacuuagccuagcccauaguuaguagcuauugaaaaggacuccuggccaggcgcgguugcucaugccuguaaucccagcacuuugggaggcugaggcaggcagauuacgagaucaggaguucgagaccagccuggccaacguggugaaacccuguuucuacuaaaaauaccaaaauuagcugggugcgauggcagaugccuguaaucccagcuacacgggaggcugaggcaggagaaucacuugaacccugggggcagagguugcagugagcagagauugccauugcacuccagccugggcaacagagcaagacucuguauuaaaagaaaaaguaaaaagaaaaggacucccauguccuucccuagccuccauguuagccucuuucugccucuccuccccugcugcugccagcagugaccacugugugguucguaagcagugucccauccuccaagauggcaugaguaacucaaaagacauucuucuggcuccaguccuuaaugugcguuauaagggcuaacuauacuuaauaucuuuagaucaacauguugcuuuucaaacguuaggaaaaacuaaugcucagcuguuauagacagcugcagccagaccagaagccugaccuaacaggaaaccccacuccaaagcaauuuuuccuuacuugagguagggaauggagguggucagauuuuuuuacagaauuacuucuauucuaaaugauuaaccuggucucugcaagagacuguccauucuugacuugaagaaauaauagagucagggauuugucacauaaaaguuugaaucauuccuucuuuauacuucuugcugcuucuagaaagacaacuuaguucuguuagauguucguguucuuguccacuaagcaggaaaaaggaaaaauaucucuagagaaugaacacuuagaaaauaauuuaaaguauacuucuaugggauagaggagcccauugccauuuuuuuuuuguuuuuauuuaaaaacaaaguacuuuccaaccuacugauuucucucuugccaucuuccuuucuacagacauuuguugagcaccaacucuguguguaaaggccuguguuuggcauugaggguucugggcuuucaaucaagcccucaaaccucucaauacacacaaacauacacacuaaucauuauacaugauagcaaguuguaaguuccauaagagagggauaaauaugaucuuauagggcuuuaaagaagggaaaaggcauauuggguuuggagaaugaaguuuccuuuggccugauacaaaaagaguaaguagcuuuugaauguauggaaaugauacaggcuguuccagaugaagagaagauucugaacaaaggaagggggacuagauaccagggagaacauggaguguucuccaugaacacucuccucugugaaggaauagaguuggaaguaaaguaggggccagaucaugagaacuuugaauguuguacugagaagcauuucuaggcaaccaggagccauguaaguuuuugaacaagguuaucaaauguguacugugggggaaaauuaaucuggcuacauguacaggauaacuugacaucccuuuugaggguucuaauccugauuuugcuauugaauagcuauguaugcaagucacauccucucugaaacacaguuuccccgucuguugaaucauuaguaauauuuagcacacaaggugucuuugaagauuaaaugaaauaacaaauuugagaacaccuuauaauaguaccuuacacauagaaggaauugauaccaaguaccuuagaaacuaacguauaccauauauucauguugucuggaaauuuguuuuuauuucuguagauagagcucucauccuccuuuucucuucuuucuuaaccugaucaacucugauuuaucuuucuacgccagguucagaaagucacuucccccuuuaugaagccucuauaccuagccagauugaaagcauucuuggcuuuugccguauuuuauguuucgcuagcauuuuguaugagccucuguuauagcaucucuuuucuguugugacuuuuuaaaaguauuuuucuacaccaaaguuugauucugaaacuuugauguguaucacagugaccuggaggacuuuuuacaucacagagcuucugauuuaguagauuuggggugggacccgagguuuuuauuuccaacaagcucccagaugaugaugaugcuggcuugagaccucacuuugaagaccacuggucuacauagacaaacugugaauuacucgagggcuaagacuguaucuuacucaucuuuguuuccugaguacuuaaggucugguacuuagcaggugcucaauaaaugggaaugacuaugguugcacauugaauauacucuugauuucagguggccauuaagcagaugaaucuucagcagcagcccaagaaagagcugauuauuaaugagauccuggucaugagggaaaacaagaacccaaacauugugaauuacuuggacagguauggaguggugggucccaucagagggaaagggccuuugggacugauugguggugaagcuguuagagaagagggcagugccagcccucagaacugccuccauuuaugagucuucugugaugcugagcucucuguaugugacccuguguaaugcuggacaccuuuuuugcugggaaauccuucuguguuaggcugaacucuaccaccguguagcuucuaacaguugauccucguacuguuuguuuugccuaagggaaaccuaccaacccaucugccugagucaaacaucuagguccuuaacucauuuuacaucccaaaucuuuccuuauucugcucauccuccugaauaacuuguuguuuguuuauguucucuuaaaaugcagugugcagaacuagauguuucauuugagaucugaccacuauggagagagugggacucuuucuaaacucaacacagcuuaaugauuucauucuuguuuuaucuuuuagguugucugcuuugacucccaguaaguuugcagucaacuaaaauuucugauuuuuuuuuuuuuuuuuacguaagcuugcauuaaacuggaaauguggaacuuuuucacuaucuucauuaagucccauuuuuauuauuuuagcccaucauuccagcccaucaaaauuuuuuugcaaaauaguaauagugguuguauauaauauuuguauugugcuuuacuuuguaccaagcacuuucaugaacaguaucucauugugagguaggguuuuuuuauccauauuuuacagacaaggaaacugagguuuauagacguuaauaacuuguccaagaguaguaagccauaaaacagcaaagcaguguuuugaauuugaauauuccuagcaccaauaucuagcaccuuucuauuuuaucauguucuuuucuccgauaccugaaaaaaaaaaaaaguuaagcuucuugcccaggguucagagacaucguagguggaggugaaauuggacuaaaucuuggacucuaauuucuuuaccucuuauauugcaugaccagcuaccucuuccuguuacugguagauuucauaagggcgccuucuuguucugcaucuaaaacacuaguaagcuucaguuuccuuaaagaagaaaagaguugaacuuugacauucccaacacuauaaagaauaaagccuucuucuuugagauggcugugucuccuuaauguggguccugacuggcucugaagaauccucugaaaguuaguaccuuaucaucucuuucagaacuuauuauacagagaauauagcucaugcaaacuacugaaggcgacagggguauuagauuuugguucaggauauggaaaaaugaaagcugucaguaaggguauggccugucucacaaaauggugaguuccccaucaguggaugcaucuacaugauaaaacgauguuauugaaggaauuuguguucugggaguaggauuaagagacuuauagauuuguuuauuaaucauaucuuuaccaguauucccagagacuuuuacucuggaaauuagaaguaaauaaugcuaucuuugcccucaaauaguuccuggucugguauagaaaaaaaaaaaauaccucuguaaggucauggaagaggacauuaaccugagcauucagugaagguguugcaaaugagggucugugguuuuugugagaugucccagaggggaacuccaucacauauggaugaacucaugggcagaacccucaugauguaaucaccuuccaaaggccccaccuccuaauaacauuagugauuagauuuucaacauauaaauuuugagggacacaaacauucagaccauagcaguucaaauccccauagucuucucucucaaaagagauuguugaagaaacacuuagucugucauguuuauuagucaggacauuaaaaaauuauaaaucagaacacagaguuuuauggaaagagcugucgauuaguagucaaaaaaauaggauucaaaucuuacccuugcuugauugcauuuguuaaaaucuuccaacagucuccacaucuguccagcaguauucccaauaucaggaugaagauaagaugauaccacacaguucaagccaaugcaagaaauguuuuuuuccaauccagcuucuuuguccaagacuggcagaagacuuuagggcucuaggcucgccuuguuuuuauuugucugauucuauaguaaggaaacauugaccaaauaggcuaagugaccuuuuuauuuaucguguaauaggguugagugauccaacuccugagugaaacuaucacuucuaacucaugucagcccauaaucucucuggggauaucuuacuaaaugguagucuuggcuuaucagaaggcuuuggcuccauaagcccuugcuaaauucauuccauucuugaaccacagacacucaaaguagaggucaauugucagcauaaugacuauguauacaacacuuugcagcuuuuaaggggcuccuauaaacauuauuucguuuaauauuuauaguuaucuuuuauuuuuucagugauuuauuuaguaaauauuggcaucugcugugcuggacucugaggauagagucuugaacaagacccaauacuuggucucauagaucucagaucugguaggacucucugggagguuuaguagcucucucuucuuuggguaacauggacucuaaauccuaucuuugucaaauguuuggaugcuucuagaggugugggaaucaugucagucuuucuaauuuuaggaugucuuccuuuguguugugaugaaauauaauuuuauuguaucacuucaagcuagagaucuuaguucugcccuuuggggcuucacagaacauguauacuugguuuucuccaggagcauccuugagagauucaaaguuagugauucuguuccccagauucugcuuuuccccaaaguaaagaaccuuuuacuuuacuuugugcuaagacguaguuucacucuguguauaugcuuagccuuugaaacccagugcuauggcucaguguacucugauuguucucucucacccuuuaucuguauuccugcaguuaccucgugggagaugagcuguggguuguuauggaauacuuggcuggaggcuccuugacagauguggugacagaaacuugcauggaugaaggccaaauugcagcugugugccgugagguaaggccaagggccaagcagucuuggguagaaagcugccuccauauuccugucuccugaaguucccuguacagugagaucucagccugggcucuguggaauugguagaaauuagugcugacacugcuaucauuccuguauuguaccuguguuugucauuucuaucaccaugauuuuuuuuuuaacgauaacuuuauucuacccauuguagaaaaauuauaaaguacuagaaaguauauauuguaaaaagucacucauaauuccagucuuagagauaaccacuugccuaagcacguuauaauauauuccuuuaucucuuuuaucugggcauauauuucaaucauuuuuauucugcuuucuugcuuuauuuaugugcuauaaggaaaauaaaacagaguaagaagguagugauggaggaaguacuauuuuagacaagacagucagggaagguuuugcuauagauuugaguaaacaucugaaugauauauaaaagcaagccagcaaaaaucuaggguaaaauacuuccaggaaaauaaaaaaagaaaacaaagcucaaauagauacucccuuucuccucauugcuauuaaaugucuagaauugauaauacgcugauguaggaggaagaaaagcccuccagaaagccuggacaguguccucagggaauaaccacauuucauuuccauuagagcaaaaagaugaagggaauauucagagacauugaggauauuggguguuuugcugaugacagacuggacuuucugauggcccaauaaugcaaaaguaauugcgguuuuugccauuacuuaaaaaaaaaaaaauaccaaaaccacaauugcuuuugcaccaaccuaguagaaaaguuaggaaauuaggggaagcauagaagaugagaugagguucagaauuuuguggagaugaguauaauaguaugauggggguuugauggugcaagagcugaaggcauacugcugaaauuauguaguuauauauuuaaucaguguuaagaaaaauaaaaugugaaaucaauacugcccuagaaaauaaugguccccuuugcaaacaacuuugggaucuagaauguucacaaguaauuggaauuaauuaauggaauuaauaccaggcugggauucuuagggguucugacuuuuuuuuuuguuccacuacuaaugcaguauuucguaaccuucuuuucauuaucuccuucuuaaggaggcuuuuuccuaaucauacucccugccaugaaauuguaauaucacagauauauagcuaagcuguuugggucauaaaccauuguaauaccuaagauuuuuuucaccccacccccuuacccucaggaacgaaguuucacuaguugagaauacaugcauauguauacuuugggaaaucauuuugccucauuauuaaucuguaaaauggaaauugcaacauucacacuauauauaccuuaggggugcuauauggaucaaaaagcacuuggaaaaaaauguuaauguuguauaauagaugguauuacuauucuucaguucuaauagagaucaucuucuccuuuuaaaaaaucuuuauugagauauaauucacccauuuagaguauauaauucacuaguuuuuaguauauucauagaguuguacagccaccaucauaaugaauuuuagauccuuuuuaucaccccaaagaggaaauuaauauccauuaacagucacuccccauguccccugcccugacucucccagcccuauguaaccacuaaucuauuuucuaccucuguaguuucccuguacugggcauuuuauauaaauggaaucauguaauauuugcucuuuuguaauuggcuucuuuuacuuagcuagcauuauguuucaaagauucauccauuuuguagcauguaucaguaccucauuccuuuuuauugccaaguaauagaauggacauuuggguuguuucuguuuucggcuguuauaaaaaauaaaaaauuacucuaugaacacuuauauaccaguuuuuguguggagguauguucucauucucuuggauauauaacuacagguggauugcuggucauauggcaacucuauacucaacuuuugaggaacugccaaacuguuuccguaguagcuguacuguuuuacguuccugccagcaauguaugaggguuccaguuucucaagauaauucuuuuucaucauaauuucugacauccugagaccuguuucuccacccuucuaagaagagcagcucuuacauuuucagggaaaauccaauucuggauauuguuuuauucuuacuuuagccauugguauauucuuagaaaguaaaguauuagguuaggaccauuuaaauaguauuuuccuguucacuuauaucuuuaguguuuuuuaauugguagaaguuucuaaaaaauuaguuuugggucaaugaaaucaaauuauugauuuaguagaaaagcugagaugaucucaucugauucccaaauuuuauagauggaaguccagaauuauauagucaaugggguagcagcagaaccaggcauuuuaauuguaccauugugucucuuuauuacucauucugccugcuaaguauagguguuuuccaagauucuucucuuucuccuuuacccuuugccggguucaaccauuuuuauaacuuaaacaaaaaucaucucuucccaaaugacuuguaaauauuuaccauaauuuaucauaaauuaaguugccuaccagacauuugucuucagauaucaaauucagcauauccaaaauaguacaaaauaucuccucaccaaaauaagauuauccugcuaacuuacugcuucuaguaucacuuccauaugucugcuuccucaaauaugacccuuauuuguuguuuuccucuggucugucauuauaagauccuuuccauuuuucuucaguaauuucucuugggccuuagguccuuuaccaaggaucuaauuagaaaaaaaauuacauuggaggaacuccuuuacuuaaaaaaacuguuuuaaggugaaaggcagcauggaguguuaaaagaauguuuagcuaggagauggaagacuuguuucuagaucuggcucugcgauugauuuggggcaaguccuuuuacucacuggggccuuacuuccuuuauuuuaaagugaagagguugaauuaguggauuuucuauuaagucuucuguauuauauguauguccuuucuuucucccccugcccacaccacuucaauagugucugcaggcucuggaguucuugcauucgaaccaggucauucacagagacaucaagagugacaauauucuguugggaauggauggcucugucaagcuaaguaaguaggagccuuaggaaugauaauacuucucugccuguggggcccugucuccugugagauggucaucauauaauaguaacuacgacacucaccaaagggucuuuaugauuucaugggauaugagggcuguuuuauauuuucuguauuaaucauaggauaucauuucauuauuuuuucauucauuuauacauuuaacaacaaccacaaaaaacuuugcugaaugguuacucugugcuagguccugugaugggcacugagaguaaauuuucccuaccuucucaaucuaguauggaaaacguguaauagauaauuagaaaaaagaguuuuguauaauuucuuucauucaguuauucagcaaacuuuuauugaauguccaguacaugcugguccuucuagggauaugaggacaaguaagaggacauaauccauacucucaaaggcuuccuaauuuaaauaaauuuauaauugcaauauaauguaaaaaccauggcagguagagcauuuuguucaaagguguaaagaccaguagaccagacaaacaggcugugucauggguggaugggcaguuuauggaaggacugcuagcagcccugggucuggggcauaaaaacagggccaugccuagucauaggugauugggguuuaaaucaaggacucgugcccaaggaauaagacaaggaccuagucgccagauuugggauuaugggaaugguuuuucaagaacaaagcagaauugggaugagcaaucaagaccaaaaugggcagcuuggacuuuaacacuaaguccccugguuugaggagaaguaggaggccagagaugguguuucuuauauuccuucuauuucucuucaggguucaauaggaaauaggcuaggagcuagacaugaaggugguagucaagugacuuuggagagacaaaggauagcagagcuggaagccaggcggaucuugucaccuauguguagguacacagucaacacuuacugaagugaguguauauccuaaauguauguucuuucucuuauuuuucuuuucuagcugacuuuggauucugugcacagauaaccccagagcagagcaaacggagcaccaugguaggaaccccauacuggauggcaccagagguugugacacgaaaggccuaugggcccaagguugacaucuggucccugggcaucauggccaucgaaaugauugaaggggagccuccauaccucaaugaaaacccucugagagugaguguuaccaguucuauuucaaguuauuugggcuguugucucuagucccaggaaauaagaauccaggguguucucugugguuuucaaccuggagaucccuuuucuggauacaacuagucacuguugaacuuaaaguauaaauggccaaagaaaaggaauauuagaagucacucauucauuuauucaacaauuauuugagucccugucaagugcaagaaacuauucuaaugaaaauaaaauaaauuaauauguaguaacagaugguaaaugcugugagaaaaagcaaaguaagggaguuaacagaguaauggaggaacaggugugcuauuuuagaguagagagggaaguucucucuuauaaguuauuuuauucugcagaguugggaagucauuagaggguuuugagcugaggaguaaugugaucugauuuauguuuuaaacagaucauuuuggccgcuuuuauggaaaauagacugcgagagacuguuguaauaguucagagugguggugucuugguaggaguggaagugagaaguggucagauucaggaaauuaaaggacuagcugacaagaugaacugaauauuagagaaagaggaaucagcaaugacuacaagauuucuggucugaauugcugaaaaaauucaguugccaucuguugaaauggugaagagcauacuuaaguuggguaauaaagaguugguuuugaaugugcugauuugaaguguuaauuggacauuuaaguggagcuggaguagaguuuggcuuaagagucuggaguucaagggugagaagucaggacuauaaacauaaauuuauuaguagauaauauauaguugguauauauaguagguagaugagaucacucaccuagggaaugaguacaguuaaagaaaagagauuugaguacugagcucuagguuauuccacuguuuacagguuggaagaacuagcaaaguagaccaaggaguggccuuucuagugugagagaacagagaagugucuuggaggugaaguguccuggagaugaagagaacagugugcuucccgaaggaggaggaggguagauuaugugucaaaugugauugauagguuaagaugagacugagaaaugaacauuggauuugccaauguagagguucuuaaugaccuuaauaaucaguuaucaguagagagauggggaugaaagucuaauuaaauucaugaaaguggaagaagaggacauugagauggcauguauaaacagguuuuuuuuucucuuaaaggaauuuugcugggaaggguaacaaaaauggagcacuaucuuaaaauggagucaagggaggguuuuucuaaaagaugaugucugugugcuaaugggaaugauuuaguggagaggaggaaaauggucauguacaagaaggaagugacaaccauagaagugauauccuuaagucgaugagagggguucgaucaaguacugaaguaaaggacauuagauuagcauggacaauuuaucccuuguaacagagcaucucaacacaggugcaaauagguugguaaucuuggugugggcaaaugugaaauuuauucugauugcuuuuauuuucucauuuauucccaccucccauccagugcaggaauucccugugcacuguugcugguagguggucaucuacaugcucaugucauccuugaauaucucugauuauuggaaauugcuucagugcaccaaacugaaacuaccuucuguaguuucuauccuuugaucccagcuuugccucugacuccacauacaacauacucuucccucccuuagaacggccuugcagauauuugaagaugauaauugcugggauauguuggaaauaagacagaaugauccuagacauaggcauauuuuuuuauuuuuuuauuuuuauuuuauuuuuuuuuuugagauggagucucacucugucaccuaggcuggagugcaauggugugaucucagcucaccgcaaccuccaccucccagguucaagcgauucuccugccucagccuccugaguagcugggauuacaggcaccugccaccaugcccagcuaaguuuuguauuuuuaguagagaccacauuucgccauauuggucaggcuguucucgauggucucgaacuccugaccucaggugauccacccaccucagccucccaaagugcugggauuacaggagugagccaccacgcccggcccuagacauaucuuuuuauguuuccggacccuaucugugaagugaagaugauaagucuugcccuauuacccagaguuaauuguggccauuaaauuagacagugcuuauguaaguacucuuugaauuaagugcugagugcuuguaaagauuuagucuuacuguuuuucuuuaccuuucccaggagacgcuucauuuaggggacuaggguggcaacaguuuucacuuacauuuaauauuccuuuccugcuagaagagaucaguucuuggaugacugaggugaaggcaccaggaauaauuucugccagcagcugggcagauguuuaacucaacaggcuaaauggauaauaaacccuucagauguguaagcaagaauaauaauaaagccaggcacagugacucacgccuguaaucccagcacuuugggagguugaggcaggaggaucacuugagucuaggaguuugagaccagccaggccaacaugguaaaaccccgucucuacugaaaauacgaaaagcagucggguguaguggcuggugccuguaaucccagcuacuugggaggcugagucaggagaauugcuugaaccugggagguggagguugcagugagccaagaucgugccacugcacuccagccugggcgacagagcaagacuccaucucaaaaaaaaaaaaaaaaaaaaagaagaagaagaauaaacccuuaggucuguaacauauuucauaaguuuacaaaguacuuucaaauacacuaucuuauuuuauuuuuacagacaugugagaugggcauuaucaucaucccuacuuuacagacagggaaguuguacauagucccauggccuuuaaauguucaaccugauccuuaggucauacucuuuccaguauauauacacagcugcuacuuugcauccuagagcauaaagcagcugaccauauuucuagaacuuguauauggggaacaagagagagccucauuuggagcucaaggugauucaccauuuuuauugccaggccuuguaccucauugccaccaaugggaccccagaacuucagaacccagagaagcugucagcuaucuuccgggacuuucugaaccgcugucucgagauggauguggagaagagagguucagcuaaagagcugcuacagguaacuguccuuaugcagggaagcaccuaauucagggaaucacuaaaccaggccuuuuuuacuucauguuuguaagguacuggauauuauagaacuaggcuucucuucuaccacuuccuacacucacucuguuccuacugcccuuuuaucccugggccuuugcucauuuauuuucuuagccuuucucagccuguuaaaacucuacacguucuccuaggcucaguuuacaaucuauuuucugagcaccuauugagcuuugcuuguagcuuuuuugcuugcuuccuuccuuccuuuccuuucuucuuccuuucccuuuccuucccuuccuuucccuucccuucccuucccuucccuucccuuccuuucccuucccuucccuuuccccccccucuucccucucccccuuccucucacgccccacagggucucacucugucacccaggcaggagugugcaauggcgugauuuugucucacugcagucuuccucuccuggguucacucaagugaucuucccaccucagccucccagguagcucagacuacaggugcacgccaccauaccuggcuaguuuuuuaaaaacuuuuuuguagagacgggguuuugcuauguuggccgugcauggucucaaauuccuggguucaagcgaucugcgcacuucgcuuucccaaagugcugggacuacaggcaugggccaccaugaccagccugcuuguaucuuucauuagcacuuccuuuguucuguuugaauuagucuggcagaguuuguuugagucuuguugagaaacgggucucugacacccaaaucuuacacaacuuauauuuugcugggauuagcucaaaggauacauuuuuagcaaaggaacauaaguuuauuuuauuuuauuuauguuuuauuuuucuuucuuuuuuuuuaauucuuuuuuuuuuacauuuuauuauuauuauacuuuuaaguuuuaggguacaugugcacaacgugcagguuuguuacauauguauacauguaccauguuggugugcuguacccauuaacucgucauuuagcauuagguauaucucuuaaugcuaucccuccacccuccccugaccccacaacagucccgggugugugauguuccccuuccuguguccauguguucucauuguucauuuccuaccuaugagugagaacaugcaguguuugguuuuuuguccuugcaauaguuugcugagaaugaugguuuccaguuucauccaugucccuacaaaggacaugaacucaucauuuuuuauggcugcauaguauuccaugguguauaugugccacauuuucuuaauccagucuaucguuguuggacauuuagguugguuccaagucuuugcuguugugaauagugccacuauaaacauacgugugcaugugucuuuacagcagcaugauuuauaauccuuuggguauauacccaguaaugggauggcugggucaaaugguauuucuaguucuagaucccugaggaauugccacacugacuuccacaaugguugaacuaguuuacacucccaccaacaguguaaaaguguucguauuucuccacauccucuccagcacguguuguuuccugacuuuuuaaugaucgccauucuaacuggugugagaugguaucucauugugguuuugauuugcauuucccugauggccagugaugaugagcauuuuuuauguguuuuuuggcuauguaaaugucuucuuuugagaagugucuguucauauccuucgcccacuuuuugaugggguuguuuguuuuuuucuuguaaauuuguuugaguucguuguagauucuggauauuagcccuuugucagaugaguagguugcaaaaauuuucucccauccuguagguugccuguucacucugauggugguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaucauuuuaggucuaacauuuaagucucuaauccaucuugaauuaauuuuuguauaagguguaaggaagggauccaguuucagcuuucuacauauggcuagccaguuuucccagcaccauuuauuaaauagggaauccuuuccccauugcuuguuuuugucacguuugucaaagaucagauaguuguagauaugcggcguuauuucugagggcucuguucugcuccauuggucuauaucucuguuuugguaccaguaccaugcuguuuugguuacuguagccuuguaguauaguuugaagucagguagugugaugccuccagcuuuguucuuugggcuuaggauugacucggcgaugcgggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccacgaguauggaacguucuuccauuuguuuguauccucuuuuauuucauugagcagugguuuguaguucuccuugaagagguccuucacaucucuuguaaguuggauuccuagguauuuuauucucuuugaagcaauugugaaugggaguucacucaugauuuggcucucuguuugucugucauugguguauaagaaugcuugugauuuuuguacauugauuuuguauccugagacuuagcugaaguugcuuaucagcuugaggagauuuugggcugagaugaugggguuuucuaaauauacaaucaugucaucugcaaacagggacaauuugacuucuuuuuuuccuaauugaaugcccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauaugucccaucaauaccuaauuuauugagaguguuuagcaugaaggguuguugaauuuugucaaaggccuuuucugcaucuauugagauaaucaugugguuuuugucuuuaguucuguuuauaccuuggauuacauuuauugauuugcguauguugaacuggcuuugcaucccagggaugaagcccacuugaucauggcggauaagcuuuuugaugugcugcuggauucgguuugccaguauuuuacugaggauuuuugcaucgauguucaucaaggauauuggcuaaaauucucuuuuuuuguugugucucugccaggcuuugguaucaggaugaugcuggccucauaaaaugaguuagggaggauucccucuuuuucuguugauuggaauaguuucagaaggaaugguaccauuuccuccuuguaccucugguacaauucggcugugaauccaucugguccuggacucuuuuugguugguaagcuauugauuauugccucaauuucagauccuguuauuggucuauucagagauucagcuucuuccugguuuagucuugggaggauguaugugucgaggaauuuauccauuucuucuagauuuucuaguugauuugcauagagguguuuauaguauucucugaugguaguuuguauuucugugggaucgguggugaucuccccuuuaucauuuuugauugcgucuauuugauucuucucucuuuucuucuuuauuagucuugcuagcggucuaucaauuuuguugauccuuucaaaaaaccagcuccuggauucauuaauuuuuugaaggguuuuuugugucucuauuuccuucaguucugcucugaucuuaguuauuucuugccuucugcuagcuuuugaauguguuugcucuugcuuuucuaguucuuuuaauugugauguaagggugucaauuuuagaucuuuccugcuuucucuugugggcauuuagugcuauacauuucccucuacacacugcuuugaaugugucccagagauucugguauguugucuuuguucucguugguuucaaagaacaucuuuauuucugccuucauuucauuauuuacccaguagucauucgggagcagguuguucaguuuccauguaguugagcaguuuugagugaguuucuuaauccugaguucuaguuugauugcacuguggucugagagacaguuuguuauaauuucuguucuuuuacauuugcugaggagugcuuuacuuccaacuauguggucaauuuuggaguaggugugguguggugcugaaaagaauguauauucuguugauuugggguggagaguucuguagaugucuauuagguccucuuguugcagagcugaguucaauuccuggguauccuuguuaacuuucugucucguugaucugucuaauguugacagugggguguuaaagucucccauuauuauuguguuggagucuaagucucuuuguaggucacuaaggacuugcuuuaugaaucugggugcuccuguauugggugcauauauauuuaggauaguuagcucuuguuguugaauugaucccuuuaccauuauguaauggccuucuuugucucuuuugaucuuuguugguuuaaagucuguuuuaucagagacuaggauugcaaucccugccuucuuuugguuuccauuugcuugguagaucuuccuccaucccuuuauuuugagccuaugugugucucugcacgugagauggguuuccugaauacagcacacugaugaguccugacucuuuauccagucugccagucugugucuuuuaauuggagcauuuagcccauuuacguuuaaaguuaauauuguuaugugugaauuugauccugucauuaugauguuagcugguuauuuugcucguuaguuggugcaguuucuuccuagccuugauggucuuuacaauuuggcauguuuuugcaguggcugguacugguuguuccuuuccauguuuagugcuuccuucaggagcucuuguaaggcaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugcugagagaucagcuuuuagucugaugggcuucccuuuguggguaacccgaccuuucucucuggcugcccuuaacauuuuuuccuucauuucaacuuuggugaaucugacaauuaugugucuuggaguugcucuucucgaggaguaucuuuguggcauucucuguauuuccugaauuugaauguuggccugccuugcuagauuggggaaguucuccuggauaauauacugcagaguguuuuccaacuugguuccauucuccccgucacuuucagguauaccaaucagacguagauuuggccuuuucacauagucccauauuucuuggaggcuuuguucguuucuuuuuauucuuuuuucucuaaacuucucuucucgcuucauuucauucauuucgucuuccaucacugauacccuuucuuccaguugaucgcaucggcuccugaggcuucugcauucgucacguagcucucgugccuugguuuucagcuccaucagguccuuuaaggacuugucugcauugauuauucuuguuauccauucaucuuauuuuuuuucaaagcuuuuaacuucuuugccauugauucgaauuuccuccuguagcucagaguagucugaucaucugaggccuucuuucaacucgucagagucauucuccauccagcuuuguuccguugcuggugaggagcugcguuccuuuggaggaggagaggcgcucugauuuuuagaguuuccaguuuuucugcucuguuuuuucgagacaggaucucucucuguugcccaggcuggagugcauggcgcaaucauggcucacuguagccucaaccuccccagguucugcugaucuucccacuucagccuccagaguagcugggacuauaggcgugcaccaccauaccugccuaauuuuucuauuuuuuguaaagacaggguuuugccauguugcucaggcugggcucaaacgaucugcccaccacagucucccaaagugcuggaauuacaggcauggcaucagccaccaugcccauccauggaacauaaguuuagaagauaauuagugaguguggcuuuuggagucuuuacacuuuauucauuggaaauccucagauaauggcaaugauacucuacuuauugagagugagauuuugccaguuuguggggaaacccggagucagggguuuacuaggccuuuuauacuccugccugccuaauccugauaauuuuauaugguugcaaaaauugccuuuagcaggccgcaucauuuguauuuaacauauauguuucaaguacaauuucuuauaacuaguguucuuuuauuguauugcccacuagugaucuaauaguaaguaucacaugcaacuuuaugaaggcaugcacugucauuugcuuucguauuaugaagcccagaagugacagagcagggcagggcagggcagggcauacugcccuguguuaauuaugaaucucuuuccuauuggauuauaaccucuauuuuguuaaucccugagucucauguuuuaccuaggacuugacucaggauagguacucaaaauauauuuauugaauugaaugaaauuacuggaagaacccacauuggaauaucacccucuggaacauacuuagcaugucuuuguaauugagguuacugauuauggcauacuggccuauuaguuaugagaucuggguucugccaaguauaacccauuagucucuaguaucuguuggaacuaaaagucucuuaguacaauguaggaccccuuuugcuguucaugagaguuguauucuggaaacugugggcacugggaaauguguaaauacuauaugcuaagccugcgauuaguaaagauaccauucuuaauuaaauaccaaauuauaguucuugaaagguuagugaccucuaaaguuuucuuccugauauaguaauauaacuaguaauaaauggguuauauugaaucuuuaccauauuuuaggcacuaaacacuuuauauauuuaggcacuaagcacuuuauauauuguccuuuacaacaacucugugagucauagguucuauucucauuuuuacaggugagaaaacugagguuucaaguguuuaguaacuuuuccaugauagcugguaaguagcagauccaggauuucagccuguuuggcucucaaguguguaugcucuuggccacugcucuuaauaggcucaaagaguaucacaacuggaagcccuuagggcucaucuagucuguuuuguuuauuagacagagaaggaaacugaggccucccaauucgauguuggaucaugcugcucucaacuuaggggaauugcagaaacaugugaucugagaaagcuggcuuuuuaacuuguugguguacauuguaaauauugaaaaccaugacuuugagaaucacaaaucauaaaagcuucacaucuguuucuccugugagaacacacuuauagacagaaauacauagaaugauauauauuggaauucauaucuucaugauuuagcuaggaucuuuuauuccuuucauaguaauaguacguucuuguucucaguagcucuuuauacuaucucugucccaacagaaguugcagcaauucucagcaaagaauauuaguauauauguuucucucucuuucucuuucucucucucucucugucucucucucucucuguguguguguguguguguguguguguauacauauauacaauaugacuaaucaagggaauuguaaguauggcagaagaaucagauaugcucaugugaguugaguaguuauguuuagaggucaaaucugguucucaauuuccugguagccagggcagaaaaggaaaugugauagcuccuauauuuuuuaucaaauagaagaacauccuacagcuuuaagacacaaagcuuuuuuacuacuaaauguuuaaaaagaaaaaaaagcaccauuuuuaagaggcucugagaauuacauaaggaauuguuagaccaggcacgguggcucaugccuguuaucccagcacuucgcgaggcugaggccaguggaucaguugaggucaggaguuugagacuagccuggacaguauggcaaaaccccgucucuacuaaaaauacaaaaauuagccaggugugguggcgggcgccuguagucccagcuauucgggagguugaggcaggagaauugcuugaacccaggaggcggagguugcagugagccgagaccgcaccacugcacuccagccugggcaacagagugagacuccgucucaaaaaaaaaaaaaaaaaaggaauugcuuucuguaacaguuuuacugaaaauuuagaugcaauuuucauauaauauuuucuccuaaauagucauuaaauguugaagguauggcccaaaguacagcccagugaaagugauuugggaaaggaccaagcuacugaacuuuuuacugaaugauuagcauuauuggauuugaggauagaacaauaaauuccuagaucaaugcuccuaaaaugcaguauugcgauauacuacugggucaugaucuauuaauaccuuccccagagguaauuauuauucugauuaucaccaugguuaggcuuaccucggaagaaauggaauaauacaauaugaacuugcuugucuggcuucuuucccuuaaugugucugugagauucaacccauuugucaguguaccaauuacuuauuguauugcuguguaauuuucuguauaguauuauaugaauauaacacuauucauuuuuccauucucuuggacauuuggguucuuucugguuauuggcuauuauaagcaaaucuuuuaugaacauuucuguguaugucuuuugguggcuauacaaacuaauuucucuugggaauauaccuaggauuggaauuacuagaguauagguagauguauuuaucuguaaguagaugcugccaaacaguuuuccaaaguggucuguuuuaagauguccuucaauuuggggaugaucagaagcuuuccacacagcacccuuuacaaacaaagaugccuuuaugucuuguaaugguuacuggggaagaauguuaaauagucaugugucuuuugcuauuuuucuccuuucuagcaucaauuccugaagauugccaagccccucuccagccucacuccacugauugcugcagcuaaggaggcaacaaagaacaaucacuaaaaccacacucaccccagccucauugugccaagccuucugugagauaaaugcacauuucagaaauuccaacuccugaugcccucuucuccuugccuugcuucucccauuuccugaucuagcacuccucaagacuuugauccuuggaaaccguguguccagcauugaagagaacugcaacugaaugacuaaucagaugauggccauuucuaaauaaggaauuuccucccaauucauggauaugagggugguuuaugauuaaggguuuauauaaauaaauguuucuagucuuccgugugucaaaauccucaccuccuucauaaccaucucccacaauuaauucuugacuauauaaauuuaugguuugauaauauuaucaauuuguaaucaauugagauuucuuuagugcuugcuuuucugugacucaacugcccagacaccucauuguacuugaaaacuggaacagcuugggaaugccaugggguuugauaaucugccagggacaugaagaggcucagcuuccuggaccaugacuuuggcucagcugauccugacaugggagaacaaccacauuuuucuuugugugugcuucuagcagcuguucgggaggaccuugacccaauaguguucccaugcuguuucuugugaaaugcucucggcuauguagcagcuuuugauucccugcauacccuaggcugcugccccuauccugucccuuguuuauaacauugagagguuuucuagggcacauacugagugagagcaguguugagaagucggggaaaauggugacuacuuuuagagcaaggcugggcaucagcaccuguccagcucuacuugugugauguuucaggaacucagccccuuuuucugccuaggauaaggagcugaaagauuaacuuggaucuucuaaugguccaaaucuuuuggucacaauaaagagucuccaaauuagagacugcauguuaguucuggauggauuugguggccugacaugauacccugccagcugugaggggaccccguuuuuaagaugcauggccaagcucucugcaaauggaaaugcuuacacuggguguuggggauguuugcuaccuccugcuauuuuugugguuuugguucucccacuaugguaggaccccuggccagcauuguggcuugucaugucagccccauugacuaccuucucaugcucugagguacuacugccucugcagcacaaauuucuauuucugucaauaaaaggagaugaaaauauucua

SEQ ID NO: 21247 - RNA, 11475 nt, Homo sapiens
ggcggggcugcucaguccuccaggcgucgguacucagcgguguuggaacuucguugcuugcuugccugugcgcgcgugcgcggacauggccucaaacgguagguaagggcgcgaggcgacggcggcggcgcacccggccgaggccucccagcugggcuuuucguuuucagugggaccggggcggcgaucccgugugggauuuuuuggcgccccuguggcgggaagccgcggagaagaguaacuggaggaggcuggugucgccauuuuguuucgcuccucuggcccucgcgcgcggggcgggaagucuuuucuuugcaguccguuugcuuggggugggcguugggagggacgcuucuuagggguuugaagcgucaggugaggguggaaaacgcccauucuccguggccucgccucccccaacucccggccccgcgcucgagcccgcuuugucgcagugcugcauccgggcacucgcggcgcgcacgcgcucugcgggccccucccccuucgcggcgcggguaccccuuccccgccucguguugguucagcuuucugucgcgagacccuucgcggaagacucggcggcgcgcguccggugugagccuugucccucagugguccuucgcgaaugggcgggaucgcuccguucccgccuggguugccacgcggcugggggcggaggcucgggaucggggccgcccucuagcuuaacgguuuggcggcgguggucaggguucgaccaacggacuuggggacggcccgagaguuuuucccgccuaaauuucuuucuuuuuuuuuuuggagacacggucuuccucugucgcccaggcuggagugcaguggugcgaucucagaucacugcaacguccaccuccuggguucaagugauucuucugccucagccuccugaguaguugggauuauaggcgcccgccaccacagcccggcuaauuuuuguguuucuuaguaggggcgggguuucaccauguuggucaggcuggucucgaacugcugaccucaggugauccgcccgccugggccucccgaagugucgggauuacagacguaagccaaccacgccuggucuaaauuucuuuuuucugagauagggacggagaagaacggccgcccgaggccacacccucuccugguccucuuucccuuuuccugcgggggaagcgccgcguuuccugugcugggaggaugaguugaucuuguucguguaucuuaaguggggcuuuucaaaagcgcuuuuguugcuuuuuguucgcugggggaaggcaggguaggugagaaaacggaaccaucuggagucccagggcuggggacucgaguaccuguugacuuucgccuccuaaggcgagcaguugcaugaucucugucauuugggguccaagggcucuuuugauucucuggcuuugcacuaaaaagcccacuucaucuccgggauuggucaaagagugaagaauggccuuuuuugagacuuucuuauucugugggucugggcugagagagcagaggccacaaucugaacacuguucgaauucaaaccugugccacuuugguaguucugcgacguugggagaguuagucucuugacuccuggcgauaauggcuuucucauagaguggaugaaacgaaugcgcgauguuuuagagcaaucacugacaugaauugggcuugcagaaaauuguggauguccaccaagaccuugguuuuuccaaugguuaaggcuucugggacucuguagaaacuugcauuuucuucacuuuuucuuuauuguaagaacacuuggcugauaacgccaguuuguuccucuucucaaccagugucucauggaggaauuuuaugcccuuuguugcaacaugguccuauuuuuauuuuuuuuuuugagauggagucuugcucuguugccaggcuggagugcaauggcucacugcaaccucugccucccggguucaagcgauucuccugcuucaccucccgaguagcugggauuacaggcgugcgccaccaugcccggcuaauuuuuuguauuuuuauuagagauggggcuucaccauguuggucaggccagucucgaauuccugaccucaagugauccacccaccucggccucccaaacugcugggauuacaggcaugauccaccgugccuggccuacgugguccuuuuuauucaucagugcuugaguuaaggaauuuagcuuuaauucaacucuuucagaguggcagcugaagauaaugugauuguauuuuucuuuugcagauuauacccaacaagcaacccaaaggugagugcuauuuuugggcuuccagaguuuguagagggcaaggguggucacgccauguuuucugaucacgcugguuuuccuuuuauuuagcuauggggccuaccccacccagcccgggcagggcuauucccagcagagcagucagcccuacggacagcagaguuacagugguuauagccaguccacggacacuucaggcuauggccagagcagcuauucuucuuauggccagagccagaacagugagucuuucucagcgggucaccucuuccuacucuuucugaauauugcuuuucuuuuucuuguuuuuuggagacggagucugguccuguugcccaggcuggagugcaguggugcugucucagcucacugcaacaucagccuaccggguucaaacgauucuccugccucagccuccugaguagcugggauuacagguaccugcuaccacgccuggcuaauuuuguguuuuuaguagagaugggguuucaccguguuggacaggcuggucuggaacuccugaccuccugccugccuugaccugccaaagugcugggauuacaggcgucagccacaaugcccugaauguugcuuuucuuaaaccugagcagcacugagauguugaaacuguuccauauuucuuuuccgugaaacaguguauaagucuuaaaacuuuuugggaucugaguccuuuacagggcauuguggcacaccuguagucccagcuacugaggaggcugaggcgggaggaucccuugaauucaggaguuuggggcugcagugagcuaugauggugccugugaacagccacugcauuccagccugggcaguguguugaggccccaucucaaaaacauaaaaaaaaaaacaaaaaacaaaaauguuuauugguuugugauucuguuuccauuuauuuucuuuggcuuuuaauuuuuuugacucuucuuauuuuccaucagcaugaaagagagcauauuuucuaaaggaagaaccaguuuuaggccaauucugaaauggagaaaaugguuuuguuugaaaauguaugaaaucaugugauacauaaggaggugggauuugccccaagguccugaaguguaacuaagaaaggugguuguccuguagauacugcacgcacagcugcauauuacagugcuguuaacagggauccuugggccuggguuuagaggguggugcuggagaugguguugggauuggcggggugaaauuggaacuguacuaaagaguugguagaaguugaagcauuaaauuuaggcuuugaaaggaggguaacuaucuuugccuaugaguugcaacaucacuaacagcuucugagaggcuggcuuuaugaguauagguauuauguuuucuuuaacccauuccuuacauuuucucuuuccugguggcuuuugugacucccuuuuucuuauccugguagcaggcuauggaacucagucaacuccccagggauauggcucgacuggcggcuauggcaguagccagagcucccaaucgucuuacgggcagcaguccuccuacccuggcuauggccagcagccagcucccagcagcaccucgggaagguacggugguguugaugucggggaaggcuugaaaagaggggugaauugaugaggaaugauaaagggaccagcaguaggagcaguucagagguguaauugggguaggggagccuguguuggguacagagaauggacuccacuaaaagugaaaggaaauugggggcuaugcugggauugugauuguguuuuuuguuuguuuucccuaguuacgguagcaguucucagagcagcagcuaugggcagccccagagugggagcuacagccagcagccuagcuaugguggacagcagcaaagcuauggacagcagcaaagcuauaaucccccucagggcuauggacagcagaaccaguacaacagcagcaguggugguggagguggagguggagguggaggugagaugucuucagcuuugucugcagcccauuuucuuuuucuuuuuuuuuuuuuuuuugagacggagucuugcucugucucuguugcugaggcuggagugcaguggcacaaucucggcucacugcaagcuccgccuuccggguucgcgccagucuccugccucagccucccgaguagcugggacuacaggcauccgccaccacgcccggcuaauuuuuuguauuuuuaguagagacgggguuucaccauguuagccaggaugguuucgaucuccugaccuugugauccgcccgccuuggccucccaaagugcugggauuacaggcgugagccacugugccuggugucugcagcccauuuucuauaaggauuuguauucuccuguuuuagcuuaaaagaggguuccugucuuguuuccuagcugucuuuuuacuuucuuuuguccuucauugccuggcacuugucaaaccuuuucaaaccuuuuagugcuacuuuacaaucuuuuuguuuuuuuuuuuuaaucauucuuucuuuucucacagguaacuauggccaagaucaauccuccaugaguaguggugguggcagugguggcgguuauggcaaucaagaccagagugguggagguggcagcgguggcuauggacagcaggaccguggaggccgcggcagggguggcagugguggcggcggcggcggcggcgguggugguuacaaccgcagcagugguggcuaugaacccagaggucguggagguggccguggaggcagagguggcaugggguaggugucucaugagccagggaguaucuuugguggggaguguggaggauugcaugaaucucccugaagccagucccuagugcaugguuuaguauucuuguugucuagggaucugugagggcuuugauuugggggcagugacuuucuuuuuacauccccauuuuauuuuugugagaacuugggagccugaacucccauccauaccacugaauagagauuuugaguaaugauacuuguuuccaaaaaaaaagaaaccauacauagauacguauggauuggagucauuaauauccuaggcaagaaacauggaagugaagacuucuuucucugcaagggaaaccgaugaucccacuccugggaaauaguagggaaacuugguauguguauucccauguguccucuagggaguugguaaugguuaaccugacuucagcuuccaggaauuggcuacucuucccguuuucuauagucauuugaauccacgagcuugauuugcacuaauuugaccgacauugauuuugugugugacuugguuuauggggccagcugacugaaguaagcagaccuuuugggcaaaaauaugcuuugacaguggucucccaccuauuuguuccacugucugccuuccccugguuacuuaaaauucaucagcuuguccaacuggaccuucuuuccuuccugcugaaguugauuugaaguaaaaccuuagauuugauguuaaaacaguugucaaaucuguugguaaauaagauuugaaggacccuacucugucucccuugaaaaaggggaggaaugucaguguuacuguuuuuggaaaaaguagauuuuuaaaccgaguuuggaaaugguaaguaugcagaggugggugggggcaaucucaaaaacgugcaaaaaugaggaaaacaaaaaugaggaaaugugugcguguguuuaaugcaaaacuuuaaaaagaaaaacaacuguuaugugacuguuaacuugcucugcauuuuaugugccacagguaugaaaggugacauugcaaaauacuccgcucuucucgcaguguagaaggggugaccccggggguugggggagaucaaaaacagcucaguaguuaggacagagcuuagcuaaguuugucuugcuuuaaggggaaguugccuuugguuuugacuuuuuauggaaugggguugggucugcuugcugcuuucaaagcaaaaaccacaaaaauguguucaaggcuaccccagccuggugugaaaugucuucuggguaaauugggguaggguuuuuaaaccaacuacuugguugucaaccacuugcgacaagaggaaaaaaaaacaucugcuccaucggaagaacgaccaaggaaaauggguuauuuuuuuuccagaggaaauagauaacguaaccuuuuaaagcaaaaucuuuauaaacugugucugagaaauugcacacgugugugugacaugcucaaaggucagacaagggguggucaggaagggauguauuuuaguagccacuuguaucuuuuuccaaaaacaccuacccauguuuggggaauguuaaacaaaaucaaaaaacaaccuuuuguagccguuggaagcuucauguccuuucuucuaacuugucuucuccagcggaagugaccgugguggcuucaauaaauuuggugguaagugaacagaguuuccaaaauucccaacucccagcaaugcuuugucugauuguucauuugcagaugucuuagcguguuaauuuaaaugucaaagguuuugagguguccagaaccaccuccagaaagggguaggguagaaugccaccuguugccuggugugugcuaaccuggagcagguagggguaagacucaauagucaucuuuuaccaaauggguuugccccagguuaauaagaggggucuaguaggccuuggacugggccguugccacaccuggcacuuagugaccaucaucaugagaaacuggagagugcgugcuggaacacguggugccaucuuggcuuuaggauccuuuugaucguuguguccaaggcuugugugugugugagugugugggagacaacuccgaauguuuaauucuggaagagggauguaacauugcccugaggauggugaaguugguauacauuuauaaaguacggaauggugucaaugaaugcaauucuauguauauggacuuaacugagaugggcaaauagaaacuagcucugggaaggaacaugugcacuacuucaagaaagauuggaagcauguguggcucaugggaaauaaccaggucuuaaacagcacaaacugaauucguggaccaggaaggucuuaaacagcacaaacugaauucauggaaaaaugacaaauuugagaagucucccaguaagcuggaacuuuucugguuugguuaacaaaagguuucuugauuuguuucaagauuuaaagccaaagguguggguucaugacuuaggugucauugcguguggguacaauauuuauauauggcgaauucagauaaacauuggucaaagauggucucuggaaaaacaaaauagaggcugcauuacggaaauaagauuucuggucuguucccugggacaugcuuaaaaaauacaauagcuauuauguaugguuuuuauuuucaugugguuucggggaaacaacacgguuuuaaggaugguuucuaaagaugaaauuaaaaauuguuccacaaggguuaagugucuggugguaaaguugggagaaacuggauggaugcacaucgcauggcugguggcgagcccaucucucuucucucgggugagagaaccgggccaagcugaguugguuuguucacuuuaaugggucuccguuuccccugccaccugugcugaggacauuucccagccugagcugggggaggcagcauuugcugaaguguggaguugucucuguggagacucaaguuacagaucuuaaggggccugccuagaauuuucuccucugggcaggcgacccaggaaaggguuuggagugaggcugugagcacuuacuugauauuuuacaaguuuggauuugguguuaauuuuuuuccuuguccguuuuuuccuguugacuaacggcucaucuuuuccuuguuuuuguuuuuuuuuuguucuuuuuuuccaugucacuaaaggcccucgggaccaaggaucacgucaugacuccggugaguucacacgugguggcaugaaaagaguggcuaaagugguaucaagacugccuggauguucuuugaaacuauuauaaaaaggaaacugaaaaaaauggggauagagaaggaagggaguuagguguguccuuaguuagcagugagaaguauuuguuacgaaguauuucucagaaauaccuggcuuguggguuccacccccagugauuuaggucugagaggacccugaaaaucuaccuuucuaacaaguccccagugaugcugaugcgucuggaccacacucagaugguuuacagcagugguucuuucaaaauguggaucauguccaaguuggugaacaaaacuagugaaagaccugaccacaugaaguaaagcauugaacuccuguuuagguuguauugauguuuguguacuagauuugaauguaaaauggguuucuuauuuaauucggggaccuucaacugaaaguugauaaauacugauggacuuuucuguguggucuuguugggcauuucacuccugagcccugguuuccauacuguauacuggguguuaacauguuucaaaggauaauugucaaacugaaucugaaauuuaucagcauggcuggcauauagggacucaaaagggauguggauuucuuuuuaguugucuuccauaaaccaaaugauaccaguugcuugauggauacuaggugcuuuagguuuuuuccuguguuuuuuauuuuaccuuuucacauuugcauuuucucuguucaacaagcagaacaggauaauucagacaacaacaccaucuuugugcaaggccugggugagaauguuacaauugagucuguggcugauuacuucaagcagauugguauuauuaagguacuuguggagaggagugggagcuuucugucaguguuguaggcuuguggauuucacacauuaguaaaagcaagucuuuaaugguugccagcaguaaaaacaagucuuagugguuguugccagcuuaauuuguugaggaaagagccuuaguuacuguuuucuaaaagagaaguucuaucuuaacacaaaaaguauaacuuaucagaguacccuaaacucuugagauuuguacucuauaguaacuuuuaguuuuaucuuucaauauuggagugagagacaguuuucuuuaauggagguuuacaugugagguaggaagaaguaacugggaagaggggagcugaaguuugggaauuauaaaccucauguucuagaggaagaagauggaaagggaguacuguagccuuuaaaauugauguuaccucauuuugcuuucuucagacaaacaagaaaacgggacagcccaugauuaauuuguacacagacagggaaacuggcaagcugaagggagaggcaacggucucuuuugaugacccaccuucagcuaaagcagcuauugacugguuugaugguauguaugagaaggcuggcagagguggggcuggggauauagggcagcaagccuuaggaaacaagccauaguuugaggguucuuuugagucuuccaacacuuacuuuagcugcgguuucagguagucucauuuuugcuuaugugucagcagauuauaaaccauuugagaaaggcacgcuucucuuguauuuucggauuaaugugucuugcauuuaaagucuguugaugauuuuuuguuucucuagguaaagaauucuccggaaauccuaucaaggucucauuugcuacucgccgggcagacuuuaaucggggugguggcaauggucguggaggccgagggcgaggaggugaggagcuaccugcuaguggugcagagggguaauggggagagugcagaagaugguaaaggcuugcauggaauggguuagauuuaccaaacuuggagagggagcagacccauacuuggucuaucugcauuaggacccaugggccguggaggcuauggaggugguggcagugguggugguggccgaggaggauuucccaguggaggugguggcgguggaggacagcagcgagcuggugacuggaaguguccuaauccgugagugaaacuuaauuuuuuucuuaguucucuugcaugcgugcucuuugauauauugguacugagguaugugcguguuuuccaaagaaguaaaugucaaggccacacuguuggggucagauuuagccaaaagcuuaccuagguaagguugauguaaugggaaagguaauggauuggguucaguaauacugauuuuuguuccugacucugagaagcaagccguuuugucuuucugaagcuucaguuuccucacuguaucucuaaagucaccguaguuucuuccuaguucuaggucuugccuauuccccaucgcuccagacugauugucuuccuuucuccuuagcaccugugagaauaugaacuucucuuggaggaaugaaugcaaccaguguaaggccccuaaaccagauggcccaggagggggaccagguggcucucacauggguaagaaaggcagaccuggugcuagggagcugggaccaaagaauccuuaauuuuucagcggggaggcucggggaacauaggggaaugggaauaugauagaucuuguuucuuuuguccuaggggguaacuacggggaugaucgucgugguggcagaggaggcuaugaucgaggcggcuaccggggccgcggcggggaccguggaggcuuccgagggggccggggugguggggacagagguggcuuuggcccuggcaagauggauuccagguaagacuuuaaaucagaauaaaaaaguagagcaguugaacagaggccauaggauaacaggguuuuguugagaaagugguuucauuuugagggcuagguggaaagaccugagguuguaaccaguaguggagagggaaggaaaauuaacucagggggagugaaucuguagacccacuugagauaagauacucgcuggguuagguaggaggggcagauaggauaucuaggcuuggagaggcugguaacucaaauauaauggauacuuaauuuuuuuuuuuuuuuuugcaggggugagcacagacaggaucgcagggagaggccguauuaauuagccuggcuccccagguucuggaacagcuuuuuguccuguacccaguguuacccucguuauuuuguaaccuuccaauuccugaucacccaaggguuuuuuugugucggacuauguaauuguaacuauaccucugguucccauuaaaagugaccauuuuaguuaa

SEQ ID NO: 21248 - RNA, 9102 nt, Homo sapiens
uaccaaacgacagaguagaauaaaauacuuuaauguugugaugacacaaagccccacacugccccgcugcuccugggaggcuccucagucugccagggcuggcacucaggcccuucccugccggcuuccugccacacagacccacaaaugcccugcauugcaggcagcccccuccgagcuccgacuugggcccucuucaguucccacuggacccugauuugagcuggcucuggaaauagcugagaacccagacgcgggacgcaggggcaagggcucaaggaggagagucagagucaagaggcugccacgccaagaugucgccaggagcucuggcgguggccaccaggcccagcuagugcgcacuggccuccagcugggagcccagucucgaagccugaacgugagagggcuccagguuauccgggcucugcuucugccgccgccgucggggcuggacccccuuaccagggggucugggcagcccacucuguagcugccgcaccaucucguggucccugugguccagcacgcggggcaggaacagggaggacuucugugugcggcgggucuugaagccccugcggggccggcccuugccguucacagacacguaccacagucucucggcgcugggcugccggcgggccccaggcguacuagacaccguccgguacagccgggaggcauacguauuauagcccagcucguggauccgcuccacaaacucgcacucggcgcuguagugcuccugcggggaugagauaucauggucagugccccggggagacuguggcagcgucagggcccaggguugccugaugccucccuccccuccugugaggcuguucgguccagugccaaaccccagcgcacucucagccagucacaccuuugccuaggcccugcccucugcccagcauguccuuccuccccugugugccuggugaacuuggccuucugccuaaaggucaccuucacucaaagcugugccagacaacucccagcuccugcucucuggguuccaccagccucugucccccaucugagggcgcugacacagcaaagggauguguaggguugucuguggagcagagaccaggccggccaacccaggugcccuggcagucugcuggcaguguggaggucagcaaggacugggcauuuggacaaaggaagaugacaacacccagaucucuuuuaaagaaauugcagaggcugggcacgguggcucaugccuguaaucccagcaguuugggaggccgaggcaggugaaucaccugaggucaggaguucgagaccagccugggcaacauggcaaaaccccgucucuacuaaaaauacaaaaaaauuagccgggugugguggcgugcgcccacaaucccagcuacuugggaggcuuaggcaggagaaucacuugaacccgggaggcagagguugcagugagcagagauugugccacugcacuccagucugggcgacaagagcaaaacucugacucaaaaaaaaaaaaaaaaagaaaagaaaaaaaaagaaauugcagaaaagaaaaaagaagaaagaacacaaaaagcaggaagggaaggggacacagccagguuugaugagcccagacucuccauuaaacgcugcgcucaggggccccagcuggggucauugaccccugagcaacacucucuuaagcuggaggaucucgccuugcagguugaagagguuacaacacagagcaggggcuggggccuggcaugaggcacaugaucaaucagugccacagauacugcuguucuuaggaugagagcagaagcuggggugucccaccacaagcaggacagagaggacaccucuuugucaucagagauuaaugggacccuugucaggcccagggugcagugggggaagggcagaagggacccugcccucucaaaggcacagugaagcucugaacugaaggagcuuacaccaacauccccaagacuuggccgugggaguuucccucaagggcugccucauggggucuucuuagucuguggcguagggaagagguggguaugccuuaugcagacccacuaggcuucagucccagcuacaggcaagugguaaugccuagggccaccucccucaggggaugacugacaggagcugcucccuccaaaccagaaaggguggugggagguggaagcagcaggugcaaggcagacagcaggaucucucuuuccuccuggggacuggccgcagggaggagucggaggcccucauggucuguccccaucugggguguggugucccguggcagagagagagaguggaaauggccuccagaggcucccagacuggaccgagcagcaucugaccucgcaggaccucagggaacaagaugcuucaagcaccccauccuguuuuucagcgacaugaaagcccagagcagggaaggguggaaggcuugaccuggugguaggggcugccucuccccauaaccccaagccccccugcucuccagcccucuuggaggcccagugcccccugggccacagucuggauguuacuauccaagaccggucuccauguuuauagauggggaaacugaggcccagggguggugccaggcccuacauuacaggggauagaacagugucugaucugugccugacccccacauagccuggggcucagcgacuaucugggaaugagcgggugggcucagggccgacuuccccaccccacacacuggguacaccauguuagugucuggcucccauggcagacugugagaagcucagggcaggacccaagcuucucccaggucccucgauccugcagcaggugaguccucucagggccagagaggccaggaaauaggcuuucucuuuggggggccacuugaggggugggucacugaaggacaggugccugugagccucagguggcagggggcucaggcucucccaaggugggagauugggggcaguguagaucaauugcugacacgugguagggcaccugggguggccaagaugaccagggcagaagguguuggcucaggggccagggccauagacuccagagcuacugcaguugggacucgcugugacaacacuuuccaauguguguccugacacugccgccccaccagaccugguuccacaggccccucccccagggccgcuuccaccccaugaaggguggggaggaagccgacuccgaagcugcuuuguugaggaggugacuucuaaagggagcuguaagggcggggcgggcacuuucucaugggcauuuucuggaggagggcguuccaggcagugaagguguggccugagcaguacagauggcuuggagaguugagggggcuuccggaagccggaggaggcucaaccucuggaugacagccccccugggagcagauggcaccugggcugcugcucuguggguggagcuaaggugccugggggaugccugcgcaucaugggaguccucagaagccaugaacugggcugauuugcuuuuuuaggaagccccuuuaacaugcacuagcagagugcaacacaugguaagugcccaggacacugacuggugaacgaaggacugaaugucagauggguggguggauggauggauggauggguggauggauggauggauagauggguggguggauggauggauggauggguggauggauggauggauggauggguggauggguggauggauggauggguggauggcuggauggauggauggguggauggauggauagguggauggauggauagguggauggauggauggguggauggcuggauggauggauggguggauggguggauggauggauggauggauggauggauggauggauggguggauggguggauggguggauggguggauggcugguuggauggauggguggauggauggauagguggauggauggauggguggauggcuggauggauggguggauugcuggauggauugguggauggguugauggguggauggguggauggguggaugggugaaaggauggaaggaaggagggagcauggacggauggacaugugaaugggcagauggacagaugaacgguuggaaggauggauggaaagaaggaugagagaaaggaaagaaggaaggaaggagagguguauggacagaugggugaagagaauaaaggaaggggaaagaaggaaggaagauggauggauggcuugacaaacagauggacuggagguaggagaggcuggagcagugauccaggugggaagugaugagccugccuuuuaaggcgugcucucagggaugaggcagagggaggugaggugugugggcugaagagaugcaggggcguggucugaggacuagggauggacugaauagcaggaggggucuaccaugacucccagcccacucugggugagagugaguggcugguggggcgaugauuaagauggggagucggggagcugcugaguucgguucgagugucugagucagcaggauguugggggaggguggucuauaccucagaagggaggucagggccagaccaggagugucagggugcagugcucacuggcccacagugagaugagcuggccugagggcaagcaugcugccggcaaaguccagggagccccguggugggacagcacuccuaggcaagcuggccgcacgcaggacugugguaucagguggcagguggcaggugacggaguuggcauccaggcuacuaugccucccagguugucugcagggcaaugggaacuucuccacugggcacucuggaaaguuccacacccuccagccagacugcuuggcuaagcaucccugguggggcuaggagccucuguccacccuucucaaagccaggcugugaguucucaggcacggaagccccaggugggcucugaaccacugggacccccucaugucaugcuuuauucugucucuccaaauccuggcuccccuauggcagaagcuggcaccaugagggccccugcucccagacacagcuuccaggacacugacugaugaauggacugaaugucagauggauagguguauggauggaugggugaguggguggguggauggaugggugaguggguggguggauagguggaugggugaguggaugaguggauggguggauagguggauggauggauggauggauggauggauagguggauggguggauggguggauggguaaauggguggauggguggauggguggauggauggauggauagguggaugguggauggguaaauggaaggauggguggauggguggauggauggauggauagguggauggauggauggguggauggguggaugaguggauggauggauggguggauggguggaugaguggaugggugaauggguggauggguggaugggugaguggaugggaggaaggagggaguagccucuggaccagagaaaaugaaggggcgcaucccggcuuucuggaccuuccuuuagcaaaacggcuaaaaaucugugaugaaaucaucagcuucugcgagagggagcugcgggauguguccucugugagcaggacugagcagagagcucacugcagggagauuguccuugggccgcgucagccaggcuacucauggauggaaaaccucucauugcccaaggaaguaucagccaaauugcauguaaugacuaguuggagguagcaaauuucccugugacauguauuuuacucuguguauuccccaccccuaccccuuaugaagaggggcgcugccauacccacagaguaaggagacccuuuuugguuacacggaggcccaggcaguagauagacugggucccaagccagggcuccaaggcuccugugugcccgggacaugggcgccaucccccuuccccuccuaggcuucagcucucgccuuuccacccuuggagagagccgguggagcugggccagcguccuccucuccaugcucccaggagagcucuggcugccccaaggaacacucccagguugucuuggguccauuuauuuugguggaaauuuggagaacaaucacuucccugcucucagcuacucucaagggagggugguagugaugacaaggaugggggaaaccuuugcuaaccuggcauucuccagaucccaggucccccagggccaggcuccaggucacucgcggagcagccucuaacagacacagccaaagaucacugggcguggagcccugggccagggucugguccuagcuugggucccguguacccuuggcaaagcauucuacugcccacaucccccguccccuggcuugaugugcaggccagaccgcuacuccgucagcgcccacccacgugacagccuggacucaccgaagcauagagucguccccucuuguucauggccagguaccgcccggagaagagaccccugauggccacaaugcccaccuccacugccguuaucuccaaaauaccuagaagaaaugagaggugccucacucccgccgcccccacggagggggcggcugaggcccagcuggcccugcccaaagccacaccccgggcucagggcuggggaggguagcacacaccccacaggucggggagugaguggaaguucaggaagggagaagucaccggacaggagguagagaagggaacaucagggaaggcuucucuucauucaaacuugggaggguaacaaugaaauuaacauucccaccugcugacgcugccugcacccuggcuuucauucgagccucacaacaccuugccagcugccaucaucauccgacagacaagcaaguggggaccacuauggcugggugacugucaggccccugcacaugugcuugagcgggaaaucaagcccuggcggcagccaugggagucugagcucugggacugcacgguccccaaugccugugccugccagcgggaaagcugggcccugaugagccaggcugauaauauaaaccacuggcaauaacacagccagggugccugccacccagaucaugcuggcaauagaccuggcgggagaucauuguacucgccgggggaccuggaagggcaggaagccaguuuagacccuggagcccgcagagggaagcuggacgggucucacccacuccccagggauaagaaaguuuaaaucuccccucccgccuuuccuucuggauacacgagugcuguggugggggcugggggcgggggacuacaucaaaggacggguuggggucauugucucccaauagaggcugcgaggggauuggggcgacugccugcacccucuccaaggcaugccucucaggagcgcccuccuggcacgcgguccgagcacagacgcggucaccaccgggcuuuugcuccagcccaggggugcuguggugcaggcugcgagccucccgccuucccagugcgcaggcugggcggcaucggcggugccugaccggggaccagcgaagcacgagucucgacgcaggacaggggcggcugcgggcgcgcgcccuccccuccccgugagcagccuacaccaagaaguuuggaugcugugcgacuccgagggggagccuggcuuuggagagaaccggagugucuuagugagacgaauuccgcgcacucggacccccuggugacagcuggugcccaccgugcggcuccggaggcgcauguccccaggacgcccucucagggcugcggcuuuccuggaggaagccgcgguuugcugaggccgccgccgccaccuucaagcggcggaaccgcuuccugcgcccggggccggagccgagcgccgcgcggagcacccgaggacagcuguggucuugacugcccucccacgcuccccacgcgguccucccgggcccugagcuccgcuauccugcuccucaaagggcucggcgcgggccucaggucccugugaccagaggagcccaaccguguaguccggcagacucccgcggugagcgcagcccgggccgcggguccugcgugcgggggccggagugugugugucugcacccccaggcccgggcggacaccguuccgcgcucgugauccgcacgucccgacggcgagggccuccacccuccugucgcugugcggccagggcggaggcgggggaggugcagauuccagcgcggggaauaacugucgguggcggccgcggccagggaaccgagcuccgcagggcaagaguccuccgcgcagaggcagcagcgggggcggccaccugggcagccgcgagcggggagggcggaggggacggcggggcguccaggggucggcaggaggaggagaagucgucaaaauaauaaagaggaugauaaaugccuuguccggcuccuuuucuccgacacauucaaagggcuuaaacuugucagagcugcccaaagcagcagagccuggagccccggggucgccuagcucgcguccccucagaccagcgggccggaccggggacggacucugacagccgccggcgcccucuucggacgugaacgcccaugcccccgaguucugcucgaaccccagcgcgcgcucuucucccggacguguagguugaggagggcacccuggcauuccccuucuggcagcgggaggcagacggucuuuucccggacaccccgggcgcaccaugccuucucccgggccagaccccuccccggcgccgccucccccgcggggccccgcagcgcgccuucucccgggcccgaccccucccggcgccgcuucccccggggccccgcagcguccggcacucacuguaggcgcuguucuccaggcugccguugacgcggccgcucgggugcagcuggaggugguacuucguggcgcaguagagcuugcggcgccggggcgccccgccaaggugcucguagacgccgccacggccgcccgcaucgcgccgcaaccgcgccccagggcccgcugcgggccagccgggcuccagcaggcugagcaguagcagccagauuaggcccaucguggcaucgcgcccgccccgcggcggcggcggcugcaggcgagcgcggcgcccauggaaggggcggcagccggacagcugcgaggugcucggagcgggaucccgcgccuggagaugcuga

SEQ ID NO: 21249 - RNA, 57320 nt, Homo sapiens
gcagaaauuaucaucacuguuuuacaaggaaagacacuccugugcggucucaaagcaaaugcuuuuaagagcuaaaaauucauuuccuaguucuguucaccaaaugaugccuucuuuaaacauaaauacaaauuguaauguuagcaggugcuauuuacagagagaaacaaagagaauuuuacaauagucgccaacacugcagcugccaaaaaaucccuagcucagaaauuuaaagcagcaaucccauuuucccuacagaaaugaaaacauauugaacuuucuuuuguauuuagcaguaauccagcaaaauauaagcuuuaauauagcgacugaggagugguaguuugagccaugagguacgggggagccagaauccacuuagugaggacagugaugaccagcagguggcagaaguaaauuccaagcagccaaaaaaccaaaaacauucggagaauuuuccccccguuccugagggacaggauggaguuuggacaggaagaacuguaagaagccaagaucugcgacagucccaacaaauacagucuggucacauggauacaggaaggacgaucuggggaggcauaccaacaagaaacgaagccagggaccugaaugcaaaacuagccucaggugacauguucuccugcacuuagaagcacuggcaaaaccaugcccacauagagggggcagacacaugucuggguuucaguuucugcagaccuucaucauuuguuuuccuuuuuguuuucucuguugcccaggcuggagugcaauggcgcaaucucggcucacugcaaccuccgccucccagcuucaagggauucugccucagccuccuguggagcugggauuacaggcgugugccaccaugccuggauaauuuuugcauuuuuaguagagaugggguuucacuaaguuggccaggcuggucucaaacuccugaccugaagugaucugcccaccucggugucccaaagugcugggauuacaggcgugagcaaccgcgcccuugcuuuccucuuaaucacuguagcucuaccccguggcuauuccuagguaggugcccccuccccagcccaaccccaccgguuuccuuggaggaaaccauccauggucgauggcugcugggccuugacucucugcccagcgccucuacugcauggaugggguuccugcccucgaagcagacaucuucuuuuucugacuuuccaaaagcagcggagaggcaggaggugcgucgugaggucugggugcaggaccuaggaagaagagguuacaaggaaccugcgccgggagcaugcggugcccucgggacagaccuagccccagggcccgugggugucccuucuuuccaguggacauucccacccuuuucauacagcccauagauaaaugaagcagcagcaauuuuuauugagggaccuaaacugaaaauagguuuagaacauaauuuaaaaaaauaaaacagcaaaaguagcaaaaaauauaugaccuuuuuaaaaacauuuuccuuuuuuuucuuuuuuguuuuuaauauauagcaacugaugccucccagccaccaggagcaucuuacccgauggguaaaucucugguaacgacccuuuuaaaaagacauguaaauauauacucagauuuauacacuuuguguuuucuucauagcuauauacagagcccccaguuuggggcugggccccagggccacaacacugcccccaaccuggccuucgccucaccauccucugguaccaggcauuuggucagcaaagcaaacuaguaucggaauuaauaagccacuggcaccaccuaucuggggcagaggucaccuucaaucgaggcacgaagcacugaccucccuacugcuguagcccugaggacaaggcaccugccaccagagugcgaggggcuuaugggugaaggcaaaacagaccaaaccgacaggagaaagcucaggaagcucucacuugcaugccuguucauuggcucccacucccugcccuccaggcagugccugguggcagggagggguguugguccaacaucugggaggggaugaaguggcuggcagcaaagaucugccucuuugcaccucucaccagcagguggagaggagguggagggagaggugagcugaguggggugaaggcaggccacacaggaaggccccugguaggcagccggcuccugccagcaggaaaggggacagggacggacagguggugggcccagcaggggcugugggugaggguuacagcugacgguggagucuggggagggcguguggguggcagucagcggcguuugaguccgccauuggcaagcugggcugggugucggggcaggcagggcuccucgggcagcggcucaugagagaagacggaauccuccccugaggagcacguagagcuccgggugucgggaaagcugggggaguacugguccaggggcauggacagguccagguacuccugugaugggcgagaggaagcagcgaugggccgggccccuccucccugcucagggaggugcgugcacgcaguggggacggccugagcucuggcucuggcacgggcagccuuaccugguuggaggucaaggccacgaugcgguccaggucuuccaccagcugcuugaaggugggucucugugagggcacugcaugccagcagucccgcaucaucauguaccugcggcaggacuguaaggucagggacgucuccuggagauggauacucucuagucuagcccccugccccucaagcccacucuugccccaaggccuggcucagggccuccgacaucuccucgggcuuacagcucguuggugcaguuacugggcuuguccaugcggugacccuccuucagcagcuugaaaaguuccuccacaggcacaccgggguauggggagccgcccagagugaagaucucccacaggagcaccccgaaagaccaccugcaaaugggcggagagccacaggguguuagagcuucuccgccuccccucccccagcacaaauccucuacccagggcagugccaggagacagcauggagaacagaucagccuuucaacaucuggagcagagggaauggccacagacaauguuuuguuuuucucucuggggcagaaagaggacuccucaguccagggagaaagcaggacucuacagugcuagaagcucucuaucccacaccucccuggcaauugcuauuacaaacucacacaucacucugguggguguagauccggucaaauaaugccucgggugccauccacuucacaggcagucggcccugaaagcagcacaggggagguuggaguggccccaggcagggccaugagggcacaggugggaagggacugggggguggguucucagcccaccccacuccuugcuucucagaugaaaccaccagcacagggcggccuugucggcacucacguugguugucuuuuuauaguagucgauguggugaaugucccgugcgaggccaaagucugcuaucuucaucacauuguccucugucaccaggacauuccuggcugccaggucucgguguaugcacugaggaaggaggaagggagagcgggaggcggggaggugagggagcuggaaggcucugggcggccgccacccaugcaacuagccgacuugucucauagaacuucugccacacugcucugccccccgaaccuuugcuuucccucuucuaacauucucugccagcuccaggcuucucaucacagcaagcgcuccucccuuccuuccccaaagacuggccccuuaugccucugcugcgucugcagcgaugcaugcuccuagguccugccucccagcacagcaaguccacauggggcugggcucaaaccaggccagcccuuacacaccaaacacugcacucaacacucacagacaguuucauuuuaucuucauaacaauucuacaacagguauuguuauacuuuauuuucuuuugagacagggccuugcucugucgccccggcuggggugcaguggugugaucauggcucagugcagccucaaacucuugggcucaagcuagccucccaccucagccucccgaguagcugggacuaucggcacgcacuaccacacccagcuaauuuuuuaauuuuuuuuuuuuuuuuaaagacgggguuucaauauauugcccaaccuggucucacacuccugagcucaagcaauccucccgccuuggccacugcacccagcugauauuauuauuauuuuguauuugaagaauuuuaagaugcuaaguagcugccugaggcuacgcagaaaguggcagugcacagaucggacccugcaucagucugaccccaaggccaccuggcuacacuggugcuccugacucugcaguucccagagagccuaagacaacacacagggcacacagggccagugcucagugcauccacaacgccaccacaagaugauaagucacaggcuggaagacuaggggggcucuguucccacccuggcauuacccaggggagccuucagguuccacaccuucuuggaggccagauacuccaugccucgggccaccugguaggcgcaggacaccagguccuuggaggagagcugcuccucuggguuguggcugggguuguagcaguauuccagcccugggggccuccgggccugcagguacucccgcagguugcccuuggaggcauacuccacgaugacauacaagggaccugcaggcacaggagaagaggccauggggccagcagcaggugagcagguuuggcuucaccucaaagaaaccccacccccagcagcacaccccggccaaccucccaucuccugccuccucuuaggggaccugggaaauccauucuacuacccaaaaaaaaucagagaaauaauuacucccagcauaguccagaaaauucccgagcaacauugggguaagagccccaguuugucuguuuauuuugagauggagucucacucuguugcccaggcuggagugcaguggcgcaauuucggcucacugcaaccucugccuucuggauucaagugauucuccugccucagccucccaagcagcugggauuacaggcaugaacaaugccuggcuaauuuuuuuuuuuuuuuuuuuuuuuuuugagauggaguuuugcucguugcccaagcuggagugcaauggcgcgaucucggcuaaccgcaaccuccgccucccguguucaaacgauucuccugccacagccucccgaguagcuggaauuacaggcaugcgccaccacgcccggcuacuuuuuguauuuuuaguagagaugggguuucaccuguuggccaggcuggucuccaacuccugaccucaagugauccacccgccucacccucccaaggugcugggauuacaggcgugagccacugugccuggccuauuuauuuauuuuauuuuugagacagcgggaguaucucccaagcuggaguacaauggcgugaucuuggcucacugcaaccuccaccucccggguucaagcaagucuuaugcgucagccuccugaguagcugggauuauaggcaugcgugaccaugccuggcuaacuuuuguauuuuuuaguagagaugggguuucaccauuuugaccagacuggucucgaacuccugaucucaagugaucuuccugccucggccucccaaauugcugggauuacaggcaugagccacugcacccagccugagcgcucuuagaccauaauuacucagcugccucuguuaacacaccacgugugugaaucuagguaucuguauuccugaaugaacaccaaugagcggagcccagaucccgagauaacacauuuuaaaccucugccaaagcagccucucuuaacccccuucccuagcuguggcugagagaggccuugggacugauaccccagcucagaucuucuccccgcugggcagggaaagccagucuggccggcacccaccauccugcgugcaggcccccagcagguugaugauauucuuaugcuucccgaucaucuucaucaucuccauuucugagaucaggucugacaagucuuucucuguugcguccgcuuuaaagaacacguugagacucauuuacuugggaagggaggagggcaggauaaaggcuaagggagugggguaugugucgaggggcugcuuuucccugggacuugauucucuccuccccacuucauccaaacuuguuuucucuucccucucaugggagccguuguugcaauaggugguagugagugggcagggauguggugaggaaagccugcaagcgauggauccaggauaaacaccugaccacagcccagguugacgccaaggaacagagugacgucauagaacaaucucaaggugcagaacacccccuccacucccagguaaccccaagcaggcagcggagcaggugugggcagcaaaggcaccagagaagcuguucugcugggcccgaggccugcuguuugcuuggaaugggacaagauuuucuuugcaaggacagaagcaucacuuacacuucaacaucuucacagccacuuuggucacacgguuggguuuguccuuguccagcccgauagccucugccaacaccaccugcccaaagcagcccucucccagggguuugccuaagaccagucuuucgggggaaacagagaguggcauaaguuggggcuggugaaguucaaaccuugagaggcaccccaucuccaccucucuguauuucacccaacugcgagcagaaaguggaaugaauguuucugcaggcauuucaugaaccuucaccgcccagaagguguuaguauacacaccuuccaccacuagaauagcaagcaaggaaugccuucaaaaaguugggagucaaaguauuauuaccugucccgaggcagcucccagcgagggucuucgggaagcucauacucagagaccccugcuagcaugggagucccacuggaggagagccgugauggccgaaccagaagaaccccagaguucauggaugcacuggagucagcagacaccugcaaggaagaguggggucacccuagagcaaggaggggggacggggugacuccuucccauucuuagucagggcuucccaacaauggcagaggcacaugucuguguaucugauguucuuuccucaacacagagugguccaaagaccaugguaggccaggaggcccaacuucuaggacugaccuauuucugccacaagcuggccuuucuggacuucacucaccuuuaaaauaagcagaccaaaugcaccucuuccagcuugacauuuuauaacugaucauugcaguaacaacucuguucuccugacucuuugcaaauacuuugccuuagcuuauggauuccuaacucccaaagcaccuuccagaaugagcacaggcuucugagggaacggucauucuugcacacaccugugccaucuguaccauuuccucccguggggaagggugggcacacaggggacaaggguaugguauggcugagaugguuuggcuguguccccacccaaaucucaucuugaauucccacguguuaugggagggaccugguaggaggucauugacucaugggggcaggucuucccugugcuguucuugugauagugaauaaaucucacgagaucugaugauuuuauaaaggggaguuucccuguacaagcucucuucucgucugccgccaugugagacgugccuuuugccuucugcaauugugaggccuccccagccacguggaacugugaguccauuaaaccucuuucuuuuguaaauugcccggucuuggguaugucuuucucagcagugugaaaauggacuaauacaaacaguucucuucucuacccugcaucucugcacuucuaagcagcccuuggggacaguucaaauucaugcuauuggcugcacauucuguccaaauaggacuuccucccaauccaugucccaggaguccggaggacuugcagugugauauggagggugcaggaaauucacgggcuacacuagcuugaaacagacucuagagcacuuaguucaugauauuccacugugccuugcccagaagccagaaaauaaggcccaaagcuauaaauuagggacaauggagagggcagggcauuagaggcccagagagagagguggugcugagugugcaaaucccccaucuacuuucuguuaccugucugcgcagagggaugcucuuggccagcuugugcacagccaucuggcuguggaagucacucuucuugguaccacucuucaucuuguagacgaugaccgaccccaccaugcaggagaugaggaaggccccugugcaauagaugaugaucuccagguacaggggcgaggucaucacugccggccucucuuccagggcugagucagugcgaacaggguguuagcaggcuuggagggccccguccaugcgaggucccgcuccauuagaaaagcaacaccugucuccuguccccugggaacuuuuagggagaagaaccauggcaaguucuagcuaggacugggauuguggcacuaggaggaucaggcaacccccugauuuuggaggcugccuucaauggacuugagccauggaaaagggauggccuagaaccaucgugcuacacaagccccaucuucauuaauuccugagccuccuugcucagcuggacuggagagguacaggcacccagggauccugcaagggccagcugagaagucacuucuaugugccuuucuuggucuccucagggagccauggcccuucucugcaaagccucagcacugugugcaugcacuuaacaugcggggacacagauguuucugaguccucugucccuaagaagacacggggucccugagggcaggguuggugccucguuuauuucugcaggccacaguaccuggugaugguggcacucacagaaugaggacagaggacaggaggggaaccagccugugccuugcucaaugucccacuuugggucugugucaucucuguaggggcacacagguaaauauuuauuccuagccaaaccacaggcaaagcugacuuaauuuccaaaaauaagcuuuuuugguaguucuuucaaauucuacucauaggccccaacuccuaaaacuuaaggaaauguggcggcagggggcggaguuccauuuuguuauucucuucucccaccuucugauuaggacucaccccccaccccauugccacagcagcuaagccaguucgguccaccuuucccuucagcacgagaggcugggaggcuuucaucccagcacgcacagcacugguuucauggaacacgcuuugccccacggguguggacggcccuccuccuuccacaggccuccucccaaccuuccccuuuaaaacccaccagccaaccauggaggcggcgccccugggaaccuucccagagaggcaugaggcaugaggcacgacccuagacugagcccagagaacgucccaaggccugacaaggagacagcagagcugaugacagggagaaguguugcuguuuuuucuuucccugauguugaggaacgaagacaacugauugggagcacauggggagcacggacaggaccaagacagggacgaugauaaaaacagaacgcuucucugccuccagcaggggcauccggagacccugacgggcaagcagggcagagugggaaaggaggggagagagaagagggcagugccagcaggaacagccagacccacaugcaggacauuccgagagacagcagcaagcccuggccccgcagucaccagccaccacccugagcaggcugcaggcuccuuccucccuggcucaacacgcagaccuccccucuugggagaggagagacggcagcaggcaaacaggauacauggacaucgugaagccugcugcggcugccugagacaggccuuucugaaggcaacucaguucaccuguccaggcugaccuccuucuucaaaggcaauaggauggcaguacaggagggugggcugcucuuugcaagcagcaagccccaccccugggcugagcacuugagaagggagaagagguguagggcccuaucugagacuuuucagaugcucaguacccagcggaggggggaggcugcuggacccaaggacggaaggagccugcccuggaggagucgggcugcaggguaaacccagaucccgggcaugcauugcaauggccagggggagagcagaggcagguguacgggugggaggccuccgugcgccugcaaaacuagggaagcucuucucugagcugagaggauucagcccucaaagcuggggcaggauguggcaccaggcaggcaggagcccauucuuccagcucuccugccucugugucuccccaagccuggaaaugcaugcuccccccgugcccguggcgagggcaggacaucgagaggagaaguuacaguguguaccuuccagaacggucaaccaugcagagugaugggagaguccgauagaguuacccgccaagcacguauacuccccugcguccucaaaggagacauuucuuaagugaagcaccuccaucucuuugucggugguauuaacuccagcagucuagaagagacaacggaagcaaaauggacaagcacaggacaugagaccucuaagagacgcagagcaagggaaggagacagaaagaagggggacuagaggaagaaaugcucccugacaucuucuuugcaacaaggaacaaacgaaaaccaccaggcagcaaaaccuguuagaggaagagggugagacccugagggaagaacuccggcagaccugagaagacgauggcugguuacgacccuucaccagaugcuggcagccacuggcccauccgagcaugcgggcggugagcggcauggagaaauggggccggcgggcaggggcuguuugguuucagguaaagauagccagaaggugaacacaggagggauggcgggggcugcagacacacacaugcacacgcauacacacacgcacaugugcauacacagccagcagaugcgaguaugcaagggaaugccuaaccccuucucucucuuuuuuaagagaugggguaccauucugucaacccaggcuggggugcaguggcauaaacauagcucacugcagccucgaccuaagcucaggcaauccuccugccucagccuucagacuagcugggacuacaggcacacgccaccauacuuggcuaauuuauuuaauuuguagagauggggucuugcuauguugcccaggcuggucucaaacuccuggcuucaagcgauccucccaccucagccucccaaagugcugggaugacaggcgugagccacugugccuggccuauggccccuucucuuaaucaccacucacucacaacuucagucugaaguaccauuuguaacacagcaaaaccguguccccgugaguccucacauggauccacacaaagccaaggaacacacagaaggcagagagggaacccacagacaccaacacaauaccaaaccaaaccagccucccaggccggguauuuuuccauggcucugggcacuagaaauacaguaggguggcaaggacaguccaguacuggcuuccccgccugccccagcagcuuggggccuacaucaaauccccagcacagggucccauccaucuccccauuaccuuuugccacaggucuggugacagugagccacgcagacugguuagcuucaccaauauaauuggaaaccuuacacacauacuccccgcucugggccucugucacauugaacagggucagcaccuccgcauccgagcuauuaauccccgaaugcuggaacaaaccaacgacacaccagucaguugggcaaagcugagauguggccacgcacguugcucccguguaacuuucaggcaggcccagggagcgaagggagauguuaagugagauuuauuaccuuucccuuuuaguuuuuuuuuuuuuuuuuuuuuuuaacgcagagucucacucacucugucacccaggcuggagugcaguggcgugaucucagcucacugcaaccucugccuucuggguucaagcaguuagcuugccucagccuccugaguagcugggacuacaggugccaaccacuaugcacagcuaauuuuuguauuuuuaguagagaugggguuucaccauguuggccgggcuggucucaaacuccugaccucaagugaucuaaagugcugggauuacaggcgugagccacugcgcccggccuucuuucccuuuuacaaguacagaacaaguggacuucaaaaguccaaagcauuugauuaaaaaaaaaaaaaaaaaaaaagaaucacugcuucaaauggaauguucuauuuguguuuaacccacucccuccaggacuggagcagggguugugaguggagacaguggccaaugaccuacagagcaguuuuagcaccagcagcaaagagaagagaagggagggccaguauaucucugagacagcuaagcuaggggaggaugaggucuaacucugggacaaagagguaaacaacuuucccagcuucugguuccuuccuguugcgagauccacuggagauuuaggcaauuaccuucccuggauuaauggagcauucagggacaaugaaugucugggagugagaggaaaaaggaagaaaaugccauuacuccucguccucauauggcuuagaauuuauauauggcauuuguuuuuccaacucuucguaagagaugcucuuaucaugcaccccauuugccagaaagaucguacguaacucaggacacagggcuaagacugggaaacgcuugguggaaaggcucugguuucgggcaaugaaaaggcagggguccaaaugccuuccuuguguagcugaccccaaagccccagugacguugcucucaaagcuuauuacagaccagcaccacccaucccugcagcccucuguucccagcucaccuccacuuugugaccucuguuacuaguccugggggauguggcuagaucccuacugagauggagugugugugccugaagcgugaggaaugaucccauucgggggcaacugagccugcccacaggaacuugagcccccgagacaguggucuccuucccaguagacuggcccacgaagacuggugccaugauuaccuucaagaucuggacauaaggcagguugucugggccaaucuugcucccauucaccucgaugugcuuuagccacuggaugugcggcugcgggucacuguacaccuuacacaugaacuccacguugcuacccagggccacuguuuuguuggcgggcaacccugcuugcaggaugggccggugaggggaccgcucuguggaagaugggagaggaggcacuugucauggggaccuugccauggcuaaagaggggugggcucaccugcgccccacuuggcuuucccagugauggguuguaaaccucccagcacuucugcugagcccaagccucucaaaacagagcuggggaaagggacacccucucuucaggcccuaagccaucaggauccuccuccccaaggcagucaucauauuuacagucacaguaagucgcucaugcuuuaauggagaaccuucuaauucaguugcacccccagaccucagcacaaccugcuccuccuuaaaaaaccagagucacuuugacuccugcuauucaaagugugguccacgagcagugcuaccagcauccccuaggagcuuguuagaaacgcggaaucucagaucuuaccccaaccucuuggaucagaaucuccuuuuuaccuuuuuuuuuuuuaaaggcagggucucacucugucacccaugcuggagcacaagggugucaucauagcucacugcagcuucgaauuccugggcucaagugaucuucccaccucaguagccucaguuaacucagcugguacuacaaguacaugacacugcacuaggcuaauuuuuaaauuuuuuuauagagacagggucucacuguguugcccaggcuggucucacacuccuggccucaagcaauccuccagccuuggccuccuaaagugaugggaucacaggcgugaguaaucccaucaugccaccuggagcucauaagccacugcuccuggccacaaucuccuucuuagaccauaucaucauaaucaagaagaacacuggcugagagauucuguacccaaugaucucuagggagugaguuucagaacuccuagaaggaaaagguugcgguaauagcuccaagaggcucaauguucuucccagagucuccugugaugcccugaaguuggcacaggugugcaguucugcauuagcaaggugucugaccucucugagccuaugcgccugugcuccugugcagggcuagacuaauacugcccaccuugcaggugugccaugagcauuacagggcagguauuuaaggagccuggcaucuugcuagcauuaagcgacagcuccuauuacgcuacauuuaacaccucuccaacaacgccuccuucaggacagacucugaacagcaccuucaauuucacagugacaaccagcuuugaccguguuacugucugaucuuaacucuauuuuacagauaagaaaagugaggcucaaaagggagaagugaccugcucaaggugacaaagccaagaagugccaaucgcuauccugacucugccccuaagaaaccuggacaccccggcuguguucuccaagccuggcucuucccacuaaacucauuccuccugcugccucugcccucuuacccacgacauccagcugguaugugugguugaugcugccguacucauucuccacaaugcagguguaguugcccuugucagagggcaccacagaguccauuaugaugcuccagguggcauaacggaccugaggggaaaugccaaagggauacauugaggguccagaggaaaaugcaggccccaugacaaugucggcaccccguggcaccugcccuccauaucagagccugguggcacagggccccaggcugcaggguuggcuaggacaaggcguggauugccccccuaccagcccguucacacucugcaagcuggcagaugggguguaaagacuccagaagucuccacugugacguucaagaucauucgugauccggacagaugugccuucugcaaacacucccaaauacaccaagaauguucccaacugugcaccucuccuauuacacuaagaauccagcccccacuguccuugacagcucauuucaaaaaccaucuccuccaguccagucucuggucagaacugugcucacccuuuccucucugccuaccaaagcacugaucacagucuacuuuuuacgguagcugcucauggacauuugccuccuaucagacugcaaaauuuuuaugggcaggaacgcuaucuugcagcauuuaaagcauggugucuugcauguagugagugcauggugaauuaauuuaaaauauuucuggcugggugcgguggcucaagccuguaaucccagcucuuugggaggcccaggcggacagaucacuugaggucaugaguucaagaccagccuggccaacauggggaaaccccgucucuacuaaaaauacaaaaauuagcugggaaugguggcugcacaucccagguacucgggaggcugaggcaggagaauggcaugaaccugggagguggagcuugcagugagccaagauggcaccacugcacuccagccugggugacagagugagacuccgucuaaaaaaaaaaaaaaaaugcuuacacccuuuaaguuaguaauuucacuuguaacaaucuguccuaaggaagcacgcuuaaaaaaaugcugacagagauucacugcaacauuauuuauuauggugaaaaaccagaaaauaccuaauaucacaaaauaguucauuaaauuauaggacuuuuucuguuguuuuuuggagacagagucucacucugucacccaggcuagagugaaaugacgugaucucagcucacugcaaccucugucuccuggguucaagcaaucuccugcuucagccuccccaguagcugggauuacaggagccugccaccacacauggcuaauuuuuuguauuuuuaguacagaggagguuucgccauguugcccaggcuggucucgaacuccugagcucaggcaauccgcccaccucggccucccaaagugauaggauuuuaggcgugagccaccaugcccagccaaauuaugggauuuuaaaauaauggaaucuuauacagucaugaaaaauuauguuucaaauauucaugcuugaaauauaucaggaaaagacucauguuaacaaaugacaaggcaaggaaauuacauacaugaugugaucaacuauguaaaaaccauauuacagaaagaagacugaagaaauguuuaaacuuuauuugcauuuuuuuguauuuaaaaauuuuaaugaauaaccuguauagguggaaaguauuacuuaaaaaaaugaaaagcauguaaucaggacuuccuaacucggccuccccuguucccauuacucuaacuuucgcaugcacacacacguaccuuguagccuccaauucuguggucagguuugaauucuuugccauuuuucaaccagcgcagugugggguuuggggucccacuggaagggcauuugaacuucacugucuuggcagccggcacugcaugcaauuucuuuuccaucuuuucuggggauguccaauauggagcuacggcugcccggggaaagccaagagagacaggcaggguggagaggagcagcuggucaggcucaggagcagggcccaggccaggaccuggaggugucuugcccaucugcccaacaccugugagcagugccuggcacuuagcagaacaggcaccgugaccccaugugcccuccucuuccuccccuuucagccuuccccuccccucuuaaacccaaugcccagacccaaagggcaguaagauaggaaacagugucucacgcauacgguuugguuugguguuaucuguuucuuucuccucugaagaggagucaucaucaucaucaucauccuccgaggaggggagagcaucuaugggaagaagaaggggcacugagguuccuccuagggaccccuagauuucaccaaggcuagugcaguuccagaugaacacggacacccuccccauggggaucccagucccacugcucccuuagugaugaucucuuggugggauggaaacuguuuaagaacaguuccugugcguguuugcuuccuuccccgaagcacugcccccacugccuggaagccuucacacugggugguuccaucagggucagcuguuccuauuuaacuuaauuccguccuacauucaaaggcgcuuucucaacuuguggugccaccugggugugcuggagccaggcaaccuguauucuucuuuggacggcugacuauagggaaacccaggcaggucuagacacacuguggcuagaugcuauuuccaaaggaugggcuaaacaccccacagucagaauuuuucuagcaugugucuacuaagguuugggggcugcccuccuuaaucagagcagauagggcacccaccaccccagcagcugccaacaccucuccccaauaaguauuuauuucuuguaagaacacgcuugauacacauguggucacccaucaggguucaugccagaucuuucuccaguccuuccuaucaccuuuggggaucugcugccaaguccacacccugaggugcauaaauggcauaaagaaaauuucagcuccacuuccucaacuccuaguuuugugaaagucacauucuaagaguggcaaguucccaaguucacagagcuccagggcucccuggcugcccucgcacagcucccuugcggugcaccuggguuccucuccagcagagcagggauaccaccaccuguucagggccucuaaucacuaagccgaguaccaaguccaaauggcaagggagugauggaguggaagcuggccgagcaccacuuagccuccuggagaucugggcaagcugugguggaaaaaaaucacagggucuuaacaucccaagagcccuggcaaucaccuccgagguguguccuggaagccccagaucuccggcccuggggcccaccccaccuagucaccucucugagagccaagccacgcggcaggcagggagcaauguuagugggcagcaguuucugaagcagagugggggcagaucacggagggggaggagguucaccuuccucugaaacuggcagagagggcuggagggggugggucuagggaggggcaagggcagggcuuggcuaccaaccugaaacauugacggagaaguagguggugucacugcccgaggggcugcugguuacgcaagcauagaggccggagucugcgggcacggaguccugcaccuccaccuccuccccugugaugcgggugcgguugcuuuccgccagcugcaccccgucccgcagccaguugaugcucugcacaucgucccgcagccgacagcgaagcugcagcaggucaccgggguggaccaggaaggacuccacuuccacaggggcuccccagggcugggcugcagccaccacggggccgggaagggaagccaaggggcgagagaggaagacagggagaggggaggaggggagagacaaagggaauuacgcuggccacacggagccgcaccauccugggcaucacuuacuggaggcuacugagccagggcagugggaauuggagcaugggucaguggggaaaacagcuggcugccugggaacccccaucucuuuuccaccccacuccuccaaaagucaaaggaagaaagaggcaaaguuaggaagcagcuguagcagcauuaagcgcauuucauuucccccauccuaaggggaaaggucggcccuccccaggacuucuuuguguccggaguugcccccuccccagaugcucaguucuuugccaagauugccacuugccagaggaacaccccauuuccuuugggauagcucagccucacccuucccuagcaacagcugaacaaaccccgccccucaaaaccccagcagccccugcccaagucgagagaaggcaauuugucaacugggggcugaccaggaugcgugugauucggagagggugggggucuggcccucgacgcgucagaugcacaugcugggggggcagcccaaggagaggucagcucagggaaccucucgcuaacaggugucagggcaggggauuuggagcuguugacuauauuaggacgggaggccacagcugccauaaaacccacacuugcucuggcagcaggagcugucgcacacaaagguccuuucuccucagcccucugacugggcacacccucaggccccccaccauccacucucccuccccgugccccauccuucucugucccugggugggagcacuggacccaccggggugucugcaccucacaagaucugauaccaccaagagcaccugucccuccccugaccagugccucuucccgcacgcguucaagaaggcccguggcccggacacaccugaguucaccauccugggcuguuacccaucuccugagcacaccccucugcacucacgaggggaaaugaacuuucuauuuccuuuuaggauguucaaauguacuccuggcaucuuccaccucucaccuaccacccacaucccgcccacagccuuggagaggacuuuucucaccauuuguucacccuaagagacucaguggagcgacugccgcuccccgaugcauaaggcucugaaacagcauguucucccucagccccugcuguggcucacggcugccccaguggccacagggccccugauuuuuuucuguccagcucucacuacucacucuucugucucagccuagcuggugacuucuccuccagggcggugcugacucccagucuggguuaggugcccucccccuccuggcaccugucacacugaagggcaguccucuuucugaaccugagugcggugaugugucaucgguaccuuuaaauccccagcaccuacuacgaugccuggcgcccaggaguugcucaagaaaugcuugcucaauaaauaccacacgugcagucacucuggcucuucacugccuuccuuucuacucucccuuuucucuuucacucccccuuauuugaaacacggucuuccucaagugcucaacaggcuuccgcuagaaaccuuaaaaaugaaaaugggugucccgcgcaucaugaucagcaacugacagggacugacagugguuucucuugggggggccaagguugcagacccaguccugcauugacccaugggcuuuaucuuaaauaagaguugucagaaacagggguacugcuuuaaaagggcucagaaaccacuaggcuugcacacguuuauuuuugugaguccggucaaggggaacaccacaaaggugaguagaccacacaacugauuaaaaauaagcuuuugugggccuuagaaaaaguuauucuuuccauuuuuaauggucugugguuuugccaaacgaagguaaggagaaaagcaguuuagacucaacucuuaaggaacagagcagacacuucuauugaucaaaucucauuucccucaaaugaccucggugauuaaauauuuugcagcuugugaucugugcaacccauuggucaagaguaaacuugaauucuuacccucuggcaucacaaggccuauugcagccgaucccagagaaaaaagcagcucccaaagacaaaaauguagcaaagagaacccccaggcauuuauuuccccccaagagaaugcagcaaaggaacacuggcccuggugagacccgcucuagcugauaccagcuuggauccguaacuuccugcccgucccaaccagaacgugcaaacaaaacuccacuauacgugaucuguaaaagccucaagaaccagcucgcuuuccuccugaugcaaguuuagaccccgguucccuuccaaacguggcucagguaugcucuguccuaucccuuuaccggaaccaucucgggauaaauuuuuuuuuuuuuuuuuuuugagauggaguuuugcucuuucgcccaggcuggagugaagugcugcgaucucggcucacugcaaccucugccucccggguucaagugauucuccugccucagccuccugaguugcugggauuacaggcaugcgccaccaugcccagcuaauuuuuguauuuuuaguagagaaggggaauguuggucaggcuggucuaaagcuccugaccucgugaucugccugccucggccucccaaagugcuggcaugagccauggcgcccagccgggauaaucuuuuaaauggccucccuggggcugcagcucagacuccugcuuccaagcugucaugugcuugacauuauuuuccugaucaaaaucuacccuguguacagaguaaaauccacaucccugccucaccuucaagacucccugcaauuggcuuccacucucuccacccagccccauucucucuaccaggggcugucccuccccaccgcgccccccccccuccccaguugggaugcuuucagcacggcugcauccucccuggcauggcaaagcuuacuccuuccugaggacugucagcgccacuccagaguccuccuaccccaaacuacucaaaguccaccauccaaaacguccaggggcugggugcaguggcuuaugccugcaaucccagcacuuggggaggcugaggcaggaggcucauuugagcccaggaguucaagaccagccuaggcaacauagugagaccucgucucuacaaaaaaauuuaaaaacuagccagacuugguggcacaugccuguagucccagcuacucagugggcugagacaggauugcuugagcccaggaguuggaggcuacggugagcuaugaucaugccacuggacgggaugacaaagacccuuuuuuuuuuuuaagacagaguugcuuuguugcccagucuggagugcaguggcacaaucuuggcuugcugcaacuucugccucccagguucaagccauuuucccacuucagccucuggagcagcugggacuacaggcauaugccacaauggcuggcuuauuuuugcauuuuaguagagaugggguuucaccauguuagccaggcuguccuugaacuccagaccuuaagugaucugcccgccucgguccuugcaucuucaguuagcaagugcugggauuacaggugugagccaccgcacccagccagacccugucuuaaaacaaaacaagaaacuaggaagccuuguuuauaucaaugucucaucucuaauuuucuguaaaacaguuaccgccugaaucacacaaauucacacucaauuacauuccauuuuguauuguuucuauuuuauuuaaacagcagacagguaauucacaugcuguaauauucauccauuuaaugguuuuuguauauucagaguugugcaaucauucaccacaaucucacuuuagaacauuuuuaccaucccucgccccucaaaaaaugccugacccauaguagucacuccuccauccccuauccccagucuaagcaaccacuaaucugcuuucugucuauggauuuggcuauucuagauauuucauaucaauggaaucauacaauaugugaucuuuugugacuggcuucuuucacuuagcauguguucaaacuuccuccauguuauagcauagaaucagcacuuuguuccuuuuaaugaccuaauaauauucaauuguguagacauaccacauugcagucaucaauugacagauauuggguauaauguuucuuucuuuuuuaaaaaauaaguuaaaauuucaaauguugcccaggcuggucuugaacuccuggacucaagcaacccacccaccuugaccucccaaaguguugggauuacaggugugagccgcugcgcucaacccauauugcugcugcuuuuuuuuuuuuuuuuuauaacaaccgcuaaucaguuuauuaaaauaguugacuuugagcaucugcaauggugacuuccaccucaauuccuggcucaacacugauggaagucaacugcuuaacaaucucagaaggacugugcaagucaguggguagcuuguggauucucaucuggaaacgaucccaugucucugaaccuucaccacaaggagauuuucuuauagugauucucaaagucuuggcaggcauucaaacuggucccuucacuuagacauucuuuuccuuuccuccucugaaucaagucagcacacaccuucuccagggauuuuacgcugcggaucauuagagggauucgaauuuggugaauggucaccuccagcuucacagguguuuucugguaucuuuaaaagccuuggugcagugcggcuuccuggcugacuuguucggaacagcgaugagugaggagcaggaaugggcagacugcaacucugcaccacuuaugacugcaucuuucucaaagagcuguauugcuucuuuuuguuuguuuguuuuuuugagacagaauuucacucuuguugcccaggcuggagugcaauggcgugaucucggaucacugcaaccuuugccuccccaguucaagcaauucuccugccucagccucccgaguagcugggauuauuacaggcaugugccaccacgccuggcuaauuuuguauuuuuaguagagaugggguuucaccaugcuggucaggcuggucucgaacuccugaccucagaugagccacccgccucagccucccaaagugcugggauuacagacgugagccaccgugccuggccuguauugcuucuuaauuguccaaaauguccaagucucuccuaggaauuagcaagcaacucagcgcagacguaccuguuauaauuuucccacagugccuaacaaugucaaaaacccagagacuacucaguaaguccagaacugaaucuagcauccagcaaaagcuaauuuucagaggaaccaaaaaucagacuaaccucggguucuagcggcuuuuuuccacggcuaggagugcucuuggugugugucagguucuccguuuacaaagcagggaugaugccacuuucuuacaggagaugaaaccaacugcuuguaugcuuucugggcccugcuugacugcgucacaaccccauccaguggcccugaacuuggggaguucuauguaagguggcugauuugggggcaugacugcucacuagcacccugcaacuaccaugucaguacuuuccauucucuuuuggucuuuccagugucccucacuuauguccucauuagaaagguccuugccucuucagcuccagcugcccugagcuggccuuucucuggucaagaccaacaggccagggugucguuagguguccauuagcaagagaaaagcuaccugacacuuuuauuggacuggccaagaaagaugaagaaagccacuuuauuguucagucacuugaaaccaacauuccaacuccuggagaaccugauuaauuggaaucagauacaaagguuguccucaaaaugcacauggggaugcugugagggaagcagcaccaaaacacuugcuuugugcaucuguuuccugagagaugagguggggaauggaggcuggagggcaucugguaucuggauucccuggugaccuagccugaggcugaaaaagacuggcuguucacuauuacaggcucuaggugccauguguuaacagugcauugcggacugggugcaguggcucaugccuguaaucccagcccuuugggaggccaaggugggaggacugcuugaggccaggaguucaaaaccagcccuggcaacauagugagacccugucucugcgaaaaauaaaaaaauuagccaggcauaguggugcaugccuguaguccccaggcacuugggaggcagaggagggaggaucccuugagcccaggaacucaaggcugcaggagcuauaaucuugccacugcacuccagccugggcaacagagacacugucucaacaacaacaaaaaaagugcauugugaaaaaaaaggggccuuaugcuuugaugccaauagaauggagucaccguucucaucaacaggagugggaaggucaggguuaggguuugccuugaacaucguucgagaacucaggcugcugaucucauuaccacgcagguuccugggucaaagcagcuggcggguggaccuugggaauuugugcaggcugcaaccagugcuccuuuuagugcgagugacaaggauucauacaucaaaccuacccugcuucucuaaggugucucuauccccuaagaaggaauuaggagcccaccggagacccacacuuuuugauaauccucaaggaagcagcuagaaaggacagaggcaggggugggaggggauuuucccauggugcuuucaaguucaggaacacgauuaaugauaaugaggcccuacugaaucccucuucccuuccuacuuuccccccaaauacugcaggcuuguacuuccaacaagccaacagguacagcauuuugcuucuagcaggacuggacaaaaaucucccacagucauuuagaaggcaguucugggaucuuggcucacugcaacuuccgccucccagguucaagugauucucgugccucagucccgaguagcugggacuauagacaagcgccaccacgcccggcuaauuuuguauuuuuaguagagauggaguuuugccauguuggccaggcuggucuugaacuccugaacuuaagugauccacccaccucggccucccaauucuugauucuaaaucugugucuuccaccagucaugggaaccaucagagacccaaacccauacaaaccuugcuauucuuaugacaagaugagaccccaguucucaaaaauccaaggaggagucagggaacuuucaucaacauagcuaccauuaggugacucugggagcccuugucacugugcaaggagaaaugggugaaacaaaggcccagaaggcauaugucuugcccuaacaggggugcucagauuugcacagcaccuuaauauggauuaagauuuuauacugcaacaugagacaaauggagaaugucaggaccaaguacaggcaggucuagcacaggcucugacgucaugaaacauaaagaaaaguaucagcagugagagcagagguuggacaaaaugacggggaagggaaaagagaggauuuagaugagaagugaaaugucuggggggaacagaagagaaugaagugcuuacaggcauggcuguacccuggucugaggggcagugggagaugaggccaggcuguacagcuggccaggaacagaagguucaugggagaaaacaguaacaaauaaugauuucaauuuguaaguugagggauagaacagagccaccaaagauaucccagggaacacaccucucugcagagacuaugaaugcagggcauucaugccacauggacaaacacaccugaaaauguauuuugaaauaccgcuucaccagcccggucccacagcagccacucuggucuggaaguuauccauccccaaaccccacaacuuaacaggaacccagugaagaauaacaacacauuugcauagcacuuuguaauuuaccaugugccuucccauauauuaucuagggauccauaaacaucugaguaaacagcaauacuacuacuggccaauauuuccagcacgcucacuauaucccauaggcugcacaaagcuuuuaacacagacccucccauuucauccucauaggaaacuuaugagguugauccuacuaugauuucuauccuauggaugcggaggcuuacuacauaccagcauaguucucagcauguguuaacuuagaaucuugugaaguauuuaagaguuagaauuauuaucuucgggcccagugcaguggcuaaugccuguaauccuagcacuuugggaggccgaaguggguggaucaccugagaucaggaguuugagaccagccuggccaacauggugaaacccuauuucuacuaaaaauacaaaaaauuagccaggcguggugaugcacgccuguaaucccagcuacugaggaggcugaggcaggagaaucacuugaaccuaggaggcagagguugcagugaaccgaaaucacaccacugcacuccagccugggugacagacccagacuccgucucaaaaaaaaaaaaaaaaaggaauuauuaucuucagagggggaaacuggggcacagaaagauuugggauuaguccaagauggcccagcuagguuguuaaguggcagagcugggauucaaacacagguagccugguucuccagaauccacauacaucauacauccagaguccagcuuuaccgcugugcaaggcagccucaaucuucacagugucuugacuuccccaggugaggaagcccuucugguucagcccuuugauucugucuaauggcacccccugcauccuaccuccucccgugagauucugaaguugguugcuuuggccuuauccuccccuccuucccucauuuccucaagcccauagcucauaucaaucauuaccuuacaguugagugcuuuuaauuauaaaaugcacucuccugccccugcgaguccagcaggcucggcuguccaaauguggcaggugagaaaaugggggagguguucauugugauuguggcagacucaagaccaguaacaaugcccuguuuuggcauugcacuuaauauuucauagggccugcuuccuugugaccaggugacuuguguuccuucccauuuaaacauggaaaaauggcucccaaagucacaaaacagggacaagcucuagaggcugcaucugcuggguccuggccccuccacuguguccagguacucuuccaggguucaguccagccagcacugucgcagcacauggggugaugagggguggcccacuccaggucugugccgcucugccugggccacaggagacagcacccugccucuccuguccucagcucaauccccagcagucaccugacaccuucucuucucgagccccucaccguugauuacagcuuacagcugaugaccccugaugacccacugagaagauuaagaacacgaggcaaaagagcugguccgcccucccccuugggccacauccucaggacugcacagggcucacaagggucccggcuuucaaguccugacugcuccagacccccaacacuccaugacagccccagcuggucuggagccucucaaccacguccucucccaccccugguucggccacuaccccaguuccaccuccccaguggagccaauauccucacugcuccuuucauuuuccuuuucuuccccuaaaugccuuucuccuucucucucuccaacaagcaaucaucuccaucacuuuccuaggccuuaaaacucacucuucugagacuggccaaacugcauucuccaccucuccccaacaugaaugugccuuucccuagagcugaaaauguucaugccugugucuugcacuuacucauguugcuggggugcugggcugacaguagguauuuguauuaccuacucuacguucuacacuccaaagggcuuagggcuuggauaacuggcccccaacaaaauccaggcauccuccaugagcaugaugucucaggguagcaauuucuaucaucccuauuccaucuuuuugauuucugaguuaagaaaauuaggagagaaaggcuaaacuccucagcaacaugggggaaacuggugguccaggaauguuuacagucuugguauaaacuccccagagauaaaugagggggcaauugugggugggggaggaacucgggguggcuuugaaagcaacuuaaaaggagcacagaacagcgcagcggggcuccgggggcccucugcagagguuuuuuuauuacguauuuuggcuuugaaauggaacugaaaacuuaccuucggcuggcaggacccggccagagugcagaagcaucucaccgaaaucccgggucacagcugccauccuacaaggguuuggguggagagagccccaaaaauguguuucucucaacucucggaguccccaaauagaaggagagcugcaaaaauggggggcacagguauguguggaaagagagccgggagcaccaaaucaauuagcagggccugacacccagggccaauggcguccaccagccccccgacccaggggauuuggagaagggcuuuuuuuuuuuuuuuaaauugaagaaagugaaaagaguaagaggggacauuuugcaugcaaaugggccacugccagaagagcccauuaaaauguaaaaacuccacauucagccugacaaaacggugcaaacugcuguguuugccagagggccggcaauaaagcucacaacaaaggggccgggggacaauggcagacugaauggccucugccagcagguccccccgugcguugccauggggaccccaccggggcuuacuaaagguauuuccugaggagaaaggccgagcacacaggcccaggcagcccggcuaauccugacaggaagccauggccauucagcagcccaggggcuuggggcccagaguuuuguuuuguuuuuauuaaaaaaagauuucggccuuuugugcgucccaccucgucacuguaauuuagugccgagccgccugcacuagccaaagccacagccaggacccugcacccgccccgagaccccccaaaaacagauccccccgagcugggcagcaagacacguguagaaucccacuugggaaucgcaggcgccaagagcuauuggccuggagaguuguguguggaucuuaaaagacagagggacucugggugucguaaaggauaacgcagccugagaacugaguuuggggcucaagcuucuaugcacggauucaucugaugccuccuucaaaucuguacuuuuuuccccuagggauuuugccaccuuucuccaaucagcaccagugucccccaccuccucccuaccucucacaauggggaguucacuaccucacugggagaagggcuguaauuaagugauuaacaaaggaaugcacccaagaguugucugaaaagaaauuucccuccuuccucucuccccagcaaaaguucucacccuauuguuuacugauacauuaaggacagagcuguacagaaaacucuuacuacacucuuucgcucaaccuauucccaauacacuuugcuucucucccuccuaucuaaacaggaagaaagcauugcucuggaaagagggaaguucauucacucauccaagaagagcaaagguagaugcccugcggcuauggaggagggccguccaagcucacaguuccuagaaguuugugucaccauuucacauuuagcaccagaauccagccuuggcagauucagggaaggaagccaaggacacagcugguggugaagacagaaacuccugugugacaacugcccccuaggacacaguuuagggucaauuaacauuuccugaacaacuugcaaauggaaagagccauccccaaugaagacugaaaaaugagaggcucaacucaucuauuaugacuugaacccaagucuaucuguguuugcaaaggcugugcuguugcaccuagaccuccacccagaaacauguuuuggggcugacauuuuaauagaaacauagagaggaaaacauacuauuucggagacauuaagacugugacuagcaacugccccggauacccugggaagcuucuaaggccauauuggguggguccuauuuugggaaaagaaguuggggcaucugcacgauaauagaaagcucccaggaucugguaaggaccacuuagguggacuguaaguuggggggaucuaaacacucagguuggaccggggcagggggagugucuucuccugccuuuauuauaauauaaaucacauccuaaacucaaagcaaaguccaacucgucaucaccugugacagugcauaagaaagaacaucuuccaccaaguuguuaaaguggugugugugugugugugugugugugugugugugcaggggucccacugcuggaggggagcucagacucucccaccacuggcccggagcccaggccucccagccaugugucugcagcugcgaccugucaugcacuuccuggucuggguucuguaauggaaagaucauuaagagugggggaggguggagagaugaaucaacggcaaagagguaacccugcagcucccacucuccacugagcucugaccuuaaaguucggucagguuccuuaaggaaaagaauguaucgcccuccccccaccucucccagcuggggccucucgaacaaccuccccucccccaaacucagcagaaauuguauggggaaggaaacgccagcagcugggcagggaaaaguugccgcucccuaaacuugcugaugaauuaguagaggcuucagcuguuucaggaugugucuucuggucccccaagcccgacaugggugcuugagcucacaguucaccuggacucucagcaccccaagugccugccauauccccgcaaucccgucucauuccugcaaugguggggcugggucaccagccucuccagaguagagaaaggaaugggcuucauaaaguuacuuuuucuccaccguaaagaaauucucuuaagguuucacacgaugagacuaaagacaauaaaacauccuuugaaaaugaaaagcuguagaauagugguuaccaaggggcuggaagaggggagaagggggaguuagcguugaacagguaaggugucagggaaggugaaauggaugguggugauggcuacacagcgugaauaaauuuuaugcuacaaaacugugcacuuaaaauuggugaaaaugcaccacaaagaaaugauaaauauuuaaagugauggauacaauacagcaauuaccaugauuuggucguuacauaaugugugcguggaucaaaacaucauaccguacccgacgauuauacauaaccauuaugcaucaauuacaaauuuaaaaauuggccgggcacaguggcucacaucucuuaacuccaauacuucgggaggcugaggugagaggauuguuugaguccagggguuagagaucagccugagcaacaaagugagaccucaucucuacaaaaaaaaaaaaaaaagaaaaacaaaauuagccaggcaugguagcgugcaccuguggucccagcuacuugggaggcugaggugggaggaucucuugagcccgggaggucgaggcugcagugagcugagauagcaacacugcacuccagccugggugacaaagugugacccugucucaaaaacauuacauaaucaauuuaacuuaaaaaaauaaaaauaguuaaaaugguuaauuuuauguuacauauauuuuaccacaacaaaagaauuagauggcgcugggcucgguggcucacgccuguaaacccagcacuuugggaagcugaggugggcggaucacaugaggucaggaguucgagaccagccugaccaacauggagaaaccccgugucuacuaaaaauacaaaaugagccaggugugguggcgaaugccuguaaucccaccuacucaggaggcugaggcaggagaacugcgugaacucaggagguggagguugcagugagcugagaucgcaccauugcaccccagccugggcaacaagaaugaaacugucucaaaaaaaaaaaaaaaaaaaaaaaaaagaaucaggugguaaugguagcaggcagcauuaguuuauuaaaaacguucuuacuuggcaaaaaaguugaugauccuuuguugguuccaaaaaucuggagggaaauuuuacuggccuaugaaaucuaaaaaucugggaccacuggucuguuccacgaauuuccaggagagcuuggacccagagacugcuucauucacaucccaucuauccauaccccacacauucauccuucagucucacuuuuaugcacacaacaugaacguugagcauuuaguacucucaguuuuaagaaauuaaaaacaugguucggguuuuuuuuuuuuuuucuuugagacagggucucauucuguagcccaggcuaaagaacagugccaugauuucagcucacugcagccuccaccucccuggcucaagugauccccccaccucagccccccaagcagcugggaguauaggcacuugccaccacgcguggcuaaauuuuuuuuuuuuuuuuguagagacaggguuuuaccauguuggccaggcuggucuugaacuccugacgucaggugauccaccugccugggccuccaaaagugcugggauuacuggcaugagccaccaugcccagccaguuuagggauuuuucuaccugagaguguguggcucugugguagccaggaagcuaaagccuaguaucuaugcucaggguuccagugaucuggggaucuagaacaauccugggaaaagagcccuuacucucagcaaagucaguauuccccauguccuacuagaagagagagaguauacuuugagguccuuguaaaaccauuuagucccaaacucagcuugagccacagguaguugucacuggcuggguccagccagagagaguaccugaagaaaucacucagaugacagcugaucacuuacugugugaccucaggcaagucaccuccccucucaagccucagcuuccuccacuguaaaaugagaaggcugacugacccugucccagcccuaaccaauguccuguuucaccugggucuugugagaugauagaggggcaucgcuuacuggcaucccuuuccgugcccaucgugagcacaaagcucccucugaugugagggaagugaagagcccucaacuguccuugaguuguccuucagaaaaaacgauucuguguuggucucagggcuccggcuaccagcaccuucaauaaaugcuucuccucuucacccguucucccuggccuggggugcuucuccagaaucuaaggcuggcagaaagcccagcuauacauggaggauucacuuuagugucaucuuuugauggucaugauauauuaccccaugagaauggcuaggccaauaaauuuuuuaaaugcacugggaguuugggguagugaagaagggcuaaaauuauaaaauaaacaucacuuucaagugcaugucaggcauucauacagucucaaugaaauugacauuucauuuuuuggggaacggagucucacucuguugcccaggcuggagugcaauggugcaaucuuggcucacugcaaccuccgccuccuggauucaagugcuucuccugucucagccuccagaguagcugggauuacaggcgccugccaucacgcccgguuauuuuuuuuuuuuuuuaauauuuuuaguagagacacuauguuggccaggcugggcuugaacuccugacuucaggugaucugcccgccucaaccucccaaaaugcugggauuacaggugagccacugugccuggccgcaagugacacuucaaaucaugacuacccaaguuuugaaugccuaacuucauucaguaguuaguaaaggaaacugacucuucuaagguucaaaagcuacuuccuaaaaccuaaggaaaauaaaccuuaauuccaaaaguaaacucuggaguuugacaccagaggaggagaaggacacuucugaagggcuggagugcugauaagcauucuaaaggcagugauaauugacugaaagcuguggcagagcaggagagcauuccaggaaaaggguguccuuccuuccuagggaagcucuuagaucacuucccuguucacauccuucuccucccccaugccuccaaggcaaacugacucagcccucucccaccuuuuuuuuuuuuuuuuuuuuuuuaaagaggaagucuugcuauguagccaggcugcagugcaguggcacaaucucggcucauugcaaccucugacucccugguucaagcgauucucccgccucagccucccgaguacuugggauuacaggcgcccgccaccacacccggcuaguuuuuuguauuuuaguagaaacaggguuucaccguguugcccaggcuggucucgaacuccugagcucaggcaaucagcccaccuuggcccccaaaagugcuaggauuacaggugugacccaccacaccaggccuaggugauccuccuaccuuagccucccgaguagcugggauuacaggcgcccaccaccacgcccagguaauuuuuuguauuuuuuguagagaugggguuuaugccauguugcccaagcgggucuucugagcucacucuaucugcccaccucggccucccaaagugcugggauuacaggugugagccacugcgccuggcccuucuucauuauuuauaaaaaacacuaguagccucaaaaaaauguuaaugucccagccucugaagcuuuugauauguuuacuuccauucaucagagauuguuggaccacauccauauuagaagcaaucuaguuuaugcguccaggcaauacccauaccacacauucuaggcuaacugugaccuauaaagaaaacucaggugucggaucugacaccuugggaaccuucuccauguaggucuuuggcaacaguggaaauggcagcguccauggggauuuuguuccauugauuauucuaggcuagggaaccuuguucauuaaggcaguucacagaccugugacugauguguaaccucucuacagaaugccacaggagauauuacugcaagcaaacacacacacacacacacacacacacacacacacacacacacacacacacacaccccugacaaagggaggggaugccugacuccugugagacaaaggggacugagccagcaauguuuacauucagaaguugguccaccuagauuuuguggggaaacccaauuugauauagaaaaauaguguaauacaaugggaaaaaaauacuauagcagaaccaccugaguuuaaauccuaguuccaccccucacccacuauauaaacuuaagauagguuacuuaaccccucaaaccucaguuuacucaucugauuauggucauaaaaccuaugccuauggaaucauuguaaaaaugggaaaaugucaagcaugcagaguguggagaugauauuuauuauuauuacuuuugagacagagcguugcucugucgcccaggauggagugcaguggugcaaucucagcucacugcaaccuccaccuccuggguucaagcuauucuccugccucagccuccugaguagcugggacuacagguggccgccaucaugaccggcuaauuuuuguauuuuuaguagagaaggguuuugccauguuaccaaggcuggucucaaacuccugaccuuaagugaucugccugccucggccucccaaagugcugggauuauaggugugagcaacugcacccggcugguauuuauuauuauauuuuaaaagacauuuacugguauaaucuuuugggggauauuugguauagugauguaauagugauaaaaucaaaacuuaaaacaaauggaacuauccuuggauacauggacagauuuuauuuguaagaauauguucuauugaaugcaaacuauugaaaauaaccuaaaugcccaaauguagagaacuggaucaacuuuguacacccacacaauggaacauuauguaguucuuaagcauaaugaaaaacauucucuguauggcucuaaaugcugauaucagucacaaaacaucguauacaguauaaauccuaauucugaaaagucagguuuacauaaaugcaagaaaaaagucuaaaacaauaaauucaguuaacagugauugcuuuugaaugauggaauuauaggagucuuccuuuuccucuuuacaggucuguauuuucugaauuuugaaagaugaacccagauuaucuaacaaaacaccaauuuuuuuuuuuuuuuuuuugagacggaguuucgcucuuuugcccaggcugaagugaaguggugcgaucucggcucacugcaacuuccgccucgcggguucaagugauucuccugcuucagccaccugaguagaugggauuauaggugcgugccaccacaccuggccaauuuuuguauuuuuaguagagacaggguuucgccaggcuggccagugcugggauuacaggagugagccaccgcgcccagccuaaacacuaauguuuuuaaaagagugauaaagauauacuugcugacuauagagaacuuugcucuaguggaguaaacagacaucuauuaaaaacuccacauaaugugaggcagaguaaaguaaguguuagaaugaaaguuaaaaagaggccaggugugguggcucacgccuguaaucccagcacuuugggaggcugaggcggguggaucacuugaagucaggagcucaagaccagacuggccaacauggcgaaaaccugucucuacaaaaaauacaaaaauuagcugggcaugguggugggugccuguaaucccagcuucucgggagggugaggcagaagaaucgcuagcaccugggaggcagagguugcagugagccgagaucgcgccacugcacuccagccuggaugacuaagcgagacuacaucucaaaagggcaugguggcucaugccuguaauccuaacacuuuaggaggcugaggccagaggaucgcuugaucccaggaggucgaggcugcagugagccaugaucacuccacugcacucuagccugggcaacagagcgagacuaggucucaggagaaaaaaaaaacacagaaaaaagaaaaagagaaaaaaugggguaauuaauuuggagauaggggaaggcuucaaaagggagguggcccuuaaguuaagcuuuaaucuaaacccaagcuaaaccuuaaacuaagauuugagcaggaauuauaaaaagugaaaaggaagaaaaggacaggaacagauauuuccagcuaagggacuaggauaaaacaauguauaaaguauacauuguauuuacggaaaaaggaagagacuugcuugacuagaugaaugaauaaaugaaugagugaaaaaaaaucagucaaugaauggaccauuagccagaagcuaguuuuugauccuagagaaaagugaggaagggcuaagcucugaauucaauguucacuguugguuaacuccuagaaaccuccguguugcuguuucugaccucuuucucugcccaaccucguaaccacuaagucuacucuuugcggaacuccuugacccucucacccacuucaggcucccugugucuccauguccagggccugggaacacaaauggcacagcccccaccccaccuuuuacacaacccaucccgggaggcucagccacgccacagcaugugaacgaggagagggcguggaguuucaagcucugccaggguggaucuuucucagugccugaaaccagcuacacggagcccucaccccacagccccuaguuugcagggcacaaaugcuuuacaugaaggcaguagauaccuguuuggcaaguggaaaggcaagaacuguugugagccaagaaacaggagaagggagggaacucugaggguagaaguucaaugucucuuggugccacacuggcaaugcuaagaggcaacaggcccacuaccggggaggagggguuagggcaauuggcccugcuacuuggcugccaccagcuguaagucagagcaaaccccaaggucagaaguggcccagacuccagcaggcuucuccuaggaggaaacaguuugggauuuagcccaggcccuucagauccagguagggcaguuagcuuucagcuuaauuauuuagggugcaguggggcuggggaguaugguggguggggagaagggauugccugccugcaaguuggugaaagagccaggcccaggaggaaggccugggccgccccguucaggagcccaggagaaugagagcagcuggacuuccccggucaacagggaaacaguugucucauuuccaagccucagggaaggaagaaagaggcaaagguggugucuacagggugagcuggagcccccaguggccccggaggaacgaggcauugugaaaauagggccagcugcuggucgggcucucugaccccagaccucgcccucccggauaaugacuccccaggacucacuucucccagggccauucaucaccgcccagacacaagccaucacucacugcuucugccuggccaggagcaaacaccccuccgugcuggggccacaggcucccaaagaaucccugaugcugucucuccaguuccugcugacccgacuccagguagucacaggaaccaggugauggaaacccugacagagucuuuguuugggaucccucccuucccccacuggcagcaagaucucuggacagccauuuguucuucccugagaaauuccuccucccugacuucagggagcgggccuggcagagccagaguggaaaaucagugaagcuaaugguguagcaaugcagaagccggagccaagaacacagccucggaguggcuuugcugcgcuugccccagcuuggucaagagggccacgugagcguccucacauucucucacaggccgagggcuggguccucccuguccagcucugaacacuugcaaacaccccuuccaggcacuggagccacuucuccaggggaagugggacagagcugauccucuggggaaaccuguuaugagcuuagcaccuugcagauuucuagaggccuaaauccuccacccuuguucucaagagggucaucugacaucaccuuuugcuccauggaauuccauucgccuucuggcaggggaugaagaaacuccucuuaccauccagguugaaugagaagcaaacaaguucuuuucaucauaagaaaucaugcuggagauggggugggaguaggggagggucuugccugugucccaaggcagccuugggacacaggaccacaguccaguguagaugcuagacuacaggucugauaguggaacagagggugucccacuaccaaaccuguaguaccuauuugagacucucccugcagccaggcugaaacgcacaccccuuugggccaaaggcagcuggagacgcccagggauggaggaccugcaagggcccuaugaucugaggcuaggcaauggcucuggcaccacgcacagccucucccccauaggugcagguuucugcaaaacacagagacaaagccccgcuuuguggugcacacagggcauccagggggcuugaggccagaauggaaaugugugguuuuuccauuaagugcaaccucuccccccucuaacaagccaccagacuccuucaaaucugggugggugggaggagcuguaaaacucagcccauuaaaucacuucugagcugcagguuuucugagcacugggguguuuaacccacaguacugcugaaaagggggcaggacccccaccccaacuaccagcaguggccuugcaagcaguguuguacucacucacuggcuuugcccaccaagacuugacuuauugcaaaagacagacaaaugcacccucugcaagcucagaauguuggggcuuaucaucugaaaccggcuucagucuuuccaaacaacucccucaccacucucaaagccugaucugaaacaagcugaggcucuguaagaucccaaaccaaaggaggggaaggagagggagaggggagggaggcugguuuuccuggaacccuuauuaaaucaacuuuccaaggacagccagaaacuccaggcccuccccaaucccucaggagcacuugcagacugaggggcguugguacugcgcucaguggggaggggcucccgacagacacacagacacacagacacacacacacacacacacacacacacacacacacacacacacacuuaaaaucacagcaaggccuuuuaaauggggaaaacucagugugaacaggguuuuaggugguuugcucucaccuuuuggacaaagcccuuaauacauagauuauaauguguuucuucuuuuuuuuaaagacagggucuccuucugacacccaggcuggagugcaguggcuugauuauagcucacuguagccucaacuccugggcucaagcaacucucaagcaauucucccaucucagccuccugaauagcuaggacugccgaugugugccacguuacccagcuaauuuuuaaaauuuuuagagauggggucuugcuauguugcccaggcuggucuggaacucccgggcucgugcaauccuccugcaucggccuccuauagugcugggauuacaggugugagccacugugcucgcccuaugauuuuuuuuuuaggacaacagcagcauuggccaggcaugguggcuaacaccuguaaucccagcacuuugggaggccgaggugggcagaucaugaggucaggagaccgagaccauccuggccaacauggugaaaccccgucucuacuaaauauacaaaaaaacuagcugggcgugguggcacgcgccuguaaucccagcuacuugggaggcugaggcagaagaaucgcuugaacccaggagguggagguugcagugagccaagaucacgccacugcacuccagccucgcgacagagugagacuccgucucaaauaaauuaauuaauuaauuaaaaaauaucagcauuauuauuuaauaaucagcaggcccaagacuaugcaauauacuuuacacuuacaagguuccuuacagcuuacaaagcaugaagccagaucuccccuuagaauguccugggcacagcaguucucuguucugucacaaagcucaugagagacaggcuaugugaaagcaccacacucacacugagacgggggcuuacuccaccaaacagagaccuggggcuuguucuccaagugcaggggcuuuccguugcugugucccaugaaacaacaugcuccucgccaugugccgucuccccuggaggcccagggaaagggacccacaacggccauugacugcucauggccuacggaccaggcaauguccuaugagcucugcagacaugcuuauuugauauucacaaugaccuuaugagcacacauucauuaucaauauauuuuauaaaagggcacaaagaggaacuuccccaagagccaacagucaguaagguguggagccaaaaucaaaaccagggcaguccaaggaaaaugugugcccacccaggcuugcacaugaagguucacagcagucuuauuacaauagcccaaacuguuauaccuaaauuaaguugguuuggccaggugugguggcucacaccuauagucccagcacuuugggaagccgaggugggcagaucacuugaggucaggaguucaaggccaaccuggugaaacccaucucuacuaaaaauauaaaaauuagccaggcauaguggugagcaccuguaauuccagcuacuuaggaggcugaggcaggagaaucgcuugaaccugggaggcagagguugcaguaagccaagaucaugccacugcauuccagccugggcaacagagugaaacucugucucuuaaaaccaaccaaccaacaaacaaacaaacccagcugaucuuaaacuccugggcucaagugauccuccugccucugccucccacaguacugggauuauaggugggagccaaugugccuuugaaaauuaaguugauuuuuaaaaaauggucauuuaaugucagucuuccuggguacauggcuccuaagagccccauccaccucucuuacucccuuucuucuguucacagggccgguacuuuguccucaucaagaucuucagcccccagguuccagccuccacccugccccagcagcuuccgugaagcccccuccucuacuagcacccccacccuggcccuaaaguuccuuauacucaucccgucgggcuggcucacaagcagccaggcccgagauccacuucucccuucuugggcugcaaaaaaaagaaaguacuuuaggcuccauuauaaauucacauucucaaaccucaacuagcuccuugcuacucuuccacuccuuuaucgcugucuacaauuggcggauucaaaucuaaacuccccucaaaccucccacucugacucacucccuuuacacucucaucucagucuccaguugcccacaguugacacccaaccuacuuaaacccacagaugcuauugcuguagugucuuuacuacuuuuuccuuccucuaucaucucccaguccccauccuggucaguaccugcacuuccucuagccagacacucaaaauaaccugcgaccucauccuucuggcagcagcaguggcagcaauagcaacuauuaacaccuuacauggaagugcuucaucuggauuaccccacuuaacccuuuauuauuuaucccuguuuuacagaugagcaaacugugacguaugguguuugaguaguuuguugaaguaaauaaugcagcuaucaaguggcagagcaggaugcaaacacaggugcaccucacucuuuccucccagccauccacacugagcugccaaauuaacuuucugaaagcugauagugucacuacuugcuaaaaacuuuucaaguuucccagcaucuacccauuuaagucuaguuuucuuuucuugcuuuuuuuuuuuuuuuuuuuuuagacagaguuucacucugucacccaggcugaagugaagcggugugaucauggcucacugcaaccucuaccucccagguucaagugauccucccaccucagccucccuaauaguugggacuacaagcaugugccaccacaccuggcuaauuuuucuauuuuuuguagacacagggucucaucauguugcccaggcuggucucaaacuucuuggcucaagcaauccuccugccucggcuucccaaaauguugagauuaccagcauaauccacgccuggccuaaguauaguuuucuuuuucuuuuuugagacggagucucacucuguugcccaggcuggagugcaguggcgcgaucucagcucacugcaugcucugccucccggguucacgccauucuccugccucagcuggagacuggagcuggaguagcugggacuacaggcgccugccacuacgcccggcuaauuuuuuuguauuuuuaauagagaugggguuucaccguguuaggcaggauggucucgaacuccugaccuugugauccacccgccucagccucccaaagugcugggauuacaggcgugagccaccgugcccggcccuaaguauaguuuucuuagcagggcauuaagccuuccauaugcuaacucaauccaauuuuuccaaguguuguuucccagagcuaccuacucaccaggcaaaccguucuccauaaaccauauacaugcugucucugaacacucaugcuguucaaccuggagggcccuucauuuuuccccuucugaacucaagcccaucucaggugcucucugcuccccucuuccucugcauucccaccaccucugguuguaacuucacugggugguuuaaacacagucugucuuguguuacuuaucccuguacuugcccaucccuccugaccauaaacucccugugggcagacacagucucucccacuuuggguccccaccgugcuccagcucagaccuugccuucgguucuguuacugacagcaacaugaauaugccugcucuagccacugcaccuucuauaaagucucacacaacuuucccuguucauccccaacuccauccagaggacacauauucucacccaucacucaucauucaaacgagucccugaccagcugaguggcagccuuuugcacacagccaccccaucacgcgcaccuccaaccuuucacccacugugugucaaccuucucugugugaccagccacugagucacgaaccacacuauccucuggcagcagaaaugcucauacauuaguuuucaaagucccgcgaaagccaccgguauucuguaccuauaaucucccaagaggccuuuccacagcucacacagaucccaagaauggugggguaaguccuuccuguuaccgaugauggcucugaauuuccaacacgccauaggucuccaugccccuuuaugcuuccugggucucaaucacuucaaaaccccucaaacaguaccuauccaaagcaaaucgcuuggcaggcccccaaacagaaccugugagacacaguuaaggauaggaaaaugcaggcgugaagccaugacugcugacccuuauagaagaugugccuuuuuuucacccaggcuggagcgcaguagugcaaucauaauucacugcagccucaacucuuaggaucaugcaaucuuccugucucagccuccugaguagcaaguagcugggacuagcagcgugcaccaucacacccaguuaauuuccuuuuuuuuuguagagauggggucucgcuauauugccuaggcugaucuugaacuccuggccucaagugauccucuugccuuagccucccagagugcugagguuacaugugugacccacuaugccuggcgaagauguggccuugaaacaauuuucuggaagucagaggucuuuagcaagcucucaccuccuacaacauccccuguagucugacccaaguucuacacgcaaauucuaaggucauucucuccccauugcaccaccagcugcauuuuauacaucaccuauguuaaagugugacacuaggguccucaucagauauucuuuccucagaaagagaaaagcauaaauuaccccccacaaacaugucaucucagguaaauggaugucaccagccuucaugaccccaaccucugaugaagucaguuauguuuauaaccagaccagaaccaacccagguaucuugagaguuucuccuacaggaagggaguucuuugcuccacuugggaaggagccuucccuguugaccacaucaccugcaaccauaucaccucccucccagcccauccuguucccaaggcccaggaguccaggcugcccccagccagcaccuuaccuuguucaggcaaggucggggacggccuagcggugcagaguguggcugugaccagcacagcccagaagaggaggcacuuccagcuccacaucccaguucugcaguuagagguuggugacaaggcuccacaucuccauggauacuccacagugagcucgauccuccuuuucaaacugacccugaggaaaggaaaaaaaccccaaaaguuaggagggucuagguaggggaggggaaaggaaaaacagaagguaaaguaugccaugugguggcugcuuaaaguguggacuuacuaaggcguccagaagaaaauugugaagcuaccccaacaaugaauuagaucauagguccuggcugggugugguggugcacccuguaaucccagcacuuugggaggcugaggcgggaggaucacuugaggccaggaguuugagaccagccuggccauggcgaaaccccgucucuacuaaaaauacaaaaauuacccaggcgugguggcgcgcaccuguagucccaguuacuucggaggcuaaggcaagagaaucgcuugaauccaggaggcgaaggaugcagugagcugagauugcaccacugcacuccaaccugggugacagagcgagauucugucucaaaaagagagguuauaggucuuaauuggacagagggaugcuuuaguucaauucuacagcuauguuuugagugcagauuacgugcaagccugggaauaccaucaugagguuuuccaagguauaaacuucaaaguaguaugugcuacaaagugaauggucucaugaaagucccaaauaguucugcccuuuugugggaaacaguuuuacaaagugugcuacaauugcaggagguuugagcaugcugauggcuccccagcauaagacuucacucugcccaggccaggugcgguggcucacaccugcaaucccagcacuucgggaggcuaaggugggcagaucauuugaggucaggaguucaagaccaaccuggccaauauggugaaaucccaucucuacuaaaaauacaaaaauuagcugggcauagugguacacaccuguaaucccagcuacucaggaggcugagacaggagaauugcuugaacucaggaggcggagguugcagugagccgagaucgcagcacugcacuacagccuaggugacagagugagacucugucucaaaaaauuuaaaaaaaaaauuuuaaaaagaccacuccaucuagggccaaccagucccucuggugagaaauaaggggcaaugaagaaucacggaacaagcuaaggaccaguaaauggaagccagguacagagauaacuaguuaguagcugcuggacuccaugcucaacuccccgaccuaugcaaugaagcagcugaaauaaaugaccuccuggguacuuucuuuuugucucuaaaauuguacgaaucacauccauaguucuaccagccucccuugcagagagaagaaaacccucaccagcuacuuacaaagagccuaagaguguggagccaggagggauccaguucucccugaugcuggaaggugacaagugaugucugacggauaugaguccagaaguugcggggggcaagggggccugggaggucccacugcagaaucaaggucuauugcaagcacugagucaaagauggcucacacuggccccaguuaaaagaacagaaucugcagcccuuuacccuucucaggucuggugggguaaaacuuaaaacuccccagggucuuaaagaacggaucauagcuguuaacauuuaccaagugacaagacuuucugggcacugucaaggcuacgugggggugaccaucucuauuuuccagguggcuucuguccuaaaugcuccagggagccauccaaguuauucagagaaucuacuuccccggaacaugcccuaaugugguacuucagcccugccucccccgagccaggcagggccccucgcaagugagucagugcuggcuggcagaaaagccccuggauucuuggcuucguucacaugugcuuggccagcgggauacacaugccacaccacuagcucccucccaaggcuuacuaaaauguuuuaaugauuucaaaucaaaagagaagucaacauuucucuuucauuuuucuacuuuuacgaaaggaaucagaaaagagaaaaugaaaugaauacugaacacccacuauguaccaaggaugcccuaaguagaauuaauuuagaacuauagugaggaauuaauucauuccucacuauaaacuuaugggggauaaguuuuauuauuccuuuuaugcaauggagaaacugaggcucaaagagguuaaguacuuuacucaaggaaauguagcuagcauguaauagugccucaagguuuuuggauauuagagaacagggugggaggaaguaaauaagggauugaucaagccugacuccaucugaugcaaacucaauuuauccaaaccaaguagauaaggguaaauccaagguaacucugguaacaaaagaggcuugauuugcaguuccauuggucaaagauagacccuugugccagggcauguuggcucauaccuacaaucccgggacuuugggaggcugaggcgggaguaucaccugagguggggaguugagaccagacuggccaacauggugaaauuccucgucuacuaaaaauacaaaaauuagcugggugugguggugcacgccuguaaucccagcuacucaggaggcuaacgcaugagaauugcuugaauuugggagguggagguugcagugagccgagauugcaucacugcacuccagccugggugacggagugagacucugucucaaaacuaacuaacuaaaagaaagacccuuggaagcagaccacagaugggccaucuaggacacugcauggggcacauucccagagcugggauagaagcagugcuugccagaggaugccccuaaacccauauuccacaacuuacuacaucccgaaaauacaccugaugcaggccugucacccagaaacgcacaccugaccaagaaaacccaggucccuugcuaagugucagaauacugaacaaguucucagguuccaaugggaaagaguggugucauguugagaugguuaagcuugcuucgacuuggccacucuguccccagaaaagccugccgccuccucccaggugugggcuggcugcagaccgcccucucucagcucccuggucaaugcacuucaaauucaucugccagcuucccucuuguucuuucccaaaaaagguacaaaaagucucuuccucuccuaccccucuggcccucaaguuugacaucuguaaaacaaggauguuaagaaaaccuggccuccuggcaccaacuccuggaauaagaagucagcauacaccccaugccacccgccugcaaaaaacacagugacacaggccacuaguccaacaugcugucugggacccugccaccuccugcuucaccucaguuucucauucuacuaauuaaugaauuuuuccaaucccuuagaaacaacuuccuuccuucacugcuugacagauagauguaaccugcagccuugcagguguacacagcagcuuccuccaagacccugcagcugguuccccccgccccgucucuccaauaucagcuaggcuccugggauucaugccugcaugcagagguccucgguggggagcagagagggggcacaucucaguuucccacucaucagagggggcugaaauacuugccuugccuccaucacaggugguuaugaagacugaaugggcugcaugggugaaagugccugcugucuucucacuggaguacugauccaacauacaggguggacagugucuggugagauagcaggggcuggacggaccacgugaccuugaagcucucccacuucuaagagaaaaaccuaugaaugucagaucuccuuguccaaaaauuauguaaggaaaacuagcugacgaauucauggccaaaucuuuuuauucuuucugagacagaguguugcucugucacccaagcuagagugcaguggcacgaucucaacucacuacaaccuccaucccccagacucaagugauccucccaccucagccucccgagaagcugggcuaauuuucuguauauuuaauaaaaauggggucucaccauguugcccaugcugguaaugaacuccugggcucaggagauccaccuacaguggccucccaaagugcugggauuacaggcaugagccaccacacccagccugggucuuuuuauucuuguccgcuggagacaguaugaauucacacccuuccacuuaugaucuugccacccugggauagucacuuaaccguucuaagccucgguuucccaccuagaggaagccacaucacaggugauuaugaggcucaaauggguggugugggugacugugcccauucucuccucucuaaaguaccaaccaaauguaaagaauuaugcauuuggauuucagauauaauauuaagauauuuauaauucucuuuguguagugcuuugagucacuccuuaauagcacucucaggagauuugguaauuggcagcagaaggacaggaacuuccaaccuuuccaaaggcauuucucacucuccaucuucaugucuuauauucuagaccuguggcccacacaguggccacugcacacuugaaauguggcuggugcuaacggauaugcuauaaguaaaaaguauacaccgcaucuuaaaaacuuguuaugaaaaaaauguaaaguaucucaucaauaauuucuauauugauuacauguucaaaugauaauauuuuggaaauauaguuacauuaaauaaaaucuaaacaaacaaguuaauuaaaaaacaaauauuggccaggcgcgguggcucacgccuguaaucccagcacuuugggaggcugaggugggcaaaucacgaggucaagaggucgacaccauccuggccaacauggugaaaccccgucucuacuaaaaguacaaaaauuagcugcgugcaguggcgcgcgccuguagucccagcuacucaggaggcugaggcaggagaauugcuugaacccgggaggcagagguugcagugagccgagauugcgccacugcacuccagccuggcaacaaagugagacuccgucucaaaaaaaaaaauuuuuuuuaccuauuucuuucuuuuaacuuaauuuccaauguggcuucuagaaaaucugaacauauacauaacucauguuauaauguuauauuucuuucuuccuuucuuuuuuucuuugagauggagucuugcucugucacucaggcuggaguugcaguggcgcaaucuuggcucaaccaccgccucccggguucaaacgauucuccugccucccaaguagcugggauuacagacaugagccaccaagcccggcuaauuuuuuuauuuuuaguagaaauaggguuucaccauguuggccaggcuggucuugaacuccugaccucaggugauccaccugccuuggccucccaaagggcugggauuacaggcaugagccacugugccuggcuuuuuuuuuuuuuuuuuuuuuaaacagggucuuccucugucccccaggcuggaaugcaguggugcaaucacagcuuauugcagccucugccuccuaggcucaagugauccucccaccucagccuccugaauagccgggacuaccaguaagcacgagcauacucaucuaauuuguguauuuuuugguagacacagggucucaccauguuguccaggcucaucuccaucucaugggcucaagcaauccgccugccuuggccucccaaagugcugggauuacaggcaugagccacugugaccagcugcucauguucuauuucuauagggcgccacagcucgaagcaacauccaugccucugugcaagacuuucuucaugccauuccuuguucugcaacaggccagcccuucccuuuucucugaaccccaccuuaagaagcuguuucuuccauaagacuuucuugggccuucuagcuggagaauuucauuccuccaaauuugcaaaccacauuacuagccccucucacauagcacuuaggucauauuauaugauuguuauuuauguucuucauucucuucucuccccacgaaacugcaggcuccuucagaacagggucugugccucccuaaccuuugcuaacacccucggcaccuagcauguacacaggagaugccaacauguuuguuaacuggaugaaugaguaagugaaugaaggaaaaaaaagggcugaugaaaagaaacugacagagauacuccuccagaaaaagaggcugagaauaucagagaaaagcaauuagguaguaccccuuguuaaccagccaaacucuaguccaaagaacccugagaaaauuucuggacaacuugguucuucagaauugaggaaguaacaccaaaacauuaaucccuucagaugagaauaagacuuauuucuuccccaaagugaccauucucuacucacauguugagagggcagggggcaaguacuuaauaaacauauggagaaaguuacucagcucagcuugcuaaauuuuaguugguccaauggaaaugcuaauuuuuugagucucuuuaaaaaaaaaaagugucuaaauguccuuggaaguaagagacauauaaaaaauuagcaauaaguggucaggcacaauggcucacaccuguaaucccagcauuuugggaggccgaggccagcggauugcuugaggucaggaguucaagcccagccuggccaacauggugaaacaccaucucuauuaaaaacacaaaaaauuagccggacaugguggcgcaugcuugcaaucccagcuacuagggaggcuggggcaggagaaucgcuucaaccggaaggcggagguugcagugaccugagauagcgccacagcacuccagccugggcgacagagcgagacuaucucaaaaaaaaaaaaaaaaaaaaaaagcaacaagugaaacacgaacugcugcacauaaucuagaaaaccuugcucuugaagacaggauguacuaugaguggaaccccaccaaauucuugggauaguucauccaugugagggcuauuaaaugggggagagggcccuaaacaugguuucuuucauugcaggggagagauaaaugguggcgaggagagaauuucuguuuaaaguagaugcaaccuuaggaggaaaaacaaauauccuagcccaagucugacauuucauccucucuggaaacaccagaaucuucucuaaagcucugcaucugggcucccacuagucccuggugcguucaggccuuuuacaaagcucuggggaagacaaauguaagacacaaauuucccaggaggaaauuaaacuaucaagugaugugaggcccuuucagaauaagacauuugaaucaauucuaacuccuuuuccuccagcagcaacaggcucaaacuuugcuaggauguucuauaacuaacagccauuuugacgaaagacacuuuagaaacgaaggcaagaaaaaagccuuuguagaagccggcugcuaaacccccaaguucauaccagcaaaucucucauuuuaggagucuuguuucaggucaauacugaaaacaaagagcacaccacuaaaagcaaaacccauggauuuuccuuggucucuaaggcuugaaucugccuacccaguguucaauucaauuuucuugcccucuggaguccaccaggaauaaagcuagcccagccugagggaugcaccgauguaucuaauccucugccccuagggagugggggacgcuucuccauuucuuccugagccuuugcuucccuugcuaucaaagggccaccuaauggaacugucuaacacccuccauggccagaggccaaggaaaagaagcacccuaagauuguucaaguggugcccacucuggccugaauucccauugggaaaaauaccucgaaaaugagcauuucugcaggcauguuuggaaaagcaggcagugaaguacgcaguccaaguggcucucaaucuggaugaaccucauuaaaaagcugacacucagcuaugacuaagaguaaaugcaacagauauuucaagcagcucgucacugaugcaguucauaacccucccagcuggagucaggccccagcagccucccgguccccaaacacccugcacucggagggucggggcagccccggagcuucuccuaacccacuggggguaggauauguaaacaagucauuagggaggcaggccaucggcaaagacggccggcaauagcagaggcugcugaaccucggucaccgagaggaagguggaugacccgggcgugggggugauuacccagaccaaggcgcgucccacggggcccugcuacuucgcuuuuaaacaagccucagggaggaaaccgggagcccgggccaagggaggaaaauggccacuuucugcuaaacagucucaaggcuagauaguauuccaaaaaaagcgcugguccggaggugcaaaggguagggcacaucugcggaggaaacagucaccuuaauuaccacgucuagagaaagugcgauuucauuacagccuccaaaacuaccgcccaaagaaggaaaccagagaaguguuuucaauuugaaagaggcuggaaagaagcggguaagacaccgacucuccccacccucccggcaacuuuggaccacaaggcgcuuuccugccucaaagacuauuaccaaacacaacucgaaaauccaaccccgcuuucaaaccuguagccguuauuuaaacgguaaaacaccccacuuuaguuuccgggggaugcggcccaaaucaguccuuaaaaacacacagagagcgccucuggcagcagccgcccacgcccccggcccugcgcaccgggcuugcuccgggaggggcgcgugacgccaccgcggggcagccgagaggggaccgcgggcuccgggcagggcaggcgcucccgcagcuccagcuauaacacaagggagagaaagcaacgcuuugguuccagaaacuuccaucgucaaggccaguucuggccagacgcacagccaaagagccccccuagucuagcggaugaaccguucgcgaguggcacccccuaaaaccuuggccccaucucccaagaugccucuuuacugcgcaauccagaaagcacccggaccgccgccacccaccagcggcggcgaauaacuuggugagaucuuaaauaacucgggauccaagggaacuuucuuuucucccccgaaucucaacgccgcaucuccaagucuccagaaauguuaaggagggagguggucaagacaggcugaagaaucugaguuuuaauuugggggagggggaggggaggaagagggaaguuaauaaugcggcugcgguguacccguguggggugaaacggaaccagaugcggcugcuacaucuggaaauugggggugggggagugcugggggagaaaggcaccgugguaauguuuuucaaaaggguugauagcuucugggcucagaacaagaaacaggcuucacaccccaccccccccccaccaccaccaaaaaagugucuggcugccucauaggggguguguguucuauaugaacccccaucuacaagguccauaaaauuccuccgcaaacaugggucguagccucacuuuucucccaaccccaaacauaacgguaggggaagcgaggugcagaggggucugggccagagaagcauacgcaucgcugccgagugaaccacaccggacaaaaacccucaucccuucccccaccucuaggaaccagauugggaccgaacgguccuuccgcccccaucccacaccucggcuuaacgaccguggguuguccucccguuccccaaacuuccgacccuuucagagaccguccaagucauaagaucaccccuucuggaaaggggagucguuuuucgcucucagcucaagcagauucagccauuuggugacgacaccuccuuaaaaccuauuccaagagaagcuaaccuagcccuccacguccuccgcaguucaucucccaccccauccgaccccaacccgcaccccaggcuuucccggggguggaaaaggacuuaggaaugccccggauuuuuagcguugagcccaaagcuaccugcugaauugggggugaauccccaaaaggggaccaaaaagacauggaguggaaugcaacacacacacauaacacacacaacgcaucccaccucgccgcccacucccgcccuccuccccaguccaggaaaccgcgggccucgccgccuucgccccgggccugucccucccgggacucacugaggagccgccgccgccucgccagcucccgagcgcgaguuggaggaaaaguugggcggcgggaagagcggcgggacgagcgcagggagggggcgcaggagacgcggacggagggaagggaggggagacccaaggggcgcggaucgcccgggagggagccaggaggugaaaggggcgggcggcgagcggagggaggcgccggccccggcugggcugcggcgggcaaagcgcgcagccgggaggcuccggcgccgggggccgcucgggacgccaagcccgccccagauccgggggcgccgcggcucuuaccucgcucggcguggagguuccgccucgggagaguccgccguggcuugugcgagcgggcgugugcccgcguccccggcuccggcccgccgcccccgggcucuguucggguccuggcggggucgcaagagcuccgcggccggcgcucgacucccggcggcgcucggugcucggcgccuccagcccgggcgggaacaauggagccggagcuggugccccggaggcggggcggggggagggcucccguccgccacccggggucuccagaccuugugccccccuccuccagaacgcagcggcggcgccucacuuuccuugcagaccgggcuccaucgcccugcggaggccccggcgccgcggcgugcccgacugcagcacggguaccgugcgcccugcggggcgccccgagcucggaccggagaaaaguccuuggguuccgcggcuuuucaagcagcggcgcgcucgcggccggggaaggcgaggucgccgcaaugcgcuacgaggggucucggucccguccggacguggccgcccagcucccggcacacccggguuccuccgcgcgcugcggcugcaccggcgucccggcucccgcuagcugccgcccgccgccgaggacgccgcgccuguggccgcaagagcgcuccgagcgcuaugcgccggcggggcgcgagggcuc

SEQ ID NO: 21250 - RNA, 2141 nt, Homo sapiens
gaggcggcgccggggagaucggucguacacagcggucccggggcggggugacccggcccgggcgcgcggccgcccccaugacgucaacccacaaggcagcgcgcuguuguggcguuuaccgcgcgucgccggggcaacggcggccgggcgggcgucggcggcuuggccccgccccuccaugcaaaugagcgacgucacccgcacccaauggcgaacgggggcggugagcucaucgcgccgagccgaggcuauaagagggcgcacaaguggcgcggcgcaggagccgccgccaguggagggccgggcgcugcggccgcggccggggcgggcgcagggccgagcggacgggggggcgcgggccccccgggaggccgcggccacucccccccgggccggcgcggcgggggaggcggaggauggaaacacccuucuacggcgaugaggcgcugagcggccugggcggcggcgccaguggcagcggcggcagcuucgcguccccgggccgcuuguuccccggggcgcccccgacggccgcggccggcagcaugaugaagaaggacgcgcugacgcugagccugagugagcagguggcggcagcgcucaagccugcggccgcgccgccuccuaccccccugcgcgccgacggcgcccccagcgcggcaccccccgacggccugcucgccucucccgaccuggggcugcugaagcuggccucccccgagcucgagcgccucaucauccaguccaacgggcuggucaccaccacgccgacgagcucacaguuccucuaccccaagguggcggccagcgaggagcaggaguucgccgagggcuucgucaaggcccuggaggauuuacacaagcagaaccagcucggcgcgggcgcggccgcugccgccgccgccgccgccgccggggggcccucgggcacggccacgggcuccgcgccccccggcgagcuggccccggcggcggccgcgcccgaagcgccugucuacgcgaaccugagcagcuacgcgggcggcgccgggggcgcggggggcgccgcgacggucgccuucgcugccgaaccugugcccuucccgccgccgccacccccaggcgcguuggggccgccgcgccuggcugcgcucaaggacgagccacagacggugcccgacgugccgagcuucggcgagagcccgccguugucgcccaucgacauggacacgcaggagcgcaucaaggcggagcgcaagcggcugcgcaaccgcaucgccgccuccaagugccgcaagcgcaagcuggagcgcaucucgcgccuggaagagaaagugaagacccucaagagucagaacacggagcuggcguccacggcgagccugcugcgcgagcagguggcgcagcucaagcagaaaguccucagccacgucaacagcggcugccagcugcugccccagcaccaggugcccgcguacugaguccgcgcgcggggcgcaugcgcggccacccuccccaaggggcgggcucgcgggggggugucgugggcgccccggacuuggagagggugcggcccuggggacccccccuccccgagugugcccaggaacucagagagggcgcggcccccggggauuccccccccccgagggugcccaggacucgacaagcuggacccccugcucccgggggggcgagcgcaugacccccccgcccucgcgcugccucuuucccccgcgcggccgccccguguugcacaaacccgcgcgucucggcugccccuuuguacaccgcgccgcggaagggggcuccgagggggcgcagccucaaacccugccuuuccuuuacuuuuacuuuuuuuuuuuuuucuuuggaagagagaagaacagaguguucgauucugcccuauuuauguuucuacucgggaacaaacguugguuguguguguguguguuuucuuguguugguuuuuuaaagaaaugggaagaagaaaaaaaaauucuccgccccuuuccucgaucucgcuccccccuucgguucuuucgaccgguccccccucccuuuuuuguucuguuuuguuuuguuuugcuacgaguccacauuccuguuuguaauccuugguucgcccgguuuucuguuuucaguaaagucucguuacgcca

SEQ ID NO: 21251 - RNA, 6441 nt, Homo sapiens
cuccuguaucaugugaugcagcggccuuggccggagcucuccggccuggagguuugcggggagcgggggcugcagaugcgcguccucgagggaccaugcacgcggugcacguggggccgcgcggccggguucugaggaccaugaaagauugauggggggcggagccagccgcagucacccccuccgggcucagcccuggguuuaggguuacagccccaccuggggcaccugccccuugaagggggcugcugggguguccccaucggcaacccucugagccccuccucugaaacgcccaggauuucaaggucacaggcugcccucugcugggggcaccaccaauuaauacuggggcuccugaugggauaaggguguccuccauacaccggccguuuucuggagcccuugccaucuucugccugggcuugggcacaugaggauggagagagccccccucacggcucugcuacacccgguauccccagauggcauccgccacagacucgcgcuaugggcagaaggaguccucggaucagaacuucgacuacauguucaagauucucaucaucggcaacagcagcgugggcaagacguccuuccucuuccgcuaugcugacgacucguucacgccugccuucgucagcaccgugggcaucgacuucaaggucaagaccaucuaucgcaacgacaagaggaucaagcugcagaucugggugggucccagcuggagggcucccgcccggcucgguuggauucccguacuuggaaaagcagccccaaccucgucuaucucuuuccugacuggagucauucacuuacacacugggcauuuaucaguaaggugcccacuguguaccggggcagaaacagcaccuguguucucccauaagcaccuaauccuggucccucaguuuccccaucuucaaguucuuccauguaugagguuucagcuggaucuugguccccauucucuuuuuuuguuuguuuuuugagacaggguggucuugcucuguccccuaggcuggaaugcaguuacgugaucacggcucucugcagccucgacuucccaggcucaaaccauucuuccaccugagccuccugaguagcuaggaccacgggcuucuaccaccacgccugcugauuuuuuucuuuuuuguagagacagggucgggcuaugucugcccaggcuggucuugaacuccugggcucaagcgauccucccaccucagccucucaaagugcuaagauuacaggcaugagccaccccaccuggccuuguuaguuuuaagagacagagucucacucuguugcccaggcuggauuugaacucgugggcucaagcaauccucccgccucagcuucccaaguagcugggaguacaggcaagugucagcuuccuuuaauuuuuaaaccuacaguuaaauucucuccaucuucaucuggcuugauuuuucuccuugguccuugucacucuccaauauaggauacauuuauaccguuauuuucuauuucccacacugagugucacuuagcaagggaagugcccaucuuguuaacaacuguguccccaguguccaguucaggguguggaaaagaucagugcccaguccauguuuguuuauuuguuuguuuguuuuuugagacagaguuuuugcucugucacccaggcuggagugcaguagugcaaucuuggcucacugaaaccucugccucccggguucaagcgauucuccugccucagccuccugaguagcugggauuacaggggcucaccaccaagcccagcuaauuuuuuuuuguauuuuuaguagagauaggguuucgccauguuggccaggcuagucuugaacuccugaccacaagugauccaccugucuuggccucccaaggugcugggauuacaagcaugagccaccacgccuggccucuguuuucuuucuuucuuucuuucuuucuuucuuuuuuuuuuuuuuuuuguuguuauuguuuugagacggagucucgcucuugucacccaggguggagugcaauggcgcgaucucggcucacugcaaccucugucuccugaguucaagcgauucuccugccucagccuccugaguagcugggauuacaggugcaugccaccacgccgagcuaauuuuuguauuuuuaguagagacagaguuucaccauguuggccaggcuggucucgaacuccugaccucaggugauccaccugccuuggccucccaaagugcugggauuacaggcgugagccaccaccacacccgacccccuguuuguuuuuugagacaggguuucacucugucacccaggcugaacugcaguggcgcgaucucaccucacugcaaccucugccuccugggcucaagcaacccucucaccugagccuccugaguaguugggacuacaggugugagccaccacacccuguuaauuuuuguacuuuuuguagagauggggucuugcuauguugcucaggcuggucuggaacuccuggguucaagccaccugcccaccucagccucccauagugcugggauuacaggugugagccacagcaccuggcacaguacguuuggugaaugacucuguggaauaauggagcacucauauauucugagcacuggugacccaaccugcucuuccugacacuuugugccccugggcaagcuccugcuucucccagggggcugaacuggaugauaucagagcucauuuccucuucgagggccuuaugugcagguccucucugaccuucaucucuuccucccuaggacacagcagggcaagagcgguaccggaccaucaccaccgcauacuaccggggcgcuaugggcuucauccucauguaugacaucaccaacgaggaauccuucaaugcagugcaggacuggugaguguaccccacuugcucuuuuuuuuucuuuucuuuucuuugagagaggguuuuauucugucacccaggcuggagugcaguggcacgaucagggcucacugcagccucgaccuccugggcucaagugauccuccugccucagccucccaaguagcugggacuacaggcauauaccaccacaccuggcuaauuuuuuuguauuuuuaguugagaugggguuuccucauguugcccaggcuggucuugaacuccuuggcucaagugaucugcccaccuuggccucccaaagugcugggauuacaggcgugagccaucgcuucuggccuuccacacucauucuggggccauugucucugagccaaacuuucuucaaaaaauaauaaauaaaacguaggggucagagaaggauuucagauggaaaaguaaaacuauaaccauauagaaacaaauaucugcaaguguaggguggagaauauagagacuauaaggagaguuggcauggccgggcacgguggcucacaccuauaaucccagcacuuugggaggcugaggcagguggaucaccugaggucgggaguucgagaccagccugaccaagauggagaaaccccaucucuacuaagaaugcaaaaauuagccagacgugguggcgcacaccuguaaucccagcuacuugggagccugaggcaggagaaucgcucgaacccgggagguggagguugcagugagccaagauugccauugcacuccagccugggcaacaagagcaaaacucugucucaaaaaaaaaaggagaguuggcauagguuagagauuguaaacauuucaauuuucugcucagaaguaauaacuuuaaaaaaaaauuucuggguugggcacaguggcucaugccuauaaucccagcaccuugggaggccgagguggguagaucuugagcucaggaguucgaguccaucguggccaacauagugaaacccugucucuacuaaaagcacaaaaaauuaccaggcaugguggcucaugccuauagucccagcuacuuaggaggcugaggcaggagaaucacuucaaccugggaggcggagauugcagugagccuagaucgcgccacugcacuccagccugggcgacagagcaagacucuaucucaaaaaaagaaaauuucugggcuggguggcucaugccuguaauuccaguacuuugagaagcgaaggcaggcagauacuccagccugggcaacagacccagacucuaucucaaaaaaaaccccaaaacacagaaacaauaaugggucagucgggggcuggaguggggugaaagcggggcacauugggggaaaggaugguggggaggauggaggggcaagcuucugggucuuucuuccucggacaaggacacaggcuccacaucagcccgucaggguggagcugggauccuccaagcccugaccugcccccauuggugccuccuauagguccacccagaucaagaccuacucaugggacaaugcccaggugcugcugguaggaaacaagugugacauggaggaugagcggguggugucaucagaacguggccggcagcuagcugaccaccuuggugagugcccagcugggcuggagacccacaagucuagaaaaaggacacuaagagaggggagggcacacacccaaggucuuacagcuaaagccagguaauucacacuuucugcaaacuagccuucauccaggagccauuugaguuggauccugagggauguguaggaguuugccaugcagaaaguuuaaggauuuauucugacacucaccguccaacgcuuuguuggguguugcugggcucaagaggcaucuaggggugccucgagggaccccugagguagagggagggaccuggaugggaggagcacaugagaggagccaggcuuccuggagugguggguagugaagaagggucuuucaggcagaggaaauagcuugggcaaaggcuugcagugagaaagguccuguguguuuugguaauaauuucacaagacuggaacaugagggucagcuggaggaaauguggccgaucacagagggccucaaccaugugcugagaggcugggacucuuuggagggcaauagggagucacagagggugugugagcagggggaggucacagcuggauuugagugucagagccuuccagggccagugcacggggcugggcuggacgcugcagggcaugucuugccaggucccuaaggacaacgagacacaauuuuaggaaggaagggcaggaggccaggugcgcuggcucacaccuauaaucccagcaauuugagagguggggguggaggaucacuugagcccaggaggucgagacugcagugagcuaugaucacgccaccauacuccauccugggcagcagagcaaggcccugucucaaaaaaaaaaaaaaaaaaaaaaagcaggaaaugcaaagcugacccaguuccauguugcuucucugugggauuugucaguaccuucaauaaguuucuucucugugggauuugucaguaccuucaauaaguugcuuggcacugggaaucuccagguguucccuuuccucagagaagcaucucugggaguuggcauagggcguggccaggguccucaucccugccuucucugaccacaggguucgaguucuuugaggcaagcgccaaggacaacauuaacgucaagcagaccuuugagcgccugguggaugucaucugcgagaagauguccgagucguuggacacggcggacccugcggucacaggcgccaagcagggcccacagcucagugaccagcaggugccaccgcaccaggacugcgccugcugagagccaucccacucccuuuccccucuucccugucuuccccaccuucccccaacuacccgggccugacccggccccuaccagccacgggcacaagaccccugcuccugacuuagcccgucacccuuauuuauuauuguagcuauuuauuuauuuauugaagaugucccccaggggcccaggcuccccugcccgccccaagcccugccccuccuguacauauagcccuuuccccacucagcuguggugucucguggccccgugaacucaccgcucacccuccugaaccccccccccccgccuuuuuuuaaaauucacccccauccacaguugucaguugugaagaggggccagaugacacccuaaagcaggcugaucgggcaaugggagguggccaggccugccagccccucggcucugccgcggugggccgaggccgcuguuggggguuucccuguguggaccauggggaucagagucuggccugccaggcuccucuccccguuuucucuuuuggugggggggugugcuguggguauucaccacccugggaccccccccccccccgcccaccagaccuguucugaccucaugagugucaaacgugccccccaguuccuuaggagaugucaugacaacacuacacgcacccaauaaagcgaauggaccauccaugugugucccugug

SEQ ID NO: 21252 - RNA, 6441 nt, Homo sapiens
cacagggacacacauggaugguccauucgcuuuauugggugcguguaguguugucaugacaucuccuaaggaacuggggggcacguuugacacucaugaggucagaacaggucuggugggcggggggggggggggucccaggguggugaauacccacagcacacccccccaccaaaagagaaaacggggagaggagccuggcaggccagacucugauccccaugguccacacagggaaacccccaacagcggccucggcccaccgcggcagagccgaggggcuggcaggccuggccaccucccauugcccgaucagccugcuuuagggugucaucuggccccucuucacaacugacaacuguggaugggggugaauuuuaaaaaaaggcgggggggggggguucaggagggugagcggugaguucacggggccacgagacaccacagcugaguggggaaagggcuauauguacaggaggggcagggcuuggggcgggcaggggagccugggccccugggggacaucuucaauaaauaaauaaauagcuacaauaauaaauaagggugacgggcuaagucaggagcaggggucuugugcccguggcugguaggggccgggucaggcccggguaguugggggaagguggggaagacagggaagaggggaaagggagugggauggcucucagcaggcgcaguccuggugcgguggcaccugcuggucacugagcugugggcccugcuuggcgccugugaccgcaggguccgccguguccaacgacucggacaucuucucgcagaugacauccaccaggcgcucaaaggucugcuugacguuaauguuguccuuggcgcuugccucaaagaacucgaacccuguggucagagaaggcagggaugaggacccuggccacgcccuaugccaacucccagagaugcuucucugaggaaagggaacaccuggagauucccagugccaagcaacuuauugaagguacugacaaaucccacagagaagaaacuuauugaagguacugacaaaucccacagagaagcaacauggaacugggucagcuuugcauuuccugcuuuuuuuuuuuuuuuuuuuuuuugagacagggccuugcucugcugcccaggauggaguaugguggcgugaucauagcucacugcagucucgaccuccugggcucaagugauccuccacccccaccucucaaauugcugggauuauaggugugagccagcgcaccuggccuccugcccuuccuuccuaaaauugugucucguuguccuuagggaccuggcaagacaugcccugcagcguccagcccagccccgugcacuggcccuggaaggcucugacacucaaauccagcugugaccucccccugcucacacacccucugugacucccuauugcccuccaaagagucccagccucucagcacaugguugaggcccucugugaucggccacauuuccuccagcugacccucauguuccagucuugugaaauuauuaccaaaacacacaggaccuuucucacugcaagccuuugcccaagcuauuuccucugccugaaagacccuucuucacuacccaccacuccaggaagccuggcuccucucaugugcuccucccauccaggucccucccucuaccucaggggucccucgaggcaccccuagaugccucuugagcccagcaacacccaacaaagcguuggacggugagugucagaauaaauccuuaaacuuucugcauggcaaacuccuacacaucccucaggauccaacucaaauggcuccuggaugaaggcuaguuugcagaaagugugaauuaccuggcuuuagcuguaagaccuugggugugugcccuccccucucuuaguguccuuuuucuagacuugugggucuccagcccagcugggcacucaccaagguggucagcuagcugccggccacguucugaugacaccacccgcucauccuccaugucacacuuguuuccuaccagcagcaccugggcauugucccaugaguaggucuugaucuggguggaccuauaggaggcaccaaugggggcaggucagggcuuggaggaucccagcuccacccugacgggcugauguggagccuguguccuuguccgaggaagaaagacccagaagcuugccccuccauccuccccaccauccuuucccccaaugugccccgcuuucaccccacuccagcccccgacugacccauuauuguuucuguguuuugggguuuuuuuugagauagagucugggucuguugcccaggcuggaguaucugccugccuucgcuucucaaaguacuggaauuacaggcaugagccacccagcccagaaauuuucuuuuuuugagauagagucuugcucugucgcccaggcuggagugcaguggcgcgaucuaggcucacugcaaucuccgccucccagguugaagugauucuccugccucagccuccuaaguagcugggacuauaggcaugagccaccaugccugguaauuuuuugugcuuuuaguagagacaggguuucacuauguuggccacgauggacucgaacuccugagcucaagaucuacccaccucggccucccaaggugcugggauuauaggcaugagccacugugcccaacccagaaauuuuuuuuuaaaguuauuacuucugagcagaaaauugaaauguuuacaaucucuaaccuaugccaacucuccuuuuuuuuuugagacagaguuuugcucuuguugcccaggcuggagugcaauggcaaucuuggcucacugcaaccuccaccucccggguucgagcgauucuccugccucaggcucccaaguagcugggauuacaggugugcgccaccacgucuggcuaauuuuugcauucuuaguagagaugggguuucuccaucuuggucaggcuggucucgaacucccgaccucaggugauccaccugccucagccucccaaagugcugggauuauaggugugagccaccgugcccggccaugccaacucuccuuauagucucuauauucuccacccuacacuugcagauauuuguuucuauaugguuauaguuuuacuuuuccaucugaaauccuucucugaccccuacguuuuauuuauuauuuuuugaagaaaguuuggcucagagacaauggccccagaaugaguguggaaggccagaagcgauggcucacgccuguaaucccagcacuuugggaggccaaggugggcagaucacuugagccaaggaguucaagaccagccugggcaacaugaggaaaccccaucucaacuaaaaauacaaaaaaauuagccagguguggugguauaugccuguagucccagcuacuugggaggcugaggcaggaggaucacuugagcccaggaggucgaggcugcagugagcccugaucgugccacugcacuccagccugggugacagaauaaaacccucucucaaagaaaagaaaagaaaaaaaaagagcaagugggguacacucaccaguccugcacugcauugaaggauuccucguuggugaugucauacaugaggaugaagcccauagcgccccgguaguaugcgguggugaugguccgguaccgcucuugcccugcuguguccuagggaggaagagaugaaggucagagaggaccugcacauaaggcccucgaagaggaaaugagcucugauaucauccaguucagcccccugggagaagcaggagcuugcccaggggcacaaagugucaggaagagcagguugggucaccagugcucagaauauaugagugcuccauuauuccacagagucauucaccaaacguacugugccaggugcuguggcucacaccuguaaucccagcacuaugggaggcugaggugggcagguggcuugaacccaggaguuccagaccagccugagcaacauagcaagaccccaucucuacaaaaaguacaaaaauuaacagggugugguggcucacaccuguagucccaacuacucaggaggcucaggugagaggguugcuugagcccaggaggcagagguugcagugaggugagaucgcgccacugcaguucagccugggugacagagugaaacccugucucaaaaaacaaacagggggucggguguggugguggcucacgccuguaaucccagcacuuugggaggccaaggcagguggaucaccugaggucaggaguucgagaccagccuggccaacauggugaaacucugucucuacuaaaaauacaaaaauuagcucggcgugguggcaugcaccuguaaucccagcuacucaggaggcugaggcaggagaaucgcuugaacucaggagacagagguugcagugagccgagaucgcgccauugcacuccacccugggugacaagagcgagacuccgucucaaaacaauaacaacaaaaaaaaaaaaaaaaagaaagaaagaaagaaagaaagaaagaaaacagaggccaggcgugguggcucaugcuuguaaucccagcaccuugggaggccaagacagguggaucacuuguggucaggaguucaagacuagccuggccaacauggcgaaacccuaucucuacuaaaaauacaaaaaaaaauuagcugggcuugguggugagccccuguaaucccagcuacucaggaggcugaggcaggagaaucgcuugaacccgggaggcagagguuucagugagccaagauugcacuacugcacuccagccugggugacagagcaaaaacucugucucaaaaaacaaacaaacaaauaaacaaacauggacugggcacugaucuuuuccacacccugaacuggacacuggggacacaguuguuaacaagaugggcacuucccuugcuaagugacacucagugugggaaauagaaaauaacgguauaaauguauccuauauuggagagugacaaggaccaaggagaaaaaucaagccagaugaagauggagagaauuuaacuguagguuuaaaaauuaaaggaagcugacacuugccuguacucccagcuacuugggaagcugaggcgggaggauugcuugagcccacgaguucaaauccagccugggcaacagagugagacucugucucuuaaaacuaacaaggccaggugggguggcucaugccuguaaucuuagcacuuugagaggcugaggugggaggaucgcuugagcccaggaguucaagaccagccugggcagacauagcccgacccugucucuacaaaaaagaaaaaaaucagcaggcguggugguagaagcccgugguccuagcuacucaggaggcucagguggaagaaugguuugagccugggaagucgaggcugcagagagccgugaucacguaacugcauuccagccuaggggacagagcaagaccacccugucucaaaaaacaaacaaaaaaagagaauggggaccaagauccagcugaaaccucauacauggaagaacuugaagauggggaaacugagggaccaggauuaggugcuuaugggagaacacaggugcuguuucugccccgguacacagugggcaccuuacugauaaaugcccaguguguaagugaaugacuccagucaggaaagagauagacgagguuggggcugcuuuuccaaguacgggaauccaaccgagccgggcgggagcccuccagcugggacccacccagaucugcagcuugauccucuugucguugcgauagauggucuugaccuugaagucgaugcccacggugcugacgaaggcaggcgugaacgagucgucagcauagcggaagaggaaggacgucuugcccacgcugcuguugccgaugaugagaaucuugaacauguagucgaaguucugauccgaggacuccuucugcccauagcgcgagucuguggcggaugccaucuggggauaccggguguagcagagccgugaggggggcucucuccauccucaugugcccaagcccaggcagaagauggcaagggcuccagaaaacggccgguguauggaggacacccuuaucccaucaggagccccaguauuaauugguggugcccccagcagagggcagccugugaccuugaaauccugggcguuucagaggaggggcucagaggguugccgauggggacaccccagcagcccccuucaaggggcaggugccccagguggggcuguaacccuaaacccagggcugagcccggagggggugacugcggcuggcuccgccccccaucaaucuuucaugguccucagaacccggccgcgcggccccacgugcaccgcgugcauggucccucgaggacgcgcaucugcagcccccgcuccccgcaaaccuccaggccggagagcuccggccaaggccgcugcaucacaugauacaggag

SEQ ID NO: 21253 - RNA, 48152 nt, Homo sapiens
ccggccuccgagugcgucacgugacgggucgguggcgcuggcgguugcugucagcugauucccgggguugguggcagcggcgguagcagcaauggacuuucuccuggggaacccguucagcucuccagugggacagcgcaucggugagucccuggagccccccacagcuccgccccggugcuccgcacccagcuucgguccccugggaagccuccgggugccuagucacggaggcagggagggcaaggaggcuggcguguagcucuccgaccuggcuccgcccagcuuuccucccacucuugauugacaagaacuugggccauuaggaagccuuggcuugugauagauguauaugacagccaguagguaaggagagaggguggguccggaugcccacggcgcagccaaugugcgucugcugggguccccaaucgagggagaaaguuuucgugguuaaagggacugcgugguuggcaguggcugggccacucugcugggucccgccgccugggcucuggccagcuccuuccuggcucaccgggcccuccggacacagacaccugagaagggcuagaagucccuucucccaggaccgcgaagccccgggcuuggcgucuuggggccaacuggccagaggggcccagcgccggacagcccgcggccaggccucacagacccgggucucaggacguguccgccugggcucuuuucucgacccaaccucaaauggacccgcacagacucucagaaccugagcagacaguggucggacaaacccuccuggucagcccaucucggugcuccguagguggggcagccgggaacucgggccaagccaagcccagggcaccuggcgccugucugcugguccgugguucucugcacccuggugacaggauacucacaguucugugacgcagccucccugggccgagguuuccucaccuguaguuggcgggcaauaaugguccccaccuccgugggcuuguugugaagauuaaauuccuuaauaaaugugaaauacuuagaacaaugccugguacauggccagugccauauaaaaaaaaacaguuguaauauuuauuaucacugggcugggcacgguggcucccgccuguaaucccagcacuuugggaggccaaggcgggcagaucgcuugagcccaggaguucgagaccagccugggcaacauggcgagaccccgucucuacaaaaaaaaaaaaaaaaaaaaauacagaaauuagccgggcgugguggugcgugccugugcacccagccacucgguaggcagagcugggaggauuuauuggaucugggaggucagggcugcagugagcccugauggcgccacuguacuccagccuggacgacgcagggagagcccaucucuugaaacacauacacauacacacacacacacgcacacauauauauaaaaauauacacauacaaacauacauauacauacacauacauauauauuauauguauuuacacacacacguuguuccugagaucaccaagugaagguuaggaaucccuggaaaucgcuuggcaguagaucucauaggugcucauucuugggcaccaacaccaugagaaccgacaugccuucacccaaacagccacacuucuccggaggaugguuuggguguuccgcauucuugcaugaagaaaccaucgcauuaccgugaaauuacucuucaucuuuuuugaugacgacuuuucgucuuaaguccagacugggaaaacuuuaagaugagacauauuuuccauucuuagugucuugcgaaaccucacgaaagcuugucgacccggcucuguguuguaaucgccaccguggcugucgguggcucuuccgagguuuuguaaucaaugcucuccaagggggagguggcaguccaggauuuacacaccaggaagcuccugaaccagggagaggaacugcccucucaaaggaccccugcccuccccggacacacacccaccccacagugagucaugguuuuuuggagcugaaaagagaaggcagcucuccucucaucuauauuucucugacuacagaaaccacugcuuuuaucacaugccaaguuuaagacuuacuacuuaaaaauaaacaaguaaauaaaagaccuggcuucaaagucagccacauacucuuaaggcuuucuggaaaagcucaccuggguucuggauuucagcuaaucaaagcaaacuucucuucuuaccuugaagcguugccuuucuugggcaagaaauacuucugugcaaagagaaugcuacuaaaucauaauaccuuaaagcacaaauggaauuuugcagguaaaagagccuuaccuuggggaucuucuaacccagugguucucaucagaauuccuaggagggcuuguuaaauaaugucggggccccaaccccagaguuucugacucuccaggucugcggugggacucuagaaugugaauuucuuuuuuuuucuuuuucuuuuucuuuuucuuuuuuuuuuuuuuuuuuuuuugagacugcguuucgcucuuguugcccaggcuggggugcaauggcaccaucuuggcucacugcaacuuccgccucccggguucaagcgauucuccugccucagccucccaagguagccgggauuacaggcacgcuccgccacacccgacuaauuuuguauuuuuaauagagaugggguuucuccauguuggccaggcuggucucaaaccugaacaggugacccacccaccucagccucccaaaguacugggauuacaggcaugaccaccguguccggccuagaaugugaauuucuguugaguucccggguaaugcuaaugcuguuccagcccauccccuucauuuuacacuggcggagacuaagguccagagaggggaaaguggaggcugugacucauccaagaccccaguaaauugacagcaaaacugagucauugaaauuuaaaccaaagcugaagaggcuccaaaaguagaauuaagaguuugaguuaauccccucaguauuccauauucuuuuagauaaagaggcggaggaaguacugcucccuggcugugauuacugaugacacaguauagcugcuuauaauucuguaaaccaggccccuccuugcugcaggaguaccaucucuucucaagccugccgacucccaugcccuuguugauaguagagcuguagagccauauggaauugacaucccucagauggugauucuaaugaugcuaaucaggaaugagugucagucacuggaaucacaaaguucucauccaccuccccucccaacacacacacacacacaccccuuugugcuugcuggucccucugccuggguugcuugcuccugugcccccacugaggagcuccagaucacccuucaaaguacagggcaucaucaccuccucccugaggcuugccccaagcccgacguugcucuuuuacucucccuuuauccuagauccucaggcccccuugcccuaugacuuugggcucugaaucuccgcuuccuccuugguagaauguuacuaacagcaucugccucacagggugguugcuggaaugaaacaagauaguccucugagagugucucgcacagugugaguguauggaaacauuagcucuuccugucaucaucaccaucaucauuuuuauuauuucuuuuuuuuuuuuuuuuuugagacagagucucaaaaaaggcuggaaugcaguggcacagccucagcucacugcaaccucugccccccagguucaagugauucuccugccucagccucccgaguagcugggauuagaggugcacaccaccaugcccggcuaauuuuuguauuuuuaguagagaugggguuucaccauguuagccaagcuggucuugaacuccugaccucaagugauccagccaccuuagccucccaaagugcugggauugcaggugugagccaccacgcuuggcuuauuuuuauuauuucuacccucauuauacuaauaugccaccgucccacucuguuagugguugugcaugucugucuccacagcuaggcugaaccucuugagagcaggaacugugccuuauuucuccagacccucagcaccuagcacggugccuggcacauagcaggaaggaggaagggagaaaaggaaaguaacauuuugugagcaaacaccauaauaacucugccagguauucugcuagcguccuggguauuaaucucauggugacccugugcgguuuugcuauuuuuuucccauuucaccaaaagucagucuaagagaaagcaucgcuuuccaggguuccacagccacucaaggucagaauccagacccaggucuucuuuuguacccucaccacacugccucgagcugcccagugcuucuuuugaauugaugucugucccacccuccaagagccacaacucuuauucuacccucagauaaggacauguacaugggucucacacuugcaggccccuccccucaucgaugaguaggggagcuucccaagggcagcacccguagcugagaggauuccagauccuuuguaccagcugguguugucacagcccucuucuuucaaggauuucaaacccuuuccagauauucucugcagacaaaucuuacuggaucuguuuuguuuuuuguuuuuuguuuuuuaugagacagagucucacucugucgcccaggcgggagugcaguggcgcgaucucggcucacugcaagcuccaccucccggguucacgccauucuccugccucagccucccaaguagcugggacuacaggcacccgccaccacaccuggcuaauuuuuuguauuuuuaguagagacgggguuucaccguguuagccaggauggucucgaucuccugaccucaugaaccacccaccucggccucccaaagugcugggauuacaggcgugagccacugcacccggccuacuggcucuguuuuauagacagauaucaagaaacccauuuuccauuucuggcugucagcuuaccccuaagcacuuggaguccaaauccuagcugauugccaacaguaaguugcaaacaacagagaugguaaauaugggcagucccuggggaugagccucagugguugggguggugggagcugggugugaggggagaagagcccagagccugaagacugagcccuggaggggaaaagugaaaaagucagagagagcugucuuugaauccacaaaagccaagccgggggagccacaggaaggaaucacagaagugagagaccacuucaggcccuugggggccaguuggggaaugaugggcuggaaaguggacacuuaagcgauguugaggagacaccaggcugggaggcgggacaccugguuccagcucugguucugcuccuaacuaugucacggucccucuccauugcccaucuccccuauuggcaacacagaggugcugucauucucccucugcuucccagaggauugguaaggaacgacagaggucauauauagggacagggaaggguugaugccagagggaagaaagaaacugauggcgggccaggcacgguggcucacgccuguaaucccagcacguugggaggccgaggcggguggaucacgaggucaagaaauugagaccauccuggccaacauggugaaacccugucucuacuaaaaauacaaaaauuagcuggacgugguggcacacgccuguagucccagcaacuugggaggcugaggcaggaaaauuacuugaaccugggaggcgaagguugcagugagccaagaucacgccgcugcacucuagccuggugacagagugagacucaaucucaaaaaaaaaaaaaaaacugaugggugcuggggaggacugauagaacugaaugugcagggcuccaagggcauggugugugguuacaggaauaagcaguucgguuucaguauaaauagcuauccccagagccuugcaaagauggaacuggcugccuuguucaguagugagcuccccaccacuggagcugugaaggcagaagccgggguggggagggcgacuauaaagaggauuccuguguugguuagcagacuagaccagggucagugagcuuuuucuauaaagggccagauaguaaauacuuguggcuucgugaaccagauggucucugcugcaacuacccaguucugccauuauagcacaaaagcagcuacauaggccauagguaaaugaaugagaaugacugugcauaaauaaaaauauuuaugggcaaugaaauuugaauuucacguaauuuucacauaucaugaaauauuauucuucuucagcuuuuuuuuuucccaacuauuuaaaaauauaaagaccaucuguagcucgaguaccauacaaaacagacugaauuuggcauauggguucauaguuugcugacuucugaaucggagcagcuggccagaggcagaaugauggagcacacuguuccucaaagugggguaccagagcacccacacuggggaugcuugagggugcuuauccccacagugugcccaugugagcccuaauaucuugaagcuucuguuuccugauccguaaguacaggacccacauuagauccccaaguuucugucuugaggaugacagagcuuugucuagaaagggcuuuguaucagcuguacacauauuaguagagcccagggugagcuugagucagacugaauggucugaguccugguucaguccucaacagcuuuguuaccaggagcaaguuacuuaaccucucuguucuucaauguccucgucuguacaaugaggauaauaauagcaccuaucagauagggcugucguguuguugugcuauaaagcacuuccugccagacaggaagucucuguaauuauuagcuguugugauuuuucacugguguuaucauuccugggacccagucuaaguuaguagccaagcuaagugccagcccaagauucugacuccagugcagccuuugugauggucuuugugucccuggcaaaugagcggucacuggcuggguggccaccacauucacagacaggucagguuucaggcuguggggaggagcagauucuuacuuggaaauuaaggccuuugccuuccccuauggauagaacuggugaauagguuuuauucccuuagugagcucaaagaaauaagaguauagucccagacuuccacucuucugguuuuagaaaaaaaaaaacccaaacccucagugucuccuaauuagcuugaggccaucaccccaugagaagcagggggauucaggacaguuuaacucuuuacugccuuacuaaggagaucuugaucuaggccagugcccuccaaacuucugucuuucauguagcucauuugugauuugugucuacccccaugccaccuucauuauuauuuucguaggguuuucuuuucauuagcuuaucuguuaaaauuugaccucauccuauauaauuauauccaugaaaucauggcuuugauguucguguuuuuuuccuauccugcauuaaaguaaauaaugcaggagaggaaaaauuuaaugucccucuaaaaaugucuuuaaguuugcccaugagcccaccuggcaugaucccagguagcucauuuugaucacugggacguaagcagccugaaauggggucacagcuuagucuccgcaucagaagagcuggguucaggugccagcuccgccccuucccggcugugucccccaggucuccuccucaagggacacgggaaacuuagaaguugauagagcacugcaaagugcgguggagaaccacugugcaagcccugaggaggggaacugggccucgcuccugcuggggaagguagagaagggaaggacggagccuggagucuucccagaagggaaggacggagccaggggagaagggagggggagagaagaaccagccagaccacaggggcugagacagacagagaauuuagggacagacagaggggucuacuguuugaacuuguuuguguuggugcaguauaaacccuguagugguuaacuuuaugugucaacuuggcuaggccaggggagaaagauaguuggucaaacauuauuuuagauguuucugugaacguaugccuuagaugagauuaacauuuaaaucaccagacccgcguaaagcguauugcccucaauaacaugggugggccucguccaaucaguugaaggccugaauaggaaaaagacugaccuccccagaacaagagggaacuuggccagcaggcuccccuuguccuugcacuuggacagcaucuguuuccuggaucuccagccugccagcucacccuacagauuuucaacuugcuaagccuucacaccugcauaagccaauuccuuaagcgcucgcucuuucuccugugugugugugugugucugucucucucucucucucuuucuuucugcuaguuccuuuucucuuuuuuuuuuuuuuucuuuuuuuuuugagacggagucucacucuguuucccaggcuggagugcaguggggcagucuuggcucacuguaaccuccaccucccagguuuaagcaauucuccugccucagccuccugaguagcugggacuacaggcgcgugccaccacaccuggcuaauuuuuauauuuuuuguagaggcagaguuucaccauguuggccaggcuggucuugaacuccugaccucgugauccucccgccuuggccucucaaagugcuaggauuacgggcaugagcuaccacagccagccuaguuccuuuucucuagagaucccugacuaauacaaagcccacuccaccccugaccauccagauugucagcaauaccuuuuacacucccaaguggggagugaaaacaaaugccaucuguaccucagccagccacuucaagccucugccuucacagccucacuucuuaccuggggaguuuuagaaaaccuuucuuuaucucacugacauuuccuuuuguuagguacuauaguuaguuacaucgacuuuaacauuguggguugcggaagcaauacccucuguaagguauuuuaggguuucucuugugguuuaugguuaaaaaaaauacaggggagaggcagccaggguuuugaggaaggguggcucagcaaauuaggagauggauggaacuuuccacgcugggucuggaaagaguuauuccuuuggaaaauaguuuucaagacaaguuucuggcugaaaaaaaaauagcuucugcauauuugugauuuaaaaaucucuuauggggugcuugaaauucucaaucauguugugguugauauguuuguagaggauagcauuuauuuuggugcuugaaauguauacacuccuccucacacaucccuggaaggugagugcuuuggucaucuuuauucuguagaggaggaacugaggcacagagaggccgaggaguuacccaggcucacacagcugguaggugcuggagucugggcaggauuugucugugucugcaucccauccucccaacuuuuccaucucaccgauucccccuuagaacugaaagaggccaggcgcaguggcucacaccuguaaucccagcacuuugggaggccaagacaggcagaucgccugaggucaggaguucaagaccagccuggccaacaugguaaaaccccaucuuuacuaaaaauacaaacauuagcuggaugugguggugggcgccuguaaucccagcuacccuggaggcugagacaggagaaucgcuugaaccggugaggcggaaguugcagugagccaagaucgugccacagcacuccagccugggcaacagagugagacuccaucucaaaaaaaaaaaaaaaaagagagagaacugagagaccugcuggguuucccuuugagugacaacaucuguguccaucuagaaugaauucguucaguaguggcuucuucuguauuucugccuaaccuucuugaccacauugguuucauccucgugcuugcauucucacgguaggaagcacaggugaaaguaccaacugucugugucucuguuaccaagaaagcaaaaccuuccccaggagccgcccaagagacacccgcuuccaucucuguggccagaagucccagggcuacuucuggcugcaagggggucuagaaaagcuaaaugcugugagcccagggggagcaucuuccacaacuauuggagucagcuccacaugguaggguuaauaaaaauuucacauagucacugaguacaguaauagaaauacaguaucuagcaaggacagguaaauguggcguguggguucccacacugcauuuccagauggacagcauggcuggccuauauccagaggggucggucagaauagggugaaggcucuggagaucauuaucagaguggaguggucacagguccugaggauguuggaggacagauuaaggagggacgugguacuuuuuaaaaguauucaaagggucacgguggcucacgccuguaaucccagcacuuugggaggccaagacggguggaucacgaggucaagagaucgagaccauccuggccaauguggugaaacccugucucuacuaaaaauacaaaaauuagcugggcaugguggcacacgccuguagucccagcuacucgggaggccgagugaggcaggugaacuucaacccaguaguuggagguugcagugagccgagaucgugccacugcacuccagccugggcaacagugagacucugucucaaaaaaaaaauguauucagaggauugcaaguuggaagaaggauuaggauuuccacacaauagcuaguaagggaucaaugagugcccaaguguggagguguuucauuuacacuguuauaaagguuuauugugcuggugaauacagccucaucuuucauucagucauucagcaaacagguacugcagguuuaucauggcccaggucccaucugggguagacaguuaguccauuugugagcuauaaccgccacccuuaaagagcucacagacuccugggagagagagauguagaaacaaagagaucgcccaacagaguuauuuuaaucacuccacuaagcagugcuuagaguuguggucuguggaaaaugcuacuggcugcuagcuggaaggaauaggcccuggcgggguggggggugucagggcagacuccaccaggagaccugaccuuugaucugggcuuaggagcacgaguugagguggggaggagcacauuucuuccuggaagaagggcaguguguucagaagcacagaagccugaggagggugaugggguggcugcgggcgaucagcugagcuggugagugggagugggaggaaggacugggccaggucucagugccggcucccgagggcuucaguggagcccggugccuucagguccaugccguaguuguccaccgcggagcagucccgugggaaggccagggcagcuggaccucacuccuuaaagaggaauauuaaucacgaauacuuugagcugcagguaacaggaaacgcaaccagcagagucugaaaccaccacaacaacgcacuuuguuuaccuagcaagaagccugaagguuggcaguuucaggguggguuugacagcuccacgaugucucaaaacagccagacucuuucuuguucuguccuuagccugguggcuaaucagugaaauacagugauuguuguucugggaaggcaggguaggcaggggcagucagcaucgaacugagcaccuaggcagugcagagccucagucggucauuccaaaaguauguaaugccccccucugcucuguugcaccagaaggugggccccagaaggucugccccaggcaggcagaggcagucuucacagggacagagcagaguggagagcacacaaguuuggagcacgcaggccuggcuuugcaucuagcaagucacaaaccucugcacauuggcugcccccacgacaguuggggauguggggaggugacacaaauggagguccuccgagcauccugcacaggcugacacuucuucacugaaugauggcugucauuguucuccaugauguuguuauugucauggugcaggaugaggagugacacggucuacccagaaggaggcaccacugaggagccaacccuggguggggcuuagaagaugaggggaguucggcugggcacgguggcucacgccuguaaucccagcacuuugggaggccgaggcggguggaucacaaggucaggaguucaagaccagccuggccaagguggugaaaccucaucucuacuaaaaauacaaaaaaaaauuaggcgggcgccuguaaucccagcuacuuugggggcugaggcagagaauugcuuaaacccaggagacggaaguugcagugagccgagaucgcaccacuguacuccagccugggcgacagaacaagacuccgucucaaaaaaaaaaaaaaaagacaaggggaguucaggaguucagcugacucauuccuccucuucaucagcacaccuggcacugucucagcaccuggucuuuccugccauggaaacgaccuuuuggaauugucaguuguggccucccacuggacuguaaaccaccacuggggcaggaccuugcuggauuugcucacugacgucucccuguagccuggacagguguugagaauguuugagaagcacauagcaucgugguuaugaauauggacuugagaaccagacuucucuggcuuugaaucugcugugcaucucacaaacugugugacugcaggcaaauugcugccuucuccaugccccugaguuuauucauccucugucuuaaagguuguggugacgggugacugagggugugacgugcuuauuagucccaugccuggugcaugcugagugccagaugagcaugugaacuggaugagccugacugaaugaggaauggcauugcagacagaagcucagaggcgugagagggcaagccacauagaggaaggggguacagcugacuguggcugacgccagccccuggagaguucaggcuuuugauccucaggcagugagggugauggacaauguuuaaacagaggaaguugugcuuggaguuauguuugaguagagcguggaggugacagugcaggccuggggagguggcagcuugagccagagcugucucagugaucaugagacuguuggaaugugcaggaugggagcgagcgggcuccaggcugcuucccagaaggcugguguggaaaggggugauacuggccggacacagugggcaguggcucacaccuguaaucccagcacuuugggaggccaaggcggguggaucacuugaggucaggaguucgagaccagccugaccaacauggugaagccccaucucuacuaaaaauacaaaacuuagccagguguguuggcagguaccuguaaucccagcuacucgggaggcugaggcaggagaaucgcuuaaacccgggaggcagagguugcagugagccaagaucgugccacuguacuccaaccugggugacagaacgagacugucucaaaaaaaaaaaagaaagaaaggggugauaccauaccauggcccccaucucugauccugcccgugguguggcgugucuuuggugacuacucauucuuucucuuggcccaagucauagucauuguagcucgguuacucauugcuagccuuuccugaugucauacugacauugucuggcugcaaggucacaacauccugugaggcaggcagucuuauccugauuuuacgggugcaaaaacagagacucagaggggcuggaucuuugcccacauucuaugaguuaggucaggccagacucgucccacuccacccucaucuccaugaggggcaggugggucuugccaucaugccaggcagauuaucuggagcccuccagggaggugguaucugcaccagacccaauagggagaggacagacugcuguaaggacgcacaggugcccagugauccgaagccacaggcuugccagccauaaacaacugcaaagccgccugaugacagguggaggauugcagggcccgguucugucaggagcuggaagacaagagcacagcugcuacccggaggcccuugaagguuacagcuccgaggucggggaaucaguugucauucucuugguaacuggcaaccacuguccguguuuuuauucccccuucuuaaaauagcaagcugaauuacuucuguggugaagaacaaaaacaaagcaaauauugccagguuccuguggguuuaaaauucugcccugauggaauaugccuacccugugggcaucugaaggaaauccacaugauucaccgcaauccuguuguccacaccuggaccuggaggaaccuggaggaaccuagaagggguuggcaagugauggucugggcagaugucccacagccucccaacagcugucuuguacuggaauugcucagaucugccuugucccgauuuugucuccuccuccucuuccucuccccuuucucguuuaggccacauauccccucccaccccgcagaaaaccuccgucuucugauuggcucugcccacuacugccugcugccacucauggcucaggagcuugccugcacugcuugggucacaucagacucaugcacggggugggggcgggggguccuucugcucccaccugauugccggguaugggauuucucuuauuuaucaauguccccgcuucccuuuaaaagccacuuacuugccuuuccaaaacaaccacagccucuccugaaacacugauguucccuccuccaggagaugagaggugcccaucguuuucaggggguacuggggacagaagaggaucugaugguggggaccacugagaggccugccgguggagcucagggaggagagggccaacucccuguguggucaggaaggacacuucugggaaaacaguguuccccgccccugcugagagaugcggauggcacagaagccucaggcaccugcgccacagcgucagcggcugccccgcccuuaccucugugugcccuuugcaaguuggugaucucucugugcuucaguuuccucaugagaugagggcaauaaugcacaccuuacaguguguuaaaauuaaaucucauucuucaugugaacagcuaaugcugcuugauauucuauggcauauaacuugggaaguuaaaauauuauuauuguggaagggcaugcaggccaggucgaagacuagggagacacggaaggauuugggcaggaaggacacugucauuuucagguuucagaaaguuccuucuggacaguguggagaaugggugggaggagggaggcaggaggagggaagaagcugaggcgguagucuagcgggaggaugguggccgggcuggggcaggggcaguggcagaggggauggugugauggacagagauuugggagcugacuuggcaggacuucguggccuuuagguguggcuagggagggagaugacacuaauccucuggccugugugacuggggcuugcugagauguggccuguggcagaggagcagguucuguagguuaacacugacugacaugacuaacccccgccccaaaacccuccaaagcagggcacggcccucugcucagagggacacuuguuuggcccgcucuguucuucccagguggcucuauaaguguggaacccccaagggcaggggugugguacaaagaagccacacucaguaaaccuucacaggauggacaacucugucucucagcccugucagaggagcuuuccucauccccuccuccaggccugaucuagggguaaagcaaccgcccucugccucagccgccuggcauguguccugggccacccuggcauccgucuggcucaggaccugaggguagaacugaaguugggccaauugcaaaaccaaggucucagagccacaguuuuaguguugguugagccagccuggcuagaagagggcccuguccagucccgcagaaacugcccuccucuguccuccggcagacuggguuuagcaggcacuguggcuucuuuugggcaccuuaaagcagggaccaugcccaccgaguccaccaugguaucccagugccuggaaccggcuuggcuuacaaauagccguguagcaagcgaagagucacccacccuccccgagccggggcacagccgugaggagagagccucccuugcaggacagcgugacaucacguggaauaacaaguucuacaugccuacucuggcacacacuccugacagauaauagacagccggcagcacugugcucaagugccuggcccaucagccagcaggugugccaaggccggcaggguggcugcagcaggcggaugaguacuuugcaugugacacuugcaggggagggaaccuuggguagugcccugugucagaacagggucucacccuuaaaaggcggagcaaagccugucuuaucacacaguccuccauguagucacaauacauaccagccagagugauguguguaauggaacguuaccugcaagaaacagggcacaaaauuuccugugugcacgugguugacgcgugaagauagcaucuaggaaggcgcagagaacagaaaacaggccaugcggcaccucccuuuccuaaagaccguuuacaaaggugcuggcauugcgaguuccugcguucaucauucauguaauaccaauuagugccucccacacuacaguucacaaaaggcugccaagcccggugcuugcuaccaugcagaccugcagccaguggucccggccauggcccugacaggcuuccagaacucugcagccgacucccggccuggaaaucuuacccuaggaacugccacaaagugaaaauuucguggaacugaauagaggugguggugguuguauucaguauuacagguguaccaaaugccacugaauuauacaugguaaaaugguuaguuuuauuuuaugugacuuucgccucaacuuuuuuuaaaaagaaccaccaccacuugcugaguguuuauuuugggcccguaccgugcugauaccuugccgugcugauaccuuacugugcugguaccuugcaugaaucaucaccucucuuugggguaguucugcuggguggcucggcaucggucccuucugugggugccucagaaggguacaggagggccaggugaccuguuaguaauggagcguuugcuuccuagguaaagaagcucucugugagauucuagaggaaccugguuacaggggaugccucuaggaagagggggcuggggcaggggacagagauagauuuaccuagcuccauuguauaccacuugagaacuuuuacauuuuguauccugugaaugguuaccaacucaaaagauaauucuuuuuugcuuguuuguuuguuuguuuuggagauggaguuucgcucucguuguccaggcuggagugugauggcucaaucucuuugcaaccuccgccuccugggaucaaacgauucuccugccucagccucccaaguagccaggauuacaggcaugugccaccaugcccagcuacuuuuuuguaguuaguaaagacggggcuucaccauguuggucaggcuggucucaacuccugaccucaggugauccacccaccucagccucccaaagugcugggauuacaggcgugagccaccgcgcccagcucaaaagauaauucuaaagucaagggagaacaucuuaucuacagaaaugaagcaaagcacugucuccauauugucaugucaggaauaagcacacggaggcccaccuagauuccccucuggugcaucccuuuggugcacucagagucaugguuuccucauccauugaagagcagagguacuccggccucaguggcuacaagaaucuagugacgaugggacaauguguauagagcagucucacacagggccaggcccugugcccaggaagugucugucaucuuccuccuccccaucucauccggcccugcaccccccuccucucccacccacgguuugaguuuacccauucaggacccccucaugacuuuaugacuccugguuucuucucagagaaagccacagauggcucccugcagagcgaggacugggcccucaacauggagaucugcgacaucaucaacgagacggaggaaggguaagggccccccaaggagagguugggggcagagacggccaucccaccacgcagcacacuccugcacccuuccagggagccccugccccagccccauugcugccauagccaccaagucugacccaacccgcuuggcugcagaggccaucugagccccuaguaccugagccccauccaagguaggaauucacagcuggccccugggggcugccaccccaccccgccucucuuaguggcagcccagauuccacacggaucuggaagcccagccuugugugcagcaucugccuaggaugaggcaagcuggagacucuuaaucagaaguugaccccaagcgccaucugcauucugcaggcgggaguguguacuagagagacuccggcuuuucugcgagcaaaaacagacuuccauuuccuuaagauuugaaaccagccuggaggguaagggagaucacaaggauggcagggaaagugaagcugaaccgugagccugaacagcacuggcguuugccgggcguuucugguguuggggucacgguaucgucuugcucagugccaaggagcccugccaaggcacauggugugggggaaggauuggggucuuggccuccaaugucugacucguugucacugaccagccgugugaccuucggaagucacuuuaccucucuaggucuuuguccucgaaggugcucuguuagauccuuccagcaauaagcccgagucccuggagggagcagaaaggggaugcgagggucccuguccucucaggaaaacccagcgaaggcugggcagaggugugggagccgugggcagcaggaagugcugccagacgaggccuccauccugagaaaucaguguggacccuccuuucccucuccaguucucacugggaucauccagcucucccgcggccagugcaggguuccucucagcccgggagggcuuugcguggagaggcgcaggcuggaugcagguggagggcagggagugcccagcucugagcuggagggaggcugugggcaucugagucacacagucaaggcccagucaggagagggcaguggcugccaggaaccugccggugucuuccucagcccugcucccugaucuugccaaggacucaugagagugagggugagggaaggaguggugggcagaggucagaagaaagaaagcaggaggcagaaaaccucaccaagccucuagacaggccugggagcuucauggacgucgcagcugcaagucacugcaguauccuuggggacagcaagcccccaugucccuuauaaacaugggaggaacaggcucggcgucggucaggugcauugcuauuuauuugagcacuuuguguguuccaggcaacacaggaggcacuagggacccagcagugaucaaaggcaggcaugacccuugaccucaccaagcauggcaccuaaacuuagccucguugcuaaagugucucccccacuggguuguggccuccuugucauacacuuugugcucccagcagaguaccggacaucaugggcccacagcaguggcaaggccagaacuuccgauucccagugcuucccucuagggagagaaggcguccaacaaggacgcugucccugcgcucuaggaggcuucuucucucccagggugggcccccaggucaguggcgcauggcggaacaugccagggaaugauucugauucccuugugucuaggccacccuagaagagguggaaagaagucacuauaaagcgcugaaguagcccgugggucaguggccaggccaagaccaggagccagggacgggcgaggggcugcccagggaggcaaggguuggaaacugcucucaggcuucugggccaggaccccccuuggugggccaccaucccuuuccccaccgugucccuuccaccgcaggccugaccgccuccauagcucuagcccccaggcaggcucugucccuaggaagccuugccucugccuucacuccugcugagaaccagugccaggguuccaggcucuccugccuuaguccuggauggggucagcacugacagccaggcagacagccggaugggucccaguggccacuggccaggcugagaaauguuacuugugcuucaguagugugaugggcucuaggaagggaagcuguccaaagagaacaccaucccugcccuauagcaagcuucuucucuacccagggugggcccccaguucaauguggcauggcagaacaggccagggagacuggaggaccugggaaaguguuguggaagggguggauuuuagcugaggcuucaccucauggauguggaggucaggagccuucagggugcaagugggggcccugcacaaaggcuuuuagacaagagcagucagggcagcacugaguauaccuguauagggccgaggguggaggauggugggaaucacagaggggacagggagagcaggcuggcaccccagcuuccaggggccucccaacaccgugaccccuaggcuucuucagcccuccccgaccucccccacacucaguguggccuccucuuaguuccuccaaggcaucaagcuccucugcacccaagaccuugguccaggcucugaccuugacccaaacugcucugcccccacuccccccaggugguccuucccaucuuucaaggcccaacuacaagaccacccccucggaggucuuuucugaccacccccauccucaccucugcucuuuuuccaggaccugcuuauuccuugcucuucuuuggaucuccccgcaagguggggaggaggcagggccauauggucuuguuugccacuguguccccagcaccuagcauggugcuacauacauauugggugcuuaauaagaguugaaugggccagacaugguggcucacacugguagucucagcguuuugggaggcugaggcaggaggaucacuugagcccaggaguuccgggcuacagcgagcugugauugcaccacugcacuccagccugggcgacagagugagacucugucucagaaggaaaaaaaaaaaaaacuugaauggaaggguaaauggacagauagagcagcuggccaggacggggcaucagaacacuaugcuagcugggcucagggacucaugccuguaaucacaacauauugggaggccgaggugggagaaucauuugagcccaggaguuugagaccagccugggcaacauagcaagaccccaucucuauuuuuguaaugaaaacauuaugccuccagguuauuuguucuuaaacuugagcaugcauaagaaacccuuggggagcaugagaagcauucagauucaggggccccacucccugagaauuugguucagguggucuaggguggggaccuaggguucugcuuuuuuuuuuugaauguccuuuguuuuuuugagacagggucucacucugucgcccaggcuggaguacaguggcgcaaucucggcucucacucuguugcccaggcuggaguacaguggcguaaucucggcucacugcaaccucugccuccuggguucaagcgauucucccgccucaaccucccaaguagcugggauuacagggucauaccaccacgcccggcaaauuuuuguauuuuuaguagagacaggguuucaccauguuggccaggcuggucuugaacuccuggccucaagugauccaccugccucagccucccaaaguccugggauuacaggcaugagccaccgcgcccggccagguucugcacuuuuaacaaaacgcucucaucuuuucucaaagugacucugcugcuggagguccaggggccacagguugugagucccugcuaagcaaugggcuaggaagauucugaugugaucagaaccuggcuggauacacaaaacagguggggcacagggaggaugggccaauaagaacuguuccaacucuccagggucucugguguuagguaagggggcucuauuccuaagcccacccuuuuucuuguccuccuuagucccaaagaugcccuccgagcaguaaagaagagaaucguggggaauaagaacuuccacgaggugaugcuggcucucacagugagugccccaucugucuguccuguggcaggacuacgguccacugaaagucaccuccccucagacccagcaggacucccagccuccucugagcuccucauuugagagcuggaaaggucuguaggcaacgcacuguccugucuacacugcaggcggaugcagaauggcaagaggccauuuggaaagguucuccccaaucccccagcaugggaacagacgcuuacaucacuccagaaccacuggcagggagagccugggccaaaggaccugugggugacauugaagcucaguaaacccaggccuccgcgggggcagggaggccggcugacugaguugggugcugcucggcacuuuggugcucuggcaaaugaauguaaaauaaauaccaguggcugagaacagucuugcccacaccacugaaccagcccagaucucagggcggccagacacacgugggccuccuagccgucagcauggguuuggcuggggaagauauaaaugcugucccacccuccuccacaagcagcauuuauauccaggugaauuggcuuaagcaaaaagcaaaggcaauuccugcagugggaaguggagaguggggagggaaguucagugccuuuucccugggccacaggcucaccagucgauugacaucucagaugcuccuugauuuccucuuggagagccccuucucucuagaccauguuuagcucagagacagcauugggauucugcgugcacugacgccagucagggaaggaaguccagcccacacaccauaccucugcccacccuaggccgugcccuccaguaaacaagucccccaguccuggcauugucccaguccuccacauucaagggucucacuccaggaagucccaucuccucucccgggccuccucucugggacacaggaggagccacgaggguggggguucugagcaccuccucuccucugaccaaggugcucgacggcaccucucggcccuccaggucuuagaaaccugugucaagaacugcgggcaccgcuuccacgugcugguggccagccaggacuucguggagagugugcuggugaggaccauccugcccaagaacaacccacccaccaucgugcaugacaaagugcucaaccucauccaggugagugccaggacagggcagggcacggccaggaagagcugucagugcaggagcuuccugcccaguggagagucgaggccaucguguuugucccaggcuccgcuucucauuucggggcgucucgguugucggcuggugggauguucuguggggagggaggcuugccaacugcgugcuuugcuguggagugggcagggcagauguaguuaaaaaaaaaaaaaaagcagggaaagaaugucuguucucugucugagugccaggugggcaggcucacaggugagcugugguuaccggcuguguccccuuguccccucucaguccugggcugacgcguuccgcagcucgcccgaucugacagguguggucaccaucuaugaggaccugcggaggaaaggccuggaguuccccaugacugaccuggacaugcugucacccauccacacaccccagagggugagagaacugccguaccgggaaccaagggaagggaggcaggacucauccccagagacaucaccaggcuggccccugacuuccugggcucuugauguucccaggagcccucacugauccuguuuuccucccacuagaccguguucaacucagagacacaaucaggacaggauucugugggcacugacuccagccagcaagaggacucuggccagcaugcugccccucugcccgccccgcccauacucuccggugacacgcccauagcaccaaccccggaacagguaaacgagccuggggucagaaccgucagguccaggcaggugggccacacacgucagggagggcccccugucagaauuuaccauccacggagccuccacuucuuccucacagcagcccacaggguaugugugguucuuccuguuugagcgaugagacucagagagguccauucacuugcccagagcacacagucaucagagacaguugggauccaagcucacgucugucugacuccuggcaggcacugcccuguaccuuggccauuuuccaaccuguguuuucugcggggcccuccaacagcaccauggagagguguccuguacgcagccccuucaggccagcuccaccugugugguuucuuacacacucacagcuuucauuugagcugggcauggucacgugcgucugugaucuuagcuucucaaagguucaggcaggaggauggcuugagcccaggaguuugagaccaggcugggcaacauagagagaccuguuucaaaaaaaaaaaaaaaaaaaaaaaaggcuucauuugaagagagguucugccugaaaaguuuucaaacaucugugcaaaaaauaaaaaacauauguacauuguaccaugcugcuucccaugaagucucaagaaggucugaagcuuuuuuguuuguucugaaacagucuugcucugucacccaggcuggagugcaguggcaccaucuaggcucacugcaaccucucucucccagguucaagcaauucuccugccucagccuccugaguagcugggacuacaggcaugagccaccaugcccagcuaauuuuuuguauuuuuaguagagauggaguuucaucauguuggccaggcuagucucgaacuccugagcucaagugaucuacucgucuuggccuccuaaagugcugggauuacaggcaugagccaccacacccagccaagaagguuugaggcuuaguaugagauucuaggggacagguuuucccagcccucugacuagcuuugaaggauuacccaccucagagcagguggcacccugggcaugucacuuccuuccuccucauggcccacugggccaugagcugcuuguggagugccauggcugcuguaucugcugagugacuucuacagccaugaccagcucguagagcugggggcuugucauucuagacuuuuggcugcuggggugggggcagaggccugcacacuguggagacacccacguuaaagguguuguacacacaucaggcccaucacauccgcggagcguaaagguggagcugcugagugugcuggugaguuagacacggaugugugauggaaagaaaagugaagcuuaacuuucccaauaagcguccccacugcccacuuuuuguaucauuugaacucauucucacccuaaccuauuugaagagaaacuuccaugauuuguuuucucauagcaaguuaugaaaucaccccucagaguuacagauauuacuagaaaauuuugcuaacuggacaaaauuauuaacgcacugcccguuugccccaagaauacucuugucucuaauccuaauguaaccucauauacauuucuguuacguuaggauuggagacaaguucuguuuagaaauaacuccaagaacaguuuuuauguuuuauuuucauguugaaaaucagucagguuuacuucagccucaaagagcauguuuauguaaaauuaaaugagugcugacagcgagcugcacuuuuuuuuucugaguggguuaaagguguguaaaaaauuguaaaaccaccuugugauugucuaacucaguuaugauuuuaaccaauuuucugaagucuagcaucuguguggauuaagacgcuaauuacuuccaaugcaagaaggugcuugcuaaacaaaacuaaucuuuguuuaauucgagaguccccuuuugucucuugggacauguuaagacaucaggugugcagugauguuacucccagacuccucuguaauuaagucccaucugauuuggauacaugggguuugugaucaguaguuuuuccacucacucauaccaagaguguucauuaaguaagccaaauagaucaaacauuuugcagguuuuggaaggugucagugaaccauaguggauauacuacuagucucuacacuccauuucuucaucuauaaaagcagggauauugaugucuaccaugguaaaaaauuaaguuagcaauauauguucaaugcuuggcacuuauuagguagucuauaaaugguagcugcugucacaaucaugaauguauauagugacacucugaaaucaacuauaacucagccacaugauuuagaauguaccagcauuucucaaaacauaaaaagguucuucagucaaauaaaucuuagaagcuuucagacugaucuuuucccaggcauucccagugugcaugagggcauuaaacacccuacaaggucccacagcauaagauccuuauaccaauggccuuucacaagcuaaccucuuugaggagacugcagcuuuauugaaaauguuuccccaagcccaacuccuuggaacccuuugaccauugaaaaccugcccacaucccuuggaacaagugcuaaaucugaguuucauauucaaggugggguacagggcaaggacuauccuuagaugagccugggacaccaaaauagaccagaaacaggacaaaaucccaguccacuaggaggagaaagagggcagaagcccaguccacuaggaggagagagaggguggaaucccaguccucuaggaggagagagagaggacggaaucccaguccucuaggaggagagagggcgggaucccaguccucuaggaggagagagacggcgggaucccaguccucuaggaggagagagggugggaucccaguccucuaggaggagagagagggggggaucccagucuucuaggagagagggcggaaucccaguccucuaggaggagagagagagggcagaaucccaguccucuagugggagagagagagagggccugcagcgucccuccccgccuuguggggagccacccuccagggccuuguuagcugcuguguuagacccaggagaugcuggagucuuccagccacacgugguggcucauuccgguguggagaugguaacgguugguagcgccucugugaggggucuguagaagggguggggcaggccucuagugcagagcugucacuuugggagccaggagggaggcugccuagagaggcugcugggaggucggcucccuggugcugcacccaggguuggugguacuggguucugucgcugugaguaacaugggccccagaacccuggcuucucucaccacgaucaacuguguguuucagauugggaagcugcgcagugagcuggagauggugagugggaacgugagggugaugucggagaugcugacggagcuggugcccacccaggccgagcccgcagaccuggagcugcugcaggugagcagguggcaccacccccuggggcucagaugacuccugcccagcugcccacaugcauucuuucccaauccucaugacagucuucauggcuuacuccauacuccuuggucacaguuggggacauguuaccaccagggacuuuggacgccaucagauuggaaucagaucgcagcucuaccacuuucugguuugaacaaaguagccccccuggccucaguuuccucaucuguaagauugcucuaacaauagccuucauggcacaaguuugaugugaguuaaauaagguauugcaugaaaaacacgcaggcuugugccugguacagaguaaagcacccaguaagggguccugagaaaaagcuggaaggugagauuuacaccauucagaauccgagacucagcaggcaggugugagaggguggugccagccuugagaugcgccagccacugaucuuggggagccaaggcagguggagcuagugguuccugcucccgggugucacaugguauucccacggccccagcccagauugggggucacuggagcagaagggacacugaauuuggcaaaaagcacccuccccauggaggccagucauagaggcaccaagagagcuaggaauccccaaggcccaggagucaccagaauccaugaggagacagagcgcuucguguaacuguucgaguuccuacugcucguccaccaggccucaggcuccuugagggcagcgcugugucuuccucgccaccgugucugugugccugaccgagcugacucugcagggguccucacuugguggugcaggguggggagaaaaggaguagccucagaguccagugaauacacaaacuugaaacccaguaagggcuccgaaagagagaagacugcgcaggcagccucgcacgccccaagccaaggccaugagaugugagcagucuggggacucagaaggcugagcaagguggaugcagggacagcucccaugcacugggcacuucccgugucccgggcuauauguggacacuugguucacaucgcucacguaauccugaccacccccauuuuccaggucaggaaauaggcauagggagaucagauaacacguccaggguuauauggcugguaaguagcagagcugcgauuugaacccgggggccuggcuccaagugcugcucuucugcucuugagaggggccagcagggaagcagaagcaaagccaccgugugcuuggucauaagagcaggaggggagcccacaggauguugaaaggcacccgcccuguccccgugcuaagggcgaugaggaaaucccggaggccugaccuuggagggggcaggggacaggguccacaugacagccaaaauaaacacugggcagugccgagccucagcguugccuccaggagaaaggcgugcuggcgugaggccacagucggcaaugccgggcagcucccuggaccucaggacccaggcaccugccgugacccaggaaccuucaccugguggcagguaccugaagaaauaauugaccaaucuuaaaaaugaaaacccauauggcuaugguuuuuuauuuuuuuauuuuuuuugagacggagucuugcucugucacccaggcuggagugcaguggcgcgaucucggcucaccgcagccucugccucuuggguucaagcuauucuccugccucagccuuccaagcagcugggauuauaggcauacaccaccaugcccggcuaauuuuuguauuauuaguagacacaggguuucaccuuguuggccaggcuggucuugaacuccugaccucaggugauccacccgccucggccuccccaagugcugggauuauaggcacgagccaccggguguagccauuuuuuuuauuuuucauaaguuuaaauaugacaccuagugguuaaaagucggugacgugauaacuaaaugcaguguaggauccuagaacaaacaaaggacauuagaggaaaaacuagugaaaccugaauaaaguccgcaguuuaguuaauaguauuuuaccaguuuuaauguuuaaugguaguuuaccaguuuugacaaaugccagacuaaggggaagccagggucaaggguauaugggaacuugugguacuaucuuugcaucucuucuguaaaucuaaaauuauuccaaagcuaaaaguuuguuuaaaaagacaaaaaaucaggcagugagaaaagugaggcaaaaacucgaaaucgagguuuguggcuaaugguugcagucaucuaguucauucuguaugcuuugguugcaaaaaucacagcauacccccagaaguugugguuuguucagccagcccccuuugcagacucaguuuuuuuuugacuaagcaaagaugguggcacaaccuuuauucuggaaucugcacgaagccaaguuaaaccggcagcacaguuggacauguugaugguuuccuguggauuaaauuuuagcaucuaacacuuggaagugaaguucaaguucauguuuguagaacccaaaaagcuguuccguggaaccuugaaguccaguuugggcaccucacccuccuccaaggcuugugcaggggcuggaggcccgugcauuagagauggccucacuuggccaggcgcgguggcucacgccuguaaucccagcacuuugggaggccgaggcaggcagaucgugaggucaggagaucgagaccacccuggcuaauauggcgaaaccccgucucuacuaaaacuacaaaaaaaaaaauuagccaggcgugguggcagacgccuguagucccagcuacuugggaggcugaggcaggagaauggcaugaacccaggacacagcuugcagugagccaagaucgcaccacugcacuccagccugggcgacagagcuccgucucacaaaaaaaaaaagagacggccucacucugagucaugugacugugguugccucacuuccuuuccuggcaggagcucaaccgcacgugccgagccaugcagcagcggguccuggagcucaucccucagaucgccaaugagcagcugacagaggagcugcucaucgucaaugacaaucucaacaauguguuccugcgccaugaacgguagccccagcaccuccccuggccucuggccuacugccccaacccucucccuucccuuccucccuguucuccuggucucaugccaucugagccuucucucguccuccucucaaacacaaggcaggcuccuaagggccugugcccucagcugucuucuuccaggauguuuaugagggccccuccuuccagccgcccuguaucuccuuuccaggguuagcgcugcugccugugcccaaguccagcccugggagauggucacaggucacagcugagagcacggcccugcaaccagacuggccugguguguccucgcccacuccaccacuuccugguucuggggccuuagacaagugacuucacugcugcaagcuacacaaaacauuucuggcuaacuuaggcagaaaaagaauuuguuaggauaauaaucuuuauuaaauggguagcuuucagaauccagagaaaagugaaacugaugucucccaacagaacaagaaagauggaucccagggcagcucagaugucucaggagcagaaauuccuggaccaucuccccagggugcugccaucaauaaauacaucagcucaaacacuuguccacaaacaccuguccaccuuuuuuuuuuuuuuuuuuuugaggcacgaucuugcucugucacccaggcuggaguauaguggcaugaucacagcucacugcagccucaaccuccugggcucaagcaguccucccaccucagccugccagguagccgggacuacaggcaugcaccaccacacccagcuaauuuucuuuucuuuuuuuuuuuuucuuuuugcagagacaggggucucacuguguugcccaggcuagucucaaacucuuggccucaagcaguccucccuccuuggccuccgaaagcauugguauuacaggcaugagccaccacacccaccugcccaccuuguaucauucuguucaagagucacauccccaagagagacuuggauuggcugagcuucauugugccuaccagcugggguaugggagagggcccuuugauggcagccccaccgggaugaugugaaaugggggaggagcaguuccucuaaagaguacuuaggugcuauuacaaaagaaggagaagggcugggcgcaguggcucacaccuguaauccuagcacuuugggaggcugagccgggaggaucacuugaggccaggaguuugcaaccagccaggccaacauggugaaaccccgucucuacuaaaaaauacaaaaaaauuagccggaggugguggugggugccuguaaucccagcuuacuugggaggcugaggcaggagaauugcuugaacccaggaggcagagguugcaaugagccgagaucgcaccacugcacuccagccuaggcgacagagcaagacuccaucucaaaaaaaaaaaggaaagagaaggagaaggauugcugggucugcagaaauugugugcccaucacaccuccucuguaucuguaaaaugaggcuuguggcauaagugagaguccaugaaacagugucuguaaagcgcuuagcaguccagggugucugauaacugacaugaguuauuccagccuccuccagccccuuguucauuuuuugugucuuucuccaucaaaagacacucacugauugauucuaaaucaguggaaagugggggguacccugcaggucacgucugccuagcuucuccugcucguuggcccaguggaaugaaaggccucuucccugccauuuugggguaugggcugugaggugacugaggggccccaucugguagcagcugguacccucagauauccacagucauuaggcuuaauaucugacugugcuuucaagcucgcagucacuuauacccauguccuaauuugggcuucagcacuucagggaggcaggugccuacagauacuagacaagcagacuaaaguucagaaggaacauaauuuacccgaggucaugugauaagugacaaggccacgacuugaacagaccccacacuaaagucuucucgaucuaucacaccggccccuaaguagcuccauaaaacaagauuagagauacauguaucuuucuuacagcacugaagagagcacuaacacacacacacacacacacauacacacacacaaauauguaauugaaacaaguuucauaagacaguccuuaccuuuacugcgugccaugcauuccuauuuucuuugcuguucuaaccuauuccuguuuauuuguuucaugcuacucaugacuaagguugccuuauaauugaucauccaaauugggacacuuuugcaagggaaagaggagcacugcuaguuacccagggacagcaggcaugaacuggaucuguccagggcacaccagacgugucaucacccugaucauaacccaccguguugauguugagacccacaguuugaaaagcucugccuggccgugugugggggccugucucagucugucuccauaacucgugucuuuucugucuuguagguuugaacgguuccgaacaggccagaccaccaagguaaaagucuucuuuucugugacuagaucaggcccuguucaugggaagaaggagugccauucucaccucccuccccuaguaaacuggacaggguggugcugucuuauccaggcccauagagaaauccccuucuaacuuuuuaugucccugucccuuuaagguaaauaaggcugugccaccaccugaugccccagggucuccccaaccucccagggaguccaguugagcuggagccagaggggaggaaggaaauucccugaugcccaguccuagcuccuggggcccuggugacagaucccugggcaaagccugcaagccacagugcuuggggcagaaaggaacgaagcugcagacagcggggaugaucagggcaucucccuucccaccaggccccaagugaggccgagccggcagcugaccugaucgacaugggcccugacccagcagccaccggcaaccucucaucccagcuggcaggaaugaguaagugugguuuggagggcuccagcugaggguacauuaugguacugugggcaccccugcagauuuucggggugcccuuguuauauacccacagcagagugucagucuggaccccaccuugcuggggucccaggcugaaucuugcugcaagguggggcacucggggucacugccccuggcagccccacaaguccugagccgccuuggaucucagaaauccuaccauccuaggauuggcccucuacacugaauucuccauggcuucaaucaucugcgugagcuugggcaaguuccuuaaaccuccugagccucucuuuccuccucuuuaacaggaguagggagcucguguaugagaagcgcuuagaccaugccaggcccagguugcacucuggcugaguaguuggccauugucacuguuaucacugugauagguuuuaauauaauuuacugucugcuucaugccaagcccuaggaaaucauuagcaccccauuuugcaucacuaaugcuauacuuuuugaaaaaaucgacuacccaucugauuacuguccuccugcccagccacuuccccagcagaaucaauggauagcguuuugacuguucucuaacgcucacagcagccccaagaggggugaguaaacuaaagcugggaagaggaagccgcuugcccaaggccccacagccagcagcagguggccugccucgcgcauucccccacccacacgugccacuuccccagcaccaagcccugggucuggcagcagguagcucagcagcagcucacacacaagcuuguggaugggucuuucacguggccuuucugucccugcagaccugggcuccagcagugugagagcuggccugcagucucuggaggccucuggucgacuggaagaugaguuugacauguuugcgcugacacggggcagcucacuggcugaccaacggaaagagugaguggccuggcccugcccugguccccugcaguucggguggcucucgggguucuggaacccgguuuuaugguggcacaccaugaggaagggcacacggacccugcuuaguaagcacgcccuuaguauccccuaagucaguccagcauggccugggagcccuguggucaguugacagacugcgcuccccacaggccaugcugggugggggagggggagccuaaugacccacuguaugccagaaucuuacauagucugaucagagggggaaacugaggcacagagaggggcaggcucauuugccccaggucaaggagcuaauauuuggcagcacuagguuaggagccuagggcugucugguuccaaaacacagugucuccaccccccgccccccucccugcacuguguaccgcauaguaagcccuccaggagcagggaaguuuccugauaaauccucagggacuuucaagucaagucuuuuucuguuguuccauagccaccguuaauuuccagagaagauuaagcagguucugucagccuugccccagagcuggggcucugcccuucccugugcaccgugcauuuucaggggguacuuucagcagcauaggcacguggccugaguguguccaccagggucugaccccuugccgggaccugcgggagaacuggccccguacaggcuuguaagaggaacagucugcuugauguuuucuucagccuuuugcccacugugacccccagggcugagcugugggcagccaggauucuuauagcuaaggaaaguucuagauuaugggaucuucccacugaccccacucagcuccuuagaggucauucuggugucuuuuggaacuuugucaaugggccuccagagagcccagggauaaccucuccacacccacaaauccagguccaggcuguagccugcuagguccuuagggcugcccuggcuguuagcuguaucuuucuuuagucugggcagagucuguacuuuuaagcccagguacccugggaccagcagcuguugccauggaguuaggggugcugccgaggcuacccugcaaaggcaagcuaaugagugugaugggacuugcagccagacacgcccauccacagaggccccagcaggcaacacugcuggccauacuggagaacccuggcgccugcccuggucaccagccuggcugagguaugcuguugcgcuguccuuccucuggggagcaggcuccgggggacagggaaaagcacacaaggaacuuguccucuagggccugcagucucaugggagagugacaugcaccaggaccaccgcugugaagggcuaagugcuguccuggagggggcaccaggcucuguggacacagaggagggagcaugcaacucugcggaggguacucagagcuggaccaggugcugggugauaggaaggccauuucaggcacuaggaacagcaugugcaaagucucagaggcagggcgggagagaggugcccuggcucccgcacagcagcugggaaagaugcucuucacacagggaagggggcaggaugcugagagggugguggggcccacugggcuacagagaggcaguugauuuuauucuaacaugagcaggagggagcacaggaaggaucuuuuuucuuaucagauuuucaucuuugaaacugccuucagcugagcacagcugaaaugacaucaugcaccuucucaggccauugguucuccugcaggcccuccccagggcuugguuuccacccuggcagaaaacauccagcaaggucaggcguggaccugagcauccauuucgucuucccuuuguucuccugccuggcuggcccccuuaaaugcuucugguggaucuuccagcucuggucaccugacuggccuuuucugccagcuugguguccagcccgcuccucccuguaccugccuggcuccccacuucacaccagccugcaaccagcucugcccuggcuggcagggaaaccagcuccuuaucagccgcuguuucugcuccagccuugaccacagcuggcaccgucacagccuuccugcagccaguccuauccacucaaugccaaggaguagcagggcuucugggcgagccacagcagagacgccucggcuaggccuucacaaaggcagggguguccuucccccgcuuuguccgcaucuucgucagugcugcuguacacagaggccuucucuacaaggagcacuuagacaagugucaccccaguggcccaggugcagccccugcccaccagccccacugggaccaccuaaggagugacccuccacccuccugcacugggcagggggcagcaggcccuagcccaggggucaccacccagugcaggaggugcgggcuuccuccagggaagugcuuggcccuccaccaccacaggcauggccuucagggacagcugggcuucagggccaugugugggcagggguggcgaggagcuaagcuuaggaagggcagauaguucuuuuuuuuuuuuuuuugagccggagucucgcucugucucucaggcuggagugcaguggcgcuugcagagugcaagcuccaccuccuggguucacgccauucuccugccucagccucccgaguagcuggggacuacaggcgcccaccaccacaccuggcuaauuuuuuguauuuuuaguagagacgggguuucaccauguuagccagcauggucucgaucuccugaccucgugauccgcgcgccuuggccucccaaagugcugggauuucagccacugcaccuggcccagauaguuguuuugagugaagggaaaucauggguuucugcguguucuggggcugggcauggcuucuucagccuugcccacaaugcgccaagcaugucuuagagacagcaacaagcaccuccagacccucaauuagcaggccuucucugggucagaagucagcaaccugacgccccaccucccccgccacuggcuuuaagguuggcuccagcagggcccugccguagucacuggcccacuugccauggaugggagccguguaaccagggaaugccccagcuaguggucacacuccaccagcaaacucugccccuggugggaaggaacagacagcagcacucuucaaaaugacugcgugggaacugggggucauauucaagaagccccuuucagugccagccuacuccauuccucagaaagcaagcugguauugcaagaguuaaaugugaugcagucccaguuccugaagccuacaguuagaccagccccgcuucacuagcgugucagguggccuuguuccuaacaggaaucgcaggccuuucccuuugugaccagaauucuguggcuuacuucuuugccucaaagcugcacugagccagugcugaaguccugucugccggcaguucagggcgagaauaacagggcucuuucccugcaacagggcuggguccccaacaccugcccugggcacccccacugcggcagcugggaaagacaccauagccgccucuccuccuuagccagcuucuccucucacucagguuauucucuugcuccccaggagacuuaaccucacacacaacauacccuuccuugccucuccucaucugcccagcaacuguggggucagccucugccgcucccagcccaucagccuugcgugcccucccaguuccugccuccccacccugccuagcuggcuggcaccccccagaggacauuuagaagagcuguaaccaagccaccucccaugcugcugagacaaggugggggcagagucaucuuugugcuggugagccagugcaagacaagauggcaccucacccagcaguuuauagauguguuuucagcagcagaauggaaucccccauucaaauacgaccucauacacaaccacagucuauaaaauaggaaacaagaucugcucaagaaagggucugcugggaauucuccaugagccuacgggcacuggagcuauuuaucagucuccugaguuuggccaauccuggucauagccauugguggucuuggucucagucuuuggccagcaacacccucccuaaccucuccagccuuugcugcugucugucauguaggucacuugucagauccuaauuuccagaggcaggaaaugagacccuuuuuaccauuuccaggcaggccuggaggaugggagccgucaaucugugccccccagcccgcuccguucuugcaucagccaucgguaagggcagcauccaauggcuugguggucucucuuucaggguaaaauacgaagccccccaagcaacagacggccuggcuggagcccuggacgcccggcagcagagcacuggcgcgguaagcagaggggccauccugccacccuggggcccuccugaaggaggugagggaaugcucacccacugggugccguugugggccaagcacuggcccagcacguccacaggcccuuccucguuuggccgucaggucgguucuuuuuggcuagugugguuauucccaguuuauagcuauggaaacugcuagagaggccaggccauuugcccaagcccacaagcaaggauucagaccugagccugacuugaaacuggagaccaggccgggcgugguggcucacaccuguaaucccagcacuucgggaggcugaggcggguggaucaccugaggucaggaguucaagaccagccuggccaacauggugaaaccccguaucuacuaaaaauacaaaaauuagcugggcgugguggcacaugccuguaaucccagcuacucgggaggcuaaagcaggagaaucgcuugaacccagaugguggaaguugcagggagcagagauugugcuacugcacuccagccuaggugacagagcaagacuccaucucaaaaaaaaaagaaagaaacuggagaccaguggcccgggcuucacauuccagcucuaccaguuaccagcuauguguccuuaagcaaaugacuggccuuucugacccucagucucuuuaucuguacauuggggcuuauccuagcaccuauacuuguuuauaauagaagugugagaggauauauuuagggagcuuuacauggaguuagagcccguucaauaguauuccucucugccucucuagagacuuuuaaucugcaggagugugggcagagaggaauaaaagagcggacccuggccaggcgcaguggcucacgccuguaaucccagcacuuugggaggccgaggcgggcggaucacgaggucaggagaucgagaccaucccggcuaaaacggugaaaccccgucucuacuaaaaauacaaaaaauuagccgggcgugguggcgggcgccuguagucccagcuacuugggaggcugaggcaggagaauggcgugaacccaggaggcggagcuugcagugagccgagaucccgccacugcacuccaaccugggcgacagagcgagacuccgucucaaaaaaaaaaaaaagagcggacccuaaagcagcggggagaaaugcgagggugcucuuugaauuccguuuaguuccuugacuguguguugagugacagccacuuguccagcaccgagcacauuuugugggugacccccacacgcuuuggcaagaccuccaagcaccauucucucaugcaugucaacguguaucuggaugcuuuucaggcagugugagaauuucugcuccagcaagugagcagacagagcaggucccaugggagacaguuagaaacagccggaccugggaguccagggaguccgggggagugagggugguggaccuggggccgaggaggcuagaggaggcucaaggcagcauggggacuucugaggcuagcaugggguuggggguaggaagugaagcucuauggguauauagcagggaccagaggaccucagcgcggcuaggagcgcugcagauugcauccuaagugagguggaggccgcggggaagucuugagcacaggagggacuugacuuccaaucugaaagaucaggauggagcuaggaaagcagggagggccgggcacaguggcucacaccuggaaucccagcacuuuaggaggccgaggugggcagaucacuugaggucaggaguucaagaccaaccugggcaacauggggaaaccccaucucuacaaaauauuuaaaaauuauccgggcaugguggcgcacaccuuuagucccagcuacucaggaggcugaggugggaggaucgcuugagcacaggagguggagguuguggugagcugagauugcacuacgacacuccagccugggcaauggaguaagacccugucucaagaaaagaaggaaagcagggagggacgaguuguggaaaccguccaggccaguccacugugggcaaagucuucgugacccccaagggcacucucuccgcuccugggucucccagcaucucaggagccauucccaagucagaacagggcaagguggaggacgcuggggugggccaucugggccucucguggacagagguugacucuaccacccagugggcaacaagagaauccaguaccucccauguguggugugugaccugccaccaagcacagcacauugcacacccgugucacauccaccgcacacaccagucagagacuccaguccuuuuucggguguaagccaucauuugcugagccugugcuccgggccaggccugcacuaagcacuuugcauccccucucuuagugagucaucacagaaacccuuaggguauguuauuaucccguuuuacagaugagaaaacugaguuccaggaagagcuuaagugaaaccacagguguacuguccucgguauggugccuggcacacacuacgguauuacggcacuuacgcuucgcaguaccgccauguccucaucccauuuacagaugagaaaacugaggcugaggacagggagauacccugccuagggucucguagguauuguucugccuggcuucuaagccaugcugguaaccuuagagcugugaaaagcccuaaggugcaaaggagagugaguggaggugugugucucccuccucagccucaggcuuccagugugucgggauucaucggaaccaacacaccgcgagccugcuguaggagcuccccucucaggccaccuggccucucguggucagagguugacuccaccacccagugggcagcaaucccagccaaucugcuccugcugcagcccagagacaggguucacuucccuaggggcacacagcaauucaggcgugacuaaaacuagagcccagguguccuggcucccacacuaccuugcagcccgcccacagggaggaaacgcaccacacaacuccacuggcagcaaagagaagcugauaaaccgguuaucacugauuuaucuccgauaaccugggagauuuaagccacuucugccaaaucaggguaugauuucuuaaaacucugugagcaaaugccugcuccuggggugcuggaguuuggcuggugguaaggccuucacccacuaaaccgugagaacaugauucccaagagcagaguacaaaacagcaucaaaaccaggcgcgguggcagguaccuguagugccagcuacuugggaggcugaagcgggaggaucacuuaaacccaggaguuugagguuaucgugagcuaugacuguaccacugcacuccagccugggcaacauaguaagacuguaucucaaaaaaaaagaaacagaaucaagugccaauugugcgcagcccagguuugcgcccugggauucagagcaggacucacaagucgugugacgaggugguauugcaugcugugugccagguuuuaguuccuucacucccugacaugccugcugugugcccugugccaugugccaggccccaugcuggucugaguagggugaaccagccaggcacagggugacgggcugggagcaggacucucgucucccuccacucuggggcccuaggaaacugcaugugugccauggaugaaugugagaagguuggauaaacugauguuucuaaaaccugggugccugucagacccuacugggagcccccagaccaucugacagccgccugcccugcuauccugggguugcugaggcccagccucugggauccuuguggagagaguugagaagcuuuguuuaguuugcugucagcucugccucagccuacccagggcgcuggcaucccagagcuguuguggcucaccccccgguggguaccacaauaccugccucaucccucuacaccagccgccacauccaccacacacaccuccacacaccacaccuccacccauagaccuacacacacaccacacacacaucuacacccaccacacacaccuccacacacaccuacacucauacaccuacacagacaccccuacacacacaccacaccuacacacucaugcaccuacacacaccccuacacacaccacacacacaucuacacccaccacacacaccuccacacgucauaccuccacucauacaccuacacacaccccuacacacaccacaccuacacacucauacaccuacacacccccacaccacacacacaucuacacccaccacacacaccuccacacaccacaccuccacucauacaccuacacacagcccuacacacaccacaccuacacacccauacaccacacacacccacacacaccacacacacacaucuacacccaccacacacaccuccacacaccacaccuacacacaccacaccuccacucauacgccuacacacacaccccuacacacaccacacacacaucuacacccaccacacacaccuccacacaccuccacucauacaccuacacacacagcccuacacaccacaccuacacacccauacaccuacacacccccacacacacaccacacacaucuacacccaccacacaccuccacacacaccuccacucauaaaccuacacacacagcccuacacacaccacacacacauaucuacacccaccacacacaccuacacacacacauucauacaccuacacacaccccuacacacaucacaccuacacacucauacaccuacacacaccacacacacaucuacacccaccacacacaccuacacacaccacaccuacacucauacaccuacacacaccccuacacacaccacacacacaucuacacccacaccuacacacaccacaccuauacucauacaccuacacacacccuuacacacaccacaccuacacacucauacaccuacacacacaccacacacacaucuacacccaccacaccuacacacacaccccuacaccuacacauacacaccuacacacaccacacaccuacaccuacccacaccuacaccuacacauacacaccuacauucauacaccuacauacacaccccugcauauaccaccccuacacacucauacaccuacacaccugcacacacaccccuacacacaccacacacaucuacacacaccaccuacacacaccacauacaucuauaccuacacaaccuacaccuacacauacaaaccuacacucauacaccuacacacacaccuacacucauacaccuacauacacacccuuacacaccuacacacaccccuacacacacacgccucccaaaguggcagcaggccuccugacccgaaaggcgcaccccuguuagaagccgcgcccuccaguggcccuggcgcugccgucccuccgccaucagcgugacucucucucacccagaugggaggcggcugcgggaaaagccucagugacuggauggugagacaaggcauggugagcaggggccaggcccggccacccggaaagcugggggugcucgcagggcuccugccaggcaugggcguggggcaccgugcugcucuccaagggagugggacccaggagaaggcccagaggagcaaggaggggcagcugagggucuugcgggaccccagggcucaggcuguuuccggguuggcccggccagcccagcuuccgcagcuccucugugcccgguuccugcucuugagucucgggcaaggacaagguagcccgucuggcagcuaagaggcgauggggauagcggagcgggagacggagccggugugcacagcugggcacuugcuguugccacugcugcugggaagucggcuccugccuucucucugggcucugcuccugccugggggguccucaggugcugggugacagagcuuggaaaccaaacuggccugguuggggaaagacucugucugucuuuuccaaaguagcucacuaguaacuagugcuauuagugccauuacugauuaauaguaaauaggaacuggccuauugguuucuugagcaucuccuccaugccaggcccugugcuaagcuuuugacaucccauuucauccucacagccaccuggacgguaaguacugcugcuagccucacccuaaggacgagggaaaucaggcgcagagaaguuaaguaacccacucagagucacacuguguuaaggggugagcuagguccagcucuuucucacucugaagucugugcccaugaccuccaacuggagucugccccugcagaagccguuagagaggaaagccuccaacuccugccccugugugggagccaucguggcacagcccaugucuuuguggccgaaagugaaauguccccaucuguagcaccgccccucugggucuacccaccuggccuugucugguuaacuucgcgccucugcucucaggcccugcuaugcccccuucuaucaugaaaucugcgucugcagagacaccaggggauggaaccuggggaccccuggcccacuaaccauguccccaucccagccuucacggcuggagaaaaugccuggggucugacccugggcuuggcgugucuuuugucagaugcuccugagcaccugcagcauagccccugccccaggccauugcccaaagccccuccuccagccuagaauccuacccgaagggugugucggaacugggguucuucucuucaaggggaaggagcucccucugaccccuggcccugcuccagcugcugggagccugguccccugcuuagucuccuggcucugcaccuccaucacccacagccuggcacagcgggcccagugguggguccgggcagcuaggcagcugaggcuggggugggaggcugcccagggccacccagcugcagggugcugagcuggcacgucuuccaccuugucaccuagggcacugccuuacccucugcccuuccuuccagaucccagucacccaggccugccucauggaggacaucgagcaguggcuguccacugacgugguauguuggggcccacuccucacccacacagcaggaggacccguuguucucaccaagaaaugacccauggggccaggguagacuuauauagcauauagcacccugagagcagaggggcacacuuaaaguccccaucuccugccaccugcccaccuuguguuuggcacgccccccagagaaguccugggcacaguagccucucggcugcuucccagagccugcucccaaggugaggucccagugggugucagcccaccuuagggacaucaggccaggcuagagaggcuaaccgaggaagcauaacagcgccaggcucuuaccugcaguagcucagaagacuccagccacuugcagagggaacccaucaccacccuguuuacagaucagaagaccgauaagcagcuguccucuaaggggaagcacccaggaggaggagggcgggugccagucauggggaccccaagcccugccacccucccagggagcagaaggggcagggccagacucagcuucuccguccagggcuccuaccgcagcaucugccaccccgucucugggcaccaaggcccacaugggcacuucaggcccagaagccgccuucugcaggugaagagaccauuucugcccaggacuaagccacagaccaaggacucaggcuuucugucugguggcagaagccucacccccucccuaguuugcaguguuagcaugaauggcccucagccucuggaugucagccuuucccccccaggggugaggaccacccaccccuugugacccuccaaggaaaggaaccagcacucaucaaggucccacugggcaccaggugcugggcuuggcgugcuguguguuaucccauuucagcuucccagcaacccuccaaguuagcuucagcccccaccccgcccccauuuuacagaaggaaaacacaaggcucaggaagucaggugccacccaaggaagguccuacggcucagggaggagcccagguccagguccugggaccuggguggugggggcgugcagagccugagcugggacccagugcugagguucagcggggcccgagcugcagcaccacugccccaggcugaccguacugggggcccggcuaaccucugccuccuuuccuucuaccuucccaggguaaugaugcggaagagccuaagggggucaccagcgaagguaguaguccccgccccugcccgcccucuccuuuccccagggcucuggccucagggccuacccucacccucuccccuuccucuagaauuugacaaauuccuggaagaacgggccaaagccgcggaccgauugcccaaccucuccagccccucagcugaggggcccccgggucccccaucuggcccagcgccccggaagaagacccaggagaaagaugaugacaugcuguuugccuuaugaguguggggucuggcacccugcagcccagguccccacugcucucacacccuuaggcugggaccucccucccuccucugguguuaaggcugcuuuggggguggcuuguuacccccuuuuccuccucuuugaagacggagcugccccagcuguggcuggggguguggaggcagugggaugaacugggggacaggucugcgcugcagugggaucuggcugcucugccuccuuucccaccccagcugaccaugagacuuugcugagaaguggaggccccaggacaggcuggcuggcuggcuggcugcuugacccagugugacucuccuucacugagugauacccugcuccgggcccaugccccaaggagcccuucagagcccacacugccagucgaggccuggcuggaggcuggccacaguggaaauucugccgagccucuugucccuucccugcucugcugcauggggccccauggcuuuggcuggccacugaggguaggguguggagguguggaggcccccugaggagcugcggcggcccagguacgaagcugcaacucugcgcgcagugggcgagaucucaucagccccaggcugcaggugaggcuucaggggaugcuggggccccacugccccuccgcugccuugcccuccauccuuccucuguuccuucuggccgggcaccacagcacuggggcucaccucuugguugauccucuuguacugggagaggugccuuuuguauccccaauuaaagguagaaaaccacccugcuagcagcauu

SEQ ID NO: 21254 - RNA, 1838 nt, Homo sapiens
uuacuuaaauagauucaauaaaaagaacaaacacacacaaacacaaacacgucuuaaaauaaacucuuuagagacuaagugcguguuucuuuuccacaguacggugcagagaggggagggcagggggcggggguccccuucccaauguccccgcgggcuugaguaccaggcggcggggccagcuccgccgcgaucgcccccucuuccccucccuguuaaauacacaaauauauuauauucaauaugaaucgagucuguuuccagcagaaaaaaaacauacaaaaaaaaguggaagggggggcuuguaaacgucgagguggaaggacugggcgcaggguaggagggccggaguccagugugguuugcggcgccccuaggucccagggugggugcccaccgccugcucccuggaccccagugggaggcgugugcccagccguccaagcgaggggguguccguaaaggggcaggggacguucagaaggcgugucccuugaccccaagcagcagcugacagccguugcugacgugggucaugaccuucuguuugagcugggccaccugcucccggaggaggccggcgguacucgacagccccgcguucucggccuugagcgucuucaccuuguccuccaggcgcgcgaugcgcuccagcuuccgcuuccggcacuugguggccgccagccgguuccgcagccgcuugcgcuccacuuugaugcgcucuuggucuuccauguugaugggggacaccggcggcguggcgucccggcugcgcgccuccggcacggucugcgguuccuccuugaagguggaggcgccgcggcccaagcccagcugcgccggguggccaccggcgaagggcggcgcgugugggagguagcugaugguggucgucggguacgagcucccggucccgacggcagccccggcgccucccgaggacgcagaggcuggggaguagcugcugagguugguguaaacgggagguggcuccgggccggcguagacgcccccgggcccagccgggggccccccgguagcgcccagggacacguuggggggugucacgugguucaucuugugcagaucguccagggcuuugacaaagccgucggcgaagcccuccugcuccucggugacgccgcccccugcgcccccugcaccuccaccgcugccacccccgcggggguaaaaguacugucccggggguguaggcgucgucgugaucacgccguugcuguuggggacaaucaggcguuccagcuccgaagaggcgagcuugagagacgcgccgguguccgagcccugaccagaaaaguagcugccgccaccgccgcccucugggccggguccgcgagccccaggcgcuuugagacuccgguaggggucggccagguugaccgccaggcucgguuucaggaguuuguagucguguagagagaggccaccaggggcccggccguaucccguagcuguguaugagucgucgugguagaagggcuguuccauuuuagugcacauccgggcggcccaggcggucuggggagggucccugcggggccgcuccgggccucgcugcagcgagcggcgagcucuccgcugcggugaccggacugggugccuggucgcgcguucucgggggcuggcgcgggcggguagcagccagccggcagcugugcgcaaaagcccugucaggcuucccgagcccccgucgcccucucuggcgcgauagcuuuccuggcgucguuucccccagcucccagcucccugcuggcuccgaggcuggccuggccgcucucaaggucccagccgcucagccugagccacacgccuuuaua

SEQ ID NO: 21255 - RNA, 59883 nt, Homo sapiens
cgguucggaggcggggcaggugggggcgggcccagguagcagguuuggcugcgcgggggccgcgcgucggagguaaauacuagggcgguggguguggggagccggggccggcccgggacgcgggcuggggagccggggcgaggggcgacgccccgccgcccgagguuagugaaugagcgggcggcuggcggccggcgggcggccggauccccucggcgcagccgccuggccucagggcguccggagccgccgcggcgaccaucgggcccucggcgccggcccguuaguugcccgggcccgagccggccgggcccgcggguugccgagcccgcugacgucagcccggguuucccccccccaccggggcuuccccaucccccgaggcuucccgggagggcugcgaguccggggagcgugcggggucgccaccaucgggacccccagaggagagaggacuuggggcgggagccgcgcgggacgcugucccccucccgccccccaccccauuuacagauugggagacugaggcacaggccgcuggcgggccccgacggccacgguuggccucaggagcccggggcugugauuccuaccgaccgcgccgcggggcguacguaccgaucgauuuugcggguguugguggcucccguccaggaauggcagucgggguucuggccuuguuaauggcguguucugcuuuuucuuucaguuucccccuuucuagggugaggaugguucuacacagccacccggaguuccuuaguugaaaggugcgcccugcugugacagguauucuuucuuuauguuuuucuuucauguuaacaaucgagggggguggggggcgaauggggggcgggggcgaagucaugaaaucuucaggagaugguguugaguuugguacucagcugggucagcugccgguuauucauguacuuggcaucguuucucuuccaccccuuggcauuugaauguuuuaggauaguugucaucuuccagccaccaagccuguggccuugcagucucccagcccccaucaucccugccaccuucuucuccucaauuuuuccuggaaaguuuuauccuuagcucagcuaaggagcaugccuaccuugcuuuugaauucgggcuaauuagggaucuuaauaagauuguucauuuugcaaucauuggcucucagagaagcacccaggccuugagaggguguucguuugauuguuggcuuucuacacacccccucacgccccaaguagacugaauggccuuaagaauuuagccucccauuccccacugagcaguagguggauuugaacuagaacaguauuaggagaaaaugauuugcuggaaauucuuauugaaguaacacccagaacauucucuaauauucugcugcaaaauuguauaguauucuugcaaauaaaccuuccucugggugguaacuuuugugagaagcagauaaggcuuguuauauaaagcacaacuaacauuaagcagcaaugauuuuuauagucuggcacaccuaaacugugguuuuguuugauuuaaggaagucuccaacacagggagagagaaaggaauaguuauguuguuuaucaaacuauuaguauuuuguuccugauuuucacacuaugauuuaaauuaguuuuuuuuucauugguuguacagaauuuauaagcaucauacaugcuaguugaggcuguaggaagcuaguaucaaauaaaccucaaaacaacuugguuucguaauugugaaauuuuccguauuuguuucuucuuauauguauaacaaugaagugguuuagcaugauuucauuuuaucuagagaauuacugaaguuuuaggcaaaauucauuaaauacucccaauuccugagucuuuuucucuucucuuucucuugguuuaaucccuuaaacaggaggaggaaaugcaauuuuguuuucacuguuaccacuugagucuuucauucauuucucuguauucagugccuagcauaugccaggcucucgugugggcacuggauaauauaaaaaugaaggacuuggggaauucacaguuuggcaguggaguggcuagguuuaacacuagagaggcagcaguauuccuuguuccagugggaauaugcagaugugagaggcucuucuuuucuuuuuuuuuuuuaaccuuauaaaucccacuuguauuagggacuguguacuugugacacaaauuagucauugaggaaaauuaaaacggacucagucuuuuuucuggccacggaaucucuguaucucuauucuuuagcuguuuagaaauauaacaacuuugucuuuuagugagagauguucucuuuuaaaaggaugaucauucuagcuauccagaagcuuuuggaaaaaggcccacaugucuucuuucuuugguguucaagcugaccuuccuaccucuuugccauuuauaauuaggggcagaauuaaguauuguaaguuuuauucuaauuuaaauagcuuccugugguuuuuagaacaagcaggauaucuuuggagaugcaaaaagcucuugaauuggaucugucuuugugagauccuuaugaacaauauaaccugauaacuugagaaucagaaaaacacugcaucuucuggauaaguuaaccauuguuaguuuucuguagcuacugauguucauuuguacuauauguugccuuucagaaugugguaauuguaaucuuuaacauuuucauguaaaacauauuuccugaucaucuuuccauugucuucauggaaaauugauaaauauuugugccuuccaacucucgucuugguugaaugacuucaucuuaauacaaguaaguuccccuuuacucagaauccagaccaucaacaagcucagauaaccagaaauguuuucaaaucuaugugaaccugaacuguucuccuucaucagcguccuuaaaggaaaggccuucuguucaacauggcuuuaggguuaaacauauuauuguguuucaacucguugguaauuuucauucaguauuuauuaccaagauauucauaaucacacaguuauccagccugaaguaagauaguauuuagaugagucauuugugauauacucacucaaagugauucaaccugcaaaauaauaagagaauacaagugaaaauuucucccuucacacugaccccucacccccaccugcccuacggugacuuugaauuuagcugugcuucuuuuuccuucaguugucuuacuguucccuaggccuuuacuuaaaggcagaagcugagugaauguggauugauguuggguuuuuuuuuguguguguucucucuuuccucuuuguuuuuuuuuuuuuuuuuuuuuuugagaccaggucuugcucugucacccaggcuggaguacaguggugugaucauagcucucuucagccuggaccuccugggcucuagcgaucuucccauccuccagaguagcugggacccugaguagcugggcccacaggcagacaccaccacacccggcuaauuuucuuuucuuuuuuuuucuuccuuuugggacaggcucucauucugucacccaggcaggagugcgguagugcuaucacagcucacuaaagccuugaacuccagggcuuaggggauccucccacuucagccuccaaagugcugggauuacaggagugagccacugugccuagccuagaugauguaguuuucaguaucuaacucuguacugaaagcguaaaaaauaccaaacuaacaaaccaaccuucuugaugauaaauaacucauuuacaaugugauuuagaucuuucccuucauauuguguugagucaguuuuuacugcuugggguaccuaagacuuuaacuauuuaacuacuaugcacaucccagugaaaguagacuguugguguuauauucacuucuacaguggggagaaauguauguuagcauauuuuuauugcaauacugguauuuugaguacauaaaauaaauauauauauauaauggaguguguauauaugugagagagugugugacagggucuugcuuuuucacccaggcugaagugcgguggcgugaucauggcuugcugcagucccucccuccagggcucaagccauccucccaccucagccucacaaguagcugggacuacaggcacaugccaucacaccuggcuaacuuuuguacuuuuuguagaaaugagguuucacuguguugcacaggcuggucucaaacuccugggcucaagcuguccacucaccuuggcuucccaaaguguugggauuacaggcgugagucacugugccuggccgagaauauuagugaucauucaguugauugccuuguauaucucuagacucgagccguaaaguuucccauucaacuuucucuaucaguugcagugaagagaaucaauuuuuaauaagagaguuucaaacuuguucuuaauauauucuuucugaaagaggaaaggcuguauccuuuauuuuuggauaaugcuuuugaaauauuugauaacuugugcuugacuauuuuaguugucuaacaugacccauccuauugcuaagucuaagcucauuuccacuugugcuaaugaaaguuaggaaaaaaguuaccacuccuuguagaguucacuuuaaaauaugguacuugaaagcuauaguuuauuacccuaaaacauuuuuauaaaccuagcaguuauaucaauuuuuacuguggauucucuuccuuaaauuauuucagaaagcaagcuuauaaucaaauuuauuuaacauaauguccuaaugcacauauaguaauuuaguuuugucuuaauaauagauuauuagcauuaaugauuuuuauuuuaaauugugacaugaauaguuaagcuacaggaccaauagaguaggagcuguugguauaaagcaauuauuaagauucagggaaguuucugauuguaauauuugaagacauuguucuuaggaauuuuaaaaaagaauuucuuuucaaaauagaauuacuuuaccuuuuucaaaaaaauuuuggcccuaaaaaucuaaauacauuuuaaagagaaccaaaacaacagcucguuuuuuugaaaguugcuuuuugacugucuuaaccuucugcuagugaccagacucucuauucaauaaagccuaugugcccuuugcuccuaaagacccuuucagaauguaugcauuccucuuuucacgauuguugcuuuguguuuucaaacacacaaacauauuucacuaccuggcuucucagaacugauucgaagcgauaaguuggaaagcaacaaggccguaaaaggagucaaaugcauacagcaggaaaccacagaaaauggcugauugcaagggaaaacucuagacaguagaucuguagaaagcauucgcgaccucaggaagcauaagauacagccuuuuaacaaaauaacagccuugcagaucaagaguuaugcaaaauaauuuacagucauaaugauacaucaaugaucaagaaaaaaauaaggacauuuucuuguggaaaguguugacauguuaaaagcauuuuggucaaaaagaaccaacacuucaguuugguccuuuaaaggaauccaaccaaauugagggguuggauagcuguuugggcagcccuuauaaggaguuuuguuuauauugugucaagauagagguuuccacaggugucuuauauaaguggcaaauauaaauugaucccauucuugcugaaguagacagugcccucaaguggaauuaaaacaaacacaccacaaaaaagaagaaaagagaaccacuucaugcuaccucugcuuuuacccucacugaguguuacacagauauuucagucauguugguuugaaggaggugccuaaccuguauccugucuuggcuaaaccacaugucucaugcuggcuuguagagggagagacuuuuaggaacguuaccauuauggaauacuucauuaucuagcagugcuuucuaaaagaaguguuccacuguguauagauuugccagguuguuugaucauuaagugauuaaaucuaaaauuugguucuuuaggaguauuuauuuuuuaauugcuagaauaaaauaaauaugauagugcuaucaauugcagccauuacccagaauaauggaaauggauaccucuaucucaaggaaggaugaaaugaaaguacugucuuuggaaaccagauagccacauucuuaugacagggauaccuaggaaguauuguuuucagcagaaaauuaauuaaaauaaugaaguaaagucucaguuuaaauuaaugaaauuguguaguuuuuuaaccaucaguuaaaauagguuugagaaugagccuacuucauuggaaagauuauuauucuuguaaaaauuuuaaaugaggaccaggugcaguugcucaugccuguaauccuagaaccuuggaaggccaaggugggaggaucauuugaguccaggaguuugaaacugcagugagcuaugaucgcaccaauguacccaagccugggugacagagcgagacccugucuuaaaaauaaauaaauaaaauaaaaauaaaugaaaauuugaaaaagaaauaauagaaagaaauuauaaugcaguuauaucaugauauucccuugcuauguaguacaaguuuugaugcuacaaaauugauuuuuaaaauauuuuuaauauagucauauuauaauaucugauauuugcgauuugagaaaucagauaacuaugauuaaugugaugaacauugcccaucuucagaaaaaauauaugaaaugaaguugagucagagguaaaauguuccauuaucacaauauggccauaucauagcuaucauuuauaggcaugagccacacagcucagcccgaaacgcuacuuuuaaaaguuuauuagugucagaauaugggacaggccugguggcuuacgacuguaaucccagugcguugggaggccaagacaggaggauuguuugagcccaggaguucaagaccagcuuaggcaacauagugagacccugucucuacaaaaaauagaaagcuuagcuguguguggugauaugcgucuauaauaccaguuacucgggaggcugagguaggaggaucacuugagccuggaaggucuuggccacagugaacugugauugugccacugcaguccagcaugggcaacaagagugagacccugucucaaaacaaauaaauaaaaauaaauuaaaaaaaguuagaauauguauauaaggguaaucuuuaaaaguuuuuacuagaaucugauuuuauaaauuucagugucuuggaagcaaacauuguguugucuuugaaaguacuuuacaauuggauuucauuaauuaaauaugcacaguuacaguagauaaaaguaauacaguauguaugucuuuuagcccuuuuagauauuuuuugaaaauauuucauuuguguguauguguuuacuggucaaaugaaaauuuuaaaagucuucagucuuaauuuucagucauguagaaugaagucuaaaguuuauuuuugcuuuuucacuaggcauuuugauuuccuuucuuuuuacagcauggacaccacguugcugaaaacaugcuuugggacugccacugaauuuaucuuuugcgguuuuaugacaaaguuauuaguaguuucccuuuuuugaauuaguauuuugaaguuaauaucacaaugaguucaggcuuauggagccaagaaaaagucacuucacccuacugggaagagcggauuuuuuacuugcuucuucaagaaugcagcguuacagacaaacaaacacaaaagcuccuuaaaguaccgaagggaaguauaggacaguauauucaagaucguucuguggggcauucaaggauuccuucugcaaaaggcaagaaaaaucagauuggauuaaaaauucuagagcaaccucaugcaguucucuuuguugaugaaaaggauguuguagagauaaaugaaaaguucacagaguuacuuuuggcaauuaccaauugugaggagagguucagccuguuuaaaaacagaaacagacuaaguaaaggccuccaaauagacgugggcuguccugugaaaguacagcugagaucuggggaagaaaaauuuccuggaguuguacgcuucagaggaccccuguuagcagagaggacagucuccggaauauucuuuggaguugaauugcugguaaguuugauaaaccauuuuaguaguguguuuguuuguguucaugugugucuguguauuuguaugcacauacauauuuuucuccuuaaauacgaaauaaauuuucccaagagucuucuguaauuuuuaauauucaucauccuugcugaugaauccauguugugguugaauccauaauccaaaacuugcuuauaguugucacugauaauaugugugaaaaucaccuuggcguuuauuucuguuggaaagagacccaagaacucugugauauguuuccaagcuuaauauucauucuugagaacuuaaaugucaauuauauuuugacauucuugcaaauagaauuguaugccuucuuugcuucuugauuuaauuucuuuuguuuacuuuuuaaugaugaauugcgaagauguaaagaugaugucgaaacuuaaaaaacuauguacuaugguaggaacauacaaagagauucaccuggcuauugcagacauauauauuuuagaaauuuuaacauugccuguauuaaacaugaacgcuaccaguuguaaauaguuacauaaaaaauuguuaauuaccuugcguuaucaucuauagguuucuuaguucuucuuaauguauguuauuaaauaacaauuuagauauaagauuuuugaaaaaaaaguugcagaaauuuaaacuugcuuauaauuguccccgauaauauaugugaaaauccuuagaauuuauuucuaccggaaggagacccaagaaugcugugauauguuuccaaacuuaauauucauucacaagaacugaaaugccaauuacauuuugacacucuugccaauagaauugcaugucuucuuugcuucuugauuuaauuuuuuuuaaaagcagugauuguaaacaauuaggaauuugaaucccaguuaagccauuuacuagcuggguugccagguuacuuaacaaagcuacuuaacuucucucauucugcauccuuaccuguacaaugguguuaauaguacaugacuuguaguguuuuugugguacauugaugcaggauuuaagcacagugacugacaauaagugcuuaaugaauggagcuaacauuacugcuauuuuaaaguaacauuuucuuuuuauaaccaaauuaauguuagaaucacaacguggaauucagccuagcuuucucaugauagaguuaugaauugaaauuaucagauaauauuauuucagcaucagauacaacuucuuauuuuuuaaaacacucuaaauccaacagaaacugcuaauaauuguauuucuuauuauauguaucauuuagaaauuuuccagagugauuuuccugaaaucccuagagugaaccccuuuuccuauggaucgucuuucuauaucuauuucuuucccuucucucuuaaaaacuaggaagaaggucguggucaagguuucacugacgggguguaccaagggaaacagcuuuuucagugugaugaagauuguggcguguuuguugcauuggacaagcuagaacucauagaagaugaugacacugcauuggaaagugauuacgcagguccuggggacacaaugcaggucgaacuuccuccuuuggaaauaaacuccagaguuucuuugaagguuggagaaacaauagaaucuggaacaguuauauucugugauguuuugccaggaaaagaaagcuuaggauauuuuguugguguggacaugguaagaaaauuuuggauuaaauaucuuugugauauauauauuaguuuauauauauauguauauauauauauaaacauauauauacacacauauauauacacacauauauauguauaguuuauauauauauguauuaguuuuaggaccaauuuacuugcaaauugaacacuuugaauauuuaacaugaucuaauuuggaguacuuuaaagaacauguucuaauuuaucuuugguaaaggagcauugaaauagaacaggggucuagauacagauuacauuuacuuuuuuuucccauuugaauaaacuagaauaauguucucuaucuuuaaauuugccuuauuguagcugaccaguagacaaaacaaaacaagacaaaacacaauuauauuacuugaaguccuauuuuucuuuauuuugaaacaguuuuuugggguacuccauuuuuuugugauauucuacacaauuuaauggcugaucugauuuuaauaauuaguauaauaaucauuuauagaaaauaccugaguagaggaaaaccacauugauuuugaggaauagacaaucagaauaucucauaggauuucauucauuuuaaaaaccuuuuuuaauugugguaaaauauacauaacaaaauuuaucacuuaagcauuuuuaagugugcauacaguggcauuaaguguauucacauuguuguacugucaccuguucaucuccagaacuuuuucaucaucccaaaccgaaacucugugccuguuuuaacaguaacugcccacuuuccccaaccucugcuaaccacaauuucuucugauuucucugucugaauuugccgguucuaggcuccucauaagaguggaaucauacaacauuugaccuuuuguuugugucacuuauuuuuaauguuuccuuacaaucauacuuuuuaauaauggauccauuccagugugguucauuggauuauaccuguggcacugaaagaauaagaagagaaaggcugagaccauuuuuaucauauauugaacauaugggcaagacuuuguuauguauaaagaaggaaauucauauggaauuacugaacacuagaaugaguuaggaggcgaugugaguaguaaucucuuauacucacaauggggaugcuuuuagucaucauuuuuaucugcucagguauacuuuuugguugguaagguaauguucuaguguaaugguuuccugugcuugaaaauuccaggaaauucuaucugauacucauugguuaguuacuaaacaaacguuuacucuuaacaugugaaaaguuagaaccagaguaaaacauguaugccccucaggauagcugacaguaaagcacuccuuuuaaccaauauucuuuaaauaguaauucagucuuuauuucaaggagaauuguggccuucauggagggaagauuggagaaagagggccacuggucauugggguuggucuccccuugcaucaggcucuuuaccuugggccucaaacuuggcagaagcuguuuaggguuuaggccuugccuuuuucagauggcggucuggggucagcuuguuuaccugaggcaagcugccuagagauuugcccugccagcuucucuccuugccuccaucugucccauagcugacuugugcagauauucauuccaaacacuucuauuauaguccuuaagaggaaaguucuggcaaaugcuagaacuucuuucuuuaucuccuuuuccuucuauucauccuuuauuuccagggacauuuuagcaugccaugcacauuggugcccagggcaguugucugacuggcccgucuacugauguaguucccuguacagcacagugcuaguuggcacuauauuagaauaucagauaauuaaauauaaacaucuccaucuuggagaagauuccuauaugcucauaaaugacaaaagaacaauuagaaaauagacuuuuuauguacagaaaggcauacagaaguucagauggacuauuuaaaugcucagggaauaugaagaacuuagggcuaauuagaggcagguuucugggugaaauaauauauuauuaaugaaacuuccugugcaaaauacugucuuuuuaaaccucaaauggguguuauccuacagauuaguauuuauuguucaguaaaguaugaaaaaaacacuuucaauucuuugcuuaucuggggguuuacuaucacuugguuauucuugaaucucauuucccuaaagaaaaaaaugaacaaaccaaugaaaaaagcaaaaccuuauuacuauggcaacuauuccuaauguauucuuucuuucuuuuagguaaaauuguuaacauuuaccaauguaaaauauuuuggaggauucuuuauggaaaauacagacuuccacauuuacauuucauugaggaggauuuuaauguuuauuauuuaauuucuaggauaacccuauuggcaacugggauggaagauuugauggagugcagcuuuguaguuuugcguguguugaaaguacaauucuauugcacaucaaugauaucaucccagguauguuuucuuuguuuuauacauuuauaaggcaaacuuuauuuuuuaauuuuuuauuuuuuuauaucaauauguuuugggggaacaggugguguuugguuacauggauaaguucuuucguggugauuucugagauuuuggugcacccgucacccgagaaguauacuccguaccccauguguagucuuuuaccccuugccaccccccauucuuucccccugaguccccaaaguccaauguauuauucuuacaccuuugaauccucauagcuuagcuccuacauauaagugagaacauacaguguuuggcuuuccauuccugaguuauuauacuucucuuagaauaauagccuccaauuccauccagguugcugugaaugccauuauuucauuccuuuuuacggcugaguaguauuccaugguguauguauauauauacacacacacauauguauauauauauacgcauauauacauauacacacauauauguauacauauauacacacauauguauauauacacacauauauacauauacacacauauauguauacauauauacauauauauguauauauacauauauauguauauauacauauauauguauauauacauauauauguauauauacauauagauauguauacauauacacacauauauacauacauauauacacacauauacacauguguauauauacacacguguacauauguguguauauacacacguguacauauguguguguauauacacacguguacauauguguguguauauacacacguguacauauguguguauauacacacauauguguacuacauuuucuuuaucgacuuguucauugaugggcauuugggcugguuccauauuuuugcaauugcagauugugcugcuguaaacgugcaugugcaaguaucuuuuuccuauaaucacuuuuuuuccuuggguagacuccuaguagugggauugcuggaucaaacgcuagagcuacuuuuaucuuuaaggaauccccacacuguuuuccacagugguuguacuaguuuauauuuccaccaacaguguaaaaauguucccuuuucaccacauccaugccaacaucuauucuuuuuugauuuuuugauuauggccauucuugcaagagugaggugguaucacauugugguuucgauuugcauuucccugauaauugaugaugcugagcauuuucccauaugcuuguuggcuauuuguauaucuucuuuugauaauugucuaaaagugggcuaauguccuuagcccauuuuuugaugggauuguuuuuuucuugcugauuuguuugaguucuuuguagauucuauauauuaguucuuuguaggauguauagauugugaagauuuucucccacucuacugauuauuucuuuugcuguguagaagccuuuuaguuuaauuaagucucaucuauuuaucauuuuuguugcauuugcuuucggguucuuggucaugaagucuuugcuuaagccaaugucuagaaggauuuuuccaauguuauccucuagaaucuuuaugguuucaggucuuagauuuaagucuuugaucccucuauaaggcaagcuuucuaauauauauuuugaguacauaaauguaagcuucaagauauauuuuuagaacuugacuuuuauauuauggaauuguuauuaaauaggauauccuuuacccucaaaugaaaauaauuaagauuuuuguuuccagacguauaugaguauaaggguggcauuaauauguuuucauucacuuuuucaucaccuguccauucuuagugggggaaaaacccuuccuguuaauuagaaggaucggaaaauguaauaaacugcuaccugagugagagcuugguuuaaacuagaaggcuuuacacagacauuggucaucuaaucuaaucuaauguacuguggagaagauucuugcuggauaaccugugagaucccuuuuaguuuugagaaggugugauugaucagggaucaggacucuagucagaaauagauugcucaacuuuacauuuagaagaaaaaucaagcaaucuuuuauuuugccucuaacaaguagcaccuagugucugcugucagguaauugacaauuucuguugauaacagcaucaacaguuucaucccccugcuguuaguggaacucucugugauacaggcuagugcaauaaagccaacaguggcagucagagauggugauucucauugagcauuaugcaagucugauuaaaaugucagaaggccugcaggcagacuguagccaggaauguaccaggcccugaguuagacgacuuaauacuuuuuuacauucuuaacaaacuuauaauguaagucuuaaugauccccauuucgcugauaaaaagcuggggcucggauggacaacaauuaccaaaaucaaaguaaauaguagagccagaauuuaaauccacaccugucugauuagaaagcugugcucuuuucaguaccuccccaccccaaauccuaucuguauauuuaggaugugaagaccugcauagaaaaccauacuucucagucucacauguauacuugggaauauuguuuccauggagauauauuuugucucuaauucuauaaaagcugaauuuugcuauagcaaggaucacaauugaauaagcaaacugaauuguuuuuuuuucaggucauuucagguccucaguuucuuuuguuguaaaaaugaaagggcuaauacuagaugauucuuaagguuccuuuuagcgugcacuguuugcgcuuccuguuuuccuguugcugaagcaaguaaucaaugcuuguuuuucaaguuagggcaugcuuucugcuuuaguuuuuagcuuuacagcaacagcacauuaauuuaguuggagguauaggauucaaaugauagcuuuauuucaauuuuacuucuucaaagugugacauacuuugcuuuacuugauguuuguaaaaucaauuuuuaauuuauugcaaauugaauuccuagcuauuuuuuauuuugcuucccuuugggaacaaaugauuuacauucaggaaaaagcauauaugugcuugauauuuuacuuggcaaaauuuaauuuaguuuuucaugauuuuuuuuuuugagacggggucucgcuuugucgcccaggguggagugcaguggcguggucucugcucacugcaagcuccgacuccuggguccacgccauucuccugccucagccucccgaguagcugggaccacaggcgcccgccaccacgcccggcuaauguuuuguaucuuuaguagagaugggguuucaucguguuagccaggauggucucaaucuccugaccucaugauccacccgccucggccucccaaagugcugggacuacaggcgugagccacugcgcccggccuaguuuuucaugauuguuaauggagauaauacaauuuauuuuaugaauuaaaguacuuuuaaauauuauaauaaaugcuuaugguuuacaaaacaguuuaauaaaaggccauuccuucauucaaauauuauuaagcccuuaccuagauguuggggauauaguaggaagcaaaacugguaaaaauucuucucguguggaguuuucauucuagugaguggagacagacaguaaauauguaauguguaugaucaauuacaugauaauaagaugaaaaaugauaaacacagugaggaggaagggagcacuagguuguagggcgggauuuuucgauuucauguaggguaguucugauaaaccuucuaauaaggugacauuugagcuguugacaugaaggaaguuugggagagaacauguggauuccgagggagagcccaaggccgcagccagcguggccaguuugagcaaugugaagaguugacuguggcugcggcagauggagugagggagaaaguuguaggagccgcagugggagcuggaacagguagugcucagugggcuguuguguggauucuuggcuuucauagugacagagguggggagcuauagguggguuuugaacaaaggacaacucacccuaauuugcauuuuuaaaugaucucucuggcugccuguuaagaauaaacuagacagaggacagaaacagggagaccaggaaggagacuguuguaguuauccacgugagagacggugguggcugggacuggggugguaugaagaggaugguaagugaaggauuuggauauaauguaaagaucccaucaagauuugcagauggguugggugugagguuugagagagagaacagaaucaaggaugauuccaagguuuggacugagcaacugguaggcuggagaggcaauuuacccaggugggaaagacaacaggaagagcaugcgucggggagugggaguuggaagucaggaucuugguuuugaucauguuaaaauugaguuagcuauuaaacaauuucauuugaauguuuauguuaauauuauacgaauucauguuuaauccuuaaaaaugggcaaugugcucaucauuuucauauuuaagaaacuuuuggcugggugcaguggcuuauuccuguaaucucagcacuuuaggaagccgaagugggcagaucacgugaggucaggaguucgagaccagcuuggccaacauggcgaacccccccgucucuacuaaaaauacaaaaauuagccaggcgugguggcggucaccuguagucccagcuacucaggaggcugaggccaggagaaucgcuugaaccugggagguggagguugcagugagcugagauugugccauugcacuccaaccugggugacagagcgagacuccaucucaaaaaagaaacuuuuuacuguagaauguauuugcaaaaguauauauaacaacauauauuaagaauaauaaugaacacucaugaaacugaccaucuagguuaagaaacagaacauuagaaguaccuugaaaaccaccugcaauaccuuguuuucauuauaauugcaaucucucccuagaggugaccauuauucugauuuuuucauuaauuauuuccuugcuuuuuauaauuuaauuauaucucuguagcuaaacaauauacuguuuagccugcuuuugaacuuaauguaguuaaaaucuuacugauuuuuaaauuacuugcaucauuuacuuaaaauguauuuugagauucuuuucuguggaugagggcauuaguaguuuguucacucucacugcuucauaguauauuucgucaugugacuaucccacaguuuggugcccauuguaauauuaauggacgcuuggguuuuagguuguuuccaccuccuuuuccacacuugguacugauuaaaauuuuugccagccugacagcugagaaaugguaucucaaggugguuuaaaaguuuguaguucccugauuacaaguaggauugaacagccuuuuauauguuuauacaacauuugugucuucuauuaaacacguauuuuuugccuguuuuucuguugaguugcucauuuauugauucaugaguucucuaguuuuagaauuuuaauaaaacaucuuuuaauguuuuguuaugacauuuuaaacagaaaaacugaaaauuuuauauugagcauccuuaugcauaucaucuagauccuacaaucaacaucuuacuugcuuuauauguaucuguccaccucucuauucacguacuuauccgucacguuuucuugugcauuucacauuaaguugcagauaccaguucacuuccuccuaaauacuucagugugcaucuaauuaacuagagauaaguauuuaggguuuucuuuuucauuucagauagaagucacacauauaaugacauacauauggauuuauuuggguucuaacuaauauauauauacccuugaauuagaaaccucuaucaaguuauuaaaacaauuuuaagaagaaaucauucauguaucucaaaucaaaauuaaaaaguacaauaaaauaucucauuuccauuuuuauccccucugccucaguugccugcuuacuccauccuucguuucucacuagucacaguuuuuaugaauuucuuauauaucuuuccaguguuucuuuauacaauauaaauauucuuauucccccuucccuuuuaauucaagaaguguaguagauacacuauucugcuguuugcuuuauucucuuaauuuuauauguuagaacucuuuguauauuugcaaacagagguucuuguuuuuuauaguguauaauuuuccauuguacggaaaaaaauuucauaauuuauuuaaccaguuuccuaucaauggacauuuggguuguuucugacuuuuugauauugcacacaauguuaccguaaccuguacaugucuguuucccacaugugcuagcauaucuggaggauauauauauucccagaaguggaguugcuugaugaaagggcguaugcguugguauuguucuggauauuguuaauugccuucagucguagauauaacaauuuauauuccugccaguagaauacaagggggaacuuauagcuuucccaugagaguguguuacuaacuuuuuucccaaucugauagauaaaaaauauauuucaguguauauaauacauuugcaaauagaaauuugcauuucucugagugauguugaacauuuuugcauaugauuaagggcaauuuuucuuucugugaacuguuugcaucuguugccuauuuuuaaauuggguuagguuauuggccuuuuuucucacugauuucuucauguguuaggguggcaaacucuucugugaugcgagaugcaaauguugcccacucuuccacccucauuugucauuugucuuuuuuuaaaauugcuuauuuuucuggucacccucauuuguuuuuauugugguaaaauauaccuaacaggauguaccauuuuaacaauuuuuaaguguauaauucaguguaaguauguuuacaguugugcaaccaucaccacuaucuauuuccagaaaucuuguucauuaucccaaauagaaacucuauacucaugaagagauagcugccgguuccucuuucccuccagccucugcucaucucuguucucugcucucuguccuuaugacuuugcuuacucuggguaucucauauuaguggaaucauacauauguccuuuggagcuggugcauuucacuuggugugauguuuuugacuuuggugcuuuuugccuugcaggauuuauaaaauuuuuaugcuguuguauucuuuuaguuuuaauagauucuggauuuugaguuacuguaagguuauaaaggaauuucccuguguuuucuucuaguacucugugguuuuaguacauaucucuauaucuaucuaucuaucuaucuaucuaucuauaucuuugacccauuucuguuuuaugugguauaugaugugaaauauaaauccaaucuaguuuuuauuuuugcccacagguagaagauacccuguugucuuaguaucauuuauuaaaaagucccucuuuacugguuugagaggccacuuucaucauacuaaauuuccacguguagcgugguauauuucuggacuuucuauucugucuucccacguuucaauaccacauuguucuuaaugauuuuuaaaaaauuguauauauucaugggguacaaguguaauugugcuacacuacuguauugcauuguggugaggucagggccuucagcacauccaucacuggagcaaugcacauuauacccaccaagcaaccucccaucauccaccccccgccaccccaagcccccuuuauucaucuuuccacacucugcuuccacgugugauucuuuauguguuuuaauauuauuaacacuagucuccucucacuguucuuuugaauuuuccuguucuauacuguuuucaaaauaguagucuucuugauaguuuugcguuuuuacauuuaaguguguuauucacuuagauuugguuuugaacaggauaugaaauauggguacagauauccaauuugaccuuccaugcuugcugcguauaaaucaaguuuccagauguacacguguggaucuuucugagcccugucauuucccuacacuaaagccuauccauagcuuuagaagucuugguagcugugagaguacauuuccauuguuuguuuucuuaaugaaugucuuggcuauuguuagccuuugggcuucauuguaaguuuaacuaucagcuucucaaauacuauaagagaguucuguuaggauuuuggaauugcaauuaaucuguagaacaauuggaggagaauugacauuucuaugauauuaaaacuucuaauauauaaaccuuguguauccuuucauuuauuuaauuuccuuuugguaaaauuuuauaauuuucuccaugaagagcuuacuugcauuuugaugcauuauaaagcauauuuucuaacagugucaugcugauguagaaauacaauugacuuuuuuuuuagaaaacagcuuuacugagaucuaguuuauaauucacucagaguguacaaaucagugcauuuuagugcauuuacagacaugugcaauugucaagauaauuuuagaacauuuucaucaccucuaaaagaaacgcugcaccccuuagugaucaucucccaaacccuucauccuuguuuaguccuaagcaacuaccagucuacuucugucucugcauauuugccuuuucuggacauuucauuuaaauggaaucacauuauauguggucuuuugugauuuacuuuuuucacuuagcauaauguuuucaagguuccuccauguuguagcaugugccagaauuuccguccuucuuaaggcagaauaauauuccauuguauggacacaucacauguuguuuauuaaucaguagauagauauuuagguuuuuuuuucaccuuuuggcuaaaaugaauaaugcugcuacaaacaugcauguacaaguuguuguguggacauaugcuuuuguuucucuuggguuuauaucuaggaguggaauugcugagucauaugauaacucuauguuuaaccauuuguggaacugccagacuguuucccaaagcagccacaccauuuuacauuccuacuagcaguguguaagcguuuugguuucuucauguccuugucaauacuuguuauuaucugacuuuuuuauucuagccauccuagugggaaugaagucauuuucaauugacuuucgugugcugauuuuucuuacaaacagacuuacuaaaauaucuuauucacaauccauggauuacuuauaaaauauucagucauuauaguuugcacauaauaacaguuuugccucuucugaauucuuuuauuuuuaaaaaugguuucuuacuguccuagcuaggaccucuaaauacaauauugaauagaaguagugauggaaggcaucuuggccuuuuuuucugaucuuaaagaaaaugcuuucaacauuucauuauuaaaugugauguuugcuauagaguuuuauuguuguaucugucauuuaucagguuagagaaguuaccuacuguuccuaguuuucuaacaguuuuaucaugaauugauguugaauuuuaucaaccccuuuuucucuauugagauaauccuauuuucuuuuaaucugcuaauuuucuuauauugaaucaaccuuacauccaugauguaaacccaaccuccucaugauucauacuuugcuugguccaguuugcuaguauuugcauccuguuuuuaaaaucucuguuuauaagagauauuggccuauacuuuuucccuuuuagcuguccuugucugguuuuggaaucaaagucgugcuugucucauaaaguaccugggaaagguuucuuuuauuuuguuauuugaaagaguuuaugugagauuagaauuaccuauuccuugacuauuugacaaagcuucuuuuuguggaaauguuuagcuacugaugaaauauccuuuaacauuuguuuguuuuugauugucuuuugcaaguuuuauuuuuuaugaauguauccauuuaauucauuuucaaagcuuugggcauaauguuguuuauaaaagccucuuaauuuucuguucaaccucagcagcaucugcccuuguguuccuauuuucauccaaaauguuaaucauuugugcuuucuuauauucuucaccaaucuuaccagugguuucugacuuucauuuuuucaaaggaccaacuuuuggcuuucuuaauucuuucuagauauacuuguuauuguuuaaaauaugcuacuauuuuuacuguguaacuagugcauuuuuuaggucuaagcccguaguucucagccugggaugcuuuugucuccuggggacauuuggcagugucuggagauuuuugauugccacaucugaggugagaguacuacuggccucuaaugcauggagaccagugaugcuucuaaacuuccuacagugcacagggcagcccuacacaacacagaauuaucugguucagaaccuuaguagaacugagcuugagacacuguguccuaagcaaauucuaggaguuaugcucauuuuauaauguuaacuugcuggauagcuaugggggaaucacuugaaaaacaaauuuucuuucauuauuuauguauucuugcagggauaaccaauucuaugcuaauauuguuuuucccagaguaacauggcuaaauguaauuucacuugucuuacgaaaucaaauacaggcauaccuaauuuuauagcgcuuuucuuuauugugcuucacagauauguguuuuuuauuaauugaagguuuguggcaauucugcuuugggcaagucugucaaugccauuuuuccaauagcaugugcacacuucgugucucugugucacauuuugguaauuccugcaauauuucaaacuuuuucauuauuauuauaucuguuauggugaucuguaaucaaugaucuuugaggugacuauugaaauuguuuuaaggcaccacaaaccacacccauauaagaugacaaacuccacugauaaauguuguguguauucugacugcuccacugacuaguggggccucugucucucucacuccuugggccucccuauuuccugauacccaaaaauauuaaaauuaggccaagucauaauccuacaauggccucuaaguguuccagugaaagagagaguugcauaucucucacuuuaaaucaaaagcuagaaaugauuaagcuuagugaggaagguauguugaaaaccgagagagacugaaaacuaggccucuugugccaaaguuagcuaaguugugaaugcaaaggaauauuuccugaaggaaauuaaaagugcuacuuuagugaacacaugaaugauaaaaaagcaaaacagccuuauugcugauauggagaaagguuuaguuaucuggauagaagaucaaaccagcacauucccuuaagccaaagccuaauccagagcaaggcccuaacucucuucaauucugaaaggcugagagagguaagaaagcugcagaagaaaaguuggaagcucgcacagguugguucauaaacuuuaaggaaagaugucaucaccauaacagaaaagugcaagaugaagcagcaagugcugauauagaaacugcugcaaguuaucagaagaucuagcuaaguuaauugaugaaaguggcuacauuaaauaaaagauuuucaguguaggcaaaacagccuucuauuggaagaagauaccaucuaagacuuucauagcugagaugaguagucaaugccuggcuucaaagcuucaaaggauaggcugacucuuuuguuagggguuaaugcaguuggugacuuuaaguugaagccaggauucugaaaaucccaaaauccuuaagaauuaugcuaaaucuacucugccugugcucuauaaauggaacaacaaagacuggaugacaacacauguguuuauagcaugcuuaacugaauauuuuaagucuacuguugagaccuacugcucagaaaaaggauuccuuucaaaacauuacuguucauugaugaugcaacuggucacucaaaagcuuugauggagaugcacaaggagauuaauguuguuuucaugcuugcuagcacaauaacuguucugcagcauauggaucaaggaguaauuucuauuugcaaguuuuauuuaagaaauacauucuguaaggcugccauagaucaggauuccucugacagacugggcaaagucaauugaaaacugucugaaaaggauucaccauucuagaugccaucaagaacauucaugauuuaugggaggaggucaaaauaucaacauuaacaggaguuugggagaaguugauuccaacccucauggaugacuuugagggacugaagauuucaguggaaaaaauaacuguagaugugguggaaguagcaaaagagcuagaacuagagguggagccugaaaauguacuugacugaauugcuauaaucucaugaucaaacuugagcggaugaagaaaggaaaagugguucauugagaugacaucaacuccuggugaggauauugugaacaucguugagaugacaacaaaggauuuagaauauuccauaaacuuaguaaagaagcagcagggcuugggagaggauuaacuccaguuuugaaagaacuucuauugugaguaaaaugcuaucaagcaguaucacaugcuacagagaaaucuuuuaugaaagaaagagccaacuucauuguugucuuauuuuaggaaauugccacggucacuccaacuuucagcaaccaucaccgugaucagucagcacccauccacacugaggcaagagccuccaccagcaaaaagacuaugacuccuugaaggcucagauaaucauuaacauuuuuuagcaaugaaauauuuuuaaaauuaagguauauacauuauuuucaauaacauaaugguauugcacacguaauggacuacaguauaguguaaacauagcuuucauaugcacugggaaacaaaaacacuugugugacuugcuuuauugugauauuugcuuuauugugguggucuggaacagaaccuacaauaucuccagggugugccuguguggguuuguggguuucaauuuuuuuuuuuuuuaauuuccauagaguacuuuugaaagcucaaaaaauaauuaaaaaaaaaagcauuuuagauugaaaguaaccguucucuuuaccuaccuuaauugcauuucuuugaauuuuacauuuuacaacugaaugcaauucauuauacugaauaaguuaggagacuagggaaaucauuaguuuaguauuauaauuuaagauugagauaccugaacuaugaaguuggcuuauguauaauugauuguuuuucucaguuggcuguagaauaaauacuugaagugcuuucucccacacacacacucuagagcuguauuuccuucugucuauuuuuuccacaucucaauuugguuugaaauguaaauuaucuuggguucuacaguagcacuuaaaaagcaaagcaaagaaaaaaaccacccuuucuauuuuuccuggaauauaaccugacaaggaauucuucauuaguaguauuuaucuuaaaaacauuuacgguuuuguuuuauuaaaauauugguggaggauugagauaauuaaaauuaguuacaugaauaucuugggcgucacuugucaggcacacuuugaucuucuaaaucaguaguuaucauugucauuauugcuggcucagagcagugaagagaaagaaaaagaaugauauuuuuuuuucuuuuaaagcuugauuuucauaaacccucaauaggagauaauuaagaaugauaccagcauuuauaacauaauacauaaauuacacuuauuugucaacaaaauaaagcuugcaaauagacuuuaaaaacuaaaguuguuuaaaugaaaauuaauuuaguuuacuuaaaugagucuucaucugccuuucaugucaucauuaggacucuuuucuugaggggaaaaaaaagucaaagugucuccuuuaguuccuuaguuucuuuuucuugcccaauuaccuucauccgugaaacaaaauuaauauuuacagcauuuaaaaaagaaaaaagauucuuuucagagcaguugaauggcugggaagcuuaggaaagaauucuuucuagucaauugcuuguaauaguuggcuucugaaggauaccuuugauugaaagaugcaggaaucuuaaaccuguuauaaaauuguuucucucuuauauuucuguucuaaaugguuaaaaacacugcuaacauaucuaauuugacauuauguucauguucuugaaguuguuaugaugaagcauaucaauuagcaccaccccaaaauuauacauuucgguuuuucuaguucaaccugugucuucuguucuaguuguggggguugggaguauaaugcuguuuuuuugacgaucucuacgaucaagauagugaacauauccaucaccccaaaauaugucccuugggaucccucccucugccucuuccuguccucucaacccccuacauucagacaaccacuggucuucuuuacaucaguauacacuuguucacauuuuuaaggauuuuacaaaaguggaauaacucagaaugcauucuuuuuugucuggcuuauuucacucgacauaauuauuuuuuauucauccauguuguccuuuuuauuguugauaugguuauauuaguuucuauauccauucacuuguugauggacacuugaguuuuuuucaguuuuuggcuauuaugaauaaugcugcuaugaaaauuuguguacgaaucuuuguauggacauaugccuucauuucacuuggguacuuaccuagauguggaauggcugguaauaucauaggugacuguuaacuuaaauaaaacccccaaaccuuccaagcuguguuuccaaagugguugcauuauuuuacauucccagaagcaguauaugagagauacaguucuuccauaucuuugccaacacuugguaugaucaguuuuuuaaauuuuaguaacaucuaauugugguuuuacucugcgcuucauuggugaccagugauaucaaacaucuuuccaugugcauauuugucaucuguauaucuucuuugguuuaguaucugugaaagucuuuggccgauuauuaauuguuucuuuaugauuggguuuugagaguuauuuauaaauuuugaauacaaacccuuuugcagauauaugcuuuacagcauuucagauuauuauagauucacaugcagagagagggacccugugugcccuuuagccaauuuuucccagcgguaacauuaacauguuguaaaacaagacgugugcaacaucacaaccagaauguugacccugauacaaucaagaagcagaacauucccaucccacaaagaucucuuaucuugcccuuuuacugccgcacaaauucccucuuccuccugccccauccuuaaccucugacaaccacucaucugcugucgauuucuguaauucagucauuucaagaauguuacauaaauggaguuguacaguauguaaccuuuugagacuggcucuuuuuucacugagcauaauucucuggagauuuaucuacauuauuuuauauauauccauggauuguuccuguuuauuccugaguaauauuccauauuauggauguaucaguuuguuuaacuguuuagcuguugaaggacaucugguuuguuuccaguuuuuggcuauuaugaauaaugcuuuuauaaauauuuguguguaguuuccugagugcacauaaaucuuuauuucuugacauaauuguccaagugcguauucggugauauuugcaaauuuaguuucuuaagaaaccgcuaaacuguuuuccagagugacuguacucuuacuuuaccacuggcaauauauggguaaucugguuucucuguauccuuuccagcauuugauguugucccuauuuuuaauuuuagccauucagagagauuuguaguuguauuucacugugauuuugauuugaauuuaccugauggcugcugauguugaacaucguuccguguacucacugucaucuguauauauucuuuuucuuucuuucuuuuuuuuuuuuuugagauggagucuugcucuguucacccaggcuggaguauaguggcgugaucucggcucacuguaaccuccaccuccuggguucaagugauucuccugccucagccucccaaguagcugggauuacaggugugcgcccccgagcccagcuaauuuuuguguucuuaguagagagaggguuucaccauguuggccaggcuggucucgaacuccugaccucaagugauccaccugccucggcuucccaaagugcugggauuacaggcaugagccccugcacccagccuucguauauauucuugagugaaagguguccucaucucuuuugcccagguucucauuggauccugugcuuuuuuacuguugaguuuugagaagucuuuauguauucuagauacuaauucuuuguucaauauaugguuugcacauuuuauuucccaauguguagcuugucuuuucauccucuuaauagggucuuucacagaguacaagauuuuuauuuuuaugaaguccaauuuauaguuuuucuugugugggucaagcuuuugugucaaguucgacaacuuuuguuuagcucuacauauggaagauuuucuccuaaguuuuuaaaaauugaaauguaauauguugugcaacccucaccacuauccaguuccagaacauuuucaugggaacccaguacccauuaagcaguuacuucccauugucucuuacccugagacccugacaaccacugaucugcuuucuaucucuacagauuugccuauucuggacauuucacauaaauagaauaaaagauauguggcuuuugugucuggcuucuucaguuaagcauaaucuuuucaagguucauccguaugauagcaaaaucaguacucuaaccuucuuuaugguugaauaauauuccaauaaauggaucugccguauuuuguuuagccauuuuucagucgauggacgucaguuucuaguuuuugacuauuauuaaaaaugcugcugugaacauucauauacaaguuauucuguggacaucuguuuucaguucuguuggguacucccuaggaguagaauugcugggucauguggugacuguguguuuagucauuuguggaacugccaaaugguuuucugaaggagcugcaccauuuacuuuuccagccacaauguaugaggguucuaauuucuuugcauccuuguucucuguuuuccaaaaaguuucauagauuuacuuuuuacauuuaagucuauaaucuauuuugaguuaauuugguauaaguugugagacuuaaguagaauuuuuuuuuaaaaaaucuauggauaucuaauuguuccaucacuauuuguugaaaagacucuuucuuccauugaauuauuuuucuaccuuugucaaaauucaguuggguauauuuaugugggucuauuucuugguucuccauucuguuccauugaucugugugucuguccuacugcccauaccacagucucgaucacugcggcuaacuaguaagucuugcaaucuauuaaacuaauuccuccuacuuuauucuuuuccaaaauuauuuuaguuauucuagaucuuuugccuuuccauaugcauuuuagaguaaucuuguguacaucuauacaaaaucuucuugagauuuugauaggaauuacauuaaaccuguauauaacuuuggggagaauugauauccuuuggcuagagagagcaaaacuuugguuggggccuucuuuugucuaugccuauugauguuuccagggugcugauuuuuuuaucucuaaguaugggauaagaauguagucaagaagaaaacccagagggaaaucucugugauguuauuucuuaggucuugagguuccuagcuggucuaccuucucaucucuaccuuucaaagucuucuuauauuuguuuuauauauuaugucuagagauuuuaguuguacuuagcaaaagaaauaggaaguacaucuacuuuaucuucccagaaguagaaguugcaccuuccuuuuuaacuuaacaauagauauuagagauuauuucauauuaguacauaaguuguauacuuggucuuuuguuuaaaucauugaauuauauuucauuuuaugcauguaccauaauuuuugaaccagccuccuacugaugagcauuuagguuguuuucaaucuuuugcuguuauaaacagugcuucagugaauaacuuuguaucuguguaucaguuagcaugugugccaguauaaaaagauaacuuccuaggaguagaauugcuaugcauuuuacauuuugauagacaguaauacauggcuuucauagagauugcuugucaaucggagucaccaugaauguugccuguauaggcaguacuccugguccuaugagacaguuagagcuggagcccugaagaaggauaauuugaagcaccagauaucagcaugcaacuuuugguguuaucuauauggcaccuucaagcauuucuugaagaauuuuucauauacuauuauggaaaauauuuauucugagcaggaacccaaccuuuuagagauuuuugaauaguugcuauguaggauauuucuggcaucggguuuaauaauaccucauucuacucaaguaaacuguauuuucuucacaagauuucuguggauguuaaauucucauuugagucugaauuaugcucuuguggcugcugauguuaagcgguacauuaauuaaacaauuucucuuaauuuacugggucauucaaauucauagacauuucauuugauuugaacaauaacuuguucacuaguuuauuguuaugauuuccugcucaagauucuccaagggauuuuucuuuuucugguuaaaucaacaagugauggauaagcugugaauuuuaucauuuaaaugcaaucuugcuguguauacauaauggauacuuuugguuugguuucuuuugcugaacacaauguccauguugcccuguuuaucaguaguuuguuccuuuuuuauugcuauguaguauuccauuguaugaauagaccauaauuuguuucucuauucuucuguagaauagcuuguuuccagcuuuugauuagaaugaauagggcugcucuguacauuuuuacucaugcuguuugguggaauuaucuucuauaucuuuuaauaucuuuaaucagguuuguuuuaaucacacaaaauugccagcugaauuuaucuuaccuugcuuuccaucccauauuuaucuuuuucugaguugguaaucacuuauaauucauuuaacuuugaaagcuuugcuucaugacccaaguaguuuugggccaugaacacaguugugacaaaguaauaagaaauauuugguguguaauugcuggagggcaauuagaggugguuugugccccuuugucuguauagaauucugauggaaugucuucuucuucagagcugauauuugacccccucucagacagccuuugacagaagguagccacaguuuccaacuccagugccccccugcucacauuccuaaucuuuggagcuccucccuagugucaccugcagaacugucaccaccggccauccaguuggcucuccaguccugccaggcuaccuucaaagccuaacaaagggaagagcacuugcuucauuuguuauaaugguuacuaacuauauaauggaucuauaucgugguauacaugugaacauacuuuaaaaauguuauaugcaguuaauuacaguuaauagugggaguuguuuuucuuuaggaaauuuauaugcuauaauuuaggaacucuucucagugacuaagauuuuccuucugaaguaucugucaugggugcuauuuaaagauaucugaaugacaacaucauaaaagaacaguggucuccucuuucaucaagggauacuuccaagacccccaguggauaccugaaacuauggauaguacugaacccuacguauacuguguuuuuccucuacauucaugccucugauaaaguuuaauuuauauauuaggcacaauaagauauugaaaacaauaaucagagaagagacaauaauaacaauauggcaacaucacuacucguguacuucaggacuauuauuaaguaaaauaagggugacuugaauguaagcacugugauacugcaauaguugaucugaugacugagguggcuacuaagugacuaacaaggcagggaguagacacaguguggagaugcuggacggggauggguuacgucagggguuauggauuaggauggugcaagauuucguuauaauacucaaaacagcaugcaacuuaaaacuuacgaauugucuguuucugcaauuuuuuauuuaauauuuuuggacagugguugacuguggguaacugauaccguggaagguaaaaguguggauaaguggggaccacaguauuaguacauagcuuuucucuuauuauaucacuugaucgaaaucgugguuaauugguauaauuuuugaauuaaaauauuuucauauucuauuggaucauauuaugagauguuuaagauauaguuuaauaacacaucccccuccucuuucaaccauggaaaaaaguuaccaaguauuuacauauaauucauuuaguaaauuuccucuuuuuuuaagaaaagucuuuuccuuguguuuaaaauguaaaaauuuuccuauuucuuucuuucuguccucaaauccacugugggugauaucguuuuugcugacacacagcuuuaucagguaugacuccuaagugucguguuggacuccacggauguauuguugaauuuuucaaaggaagaacuuuucacacugccucuucuacauucccuugaucaguauuuaggaguauucuaugaucauugcugggcuuuaaggucuagaguggucuuuguauucaaaacaaguuugccacacuuauuacaccuauauuucagaaauaauugugaguguuuucuucaaauauauuauuguugugugucucuggcuuucuguauuuuuaaucuaugcauaauucucuauguuuuccucuuuuauauguauaaguguuuguauacacaucuguguuauucuuaacauauauguuuuuaaaaacagauauauguucuuaaccagaacuuucuuuccuaaccaugauacauauuccuaaccaggcuuuuuucaaacuguguucaugaaauaauauuaaucugagaugcuaagcaaaguggcacaaaaauuuuuaucaauaaguuuauuuuguuucucccugagcaguucacaaugcacauuagcauauuaaaggcucugguuccgugcaguaaagaaauuguuuaucuuuguuuaucucagcaucuucaagaaauauuugaguucgaaacacuucauaauacacagggguguucuaagccugcugauuugggaaaugcuguaaaaaaccgaguaagauuuucuuuguaguguuuuaagagaucaaauaaaauugacuacaagugauuaaauuuucaagagguuaaagcauuuagcugaauuguauuuugagaggguauuuucuuauagaaauuacauuuugaaauacagcauugguuuuuucccccauaguauuaucuuuuucaauacuuuugauggccuuuaaaaggcauuuguaaaacuaaaaauucugccuuuuuguggaaagaggguuuuuuuauuuuguuacugucauuccuuguuucucuucuauaagaauuugccuuuaucuuuaaaaaacaugcuuacuguuucagagagugugacgcaggaaaggaggccucccaaacuugccuuuaugucaagagguguuggggacaaagguucauccagucauaauaaaccaaaggcuacagguauggauuaauagcauauaaccuuuaguaauuugcauaaugccuaacuugccauagcauuaaaaaagauuauaagcuauuacuucugaacauguauguagacuuuuuuucuuucaaacauuuuuaguagugaaacuaaaguuuguauauaaauacuguugcuuaagccaaguguucccagccuuuuuuaccucaggaagaguuccccauagggucuuguguguuuugcuggucuauaaucaaaugguuuuuggaacuccuuacuuggaauauuuguauguauaguuuaggauugcaacuguguaaaauaauccuauauggauaauguuauauaggauaaaguauacuagagguuaauuaaauggauuuugcuaacuagauuugguacaaauuaaaucccaaacugcuaagcaaaaauuucuucucuuucccagaagcuuccucacaauauguguggagcuuacagcucuuuuuuuuguuagcuuccacauacuucauagauuuauagaauaguaguuauacaagccaaagagcucauuaaaaaggcucugagaauuuuuguuaacucagaugcgaguuaggaaaagaauauuuuuuccucaauuauuacaauuuuggcucauuuaaaaggaaauuguacuuuaagaauuauuuuaugugacauuggggccugggagacuuaggauuaauugcaggauauauagguaacagucuuuuuuauguuaaccuauagaucuauauaggauagcucaaacuugcuacucucacuuaaauagaaacagacuaaagauuuucuuaagcuauggcauguuaauuguauuguaguagaucuuaaaguuauaaaauguacagcuaccugcuuuaauuugaaaagggaaaucagcuuuuuuguggguucuggagagcccacugcccuccacugugugugguauguccuugaauuaauacugaggcaggguaaugucaugaaauggcuguggcauagcuacacucgcccucucacguauaauaaauccaaucuguaagaaauaauagugcuugauuuuuucaaagacacaaggaauuugaugaccaaaaauuccaaaauguuuaaaacuuaacuauuuuuaaauguaauuuguguauugauuuauauauagaauuugaggauuaccuucuuuuaaaauaauagguuaaauuugugaaccaaugggucuaugaaaugaagcuggagaauggugauuuugacauuuagaaauaagcugugguacauggaacaauuucuuaaagcaguucauuuuuuuuaaaaaugagugggcuuuucuuuuaacuuacuccuguuucccuccuaucuugacuuuugggcugaaaaauauuuuuaauauugucaaaaugguuaccaaauuuuuaaaagcugaagacaguuaaaaaacauauuguguuuauauacauuuauugguuauguaaacaguuauuaacaucauauucauaauaauuucucuuacuaaaaaaaaacuuugaugcuauauugacuuuauuuuuaaaugaaacuuuucuuguuccuauaggaucuaccucagacccuggaaauagaaacagaucugaauuauuuuauaccuuaaaugggucuucuguugacucacaaccacaauccaaaucaaaaaauacaugguacauugaugaagguaaucaguaauuuuaguguucuuuauaaugauccuuucuuucuaacucaucagagaaaaaugguuuuuuauaucaauauuuguaguuuuuggaaacagaauaaguagaccgcucuuuguaauauugcugaacuaaaauauuguacacaguuugaaccguacugcuguuaagauuauuaaaauguuuaagaaauguauuaguaauuuguucuuuuccuuuaacugcugaucuauuuaggguggaagauuucugucugguuccuuccugaccucuuuaaagcacucccuuuuaaaaaauuuuaucuucccuugguccugggacaucauuuucaccuaguuuauucucuucuuuguucauuuguucaacaaauauuuauugagugcuuaugauugccaggcauucuuuuaggcaucaagaugaaaauggugagaaaaaauagacaugguucaugcccuuugugaguuugcaguuguuaaguuguugagauagaaauuagucaaacaaccacagacacaguagaguugccuugguggugugugcagugaaggugcaugaugcugugagaauacaccaaagaugauuuuucucagggucuuagggguguuucuuuggggcagugacacaugcuuagguuuaccagaggagugacagaugacaaagugaaaggggcuagaacuuccucgggagaagaaauagcauagggaaaguccuccuggaagaauggaagcuaguguuugccagggacuagaacacagacagaggcaugacauucaugagaugagaauggaaaggcaaacaggccugacucuguggucucccagccuuuagaguuuugccugccacauuuguuuuuaaggcaccuggagcugauuuucauguaaaguaugaguaggauuccuguuuaauuuuuuuuuaaaaauauggauaaccaauuaucucaacagcauuuaguaagaaguucauucuuuugucauugaucugcaauaccugccugucagcuguauuagucauuuuaagaaaauagcuuuuggcuguggcucucuuuaucauguguuugguuucucuuaaauuacauucuguguuuguguuuauucuggcuuugaacuucuuauuguauguuuguuuucucucuucuguuguuucuguucuuuaguuuauucuucucuacuuuuuugaggguuauucuguucuuuuaacuucccaaguuguaugcugaguucauauuuagcuuuuguuuuuuucugaaauaagcaaugaagucuauaaaauucccuuauaaguauuaauuuagccauguuucacaaggauucuuucuuucuuuguuacuuuuucucucuuuuuucuuuauuguuaaaacguauuauuucuuuuuugauccauuagauauauagaagcguuucuuaagguuuucgguaucuuuuuguacugccuucucaauuaauuguauuuuggacaaagacuaucacguauacgauacccgcugauaauagauuuuuuugguuugaacaguugggugccauugacugaggugcauaaauauggagguggagagaggagcgagaacacuguuggagauaauaacuuugugaugccuaugagaguacuauuaauagcagggaggucaggugggcaguuggacuagaucuguauauaaauuuuuagaaauguaagacagagucaauauccuugaauacauuucuguaauuaggaauaauuuuuuaguugcagaagacccugcaaaaucucuuacagagauaucuacagacuuugaccguucuucaccaccacuccagccuccuccugugaacucacugaccaccgagaacagauuccacucuuuaccauucagucucaccaagaugcccaauaccaauggaaguauuggccacaguccacuuucucugucagcccagucuguaauggaagagcuaaacacugcacccguccaagagaguccacccuuggccaugccuccugggaacucacauggucuagaagugggcucauuggcugaaguuaaggagaacccuccuuucuaugggguaauccguuggaucggucagccaccaggacugaaugaagugcucgcuggacuggaacugguaauuuaacuugacccaaaaauuucaauuuuuuucucugugagguuuugugcagauuucgcccuauuauaugcuuuuugacaaacuguuauauuugucagaaaagcuaucacugcagaauaauuuucucaccauguuuucugacuucccuuugccgccccugaagcuugcgacccacuuguccuaauguuaguugauuuauguucaaggaaugaaaguugauuuuuaggccaaucgauuuaggcuccuuauauuaaacagaauuuaguaaaucaagcaaauuugccaucagcuuuucucuuucuucuucagccccuuccccuggucaguucuaauaauuauaucacuggcuuuaaaguuaaucaccauuuuuagagaucuuuugagaccuuugcuagagggaaagguuuucccuuuagagaucaggagaacauaucauuugauauuuuguaaucaggaaaggagaaguugaguauguuuaggauuuauuuagagauggggucucacucugucacccagacuggagugcaguagcacggucagggcucacugcagccucgaccuccugggcucaagcuauucuccugccucagucaccugaguagcuggaauuacagacauguaccaucaugcuugguaauuuuuuguauuuuuaguagagacaggguuuugccauguugcccaggcuggucucaaacuccuggacucaagugaucugcccgccuuggccuccuaaagugcuaggauuaugggcaugagccaccacaccuggccaauuuaaauauauuucuuuuuuuuuuuuucuuguuuguuuccaugcuagugaauacuaucuuauggggcaugguggggaggcaagaaugaggguuaaaauaaauagccuucuccuucccugccuguuuuaaugcuuguagaaauggugcgggaaagcccguuuaaccaggggagguugaagcauauauucugaaaggaaauacaagaaggacuucaugcuggauuaaggaagucacuucuuaaaucaguagcugugggcugaagcacugauuacucaacuccuuuuucuugaugagguucucaguacaggugcgaagagggaguggugagaaaggguauacuagaaacaggucuuagaaaccuuaguucuuuguauacuaucucuguaaggcacgguauaaugcauauugaagcauuucuuuuucaggaagaugagugugcaggcuguacggauggaaccuucagaggcacucgguauuucaccugugcccugaagaaggcgcuguuugugaaacugaagagcugcaggccugacucuagguuugcaucauugcagccgguuuccaaucagauugagcgcuguaacucuuuagguauuuggaugcuuuuuguuuacuuaacaaccuggaaugacucuaauucuaaucucauaucauguuauauuaggugauggugacaguguuuuaauauauuucuugccaacgcucauuaagcuuuaaaucaguaaaaauguugcaugguguauaagaaaguuguuuuaagaggggacaucuuaaaaaaguauuaggacgugcguuugggacuuauaaagugaauaauagugugguuuguuuuucucuuccuguugaugacagacauuuaguuuucagcaauacuagugguagaaauugaaauguaaccuucuuuuuuuuuuuuacugacuucccucacagugucuuguuuacagcagugaguguaucuuacaaagaaaucagcauuuuaguguaagaaguagauuucaacugauugcuggaggacagcucuccucaucauguguaauugguggcaguuuccuggugcuguuccuuuccacuucuacauaauaguggaaaagcaucuuggggcuucagcaggugcaaacaggaaagccaucuuuaugaaaaacacucuuauuauguugaaauaguacuuuggaauuuucauuuucuuuucaaacuugaaagugaagcaacuucagauaaauagugaaauauuugggaaacauauuuuacuugacagaugcuuuuuacacauaauacucuaaaguguguuuuuaaaucuuggaggaaaugaaguugaaaaugaacaauagcaauuuuuauaagccaagucaaauagcaguuaaccaaagccuacuuuccacuuaaagaaaaaauuuugcaucaaaauacaaaaacauuuuaaaaugaaaaaauauuuaugggaauacauauuguaauaguuuaaaagaauucuuuucauuuacuuuuuuuaaaaaaaucuuuucagcauuuggaggcuacuuaagugaaguaguagaagaaaauacuccaccaaaaauggaaaaagaaggcuuggagauaaugauugggaagaagaaaggcauccagggucauuacaauucuuguuacuuagacucaaccuuauucugguaaguuuaaaaagaaugcaauagguauagauagugccaugaggcagggacacauaccggugugugugugugugugcgugugagugugugugaaagaaacugccaucugccucugaguagagaaacuggaugacugugggucaggauugaaagggagauuugcuuuuuaugacauacuccuuuuaagcuuuugaauguugucucauguuucuguguccagaaaggugaaugauauugguacaauggaauagauauacagaggguaucugggaaaucuuugugcaugucucaaacaacauaacuugcaguaaagccauuggcuguuaugugcuguauuucuuuuaguagguaaaggcagucauaaaacuacugucuuuaaaaaaacgauuuucaguagcagcacugcugcccucauauaugcaauuuuuuccaaaguggaacaacuuaagauuuuuuuuuuuuuuuuuuuuuuuuuugagacagagucucacucugucccccaggcuggaaugcagcggcacaaucugggcucauugcaaccucugccucccagguucaagcgauucucuugacucagccuccugaguagcugggauuacaggugugaaccaccacuucuggcuaacuuucuuuuuuguauuuucaguagagacggggguuucaccacguuggccaggcuggucucgaacgucucaccucaaaugaucuacccgccuuggccucccaaagugcuugggauuacgggcaugagccaccacgcccagccuuaacauugcaaggaucuuuaagcucuggaaauugaaccaagaaucuuuaggcucugaggauuguagacugggcuaaauugagaguagccugccaguucuguagccauaugauaagaauuaggaaguuaauaugggauguuaacauuuuuaaaguaggaagaagaauaaaguggcggccauuuuauuugcagaauacuuugacaaaaacaaaccuuguagcauugauauaauauucuuuagauuuccugauaaaaaucuauauuagcuaaauuuucuuuuucuuugauaacagcaaguuacugcugucacucguuuauuuuuuugagaaggagucucgcugugucgcccaggcuggaaugcagugacgugaucucggcucacuggaaccuccaccucccggguucaagcgauucuccuaucucagccucccaaguagcugggacuucaggugcacuccaucaugccuggcuaauuuuuguauuuuuaguagagacgggguuucaccauauuggucaggcuggucucaaacuccugaccucaggugauucacccgucucggccucccaaaguucugggauugcaggcaugagccaccgcaccuggccuguuagucacucauaagugauuuuagcauuuaaagaaauuuauuaauguaauagaucuuugcaaaggggcauggggagagggaaguggggcacugaauagugcuugccucgggaagucguuuccaaaugcuguccucuguugucuguuuguaauuugacugauauuuguagucucucuaucaacuuuugcaaagaaguuuucuuucuuaauauucuguuggcacguuguuauccuuuaacacugccaaucugccguuugcuuucucaguauuauugguguuguccuuaacauggaaggaucuguagguccugaugauugaaccauggguaucuucacagggguccugguaccuguguuaaugaaaaacacaaauuguuauguuauuuguucuccagacuuuacuuauuuuccucuucuaauucuguuaaaaaucuguuucuugaaaaauauguuuacagcaugaagaaaauuauccuuuuucuuuugcagcuuauuugcuuuuaguucuguucuggacacuguguuacuuagacccaaagaaaagaacgauguagaauauuauagugaaacccaagagcuacugaggacagaaauuguuaauccucugagaauguaaguagaaaacaaauugcuauuuugccuuuacaugguguucuauuugcuguuuucugguauaguaauuaauuuauaccuugucuucauguaauaagagaugggugaaaauuaguucuuaugguaaaauauuacguuuuuaaaccuuugguccuuguacuuuuuugcuuauuuaauuucuuaaauguggccaagguguagaacauagcauauuccaugaaaugauuuaaccuauuuugcuagaguaaacuauaauuuagcaauugcaguauguuuaggaaagcuaauacauaauacuuaggauucuuaucuuuugaaauaguuuauuccaacacuucugcuacaaguaaucaugcuuauuaguuaaauugguguagucuagcuucuuaaaucugaaagaaaaggagaaagggaaauucuuuauagaauagcuaguguuuaauacuuuggacuagcaacagaugagauguauuuuaguaccauauuuuuugguuaaaggaauauauuuggccucuuuccaccugccuuaaaaaggugauucuuuuuccauuuccuacuuuaggaauuauaaauaugucuuuuuauggccacaggaagcaauuuguaaugguacaagcacaagugacaggagauaucuaguaaagacuuugaauaagugguaguagugauaugugauaaugucacauuauaaaauuuaaacuaugaagaauuaggaccauagaucauaaaacaaauuuguucauucaggaauauagagagaaagugauuuauuuaaaguccauauuaagauaaauuugaauccuuuuauauacuguucuuauuuaucaauuaaaguaaaaaauaguuugauaucaaauuugaaccaaaaaagcagaauacucaaauacaaugaggauuccaaauuaucugcuauaucacaugacuaggaaaguaaauuauaagagaauaaauuuccucacuuauaucuuuugcuuucuuuaaauucuguaaugauuucucuaaugaucuuacucuuuaagauaauugugaaucuugauuuucacaucaacuauuuugucuuaugcaaauuuuuaaacauacgauuuuuuucccccaaguaauugauacuggaacaagacaggucaaacccgaaacucuaaggcauguuaacaccuccuuccuagaagagaggaagaauaaacauucuuuggauccuauuguucagccaguuaagaaucauaguuaaucacacuuucuuacccuguccacgguaagaaacuggucagaugcccuguugugaucaggauucccugugucuguagcauucauaucuguauauagcugacugguuuuauuuggugcugaaaucucugcuuuucuucagagacccugucuuuuuaaccuuacucauuuuguauucccaguggcugacagguuacguuacuauguaagugguagauucucagucuguauugguugcaggaaacuaaugagugaaugaauaguauaaaaaguggauauaaaauuagcuaguucugacuuguccuuaguaaacuuaugguagccgccaaguucuccucugaagccauuuuuagaauuacaaauuuaaagugauauuaaacugauugaaugugucuugcauucagacaaagaagagagaaaaugucaucauuaugccaauugguuugauugcagauuuuagauuuucaguuucuuauaaauucccuuucccauuucccuugguggcuguuucacacuucaguauuaaaaggauauucucucucaaaauuguauauucugcuuuauaaaguaaaugcuuuaauuucccaagcaaauauuauuuaaaaaaucagucacagcaaaccuaaaaauuuuuuaucuuaguguaugacaguuacuuguagagcauauaauagugucuaggauaauucugguucuagaucuuuaauuuugcaaacuucaagaagaagcuuaucauuguuuucuucaaaaauaauugucuaaccuauugauuuaugacauacuggaguuguauaagaaauguguuggccaggugugguggcgcacaccuguaaucccagcacuuugggaggccgaggugggcggaucacuugaggccaggaguucaagagcagccuggccaacauggugaaacccuguuucuacuaaaaauacaaaaauuagcuggaugugguggugcacgccuguaauuccagcuacuuugguggcugaggcaugagaaucucuugagccuggaaggcggagguugcagugagcugagaucgggccacugcacacuccagccugagugauagagugagacucuaucucaaaaaaaaaaaagaaaaaaagaaauaugugauuaagauguguuauauaauuuaauacaugccaauaucaauuaauaguuuuuuacuaacuuagauauggauaugugugugccacaaaaauuaugaaacugaggaaaauacuugaaaagguggaggcugcaucaggauuuaccucugaagaaaaaggugaccaucuuaacuuauaugcguuaaaaauaacugaagagcauauucacaugucaaaguauuagcugaaaugugugucuguguaguugggggguuuucuuuuaaauuagaaauuucuuuuuaugugauauaugguuagcuccucuuuuuguaaauucuuccucucuucuaaaagugauugaugauguggaauaaugaacuccuuuaagaagcuggcugguucuaguauauuaaaugcuuaaauaaaaaguccuuuccuuuccaccuagcaaugauauucucaguuguuucucucuuguggugcagaguugcauuggguuuucuacauuuucccacugagucuucccuguuguaaaagggaguuagaaagcugcuaacuaggauuaaguuuauagucagggaacaguguuauaaucucuuccuagcuaaugggcuuacucaaagauucaccaccugacuuugaauuugucagcagcauacuguaaacagcuguaauguucagaggcuugcaggaaaaaacagagcauacuucagauuguacuccauuuaccuuaaccccuccaaaggaaauaacagcuauuucauuaugugcaauguguuacacccuuucaaauguaauaaacucacaacaaaauugaaacauaauacuugauuauaacuuauuaaaugucuuuuauguuuuuccuuugucaggaaaacuugaaaacugugcuuuuaauugaaauaauauuggaugaaugaaacugaauucaguauuaaaauuugacuguuagaaaugaaaaauaaaaugauuuaaaaauuuugccugugacuuauuugauuuuuaaauuuucuccuagauccugaggaauucuugaauauucuguuucaucauauuuuaaggguagaaccuuugcuaaaaauaagguaaccuuuaaauuguucuagaagcauuggaaaaauagacaauucucauuucuacugccauuauucaacagacaugauuuccagaaugauuucuuaauauuguauuuguuuagggcucuuaauaggcuaggggaauaucaugcaaguuaauuuuauuuguuguccuugccacaguaccauaguuuacuugaagaucaaauccaauguaaauuuauacuacaauuuuuaacccuagcgauaaguauuauugcaaaucauuuucuuuugaaacuguauauauauuuucauaauuucaauuaaugaaccuuuuaagaaaaaauaucucauucuaacuuaaucagacacuucaagaagacuguuuucugucuacucaucacucaaaaaauuuagucuuaaauuagcuuuccuguuuuuaguuguauaacuuugucuccccuccccacccaccauguugaaugaaagccuuguuuaauguaguaaaguucuuaaugaaauguucuaaaugacugaacguuccagguaguuugaauguucucagucuaaacaauggaccuuuuuacauuuuagcuuggguuucucuguugagaaucuuaguaauauccuauacacuucccuaaaagcuaagcauagacgagcacucuuccucaucucugugucuuaaagugauauuguuugaugccacuguugaacugaugggugaggagaauagagggaggcuggguggugccauggcugugguuugauauuguuugggaaguucuuaugaaugaaaugagacugauacauaaccaucaagaguucauauuaucuguucaaagaugauaauagccauauguacaccuaaaaauccuagagaauggccuaaaaauuacuacaauuagcaaaauaauucauaauuugucuauguaaaauauccauggaaaaaucaauagcauuucuguauaccuucaagcaaauaugaaaaaguaauuuaauacuucaugaaaguauaaaauaccaagaaaucaauuuuauugagauagauuuuuuuuaaaagacuuauacagagcuaaaaggguuuugauuaauuagugagaaagauuacguucuggguaggacaauuaaauaauuuaaagaugauuacauaauaauuugcacacaagcaagaucuuaacauacuucaggaaaguggauuuagaguucucuacaaaaugaagugggaaaaaaucuugaagaaugcuuuuaaaauagauuucuauuauaagcuacgaaggcaaagcaauagacuuuaaaauagugugugauacuagcauaugauuagaaauauggaucaauggggccaaauagaaagcucagaaauagaauuaacuguauguagaauuucaguaucuuauaagucaacuuucaaacagaaaugggaaaggaaagauauguuuaauacaugauguaggaaaccuagaaggcacuuugggagaaaaaagucaauuugguuuuucauuuuaaagagauaaauuucagaugcuuaaaacaguuguuuucaucguuuuuacccuuuuucuagccuacacacuuauggaauguaauacacgcccaguaauaacauagguugaauacugagugauccucagaguggguagggagggaucagggcaucucugaauauaucucagagucugaaugccuugugggacuugaaagggcccugggaaguucuuacacccccugaaggguacacuguccccuucaccccugcaaacaaccucuucauauugagaaucacuuuuuaaagauuauaaauauucuaaguuggcucuuuuucaagaguaauucuuccccuccacuagcauuucauuuugacagacagagucagcagaugcaacaaauaggaggauaaguaccuuaaaaaaaaucuaaaauaauuaaauagucuaaaagagacuauaagauguucuuaaaugauugaagagacaaaagaacuagaugacaaugaaagguaaaacagauuugauaaacagaaucaaauaaccaaagacagaaucuccagaaauagaaaccauaucaugauguuaccucauugaugcagugugcacagcugaagagagaauugcucauuuggaagacagagcugaggaaaguacccagaauguugcacaaagggauaaagaguuagaaaacaagaaagagaggauaauagacauggaauauggauucuaacuggaguuccagaaggagauacuagagagaauagggaaaaggcaauguuucaacagauaauagcugaauaaauuuuagaauuuuugauagacugaaauucuaagaauaaaaauauucagaauuucugagcaggaagaaccaggacuaaauuaccauucagagacuuacuauaggauguacuucaguaaaacaaaacugaguuuagaauaaaggagugggaugcaagaaacaagggaaagucaagaaauuaguaaauugucuucuccauccucauuucugccuucuuucccucaguguuugcaaugcagugguccguucaaccaccagcccuccuccccugcugccauuauuaugauuacaacuacuuaccucuacuacuuccugguuucuuauuuuccucucuuauuuuuuuuuuccuguaaacuguuaauuuucuaugcuuuuuggcuuucacagaaaaauucuggucuuuugucauagucaucaacaacugauuaaaacauugguauaucauagccuucagguuuuuugauuaucaucuguuuguauuuguugugggucuccagaaucuccuguuuuguuaucaauuaaauuuuguuuauuuggggauauaaguugcuuugggaagcugagaauuuuugcaggcugaucucugaauagcugaguuuuuuuuuuuuaagugaaaacuauguuaauauuuucuccuaaaaaucuuaaaaucuagauauaaguuuagauguaaauagucuaacuuuauauccagaaauucugcugaaaagguaaauaguaaacuuaaggauuauuaguccuucugguagaguuaaagacuaauggcaugcuauaguaaaauauuuaggaggaaagaugcucaaaauauaagaguaacacugugauuggcauaugguaggugcuuacuugguauuuguugaauaaaugagugacuaucagacagcaugcuuuagcagaaagaaugguaagcagugguuagggccccuagauucuuuacccagcucugcuuuugacuugcugagaagucauucuccuucccuagaucucagcgccuucauuuuagaaaugaaaaguucgaucuagaaggucugcuaagggucugucacauccagcauauaauaauuuauuuucaggcauuaaauacaguuugcugcuuucuagauuugggcagugaaguugcacuaagugauuuaccuuuugguuaguucuguucacacagugcuucuugauugagauuauuauuccauuauuuuuuuccuaaucacuaggagaacuuuccagucuaaaaacuaagcaaaauaaaucauuuauaaggucuugugccugagcacauuuaauuauuuuauccaaaucauuuauuucucucuguuguucugacuauccaaagcuacaccaucaauuuuaugguuuuucuguucucaaauacugcugggacaacuuaacauuuugauuuaagcauuugauaaauagguuguauguauuuuuuucucugcguguuuuuagaucagcaggucaaaagguacaagauuguuacuucuaucaaauuuuuauggaaaaaaaugagaaaguuggcguucccacaauucagcaguuguuagaauggucuuuuaucaacaguaaccugaaauuugcagagguuagugauacucaccugugguauuuuaugugaaagucugugggagucuuaagacuauugguaguuucaguaucuauugauuuuaacuagcugagaaaaguuugaaacacaaacuguuaagaaacacaaauuuuaaaaaguaugcaguguuucaacuuugccuuuacagaaaaugucuuagaauuaagauugaauuuuuuggauuucugcugccaaagaaaacaccaagcuaaucugcguaacuugaaaacuuuuagguaguuuaaagcaaaaggagacuuacguuuuuuaaaaugccauuuuaugcaagcauauuauccaaauacaucaaaauauaauguuuacuuccccccuucauuaagagacaaaaugucaauaaauucauuuauauuugcuaaugaaccagugauagaaauuauuuuucuuuuauuguccaagaaucucaguaauuuuaauaguauaugcuugugguuuauuuugauuguauucauuucugaagucauuuuugguaaaaccuuaacagccacaguuauuuauuuguugaaauauaaugaguaguauccuucugugaugacauuuucuguauuauauuugcaaaaacaaucuguccaaaaccuuuaauaaauauaaacccaaauaaaaugccaugauuuuauuugagacucaagauuauugaacucugugaccucuaggugcuggugugccccugcgaucaugagccacuugaagacuuguggcuuauugguguccucuguccacagcccauggucacguguggauccuguuucauaggacaccaauauuaaggcagaacuguuuuguuugacagccaugacuauuuugguuucauagggaaaaguguuuuuuuuaacacuuugauucuaaaaauaucugucuuuuuuauaggcaccaucaugucugauuauucagaugccucgauuuggaaaagacuuuaaacuauuuaaaaaaauuuuuccuucucuggaauuaaauauaacagauuuacuugaagacaguaaguaugagauuuuuuuaguuuguuuuguugguuuuguggaaauugucagauaauucucaucaguuguggguuagacucuaacuggacacaguauuucccaaggcaauucaguaucugaagagccuggaaauaugaaaccagucauuuuauuucuaggaauuuauucugagaaaacacaaaugaaaauaaauauuugauaugcaaauauacuuauuauuauaugauuaagaaauuagaaacaacuugaauguuaaccagaggagaaugguuaaaugaguguguaucuaacaauuaaacuacugccauuaaaauucaugguuuugaagaccaauguguaugaaauggucaugauguaauauuaaguggaaagguaaguacguugauauauucuacaaaaggagccauauacacacacacacacacacacacacacacacacaugcauauauaccuauguaaauauucaguaugaaauuauuagagaaaauucauaaucauauugacagugguuaucuucugccaacuaaaauuguagaugcuuuuaguuuucuccauuauacuuucuuguaucuuugaauuuucaucaauggguauuuuauaaugaagggaaaaauacucuaggagacacuauuuagaaaaacuauuugguccaaaaaaauguuuuuaaagauauuucaaauacuaacugagagcuuaagcagauggaagagaaagagacuuuuuugaagccaugaacauuguccuuuuuaaagccuaacuuuucuuuacaucuucuucaugaaagaaugcauuuuuuuuaaaguccucuuaacuucccuuccccuucucacauuucagcucccagacagugccggauauguggagggcuugcaauguaugaguguagagaaugcuacgacgauccggacaucucagcuggaaaaaucaagcaguuuuguaaaaccugcaacacucaagugagcuucccuucacuuaauggauaaacuuuuguugaacaguaacuuauuuauaguugaaaacacaaugcucguuuuggaaaguuuuuuaaaaucauaauuaacgguuaaaaauucacaauaaaaugguauugcuuuugccuuuucuguuuacuugagagcuguuggugaaguacuugauugcuauaagggauguauuuaguaagaguaaggaagcccauucacuugacacauugaguuucucucauuaaugacauuuuuuuuuuuuuuuuuuugagacugagagacugagagagacuaaugcccaggcuggagugcaguggcacgaucucggcccacugcaaccuccgccuccgggauuuaaaugauucuccugccucagccucccgaguagcugggacugcaggcgccugccaccacgcccagcuaauuuuuguauuuuuaacagagacaggguuucaccaucuugaucaggcuggucuugaacuccugaccucgugauccaccagccucggccuaaugacauucuuuucaugguccauuuuagguccaccuucauccgaagaggcugaaucauaaauauaacccagugucacuucccaaagacuuacccgacugggacuggagacacggcugcaucccuugccagaauauggaguuauuugcuguucucugcauagaaacaagccacuauguugcuuuugugaaguaugggaaggacgauucugccuggcucuucuuugacagcauggccgaucgggaugguacugaaaacgccuuucuucugcauguggcacaggguucugguuuguagugggacaguuuguagugggaucgccuguucugagugauauuuucugagaaaauccuuucaggauuauucuggugacaacagucuuauaucuuggauugcauuaacaaccuugcuagcugaacuaaggaauaauaugcuguguuuuuuuuuuuccuuuuuugagauggagucucacucugucacccaggcuggagugcagcagcgugaucuuggcucauugcaaccuccaccucucagguucaagcaauccucccaccucagccuccugaguagcugggacuacacgcauaugccaccaugccuggcuaauuuuuguauuuuuaguagagaugggcuucugccauguugcccaagcuggucucaaauuccuggccucaagugauuaacccuccuuuuccucucgaugugcugggauuacaagaggagccagugcacccagccucauauugugauauuuugacaugcauaugcucuuuuuuuaaaaaaaagaauccuaaaauucuuauuucagcccugagggaucuuauuuccagcuucgcugucuucuuucaggccccucucauuuuuguaggagccacgguagcuguuuauugagcaccauuaagucauucuaccuaaauccuggcaagauggggauuauuccuguuuuucuguuauuaaagcugagguuuaaggggcuugagguauuguaguuuguguuuaacucagucuuucugaucucagugcauauguuuuuuuguacuaaaccauguuaucuuccaauugccaaaagcugagagcagaaguaaacauccuuuucagaaaaguaaagccucuucugcauguaguaucuuucucccugaaguggggaauaggcugcaguugccaggccacuuucuaggaugcuuaaucauuauuuaacuaaugcuuaaugaaugccaggcaggauaguggguuguagguaagaaauguuuguuaaagcagcccugccucuaccuauaaggaguuugcagguuaagaccaggccugggcaagguugugaggugugacucucauguuccuccauucuuauacccuauuuuuccuuuagcugcucucucagauccagcccccacggccuucugguguggcccuccaguagccuaagacauucccuguggcagccucuugaacagaggcccaggcccuagaucaagaguucuccaccuuuucucaguucucugaugcuugagggauacaucccagccccaucuguagaugugcccccaacccaguuaacauuugcacuaaacagcguaacacaacagcauagguuuggaaaagccacugagguaacccagaggagccuuuccuggaaucucugaaaucacaccccagagcaccuucaucagggccuggugaugugucaaacaaacuguauuagaguugcguaaggauguguuuaaaguguagggagcuauaauagcguucauuugacuagaucuauuccaaauuggacagucuuauggugaagugugcuggguggcuugugucugggaggaaaugaaaugugaggaacagagugucgucuacauauguauugauaauaugauucagagagaagucuggaaaguagguugggggcuuaccucagaauucguguccuuuuaccagguuuauucacuguuggccccagaauccuuucagaaaccaagaaaugagaauaugucaaggguuaaaggaggcuuucacuuccagaaaucagaaguaaaauaaaggcuuuuagagccugaaauuagcuuuuuggaaaugauaggauuauaaaaucacuggcaaaaggguuuagaacuugacugcccuauaaagaguucuuccucugugccauagguggucagaauggcuucaacauuccucaagucaccccaugcccagaaguaggagaguacuugaagaugucucuggaagaccugcauuccuuggacuccaggagaauccaaggcugugcacgaagacugcuuugugaugcauauaugugcauguaccagaguccaacaaugaguuuguacaaauaacuggggucaucgggaaaggcaaagaaacugaaggcagaguccuaacguugcaucuuauucgagcuggcaguucuguucacguccauugccggcaauggaugucuuuguggugaugauccuucagaaaaggaugccucuguuuaaaaacaaauugcuuuugugucccugaaguauuuaauaagaagcauuuugcacucuagaaaguauguuuguguugguuuuuuaagaagucuaaaugaaguuauuaauaccugaagcuuuaaguuaagugcauugaucauaugauauuuuuggaagcauacaauuuuaauuguggaaguuuaaagccucuuuuaguccauugagaauguaaauaaaugugucuucuuuauggaccaaggauaugaaaucauuuuucuuuuguagcuaacgguugccuugaggaagaaauaauuugguuuuauuaagagucuacucucaauccaguuauuagagauguacugaguuugauuuguuaauccuuucuauauacugcugaucuugcaugucuacaaucugcucaguuuuucuguguuucugcaauaguggucagaaaaauacuuaaauucccuuaaugguguuguuuucuauuuguucugguuuugagauaaaugagugauucuguccccaaauguccauuuuugaagugauuuuccuggaggauuaggguauuuagcaguugaagcucuucauucauaguaguuacugucagcuaacagguuuuuuaaggcuuuuaacuauuaauauuuuauggaauggggcaaaguaaauugaugaaagaauuggagugauaauaguccuuuacaaacauacaguccauaagaaaaugaauuuggcauauagaauuauuacaauuuccugggagagauggauauuuaaaccucuauuauuuuagacaagacugucuagaacuuaaguuugaucugucagccaguacucccauuaaauucaguguaguuucacuugauagaaucagauauguuaucgaaauguuagcagcagcuucauccuccuucugauuaaaguaaguagaaaugggauguuuuguuuaauaacagccauaguguguguuuagaccacagcggauguuguagaccaggaccauagaugauacaugucagugcuguggaaugugcauucucugaguguuguuuugugguaucauugucuuuccugaaugacuuucuaacugugcagaaaggcagaaaagucaucauauguauaugucauaugacuuuauaaaauauuuaaugugacaaaaaguggaaagaaucuuuacaaacccugcaauuacuuuuuuaaaggcacuuuuacucuuugguuuuaucauuccauuuugcuaauauuuacuagcuuuauaaauuacaguaagguacaaaaacucaucuuguaauauuuucauuuuugaagugaaaaaguacauauauuuugcacaagguuuuauacugcuaagugcuugguugggguggugagaugaugauuagaucaggggugaggcugagagacucuggguuuagggcuagcccugccuccaucucccuuggguaaaaugaagggugugggguaaaagaugcauaaggccuuuucuagcucugacagccuagaaguccaaucacccuguaauaaauauguguugaaugaagaaaugggugaaugagcuugucaaugugauuuuaaaaaauugacuaccuggaggaaugauuaggaaucuaaaugaagccagcccucgguaucugcagguuucucauccauggauucaaccaacugcaaauggaaaauacgauuuuuuuuaaaaaaaggaugguuacauccguauugaacauguacagacuuuuuucuugucauuauucucugaacaauacaagaacucuuuauguagcauuuacauuuauuagguauuauaaguaaucuagagauuauuuaauuaaaauauacaggaggaugugugucaguuauaugcaaauucuguaccauuuuguaucagggaauugagcaucuucagauguugguaucugcagggauccuggaaccaaaccccugcagauacuaagggcugacgaucuagguaagacuggauuuaacaguuggaaaaaaaaaaaaaaaaggagagagaagacaguuccuuuccuguagaaauuaaaacaaaauacaaauugaggaagcucugcuacccaggcugucaugguagagaacuugaagaagaccuguuuggauggacaccugguuucaaaagucagguguggagacuguuaaaugggagggccucauccauaaaugauuucuggcaacgucuucuucagguggagcuugacgucuuuuuaauguuacuuggggagggagugcucauuaagggaugccagggccagcucuggugguuccuggggaggcugcguccuucccugcuucugcaugucaugaggcagcaggaagguuuccccugcaccugucuguccuggcucccucuggguagcccccuacuguucugugcuucagcacagccugguuugucaagaggcacauaguuggggcugggcugcauggcacaggggcuuaugugccugcugguuauuuaauuuucagccuuaaguuuucuuuaauauuuuccuguuggcuauuuaaagguuuugguuaucuuuuauuccuuaucuacaaucaagaugacaauguaauugaauuaucuuauuuauaacacgguucgugauucaugauucaugauuacaaguagaaaauaugucauguuccucaccuccaaauaaauaugugugugucuguguguguguauauauguauguggcggagagggagagaguggggaaggagagcaguguuaucauacauagagaggcuaaaugugucccaucccucacugucagcuuuauaaaggaguuugacuccauccacagaagaauguuuuauaagacuaggaaaacacguugaaaacuaggauaaacagcaacaaaaaucaacuaaauauguuguuacuguugcuaaggauuuucuccuuagaauaauuuaggauuuuuaaaaauuucuguuugccaaaugcuguagauaaauggccagauucuuccuaucccuaggauuccuuuauuauuuuuuuucacagauuuugagaacaagggggagagauaguauggaagauuaagauuccauuaaucuuauagaacuguguugucacccaaauuccugcuuguuugaacauggcaucuucauagauucaggauucacuacccucuauagcuggaucuugaaaauuaucuggccagauaauuuugcaucugcuuggaugauuguagacugagaugugaguggaggauaaaguauuagacuuuugcugaguaacugccaaccaagaaguauuuaucggacacuuacuaggugccuaggauuguaucagagggaauaugaaaugugucccugcccuaccuaguuuuaacgacagaauaucuauuaaaggcuacuuagcugaaggguaagggugacaggucuaggggaagcuuugggagguggugugcugugacagaaaaaguggcagaguagggacgagagaccugcauucuagcccuguuucugucacuugcucuguacacuuagacaacagcuugaccucuugagcuuuaguuuccuccucugcauaaugagaggguuagacuacugaauuguaugggaaaaaaauacaaauuccuggguccuaggccaugccugcugaauccgacuguucaggaagaggccuaggaaaucugugagggaauccccaggggaaucucgugaccagccaggugugaaaucugcuaacuggaagaucucaaagcuuccuucacuuuuugugauuuuguggucauguaacguuacuguauuauucuacguaaauguggguacuuggauguuuaucauacuguuucucuguguuuacauacuaauuuguguaagaaaugcauuuuagucuguguaccucaaccugcuguuuguuuccuagagguguuaguagucuuuaaauacaaguaagacuuaagaggauauuugauguuauuuaccuggauauuuucuuccccuuuuauuuauuuagaggaaauugagauucuaggagccaaaaaaaugaaaacaaaauucuaaggcaaaguuaaagaaaaaaauuacauuauuucuuaccauuugcuacuuuauaaugaaaauuuaaaaauuauaugggaagauuuuucucugggauaacaaauccuugucauaaaguaagaggucuuuuuaaaguagguaggcuauaaggccuguaauuuaaaauaauacuccuuucucuaggguuuggugcaauucuccauuaaugaagauaacauuugaauuccccaaagcaggugaggagucggggaggagaaagcgauguuaaaaugaaaacucacugcaaaagaggaggcagaggaagaaggaauguaaaccccuuaaagcagauguguguggggccuuaugaagaccaggauucugcgggugucaggggauugccccucuugacagagacuaggguuuuagacugaggcuuccugcaggguguucgcauugcccuucuccguuccccuucagaccuuucuggggagaagaggugggaggaggggagaaagacuguucaucuuauucugaauccuggagcagcugaagguuuucucuugagucaggaugcagugguaaugcauuaaccagcaaguguggccaaggauaaugaaaaagugggaaaggaagguccuccuccucccugauuguagcauccagcagucucuguagccagguuacucaagaaccacauuugauuuccuggcccuuugccuuggcagugauggcauuuuuauuucacuguguuuuaaagucuucauuuauuuuuauaacauggguuagggagaagggccacaaauggagggauuguccuuucaagcaccacagcuucagauaaaauuaguacuuucaaauauuguccacuuuaacuuaaaaaauucuagagggauuauauuggagacucaacugcccuugguuuuaguuuauaaaauggccuaguacuguggaauuuuaauuuuagaaagucuuagcaucagaucauaaacauucauuaaaagaacucacaucccaucugaaacuucccaggggaguugggauucuuaguagauugguagaaaggggcucauuuucuacugcauuucccauuuuugguaucuuguucagcauguuuuauuuuuauuucuugucugcagaacauccuauauuuaugagaacauucuuuaagaagaccaccacauagaauaccccuuccuaucagcucgcucugauuuagccuuaauuuuguuaaauuuuuuagagaugaaugaagugcugcuguggaaagaaauguacauauacuauuucuguaucauuaaaauuacauuuuuaugguuc

SEQ ID NO: 21256 - RNA, 27083 nt, Homo sapiens
cccagccggcuacaucuggcggcugcccucccuuguuuccgcugcauccagacuuccucaggcgguggcuggaggcugcgcaucuggggcuuuaaacauacaaagggauugccaggaccugcggcggcggcggcggcggcgggggcuggggcgcgggggccggaccaugagccgcugagccgggcaaaccccaggccaccgagccagcggacccucggagcgcagcccugcgccgcggagcaggcuccaaccaggcggcgaggcggccacacgcaccgagccagcgacccccgggcgacgcgcggggccagggagcgcuacgauggaggcgcuaauggcccggggcgcgcucacggguccccugagggcgcucugucuccugggcugccugcugagccacgccgccgccgcgccgucgcccaucaucaaguuccccggcgaugucgcccccaaaacggacaaagaguuggcaguggugaguugcugcgcuggccucaaggaaccacguuuagacaaacuucggaggcaaaggaugggggugucucucccccugcccucggcggugggcacacagcgugggggaggggcuucgguaaacagcuuggggggucuuuggcaagcuauuggagugaucucuugcaaacggugggggaucuuuuguaagcaaagaaaaccuuugauaaacaauuuggcaaccuucagcauacagcaguggggcgaaaaacaagccagagagugggagaggggugaccuggcaaacuacuggaaagggacucuuauguaaauagcggggacauccucuaguaucugggacauuuggcggggggggggggcggucuuuguaaacaacuuuuggacacaucugggcaguugcuaagggcucuugccaagcgucuagguaagccuuuggcaaacagcuacaggggucguuuuugcuaauguaggacuuugggaacggugcucuggcacacaauuuggguaaacuuaugcgcgcauaaggaugggagggagcuuggucaaagcggggcuuggcaaauuucuaggaaccuucggcacagauccggagagggaccuuuaaacaaacagcucgagggggccauuugggaagugauuggggcaggagggaagcagagagcgcaucuuuuuucuccuggcuuaauggacaaauuggucaagggcugggccucggaaaguuuccucgaacuucuccaaagggucggagaaaagaaggagagagcuggcccggcaggagggaggaggaguggggcaggcgcuggagggcccggcgcguggggcgggggcggacugcgcuccgcucgggucggagagcggccagagagcccuccuuccuggcugggcucccaaaccgcgguucagauguugucuugugagcgugcgcgcgccuggcuggaggggcacugagccuggccgcaguguugcguaaguagggccugaggagagaggcaggccagggacccaucaagauguccuuuccaguccaggggauaucugcucccuuguugcuucagccacccugcccuccagccucccccucaaccuguccgggagaagacgcccaugcccucuggucacccuaggaacuccuucaggaggugacaacuacccucucccaacucucacccuuccaaacagcuaggucucagcccccucuggauagauggguugggaaaccuccauacauuuuuagagggcuacuuuuuucaaggaucuggagcuggcuggcauaaugauguggcuguugggugggggugagaguggagcuuugggacaaugacaaagcuacuugguuuccuacaccuuuuccagccaaugggucacaggaugaaccccuaaauugggguucagccugggggccacauggguucuuggcuugcacaggaaggaauucaagagcgagccaacagaguaaagugaaaacaaauuuauuaagaagguaaaggaauaaaagggugauuauuccauagacagagcagggaaugggcugcuggacugaguauacauaugguuauuucuugauuauaugcuaaacaagggguggauuauuuaagaguuuuccagaaaaaggguggggaguuccuggaaccgaggguuucucucccuuuuagaccauauaggguaacuucucaauguugcuauggcauuuauaaacugucacagcgcuggugggagugucuaauguauuuaacaugcuaauacauuauaauuagcauauaaugagcagugaggacgacuagaggucacuuucauugcagucuugguuugggugggcuuucuccagcuucuuuacugcauccuguuuuaucauaggggucuuugugacccgaacuguauauggugaaaucaguccuaccaaccuccugucucauucugugacuaagaaugcaugccugcccuccugggaaugaagcacagcaggucucagccucaucuuacccagccccccacucaagauggaggugccugguuugaacaccucugacaaauggaagucuguguuguccagaggcaaugcagugggggcuuaagaagauaacucuggacuuagaccgcuuggcuucaaaucaaagagugcaugaaccaaccagcuggccuagugaugauguuaggcaagugacuucucaguuucuucaucugcaaacugggaaauuuccuaucucaggguuaaaagagagguaaucuuaggugcuuaccuagcacaugguaaguacucaauaagcacuagccauuauucuauuauauuauuauuauuguuauguccuccauuuccccuuuccuaacuacuuccaacaaggcuaggaccguugucagaagaucuccuggcuccuuucaacauucuaacacaguacuuaucacauacuucauuuuguuuuauuugggaucuaucagccucccugcuaggauuugaaccuuagagacagaauugucuaucuuuuucaccuguuuuuccucagcaguagcacugggcuugguacaugguagguauuaaaaaguauuuguugaauaaauaaaugagucgguugcucccugaaccucugcagggaccugcucaguuugggccucaguuugggcagggccaguuguaugacucaugaaggacaggacuacuuucuuuuugcaaauggcugauucaggauuuaaacccaggucugucuacugccagagcccaugcacauaguccuugaaucucuuuagaagaaaacaggaggaaaaaaguccccaagucaccagccgcaagguagauaaaugaguugauagagguaaaggaaggaugcuggaguauaaugauuccauaucacagccucuggagccagauugcuuugucccaaauccagaucuaccauuugugaacugugugaucguaagcaaguuucuuaaccucucugugcuucaguuuccuccucuguauaauaggguuaguauaucuacauuacagaguuuugagcauuaaaugaguuaacauauucugacuuuagugccuggacauauagucagcacccagcaccaacaagugguagccaugcucucuauagcuguauguccugucgcucaacuaaugggugaccgugcugguuugggaacccaguacuccacccagugcucugggaccccuggcuuauuuccugucuggacuauggcacuggguuggggggcugauugcuacagccugcuuuggucaguacugugccauccuaauguggcuaauugccuugggggugugcauuucuuucagcaauaccugaacaccuucuauggcugccccaaggagagcugcaaccuguuugugcugaaggacacacuaaagaagaugcagaaguucuuuggacugccccagacaggugaucuugaccagaauaccaucgagaccaugcggaagccacgcugcggcaacccagauguggccaacuacaacuucuucccucgcaagcccaagugggacaagaaccagaucacauacaggugccggggcagggcuuggggaggcagggccauggggcugagggacacgagucuccuugacccaugcauucucuccacucaggggauccaugaggugucuuuugugaaggcuugacaucuuagggaguuucaauacacaguucuuagaaaaugaagucagacagacuugaguuucauacuugcuggccaugagacauuggguuacuuuucagugcugugaauguuggcuuuccaaucuacaaaauggggcuuaaaaaaugcccuuauaugguauguuggggaacuaagcuaggcugaacuaauacaaacggcuucuaugauuuuugacacagagcaagaguguaguaaugcuagucauuguuauuguuuuuagaugaggucauugggaugggcagaaggaacgugaugauugguagcuaauuggguuuagcagcccaauuggguuauaacugguugcuaauugggccaagagcugugcucuguauggguggugcuggguuccaauggugggaucuuugcccugugccccauaaugcacuacuuauggcccucccccaccagccagaagugacagauggaacuccugagcuggggccuaaaaauguuggcuggccugggacucccugggucuucaaggcauucugggaggguuguccuuggcagugagcccugcccagccuacacacacauacacgcaggcacaugcucacauauacauacacauaccugugcacccuucccgugcuugugcauauacuuguauguucacauacacacacacacucaaacuuuuucauacaucugugcacacacacauacuugcauauacauacacuuaugcacaugcauacacacucacaugcaguucuaccaccuccaggaucauuggcuacacaccugaucuggacccagagacaguggaugaugccuuugcucgugccuuccaagucuggagcgaugugaccccacugcgguuuucucgaauccaugauggagaggcagacaucaugaucaacuuuggccgcugggguaggcagaagauggggcagaagaggggccagcagggaucaguguugagacgagggggugagauggacauuagaggggcguggggauccuaagggcggcuuagauaggacaguagauggugugggcccugggggugguuuagaugggggcagcacaacacggaguggacacuggagagccacguugacaugggggcagaugguguguugugguauaaccuggaggccgucuaaacccgaagcaaguggucuacugugcuguccaauauggcagccauuaggcagaauauacauggcuguuuaaauuuaaauuaguuaaaaauuuuaaauuaguuuccuggucacacugggcacauuuuaagugcucaaaagacacaggaggcuagugacuauugauuuuggacagcacagacaaagaauauuccucuuaaucacagaaagcucuguuggaugaugcugguagacacugaggaacuguagauauaugagagugguuuggaaacaguggagcaguguagacacuagaggaagggucguagaaccuggggccagguggccaugugaguuuauggugugaacacugccaguagcacagacauaaagguaugugguauagacacugagugguaagugaugaagguaaagagcaggggaaacaauguagacaagugggugggugguacaggccuuggugacaaggugggcaugaggauucauguugcagauauuggugauagugugacaugaaggcaggauugugguuaagagggcaguauugacaggauggaggauggcauagacacuggggaugaugaagauggggugaggacacuagugugguaauguggguaugugguacauauagugucauggugguagaguagacaauggagguagaggguauggauacugggagucauguaaaccugggagagcaguguagaccauaggaugguaacaaccaggucagcagaucucuacugagcuccuguugacaguccuggauaaccccacugggacaagggaaggggacagaugcugggugggcugacaggcuccacauguagaugggguguggagggguuucagggucuagguggcacagcuagacgcuaagacccaguguguguuucagagcauggcgauggauaccccuuugacgguaaggacggacuccuggcucaugccuucgccccaggcacugguguugggggagacucccauuuugaugacgaugagcuauggaccuugggagaaggccaaggugagaaaggggcccucugcaugccccagaccuucucuccuguccucucuccacuccauuugcuuggaccagagaggugggaggggaggaaagucacacaucugggugagucagaaucuuggucuccaaagaaggccuggagaaguccaaccucccccuuccaugucacucuuuagugguccgugugaaguaugggaacgccgauggggaguacugcaaguuccccuucuuguucaauggcaaggaguacaacagcugcacugauaccggccgcagcgauggcuuccucuggugcuccaccaccuacaacuuugagaaggauggcaaguacggcuucuguccccaugaaggugagcauccacucuaguccccaagacuuuccaccccaagccuccagcuucccgggcuccccagugugcucuucccuccacacucuccaggacuggcugccacugccaguuaaugagcaucccuccaacguccuucacucaguucccccccauccugaucugagccauugcuguuucucucccaccaguaccaugaugaacguaguacucuaauuaaaucaaguugauuuuuuuuaaguuucaccauuagcaaucauuuaggaagucacagauuugauuugcuaauuauuuauuucuaauauauauuggagugaacuuagaacuauuacaaugcccagugguucucucuagaaccagucuuuacacuucagucaagauugauacuucaagggcaugaggaaaggcuugcugguagcuggaaaccuagcagugugauagggaggcaggacucagaccagggcuggacucaaccugguuugcguacuccaacugaggaauuucagcuauugcuccugccuugguccugaugcugccucugcuaaugcgugugugugugugugugugugugccugugugugugugugugugugugugugugugugugugugugugucugggcacgggggcuauacuaucugccucucuugggcacugucuuuuucugccuccugucuagcuugugucugcaucucugugucuugauaaagacuuuaggcuugacucaguauuuguguuugugugcuugucagugccugagaugcaacauuucagagauuuugaagccacaugggggaaaucuuuuaaaaugggguacagauauugacauacacacucaauccuuuuuaaaaauauccuugacacacuuaauagucauaaaucacaaaaagacaauguaacuucauacucuaugaagucaucauauuugauaauucugcagauugaaagcccagaaaaccuggcgaaaauggaaaaaagucuaaaaauuuuuaacacuaucuucuuucccaugucacaaagacucuauagucuacauagacuaaagacugucuuuuugucuguaauuuuaugucugugaaucucccuaaccccacuguaacugaaaacuaagcaccaaccaucuugacagaaugaaagaaacaaagagcuaguuaauucccuuccuguuuaugcuuuuacuaccagagcuaaacuuuauauuaaguaagaguuuaagccauucaccauuaauaagucagacauuuugaaauaaaaauauuuuuuguaucuugcguuucccgguagggauuacauguggcguuaacccuucccugugucaccccucugauaggaacagaaagcuuuggugauaguuagauguggaaacagcuguauuucauaaauuugggaaggguuauucccugcauuggacauuagccauuuacuuugugcuuagccagaugcaaguacgcacaacacgcacgugucugggucucgaggcagagauuguuguuacucagccccugcugauggcugagucagugucugauucuugccauccuugucaggggaauuugggaggagacaggggcuuccugggugguagaaaugagaggucagaggcagggggcuggcauuggucgaaguuaacgcuuugccuuucucaacucugaggccacuaagguaucuggacucagucuugccuuuucucuaggugccauuguuucuggcauugcaggacaaggucuuuugguagagaggggaguggugaggauacagggccucgaguucuguggugggaggccagggacugggcuccauuccggccaugguggaguuaacgggggcuggugaggucaccucuggcgccguugugcacagaugguccuuguuauggacuugugguuuugcugguuggcaauuccagagacaccauuuuuuagcuuuggguggaugaggggaggauggggagaauccaagacagacaggccaggcucugaaccccacucccucccccaacucuccauuuauggccccugucuugaagaugucaaaguaggagcccagaguguuuaguaaaagggaccugaaggcaccaccucccucucccucccuccuccucuucauucuuucucuccuuccuacagagacugcaacaaggccauccaggaaggggccugggguugacaggagguaaagcaagcuuucuguguaugcgugugcacgcacacacacauauaugagagugacagacuaagcaagagagauugagauuaguguguuuuguaguuuuuaguuacaaccuucauucacuucuuucauuucugugaccaugagcaguuugagaaccaucuuuguccuagccuugauuucuccaccuaucaaauggagagagauucucgugguccugccugccaugacugauauauucaugucauacaucauuauuacaugaaauuugcaugguacagguguggaccaggcagaauggacagugcccuuggggcugaggcaggguucuagaagcccuugcugugugccaggugucaaucauuuuguuguugggugguccacaaggucccacgggagggauugggauaaccagggaagcagggguucucucugggagcucagagaagcagcuccuuaccaaccaguagagauguuuucuuaauauuuuaacaaugcaucaacuucacuggugugaaccggcaggugggcagccagccagcccugugcccauggaagcaugucucauucacauccuucccucucucccccacccuuagcccuguucaccaugggcggcaacgcugaaggacagcccugcaaguuuccauuccgcuuccagggcacauccuaugacagcugcaccacugagggccgcacggauggcuaccgcuggugcggcaccacugaggacuacgaccgcgacaagaaguauggcuucugcccugagaccggugggugccacucccucucccucccucagggcccagcaccugcugucugacaaaaaaaaaacccauaagacuccgagugcccaccuccuuuccccaagacaggggugcuaagacaucugugcgaaugacauccacaccaagauguccguguagcuagucaggauacuugucaccugguauggccugggcacugaaaucagaacagacauugggcaucaacaguugaauuggugacacuuaaaugucaggccugcucaggauccucugaccgaccugcaucccuuuucucucaggcucucuggcagagacuucucucuccuccucucugacccugcaaucucucuucccugccuuuccuggucuguaucuccaccuuuuagucuguuuuuuauuaagagcuccgugcuuuccucccugucuccuuccugcccuccucucuaucccucccuccuuuccuucuucccuuccuccaacaggaauuuacugagcgccugcuuugugcagcauacacagagguuggucucugcaaagcccugcccaagggggcucacagcugaggggcaugugcuggugccaucagcuucauccaacucccuuugccccuagcccaucugcccccuuccaugggaggcucauuagaacucuggaaucuggcuuccuggguuugaauugcagcucugauacuuccuagcaguguuggcuuagggaaauuucaucaucucucugaucuauuucccauccaugaaacgcggugcuauucagucccuccugcacaaggcuguugucaggggugggugagaugagucuaaagauacagugccugggacugagucuaacuuaggugugguucauuaaggucagcgucaugucauugcuuccuggugguagccucagacucuuugcugcgccuugacccguaucccuaaccccacagccauguccacuguuggugggaacucagaaggugcccccugugucuuccccuucacuuuccugggcaacaaauaugagagcugcaccagcgccggccgcagugacggaaagauguggugugcgaccacagccaacuacgaugaugaccgcaaguggggcuucugcccugaccaagguacgaggcccuggucauuggacagagacccuggacauugcccuugccccuaaacuugcuccaaaaaccuuccugagaccucacccacuucaagcauagacacugccccccagacacccaccuacccagacccgcccaccugggcugagacaaugcccaucucugguggagccaaggucccugcuuagauccugcccauccagguggaggcacagccuccaaaaucagacccugguagaccagaugcugcuacucaccuccuggguaagaacuggccuuccugaggggucacugcucuugucuuccccuucagccacccuccaggcgggcuugugacuaccaaaauuggcugaauucugagcacagauuaccagagagacaauucuccuaagagacauucccacugcacaaagaggugccuucaaggagcugguaggcaguagaagaaaggaaaaaaggaagagccucaugcuugaucugacaccaugguccacgcagcccugggggagcccccagagcccucucucccccaucagucagcaccaucuguuaccaggguguaaaugguggguccucgucaguccugggugcugaggauggagcugacugggacagcucucugcccccuaggacucacaagcucaggggagagagugaccaggagacagcuugugaccuuacuaugugcucagugcagugagcagggugcuuggggcccugugcccaaucuaggcuacagagcccaggguugcaggguugcuuaaagcucccugauggcccauaauggccaggucagugggcagguccagggccugucagaauuaggcaagccugucuuuauguugcuuucauucuuuuuaaucaucaugagauggaacuuggcagaugucaguggacagaggcuggccaaaggagguuuucuuauccccugcuaaauuccuugcuaggacacagucugauuuuaccagcuuaaaggugggauucuccaccuuccugagugguucaaguauccagagcucaguggcucacccagggugaauauuauagucuccuggggcugccaugacaaagugccacaaacugauggcuugaaacaaaccccauguauucuuucaugcuucuggaggcuggaagucuaaaaucacggcgucaguaaggccauguucccucugaaggaugcgucacuccagucuaugccucugucaugacauggauggccuucuucccccucugcuugccucuccuccuuuuuuuuuuuuuugagacggagucuugcucuugcccagcuggagugcaguggcaugaucucggcucacugcaaccucugccuccuggguucaagugauucuccugccuauuuccaaauaaguucacauucacaggucccuaggguuaagacuugggcaaaucuuuucuggggggacgcauuuaaccacaacagggugugacacagguuuugcucgcuggcuguggcucagccugugcaaccacgcuaagugugaaagguuuuuacugcuuucaccugggcagaaaugguggcaacauggggccagccuauccccacucuucuuaccucuucagagaggcugaggagcuggguuuguagagcucaucuuuuauagagagacauaaaaagccaggaagcaggauuuuaaaaugaaugggguuuuaaguagaaaauucgcagauacuacuuguucuguuccuuuauagcacaccuguccugauacugacuuggaaagagacaagaagacuuuggcugaccccacuuggaaacaauaggcacuaaucccaaaauuguguauugaucccagaauucucaggaaaagaaaaaaaaaaucaauacaugccgcuuccaggguucucagccuuacuguggggcuguccucaaaagucugcaucacugggucaggucuugacuucucucucaucucucuuccugucuuucaacccucucuccucccugcaacccucaggguacagccuguuccucguggcagcccacgaguuuggccacgccauggggcuggagcacucccaagacccuggggcccugauggcacccauuuacaccuacaccaagaacuuccgucugucccaggaugacaucaagggcauucaggagcucuaugguaaaccuccgggcggggguuggggguggagggugaggaggggggaggucauguagccugggauggaggcccagggggugggaccagcaagaucucauccagccaggagugcuggagacgagggcaggaaaugggaguguugaccuggucuugggaaggcagagcagcucuccaaggggauacuuggauaacucuucccuauccgaacaaugcuaauauccaugucacucuuagcgcuccauuucuggguuucucccauuuucuaggugaguaaggucaccuggugcaagguuacacagguuugagcaacccaguggaguuuagaauccaggagaauagccaaguacaggacagaauuuuccaucauguggaaugaccuuaacaauacggggguggaaguuucuaguuuucauaauaagcuuugauuuuuaguauguaguagaaacagaacaaccagugccuuaagccaauuauuuauuuauuuauuuauuuauuuauuuauuuauuuauuuauuuauuguugguucuuacagugaggcuagaguuuaaaaagucaguucauuuuuaaaaaauauuuaaugguccaggugauaucugagccaggccaaaauagugaaaguggugcuugagugaugaaguuuggggacugcuagacucaggaaaaagcccaaggucugccgugaggggugcuggguucaaauguggccucugcccuucacuagcugcaagauauuguguaagucuuuauaccucuuuggacucaguuuccucaucucuaaaauaauugcuuaucaugaaaagugccauacugucaguucuggacacaccagcggcccccugaccgcccugacucuugugggcauaagaaucugagcuuuggguuugaauccuugggcaagucacucaacuuuucugggccucaguuuccucaccugugaaauggugcaaucaugauaccccacucccagggcuauagagaggacugauuugggugaugucaguaaaaagcauauauaaaguacaaagggccccaggacuccccaaguccaggcaucuucuuguuaccuuacggagcuuacacuaaggccagaaggcgauuucuucugacucuuagaugguugggugggcaccccugggggcucacccuaguggggagaaccucuggagcugcagagagucuaaggucagguguucuccccaggggccucuccugacauugaccuuggcaccggccccacccccacgcugggcccugucacuccugagaucugcaaacaggacauuguauuugauggcaucgcucagauccguggugagaucuucuucuucaaggaccggugagugcaggagcuugcuucuuguccuccuugucuccuguccucugcucuuauaccauuauucuuuucccucacucuucgcugaagacuccgccaaaugcuucccagaaugaccugaauuaggcaguuucugcuguguaucaaacaaccuccagguuucaguggauuugcacccaagcauuuuguuugcucucucauagucugugggucuacuaguuaucuugacuuucagcuacaguuuggguucaggugugcucugccuguuguucucaugggauuagcagcuacucauggcagaugacagggugcaagaggccaaacugaacuacacaagcucauuuaaagccuccacucacaucuugucugagaauauuccacugccugaaauaagucacauggccaaucccaagaccuacccuagaggguaguacugcaaagucacauggaaaugcauaugaaugcauaauccuaaaaucaaaauggagggaagaauugggaaccauaauucagucuaccacaggccuucuagaauggcguugcccucaaauggccaaauuacucuguguauggguggugagugacugcagaguagaaagaggugguauucuucaugcuauagauaaagaucaccacucaguugacuaaagacugagguuuacccuaaugcccuaguucccuggagaauggcaggcaguaucuaggaccucauuaaagggucuguccuuccauucuucuaucauccauccaucuacccauccauccauccauaccuauaucuuuccauccaucauccauccagccagccagccaucuauuauccauuauuuaugauccagccauccauuauucauuauucauccauuuauucauucauagaguauaguaguugagaaaauggacucugaagccagauucucuggguuagaauucuguaacugcuacuuacugguuauguaaucauagacaaguuaauuaaguaucuucuuuguaccuugguuuccucauuuauaaaauggggcuaauauuccaaccuaucuccuagggcuguuguaaggauuagaugaacuuagugcugagaacaaaaacaaugccugacacagaguaaguguauucauauuagcuauuguuauugacaaauaauuguuuggcaucuacugugccaaauacuuugcuaggcuuuaguagcuggaggaggaagaaugauguucucgggacagugggguggggggcugcuagaucaguguucucaaagacaggcgcaugggccuccuauaacagaaccaucuagaguguggguauuaaaagguggguuuucugccccagcuucagacccuccugacuggaacucuggggcuaggccccaggaaucugcguuuuagcaaauucucccagugauucugaugcacauuaaaguuugugcaucacaaguccaguuugagaaauaggcauggagaacugacauggcaagaugaaagaaaagugaucgcagagguguuaggugcuuuugugagcacgucccagucaaggaaggcuucacagaugcagcagcauuugagcagagccuucaaaggagaagcaagaaucugaugggggugacaaguuaggagguucuuugagacagagggaccugcagagccaagccauagugaugugaaaguuucuggauuagccagugagaaucuggugaggcuagaagauguuccauaaacuuucaggaagaguuuccucuacucuaggcacugggccaaauucuggggugcagaugccuugcccuucacagggucugcuggccaauggggaaauggcaagaaugcaaugagagaugagacuuagaauguagugagaaaucaggucccgucaggccucgaaugcccaaaucaggauauauaacagcagaugucagcacugcucugcaguucccauuguaaggaucuggcaaugugcuucaucuggagcuccucccacuaagaaagcccugaccacacaugcagaucucagauguguggggccuaggaaaggaugcagagcccagacccaggcuggagccaucccuggccuaccacaucacaguuuucuuucaaaaggaacgugaugaguguuuaauggguuuauuugauuaaccaguaaauauuaaacuucaaccaugagcaaaaauugcugcuaggcacuggugagggugggggucaugaaggacaguauugcagggugauuaaacucagacuuuggagucagaucuggauaugaaucuugguaauaacuaauuuauuuagucauugauguagugauaacuaaguaauuugaauccuaaccucucugagcuucauuugcuaaauaaaaauugugacaccuuccuacgcuaggauguuuuucugcaaauaacagagaccaucccucugcaaacucaauccagccuaaacaguagagagaaauugcuuucauuugguacaaaguccagggguagagcugccugcaggggcagagagagggucagugacuugaugucuuuguccacugcuagccucugcacuuacuucauccuaaggccgguucuaccucauggucacaagaagguuaccaguggcaguuggggcucuaaucccugcccucucccaggaagcgagagagaaagagacacgcacagauacacacacacagacccccagaugugaaauacaagucuguguguuccgucuuuacaccacuguaagucauauggcaacugcugaaucaguaacagugcuagggaaugcuaaacucugauuggcuuagaccaguaguucucaaaccuuggcaugcguuagaaucaucuggaaggcuuguuaaaacacagauucugggccccaagcccagagauucuuaucuguagaucucuguaaggacccaaucauuugcauuucuaaugaguucucaggugacgcagaugcugcuggucaggagacugcacuuugagaaccaguggcuuauaccaaucaguaucuaccccuagaauggggguaggggacacagggucagaggaggugaaggcuggaucauaaauguggaguuuugugaagaaggaugguggggaaauagauaauuaaugcuagguagaccauccagagugcaugcugucuuaaaagauuguggggauuaaauuacaaggcacauaaauaaagcacauggcauuuaguaggacccucaauaaaugauaacucuuacucuugacaaaguacacaaauucauuucauuuuaauucaggaaauacuugagugucaucagcuccugccccaauuggccucuaaucaaauaggagaguuaagacaaacagacacuacuguuccaggcacucagaguugaugauuuugagaggcuuagagagggaaaacacaauauggauggagguagucagggaaggcuuccuggaggagguagagggagagaacaggguaggaggauguuucucagcuccagcagauugcagacaggaacucugcccguucuccaguccuucuccaaccuuccuuugauccugccucccacucccaucauggaaucaucucugggauguuucuggguggguuugggggugugugugguucgagcugcagggugacugaagaugugguuuccugugcccccuugccuccugccagguucauuuggcggacugugacgccacgugacaagcccauggggccccugcugguggccacauucuggccugagcucccggaaaagauugaugcgguauacgaggccccacaggaggagaaggcuguguucuuugcaggugugugggaagcacccuuccuuggcccucagcuccacagggcucugcaccagggcuccugggugucccaggcucacucccccucucaaaccacaguuccuaugcacccgugggugcucccuuuccuuuauggauucauucuuucaacauuauuuccugaagugcgcagcuccucugggagauugguuccgacacccaacaucagauagcauuaacccucaguguacacauuucauuuucuuaauucuuuucaauccgucucauuucuuuucuagaagaaaaaaagucucaguuuagugcuggugugucccuaacgccuuuguagugauacagucuuuggcagguaacaguuuuaguucgaauguuuuaaagaauauuuguuuucauuuuuacuuuuagacauaaauugguuuuaacagaggcaguuaguuauaauaguguggaguuucaaaucaggacagaaacggauuauucaguaacugauauuuugacagucaaaaaacauuuuuuaauaaauuuauuuuuaaagauuucaaaaugaauucacugaaagcagaauguuaaguaaauaauaguacagggagccccuagaagugguagaaaucaucaaggugaggucuguauggcuaagguuuacucauuuaacauuuauuggagcauuuccaugcgcugggcuuugccauacccuggggauacaagcucugccuucgcgaugcucacaaaccacucagggagacagacagcugggcucuuaugagggguaaagaaggauuuaggaggucccuguccuggucugaggugggauccuagagaagauaaaggcucagccaagacuauugucuccaccaccuggcucccaccucccccaauccaccguaaucaugggucccggagaggacaacugcuggcuccuagggcaccuuuuugcaaauuagcaaaaggugccucuuuaugacagcaaggcccuuagagugcacgacuuggugagcagagugugagcuggauuuaucccccaacucauguccuugaccaggcaccuucuguaauugacuucuaaagcccucugugugagcccugauucugggcacugcaaccaggagugagcaggaaguugcacucuguugggaauggcugcaguggggcccguggacagacagaugaugggaggaacaggcuggccuagggcaugucagcaccagccaacacacccuuugcuuccaccccagggaaugaauacuggaucuacucagccagcacccuggagcgaggguaccccaagccacugaccagccugggacugcccccugauguccagcgaguggaugccgccuuuaacuggagcaaaaacaagaagacauacaucuuugcuggagacaaauucuggagguaagggagggcgguggguaggacagcagcacaguuggcugcgagagacagagaagccgcccugaggcuucaagccuccugggcugaguucagagguuggugggcucuggaugcccucucucugguaucuaaccucuuuggucucuggcaccucugagauguugccaaaggugaaccauucuuguacacauugcugauauaauucugguggaauauccuuucucuuugcagaauucuuuugauuggcccaugucuggucuggacccucacauuuugaaaugacucacugaagaaggggguaauaaaaauaaagauaauaacugcuccuauugacacuaugugucagagacugucccaaggguucuaugggauaggaauuauuauuccucccauuuuacagaugaggaaaccuggguucagaaagguuagguaaccguggcugggcacaguggcucacgccuguaaucccagcacuuugggaggccaagauggguggaucacuugagcucaggaguuccagaucagccuggccacauggugaaaccccaucucuacuaaaaaugcaaaaaaauuagcuggacaugguggugcaugccugcaaucccagcuacuagggagacugaggcaggggaaucacuuaaaccuggaagacagaaguugcagugagcugagaucaugccacugcacuccagccugggcaacagagugagacuccaacucaaaaaaaaaaaaaagaaaaaagaaagguuaaguaaccagcuuggagucacauagccagguagggacagguugggauuugaacccuggcauucugucuccugggaaaacauguuagucuucacucuucacuacuauucuauacccgagaugguggaauggggguuccaagagaugggggaacaugaaggcaguggacaaaauaugaagaagacuuagagaugggugcaccagucauccauagaagccagcauccaaaucagaccccauggaaggagcaggugcccugugucaugcucacagcaggcccguggcugugggugcagguuggcaggggaacaauuuggaagcagaugguucugugcuccagguuaucuacaggaaaggguccaguucugaggggcuauagucaugaccagggaaccuaauauccaggaguggcuggugagagguagcccaaaccucaggaguuugacuguaauucuucacacuuucuagaaaaggaaacggagguccaaagaaauuaaauaacuuguucaagcuauagagauauguguauuugcacaaagccaggauuauagcuacuucucuuguauucuaacugaguacccccuccacuauaccugccaguccauuugauuagugaggaaagaguggucggggcacaaagacuuguggugugucuuuccauccccucccuccugguauccccacauuccuuccauggcugccacugcaucugggcccuacccaagaauuuuagagggcacuuccugaggccuuugucugccauccccaaaacaaucccgcuuacuuccuaaggccucugucuucucccccuucccuccuccccacuacucugccccccagcugcccugcauucagaaacucuuuauaucccaggccugcccaugucaggguggaauuccagacauauugcuaagacacuuagcaaccuaagcugauugauaucucaagccucaagaaagaaaacagucaggcaggaaaccacagagcaggcuuuccacccaccagcuccagacacuagccccagacagugugcacgcacacgcacacacacacacgcguacugcgaauggcaucucagcauuguaggagcccugaaucuccaagucuuagaauuguggcuggugagccgcacagacucacagaaacgugaaucuuagaauccuaaagcccugaaguuuucaaauuaugguguuggaagaacuuuuuaaaucacuuuuccaugcacuguaucuauguaaacaugcaaaaacagaccuguuccuagcauauaggaacaugauugugugcgcaugugcgcauacacacacacacacacacacacacacacacacacacacacacacaggcauggagguuguggcagugccuugcuggauuuccaggcagaguuauuugccucccaguccuuuuccacacaagcccaccucccaaagccagagccaggacagacagcgugcucuacagaggaaccacccugagacuuccugaaaagggacagagcugaagggccuaucagaagcucugggcuggcuuccaaaggagacagaucucuauuccaagagaaguggugaaugagcuugugacacuggcccugccguggagucugcagaggccccagaggcaucuuugcuggagaaggagagagagccccagagugacagaggcugagcagcugucuucagcaugccaagaagagcucaggcccugcuuguagaagcuuucacuaagccacaaauauauguuccacaucugcugugugccaggcacuuagcuagcugcuggagagacgggggucaaaaaaucaucacacccugcccucauguaguuuauaguagaaugagggaaaauuauguaaacacauuugaaucagauaaugauggcucucaguauggggccucuaccauagcccagccugaggcuaugcaggucaccuauauuucucaguugagguagauacuguuagcuccuuuucccaaguguggaaacugaggcuaaaguggcucaaggaaaagcugggacacaaauaucuguguucuuaacaccugcuauacauggcaacuucuacagcugcagagaaguaccacaucuucugacaccacagugcuuguauucuuucuggaugaaaagaacuuggaagcaaacuaauucucuuaucugagacucaguuuccucaucuguaaaaugggcuugacuucugccauccccaccuucuguggguagaaugagaaagaaaugagggccaguucaagugugggacacacaucuccaaacuauccuaacgcuagggaauguaguuugagggcucaguggaggugccuuggaugggaguguugggauuuugagcuagggaacuugguuuuggugacccagggcaugaggaagcaugccagguuuuguaagaaugaguuuuaugcugcaccugggauuaaggaaggcguuaguucuucggggugauggcugagggagaagucccuuugagggagaagucuccucuagaagggagcauauagggaaagcugcuguugggguccaggguggagguggucaaggcuggcugcagaaaggaagggagcccccuaggaggcacuguggagcaaaagguggcugcuaccaggaugggaugcgaacacagauucaucuagaaacagcuccacuugggcaagacuuguuuacuaggauauccauagcucccauagugggagcucaguaaauauuuauggaauaaugaaguggagaggcaaaggaaucaacaugacagcagcauuuaaaaaguucuccaaaaaucuuaaaagacagaaggauugcuagccagggagaagaacauacuaaccgaugcccaaaguauuuaccugaauuaaaggcggggcccaggauugcugccgccggaacugagguggcauguggcccacccugugacuaacaggccuuggacuuacacguaccuuccaccuugcauuguaaccucacugccccagccauggucaucucccagggcagggacugucaucucccuguggcagaugaagaagcagcaauuuuuccaagccaugaagugaaagaaugauggggcagauucccaucccugggcuucuaguuuagcacuccucggauuacagcagggauuuguuuguaagggagcuaacauuucuuaaguaccuacuaaauauuuaugagacauggggauagaggcucugcaugugcuguuuuauuuaaugcaugcauuaaauuaaauacacuaaauuagacacaaccccauuuuacagcugguaaaacuguagcuguauggaaagugguuaacacacuguuuggcauguaguaagugcuuuauaaauguuagcaguaaucaugagauuguuuuuauggggucauccaaagucauauaauuaaaagugguagaucugaggcucagacucaggucugauuccaugcccuuccuuccacugcagcuggcugcuucccugaagggcuagguccaguuuccgaggccuauccaggagccaucagcugggugcucccauccaggccaggggggaaguguccuuuagagaggcccugcugguucacugugucuguuucuuuacagauacaaugaggugaagaagaaaauggauccuggcuuccccaagcucaucgcagaugccuggaaugccauccccgauaaccuggaugccgucguggaccugcagggcggcggugagccacccaggacugucuccgcuuucuaggacuccccgccccuagccagggcccagcuccuugcaaauacacacuucuuuauugugcagggcaggcaggcaggcggcgcccaggaaaacaaaucaacuccuucauccuagugcugggaagguuuccagaucccugaccucugcuccuuggccuggcuccaggcaguaagacccagaaagacuucucacagcugcagggccuggagccagggcaggggagggcggaaggccugggccaggggagaaggaacaugggcucugugccguggauucauucugggguuugauccaggcccauuugcguuuugcaggaggccugugaccaccucccauuagcagaaggauggcuccauuugagacaaggcaaacuuugucaugcucuguugcucauguggcaaagauccuccacucaaccaguuugccccuggcccccugcugauuaaaacacaaccaguagcagcgagggauagaauuuggaguuugaaaaucauacucuugaggaggcaucugugagcuuucuaggguccuggaaauggguccaguuuggcuuuuuuuagaggagauuucaacuaaauuccacagauuuuuuuuuuuuugagcaccuacuguaugcuaagcacaggcccugaccuccaguagcugaaggucuuacauguccaagaaaaugcaguguacaaucagaugcuagauuaggaguuaucuucaagaauaaacaucuauugagcaccuacuacaugcuagcauauuaauaguaaaugagauuauguaugucaggagucacaaacuccaacagcuccaugugucaggcagguagcacaaaugaguaaagcaggcaggggcagacaguggggaacuguggagucugugcggaaucagagcacaugccucauuuacaggagacacuuucuucucaccuucagauaauuauuggcgggcaagauuaggggccuaggcagcugccaugguucacaccugucaucccagcacucugggaggccaaggcaggagaacugcuugagcgcaggaguuugagaccagccugggcaacauagugagacucuaucucuacaaaaaaauuuuaaaaaacauuagcuacacaugacggcgcauaccuguagucccagcuacuggggagggugagcagagaggaucgcuugagcccaggaguuuaaggcugcagugagccguguucaugccgcugcauuccagacugggugacagagugagaccuggucucaaaaaaaaagaauggggccugguguuguuagauauucuauauuagauauucuaguuuuuuuaaaggaagccagaaaucuguacuucugugugacuuuuuggauguuuacauguuggcaaguuauucagauuuaaagacaaaacaaaacaaacuugugagagucaaauaaaacccaucugugggccugacaggacuggauauauccuguuuugccaccucugguacauggaaugugcuuaguuugaugcuuguguuaaguggaguuauuguuuuuaauaauagcauauguuaucugacuuaaugcucacugcaagcccuagaagguugauaaucuuuauccucaucuuagagaugagcaaacagggaauaaaagagcuuauuucacagccauuucccuucuuccacucccagagggggcucuucugggcuuuuguuguguuuugguuuuguuuuuguuuucuuuucuucaaucagcucagauugaaacaauugaauuuuuuuuuuuuuuuuuuugagacagagucucccucugucgcccaggcuggagugcaguggcgcgaucuuggcucacugcaagcuccgccuacuggguucacaccauucuccugccucagccucccgaguagcugggacuacaggcgccuaccaccacgcccggcuaauuuuuuguauuuuuaguagagacgagguuucaccauguuagccaggauggucuugaucuccugacuucgugaucugcccgucucggccucccaaagugcugggauuacaggcgugagccaccgcgccccgccacaguugaguuuuuuuuuuggcggggggacaaggucuugcucuaucacccaggcuagaggcacaaucauagcucacugcagccucgaacuccugggcuuaagcgacccucccacgucagccuccuaaguagcuuggacuacaggaauguaccacuauacccagcuaauuuaaauauguuuuucguagaaaugggggucucucuaugcugcccaagcuggucucgaacuccugggcucaagcaauccuccugccucagccuuucaaagcucucuucucguuuaaaagcuucuucccuaugccaggcagaaauucaaaguucccaggaaccuucugugugccagaaugucaggauaagggggucacggucucuucuuucucuaucccaggucacagcuacuucuucaagggugccuauuaccugaagcuggagaaccaaagucugaagagcgugaaguuuggaagcaucaaauccgacuggcuaggcugcugagcuggcccuggcucccacaggcccuuccucuccacugccuucgauacaccgggccuggagaacuagagaaggacccggaggggccuggcagccgugccuucagcucuacagcuaaucagcauucucacuccuaccugguaauuuaagauuccagagaguggcuccucccggugcccaagaauagaugcugacuguacuccucccaggcgccccuucccccuccaaucccaccaacccucagagccaccccuaaagagauacuuugauauuuucaacgcagcccugcuuugggcugcccuggugcugccacacuucaggcucuucuccuuucacaaccuucuguggcucacagaacccuuggagccaauggagacugucucaagagggcacugguggcccgacagccuggcacagggcagugggacagggcauggccagguggccacuccagaccccuggcuuuucacugcuggcugccuuagaaccuuucuuacauuagcaguuugcuuuguaugcacuuuguuuuuuucuuugggucuuguuuuuuuuuuccacuuagaaauugcauuuccugacagaaggacucagguugucugaagucacugcacagugcaucucagcccacauagugaugguuccccuguucacucuacuuagcaugucccuaccgagucucuucuccacuggauggaggaaaaccaagccguggcuucccgcucagcccucccugccccucccuucaaccauuccccaugggaaaugucaacaaguaugaauaaagacaccuacugaguggcc

SEQ ID NO: 21257 - RNA, 27083 nt, Homo sapiens
ggccacucaguaggugucuuuauucauacuuguugacauuucccauggggaaugguugaagggaggggcagggagggcugagcgggaagccacggcuugguuuuccuccauccaguggagaagagacucgguagggacaugcuaaguagagugaacaggggaaccaucacuaugugggcugagaugcacugugcagugacuucagacaaccugaguccuucugucaggaaaugcaauuucuaaguggaaaaaaaaaacaagacccaaagaaaaaaacaaagugcauacaaagcaaacugcuaauguaagaaagguucuaaggcagccagcagugaaaagccaggggucuggaguggccaccuggccaugcccugucccacugcccugugccaggcugucgggccaccagugcccucuugagacagucuccauuggcuccaaggguucugugagccacagaagguugugaaaggagaagagccugaaguguggcagcaccagggcagcccaaagcagggcugcguugaaaauaucaaaguaucucuuuagggguggcucugaggguuggugggauuggagggggaaggggcgccugggaggaguacagucagcaucuauucuugggcaccgggaggagccacucucuggaaucuuaaauuaccagguaggagugagaaugcugauuagcuguagagcugaaggcacggcugccaggccccuccggguccuucucuaguucuccaggcccgguguaucgaaggcaguggagaggaagggccugugggagccagggccagcucagcagccuagccagucggauuugaugcuuccaaacuucacgcucuucagacuuugguucuccagcuucagguaauaggcacccuugaagaaguagcugugaccugggauagagaaagaagagaccgugacccccuuauccugacauucuggcacacagaagguuccugggaacuuugaauuucugccuggcauagggaagaagcuuuuaaacgagaagagagcuuugaaaggcugaggcaggaggauugcuugagcccaggaguucgagaccagcuugggcagcauagagagacccccauuucuacgaaaaacauauuuaaauuagcuggguauagugguacauuccuguaguccaagcuacuuaggaggcugacgugggagggucgcuuaagcccaggaguucgaggcugcagugagcuaugauugugccucuagccugggugauagagcaagaccuuguccccccgccaaaaaaaaaacucaacuguggcggggcgcgguggcucacgccuguaaucccagcacuuugggaggccgagacgggcagaucacgaagucaggagaucaagaccauccuggcuaacauggugaaaccucgucucuacuaaaaauacaaaaaauuagccgggcguggugguaggcgccuguagucccagcuacucgggaggcugaggcaggagaauggugugaacccaguaggcggagcuugcagugagccaagaucgcgccacugcacuccagccugggcgacagagggagacucugucucaaaaaaaaaaaaaaaaaaauucaauuguuucaaucugagcugauugaagaaaagaaaacaaaaacaaaaccaaaacacaacaaaagcccagaagagcccccucugggaguggaagaagggaaauggcugugaaauaagcucuuuuauucccuguuugcucaucucuaagaugaggauaaagauuaucaaccuucuagggcuugcagugagcauuaagucagauaacauaugcuauuauuaaaaacaauaacuccacuuaacacaagcaucaaacuaagcacauuccauguaccagagguggcaaaacaggauauauccaguccugucaggcccacagauggguuuuauuugacucucacaaguuuguuuuguuuugucuuuaaaucugaauaacuugccaacauguaaacauccaaaaagucacacagaaguacagauuucuggcuuccuuuaaaaaaacuagaauaucuaauauagaauaucuaacaacaccaggccccauucuuuuuuuuugagaccaggucucacucugucacccagucuggaaugcagcggcaugaacacggcucacugcagccuuaaacuccugggcucaagcgauccucucugcucacccuccccaguagcugggacuacagguaugcgccgucauguguagcuaauguuuuuuaaaauuuuuuuguagagauagagucucacuauguugcccaggcuggucucaaacuccugcgcucaagcaguucuccugccuuggccucccagagugcugggaugacaggugugaaccauggcagcugccuaggccccuaaucuugcccgccaauaauuaucugaaggugagaagaaagugucuccuguaaaugaggcaugugcucugauuccgcacagacuccacaguuccccacugucugccccugccugcuuuacucauuugugcuaccugccugacacauggagcuguuggaguuugugacuccugacauacauaaucucauuuacuauuaauaugcuagcauguaguaggugcucaauagauguuuauucuugaagauaacuccuaaucuagcaucugauuguacacugcauuuucuuggacauguaagaccuucagcuacuggaggucagggccugugcuuagcauacaguaggugcucaaaaaaaaaaaaaucuguggaauuuaguugaaaucuccucuaaaaaaagccaaacuggacccauuuccaggacccuagaaagcucacagaugccuccucaagaguaugauuuucaaacuccaaauucuaucccucgcugcuacugguuguguuuuaaucagcagggggccaggggcaaacugguugaguggaggaucuuugccacaugagcaacagagcaugacaaaguuugccuugucucaaauggagccauccuucugcuaaugggagguggucacaggccuccugcaaaacgcaaaugggccuggaucaaaccccagaaugaauccacggcacagagcccauguuccuucuccccuggcccaggccuuccgcccuccccugcccuggcuccaggcccugcagcugugagaagucuuucugggucuuacugccuggagccaggccaaggagcagaggucagggaucuggaaaccuucccagcacuaggaugaaggaguugauuuguuuuccugggcgccgccugccugccugcccugcacaauaaagaaguguguauuugcaaggagcugggcccuggcuaggggcggggaguccuagaaagcggagacaguccuggguggcucaccgccgcccugcagguccacgacggcauccagguuaucggggauggcauuccaggcaucugcgaugagcuuggggaagccaggauccauuuucuucuucaccucauuguaucuguaaagaaacagacacagugaaccagcagggccucucuaaaggacacuuccccccuggccuggaugggagcacccagcugauggcuccuggauaggccucggaaacuggaccuagcccuucagggaagcagccagcugcaguggaaggaagggcauggaaucagaccugagucugagccucagaucuaccacuuuuaauuauaugacuuuggaugaccccauaaaaacaaucucaugauuacugcuaacauuuauaaagcacuuacuacaugccaaacaguguguuaaccacuuuccauacagcuacaguuuuaccagcuguaaaaugggguugugucuaauuuaguguauuuaauuuaaugcaugcauuaaauaaaacagcacaugcagagccucuauccccaugucucauaaauauuuaguagguacuuaagaaauguuagcucccuuacaaacaaaucccugcuguaauccgaggagugcuaaacuagaagcccagggaugggaaucugccccaucauucuuucacuucauggcuuggaaaaauugcugcuucuucaucugccacagggagaugacagucccugcccugggagaugaccauggcuggggcagugagguuacaaugcaagguggaagguacguguaaguccaaggccuguuagucacagggugggccacaugccaccucaguuccggcggcagcaauccugggccccgccuuuaauucagguaaauacuuugggcaucgguuaguauguucuucucccuggcuagcaauccuucugucuuuuaagauuuuuggagaacuuuuuaaaugcugcugucauguugauuccuuugccucuccacuucauuauuccauaaauauuuacugagcucccacuaugggagcuauggauauccuaguaaacaagucuugcccaaguggagcuguuucuagaugaaucuguguucgcaucccauccugguagcagccaccuuuugcuccacagugccuccuagggggcucccuuccuuucugcagccagccuugaccaccuccacccuggaccccaacagcagcuuucccuauaugcucccuucuagaggagacuucucccucaaagggacuucucccucagccaucaccccgaagaacuaacgccuuccuuaaucccaggugcagcauaaaacucauucuuacaaaaccuggcaugcuuccucaugcccugggucaccaaaaccaaguucccuagcucaaaaucccaacacucccauccaaggcaccuccacugagcccucaaacuacauucccuagcguuaggauaguuuggagaugugugucccacacuugaacuggcccucauuucuuucucauucuacccacagaagguggggauggcagaagucaagcccauuuuacagaugaggaaacugagucucagauaagagaauuaguuugcuuccaaguucuuuucauccagaaagaauacaagcacuguggugucagaagaugugguacuucucugcagcuguagaaguugccauguauagcagguguuaagaacacagauauuugugucccagcuuuuccuugagccacuuuagccucaguuuccacacuugggaaaaggagcuaacaguaucuaccucaacugagaaauauaggugaccugcauagccucaggcugggcuaugguagaggccccauacugagagccaucauuaucugauucaaauguguuuacauaauuuucccucauucuacuauaaacuacaugagggcagggugugaugauuuuuugacccccgucucuccagcagcuagcuaagugccuggcacacagcagauguggaacauauauuuguggcuuagugaaagcuucuacaagcagggccugagcucuucuuggcaugcugaagacagcugcucagccucugucacucuggggcucucucuccuucuccagcaaagaugccucuggggccucugcagacuccacggcagggccagugucacaagcucauucaccacuucucuuggaauagagaucugucuccuuuggaagccagcccagagcuucugauaggcccuucagcucugucccuuuucaggaagucucagggugguuccucuguagagcacgcugucuguccuggcucuggcuuugggaggugggcuuguguggaaaaggacugggaggcaaauaacucugccuggaaauccagcaaggcacugccacaaccuccaugccuguguguguguguguguguguguguguguguguguguguguguguaugcgcacaugcgcacacaaucauguuccuauaugcuaggaacaggucuguuuuugcauguuuacauagauacagugcauggaaaagugauuuaaaaaguucuuccaacaccauaauuugaaaacuucagggcuuuaggauucuaagauucacguuucugugagucugugcggcucaccagccacaauucuaagacuuggagauucagggcuccuacaaugcugagaugccauucgcaguacgcgugugugugugugcgugugcgugcacacugucuggggcuagugucuggagcugguggguggaaagccugcucugugguuuccugccugacuguuuucuuucuugaggcuugagauaucaaucagcuuagguugcuaagugucuuagcaauaugucuggaauuccacccugacaugggcaggccugggauauaaagaguuucugaaugcagggcagcuggggggcagaguaguggggaggagggaagggggagaagacagaggccuuaggaaguaagcgggauuguuuuggggauggcagacaaaggccucaggaagugcccucuaaaauucuuggguagggcccagaugcaguggcagccauggaaggaauguggggauaccaggagggaggggauggaaagacacaccacaagucuuugugccccgaccacucuuuccucacuaaucaaauggacuggcagguauaguggaggggguacucaguuagaauacaagagaaguagcuauaauccuggcuuugugcaaauacacauaucucuauagcuugaacaaguuauuuaauuucuuuggaccuccguuuccuuuucuagaaagugugaagaauuacagucaaacuccugagguuugggcuaccucucaccagccacuccuggauauuagguucccuggucaugacuauagccccucagaacuggacccuuuccuguagauaaccuggagcacagaaccaucugcuuccaaauuguuccccugccaaccugcacccacagccacgggccugcugugagcaugacacagggcaccugcuccuuccauggggucugauuuggaugcuggcuucuauggaugacuggugcacccaucucuaagucuucuucauauuuuguccacugccuucauguucccccaucucuuggaacccccauuccaccaucucggguauagaauaguagugaagagugaagacuaacauguuuucccaggagacagaaugccaggguucaaaucccaaccugucccuaccuggcuaugugacuccaagcugguuacuuaaccuuucuuuuuucuuuuuuuuuuuuuugaguuggagucucacucuguugcccaggcuggagugcaguggcaugaucucagcucacugcaacuucugucuuccagguuuaagugauuccccugccucagucucccuaguagcugggauugcaggcaugcaccaccauguccagcuaauuuuuuugcauuuuuaguagagaugggguuucaccauguggccaggcugaucuggaacuccugagcucaagugauccacccaucuuggccucccaaagugcugggauuacaggcgugagccacugugcccagccacgguuaccuaaccuuucugaacccagguuuccucaucuguaaaaugggaggaauaauaauuccuaucccauagaacccuugggacagucucugacacauagugucaauaggagcaguuauuaucuuuauuuuuauuacccccuucuucagugagucauuucaaaaugugaggguccagaccagacaugggccaaucaaaagaauucugcaaagagaaaggauauuccaccagaauuauaucagcaauguguacaagaaugguucaccuuuggcaacaucucagaggugccagagaccaaagagguuagauaccagagagagggcauccagagcccaccaaccucugaacucagcccaggaggcuugaagccucagggcggcuucucugucucucgcagccaacugugcugcuguccuacccaccgcccucccuuaccuccagaauuugucuccagcaaagauguaugucuucuuguuuuugcuccaguuaaaggcggcauccacucgcuggacaucagggggcagucccaggcuggucaguggcuugggguacccucgcuccagggugcuggcugaguagauccaguauucauucccugggguggaagcaaaggguguguuggcuggugcugacaugcccuaggccagccuguuccucccaucaucugucuguccacgggccccacugcagccauucccaacagagugcaacuuccugcucacuccugguugcagugcccagaaucagggcucacacagagggcuuuagaagucaauuacagaaggugccuggucaaggacaugaguugggggauaaauccagcucacacucugcucaccaagucgugcacucuaagggccuugcugucauaaagaggcaccuuuugcuaauuugcaaaaaggugcccuaggagccagcaguuguccucuccgggacccaugauuacgguggauugggggaggugggagccaggugguggagacaauagucuuggcugagccuuuaucuucucuaggaucccaccucagaccaggacagggaccuccuaaauccuucuuuaccccucauaagagcccagcugucugucucccugagugguuugugagcaucgcgaaggcagagcuuguauccccaggguauggcaaagcccagcgcauggaaaugcuccaauaaauguuaaaugaguaaaccuuagccauacagaccucaccuugaugauuucuaccacuucuaggggcucccuguacuauuauuuacuuaacauucugcuuucagugaauucauuuugaaaucuuuaaaaauaaauuuauuaaaaaauguuuuuugacugucaaaauaucaguuacugaauaauccguuucuguccugauuugaaacuccacacuauuauaacuaacugccucuguuaaaaccaauuuaugucuaaaaguaaaaaugaaaacaaauauucuuuaaaacauucgaacuaaaacuguuaccugccaaagacuguaucacuacaaaggcguuagggacacaccagcacuaaacugagacuuuuuuucuucuagaaaagaaaugagacggauugaaaagaauuaagaaaaugaaauguguacacugaggguuaaugcuaucugauguugggugucggaaccaaucucccagaggagcugcgcacuucaggaaauaauguugaaagaaugaauccauaaaggaaagggagcacccacgggugcauaggaacugugguuugagagggggagugagccugggacacccaggagcccuggugcagagcccuguggagcugagggccaaggaagggugcuucccacacaccugcaaagaacacagccuucuccuccuguggggccucguauaccgcaucaaucuuuuccgggagcucaggccagaauguggccaccagcaggggccccaugggcuugucacguggcgucacaguccgccaaaugaaccuggcaggaggcaagggggcacaggaaaccacaucuucagucacccugcagcucgaaccacacacacccccaaacccacccagaaacaucccagagaugauuccaugaugggagugggaggcaggaucaaaggaagguuggagaaggacuggagaacgggcagaguuccugucugcaaucugcuggagcugagaaacauccuccuacccuguucucucccucuaccuccuccaggaagccuucccugacuaccuccauccauauuguguuuucccucucuaagccucucaaaaucaucaacucugagugccuggaacaguagugucuguuugucuuaacucuccuauuugauuagaggccaauuggggcaggagcugaugacacucaaguauuuccugaauuaaaaugaaaugaauuuguguacuuugucaagaguaagaguuaucauuuauugaggguccuacuaaaugccaugugcuuuauuuaugugccuuguaauuuaauccccacaaucuuuuaagacagcaugcacucuggauggucuaccuagcauuaauuaucuauuuccccaccauccuucuucacaaaacuccacauuuaugauccagccuucaccuccucugacccuguguccccuacccccauucuagggguagauacugauugguauaagccacugguucucaaagugcagucuccugaccagcagcaucugcgucaccugagaacucauuagaaaugcaaaugauuggguccuuacagagaucuacagauaagaaucucugggcuuggggcccagaaucuguguuuuaacaagccuuccagaugauucuaacgcaugccaagguuugagaacuacuggucuaagccaaucagaguuuagcauucccuagcacuguuacugauucagcaguugccauaugacuuacagugguguaaagacggaacacacagacuuguauuucacaucugggggucuguguguguguaucugugcgugucucuuucucucucgcuuccugggagagggcagggauuagagccccaacugccacugguaaccuucuugugaccaugagguagaaccggccuuaggaugaaguaagugcagaggcuagcaguggacaaagacaucaagucacugacccucucucugccccugcaggcagcucuaccccuggacuuuguaccaaaugaaagcaauuucucucuacuguuuaggcuggauugaguuugcagagggauggucucuguuauuugcagaaaaacauccuagcguaggaaggugucacaauuuuuauuuagcaaaugaagcucagagagguuaggauucaaauuacuuaguuaucacuacaucaaugacuaaauaaauuaguuauuaccaagauucauauccagaucugacuccaaagucugaguuuaaucacccugcaauacuguccuucaugacccccacccucaccagugccuagcagcaauuuuugcucaugguugaaguuuaauauuuacugguuaaucaaauaaacccauuaaacacucaucacguuccuuuugaaagaaaacugugaugugguaggccagggauggcuccagccugggucugggcucugcauccuuuccuaggccccacacaucugagaucugcauguguggucagggcuuucuuagugggaggagcuccagaugaagcacauugccagauccuuacaaugggaacugcagagcagugcugacaucugcuguuauauauccugauuugggcauucgaggccugacgggaccugauuucucacuacauucuaagucucaucucucauugcauucuugccauuuccccauuggccagcagacccugugaagggcaaggcaucugcaccccagaauuuggcccagugccuagaguagaggaaacucuuccugaaaguuuauggaacaucuucuagccucaccagauucucacuggcuaauccagaaacuuucacaucacuauggcuuggcucugcaggucccucugucucaaagaaccuccuaacuugucacccccaucagauucuugcuucuccuuugaaggcucugcucaaaugcugcugcaucugugaagccuuccuugacugggacgugcucacaaaagcaccuaacaccucugcgaucacuuuucuuucaucuugccaugucaguucuccaugccuauuucucaaacuggacuugugaugcacaaacuuuaaugugcaucagaaucacugggagaauuugcuaaaacgcagauuccuggggccuagccccagaguuccagucaggagggucugaagcuggggcagaaaacccaccuuuuaauacccacacucuagaugguucuguuauaggaggcccaugcgccugucuuugagaacacugaucuagcagccccccaccccacugucccgagaacaucauucuuccuccuccagcuacuaaagccuagcaaaguauuuggcacaguagaugccaaacaauuauuugucaauaacaauagcuaauaugaauacacuuacucugugucaggcauuguuuuuguucucagcacuaaguucaucuaauccuuacaacagcccuaggagauagguuggaauauuagccccauuuuauaaaugaggaaaccaagguacaaagaagauacuuaauuaacuugucuaugauuacauaaccaguaaguagcaguuacagaauucuaacccagagaaucuggcuucagaguccauuuucucaacuacuauacucuaugaaugaauaaauggaugaauaaugaauaauggauggcuggaucauaaauaauggauaauagauggcuggcuggcuggauggaugauggauggaaagauauagguauggauggauggauggguagauggauggaugauagaagaauggaaggacagacccuuuaaugagguccuagauacugccugccauucuccagggaacuagggcauuaggguaaaccucagucuuuagucaacugaguggugaucuuuaucuauagcaugaagaauaccaccucuuucuacucugcagucacucaccacccauacacagaguaauuuggccauuugagggcaacgccauucuagaaggccugugguagacugaauuaugguucccaauucuucccuccauuuugauuuuaggauuaugcauucauaugcauuuccaugugacuuugcaguacuacccucuaggguaggucuugggauuggccaugugacuuauuucaggcaguggaauauucucagacaagaugugaguggaggcuuuaaaugagcuuguguaguucaguuuggccucuugcacccugucaucugccaugaguagcugcuaaucccaugagaacaacaggcagagcacaccugaacccaaacuguagcugaaagucaagauaacuaguagacccacagacuaugagagagcaaacaaaaugcuugggugcaaauccacugaaaccuggagguuguuugauacacagcagaaacugccuaauucaggucauucugggaagcauuuggcggagucuucagcgaagagugagggaaaagaauaaugguauaagagcagaggacaggagacaaggaggacaagaagcaagcuccugcacucaccgguccuugaagaagaagaucucaccacggaucugagcgaugccaucaaauacaauguccuguuugcagaucucaggagugacagggcccagcguggggguggggccggugccaaggucaaugucaggagaggccccuggggagaacaccugaccuuagacucucugcagcuccagagguucuccccacuagggugagcccccaggggugcccacccaaccaucuaagagucagaagaaaucgccuucuggccuuaguguaagcuccguaagguaacaagaagaugccuggacuuggggaguccuggggcccuuuguacuuuauauaugcuuuuuacugacaucacccaaaucaguccucucuauagcccugggagugggguaucaugauugcaccauuucacaggugaggaaacugaggcccagaaaaguugagugacuugcccaaggauucaaacccaaagcucagauucuuaugcccacaagagucagggcggucagggggccgcugguguguccagaacugacaguauggcacuuuucaugauaagcaauuauuuuagagaugaggaaacugaguccaaagagguauaaagacuuacacaauaucuugcagcuagugaagggcagaggccacauuugaacccagcaccccucacggcagaccuugggcuuuuuccugagucuagcaguccccaaacuucaucacucaagcaccacuuucacuauuuuggccuggcucagauaucaccuggaccauuaaauauuuuuuaaaaaugaacugacuuuuuaaacucuagccucacuguaagaaccaacaauaaauaaauaaauaaauaaauaaauaaauaaauaaauaaauaaauaauuggcuuaaggcacugguuguucuguuucuacuacauacuaaaaaucaaagcuuauuaugaaaacuagaaacuuccacccccguauuguuaaggucauuccacaugauggaaaauucuguccuguacuuggcuauucuccuggauucuaaacuccacuggguugcucaaaccuguguaaccuugcaccaggugaccuuacucaccuagaaaaugggagaaacccagaaauggagcgcuaagagugacauggauauuagcauuguucggauagggaagaguuauccaaguauccccuuggagagcugcucugccuucccaagaccaggucaacacucccauuuccugcccucgucuccagcacuccuggcuggaugagaucuugcuggucccacccccugggccuccaucccaggcuacaugaccuccccccuccucacccuccacccccaacccccgcccggagguuuaccauagagcuccugaaugcccuugaugucauccugggacagacggaaguucuugguguagguguaaaugggugccaucagggccccagggucuugggagugcuccagccccauggcguggccaaacucgugggcugccacgaggaacaggcuguacccugaggguugcagggaggagagaggguugaaagacaggaagagagaugagagagaagucaagaccugacccagugaugcagacuuuugaggacagccccacaguaaggcugagaacccuggaagcggcauguauugauuuuuuuuuucuuuuccugagaauucugggaucaauacacaauuuugggauuagugccuauuguuuccaaguggggucagccaaagucuucuugucucuuuccaagucaguaucaggacaggugugcuauaaaggaacagaacaaguaguaucugcgaauuuucuacuuaaaaccccauucauuuuaaaauccugcuuccuggcuuuuuaugucucucuauaaaagaugagcucuacaaacccagcuccucagccucucugaagagguaagaagaguggggauaggcuggccccauguugccaccauuucugcccaggugaaagcaguaaaaaccuuucacacuuagcgugguugcacaggcugagccacagccagcgagcaaaaccugugucacacccuguugugguuaaaugcguccccccagaaaagauuugcccaagucuuaacccuagggaccugugaaugugaacuuauuuggaaauaggcaggagaaucacuugaacccaggaggcagagguugcagugagccgagaucaugccacugcacuccagcugggcaagagcaagacuccgucucaaaaaaaaaaaaaaggaggagaggcaagcagagggggaagaaggccauccaugucaugacagaggcauagacuggagugacgcauccuucagagggaacauggccuuacugacgccgugauuuuagacuuccagccuccagaagcaugaaagaauacaugggguuuguuucaagccaucaguuuguggcacuuugucauggcagccccaggagacuauaauauucacccugggugagccacugagcucuggauacuugaaccacucaggaagguggagaaucccaccuuuaagcugguaaaaucagacuguguccuagcaaggaauuuagcaggggauaagaaaaccuccuuuggccagccucuguccacugacaucugccaaguuccaucucaugaugauuaaaaagaaugaaagcaacauaaagacaggcuugccuaauucugacaggcccuggaccugcccacugaccuggccauuaugggccaucagggagcuuuaagcaacccugcaacccugggcucuguagccuagauugggcacagggccccaagcacccugcucacugcacugagcacauaguaaggucacaagcugucuccuggucacucucuccccugagcuugugaguccuagggggcagagagcugucccagucagcuccauccucagcacccaggacugacgaggacccaccauuuacacccugguaacagauggugcugacugaugggggagagagggcucugggggcucccccagggcugcguggaccauggugucagaucaagcaugaggcucuuccuuuuuuccuuucuucuacugccuaccagcuccuugaaggcaccucuuugugcagugggaaugucucuuaggagaauugucucucugguaaucugugcucagaauucagccaauuuugguagucacaagcccgccuggaggguggcugaaggggaagacaagagcagugaccccucaggaaggccaguucuuacccaggaggugaguagcagcaucuggucuaccagggucugauuuuggaggcugugccuccaccuggaugggcaggaucuaagcagggaccuuggcuccaccagagaugggcauugucucagcccaggugggcgggucuggguaggugggugucuggggggcagugucuaugcuugaagugggugaggucucaggaagguuuuuggagcaaguuuaggggcaagggcaauguccagggucucuguccaaugaccagggccucguaccuuggucagggcagaagccccacuugcggucaucaucguaguuggcuguggucgcacaccacaucuuuccgucacugcggccggcgcuggugcagcucucauauuuguugcccaggaaagugaaggggaagacacagggggcaccuucugaguucccaccaacaguggacauggcugugggguuagggauacgggucaaggcgcagcaaagagucugaggcuaccaccaggaagcaaugacaugacgcugaccuuaaugaaccacaccuaaguuagacucagucccaggcacuguaucuuuagacucaucucacccaccccugacaacagccuugugcaggagggacugaauagcaccgcguuucauggaugggaaauagaucagagagaugaugaaauuucccuaagccaacacugcuaggaaguaucagagcugcaauucaaacccaggaagccagauuccagaguucuaaugagccucccauggaagggggcagaugggcuaggggcaaagggaguuggaugaagcugauggcaccagcacaugccccucagcugugagcccccuugggcagggcuuugcagagaccaaccucuguguaugcugcacaaagcaggcgcucaguaaauuccuguuggaggaagggaagaaggaaaggagggagggauagagaggagggcaggaaggagacagggaggaaagcacggagcucuuaauaaaaaacagacuaaaagguggagauacagaccaggaaaggcagggaagagagauugcagggucagagaggaggagagagaagucucugccagagagccugagagaaaagggaugcaggucggucagaggauccugagcaggccugacauuuaagugucaccaauucaacuguugaugcccaaugucuguucugauuucagugcccaggccauaccaggugacaaguauccugacuagcuacacggacaucuugguguggaugucauucgcacagaugucuuagcaccccugucuuggggaaaggaggugggcacucggagucuuauggguuuuuuuuuugucagacagcaggugcugggcccugagggagggagagggaguggcacccaccggucucagggcagaagccauacuucuugucgcggucguaguccucaguggugccgcaccagcgguagccauccgugcggcccucaguggugcagcugucauaggaugugcccuggaagcggaauggaaacuugcagggcuguccuucagcguugccgcccauggugaacagggcuaagggugggggagagagggaaggaugugaaugagacaugcuuccaugggcacagggcuggcuggcugcccaccugccgguucacaccagugaaguugaugcauuguuaaaauauuaagaaaacaucucuacugguugguaaggagcugcuucucugagcucccagagagaaccccugcuucccugguuaucccaaucccucccgugggaccuuguggaccacccaacaacaaaaugauugacaccuggcacacagcaagggcuucuagaacccugccucagccccaagggcacuguccauucugccugguccacaccuguaccaugcaaauuucauguaauaaugauguaugacaugaauauaucagucauggcaggcaggaccacgagaaucucucuccauuugauagguggagaaaucaaggcuaggacaaagaugguucucaaacugcucauggucacagaaaugaaagaagugaaugaagguuguaacuaaaaacuacaaaacacacuaaucucaaucucucuugcuuagucugucacucucauauaugugugugugcgugcacacgcauacacagaaagcuugcuuuaccuccugucaaccccaggccccuuccuggauggccuuguugcagucucuguaggaaggagagaaagaaugaagaggaggagggagggagagggagguggugccuucaggucccuuuuacuaaacacucugggcuccuacuuugacaucuucaagacaggggccauaaauggagaguugggggagggagugggguucagagccuggccugucugucuuggauucuccccauccuccccucauccacccaaagcuaaaaaauggugucucuggaauugccaaccagcaaaaccacaaguccauaacaaggaccaucugugcacaacggcgccagaggugaccucaccagcccccguuaacuccaccauggccggaauggagcccagucccuggccucccaccacagaacucgaggcccuguauccucaccacuccccucucuaccaaaagaccuuguccugcaaugccagaaacaauggcaccuagagaaaaggcaagacugaguccagauaccuuaguggccucagaguugagaaaggcaaagcguuaacuucgaccaaugccagcccccugccucugaccucucauuucuaccacccaggaagccccugucuccucccaaauuccccugacaaggauggcaagaaucagacacugacucagccaucagcaggggcugaguaacaacaaucucugccucgagacccagacacgugcguguugugcguacuugcaucuggcuaagcacaaaguaaauggcuaauguccaaugcagggaauaacccuucccaaauuuaugaaauacagcuguuuccacaucuaacuaucaccaaagcuuucuguuccuaucagaggggugacacagggaaggguuaacgccacauguaaucccuaccgggaaacgcaagauacaaaaaauauuuuuauuucaaaaugucugacuuauuaauggugaauggcuuaaacucuuacuuaauauaaaguuuagcucugguaguaaaagcauaaacaggaagggaauuaacuagcucuuuguuucuuucauucugucaagaugguuggugcuuaguuuucaguuacagugggguuagggagauucacagacauaaaauuacagacaaaaagacagucuuuagucuauguagacuauagagucuuugugacaugggaaagaagauaguguuaaaaauuuuuagacuuuuuuccauuuucgccagguuuucugggcuuucaaucugcagaauuaucaaauaugaugacuucauagaguaugaaguuacauugucuuuuugugauuuaugacuauuaagugugucaaggauauuuuuaaaaaggauugaguguguaugucaauaucuguaccccauuuuaaaagauuucccccauguggcuucaaaaucucugaaauguugcaucucaggcacugacaagcacacaaacacaaauacugagucaagccuaaagucuuuaucaagacacagagaugcagacacaagcuagacaggaggcagaaaaagacagugcccaagagaggcagauaguauagcccccgugcccagacacacacacacacacacacacacacacacacacacacacacaggcacacacacacacacacacacacgcauuagcagaggcagcaucaggaccaaggcaggagcaauagcugaaauuccucaguuggaguacgcaaaccagguugaguccagcccuggucugaguccugccucccuaucacacugcuagguuuccagcuaccagcaagccuuuccucaugcccuugaaguaucaaucuugacugaaguguaaagacugguucuagagagaaccacugggcauuguaauaguucuaaguucacuccaauauauauuagaaauaaauaauuagcaaaucaaaucugugacuuccuaaaugauugcuaauggugaaacuuaaaaaaaaucaacuugauuuaauuagaguacuacguucaucaugguacuggugggagagaaacagcaauggcucagaucaggaugggggggaacugagugaaggacguuggagggaugcucauuaacuggcaguggcagccaguccuggagaguguggagggaagagcacacuggggagcccgggaagcuggaggcuugggguggaaagucuuggggacuagaguggaugcucaccuucauggggacagaagccguacuugccauccuucucaaaguuguaggugguggagcaccagaggaagccaucgcugcggccgguaucagugcagcuguuguacuccuugccauugaacaagaaggggaacuugcaguacuccccaucggcguucccauacuucacacggaccacuaaagagugacauggaagggggagguuggacuucuccaggccuucuuuggagaccaagauucugacucacccagaugugugacuuuccuccccucccaccucucugguccaagcaaauggaguggagagaggacaggagagaaggucuggggcaugcagagggccccuuucucaccuuggccuucucccaagguccauagcucaucgucaucaaaaugggagucucccccaacaccagugccuggggcgaaggcaugagccaggaguccguccuuaccgucaaagggguauccaucgccaugcucugaaacacacacugggucuuagcgucuagcugugccaccuagacccugaaaccccuccacaccccaucuacauguggagccugucagcccacccagcaucuguccccuucccuugucccagugggguuauccaggacugucaacaggagcucaguagagaucugcugaccugguuguuaccauccuauggucuacacugcucucccagguuuacaugacucccaguauccauacccucuaccuccauugucuacucuaccaccaugacacuauauguaccacauacccacauuaccacacuaguguccucaccccaucuucaucauccccagugucuaugccauccuccauccugucaauacugcccucuuaaccacaauccugccuucaugucacacuaucaccaauaucugcaacaugaauccucaugcccaccuugucaccaaggccuguaccacccacccacuugucuacauuguuuccccugcucuuuaccuucaucacuuaccacucagugucuauaccacauaccuuuaugucugugcuacuggcaguguucacaccauaaacucacauggccaccuggccccagguucuacgacccuuccucuagugucuacacugcuccacuguuuccaaaccacucucauauaucuacaguuccucagugucuaccagcaucauccaacagagcuuucugugauuaagaggaauauucuuugucugugcuguccaaaaucaauagucacuagccuccugugucuuuugagcacuuaaaaugugcccagugugaccaggaaacuaauuuaaaauuuuuaacuaauuuaaauuuaaacagccauguauauucugccuaauggcugccauauuggacagcacaguagaccacuugcuucggguuuagacggccuccagguuauaccacaacacaccaucugcccccaugucaacguggcucuccaguguccacuccguguugugcugcccccaucuaaaccacccccagggcccacaccaucuacuguccuaucuaagccgcccuuaggauccccacgccccucuaauguccaucucacccccucgucucaacacugaucccugcuggccccucuucugccccaucuucugccuaccccagcggccaaaguugaucaugaugucugccucuccaucauggauucgagaaaaccgcaguggggucacaucgcuccagacuuggaaggcacgagcaaaggcaucauccacugucucuggguccagaucagguguguagccaaugauccuggaggugguagaacugcaugugaguguguaugcaugugcauaaguguauguauaugcaaguaugugugugugcacagauguaugaaaaaguuugaguguguguguguaugugaacauacaaguauaugcacaagcacgggaagggugcacagguauguguauguauaugugagcaugugccugcguguauguguguguaggcugggcagggcucacugccaaggacaacccucccagaaugccuugaagacccagggagucccaggccagccaacauuuuuaggccccagcucaggaguuccaucugucacuucuggcuggugggggagggccauaaguagugcauuauggggcacagggcaaagaucccaccauuggaacccagcaccacccauacagagcacagcucuuggcccaauuagcaaccaguuauaacccaauugggcugcuaaacccaauuagcuaccaaucaucacguuccuucugcccaucccaaugaccucaucuaaaaacaauaacaaugacuagcauuacuacacucuugcucugugucaaaaaucauagaagccguuuguauuaguucagccuagcuuaguuccccaacauaccauauaagggcauuuuuuaagccccauuuuguagauuggaaagccaacauucacagcacugaaaaguaacccaaugucucauggccagcaaguaugaaacucaagucugucugacuucauuuucuaagaacuguguauugaaacucccuaagaugucaagccuucacaaaagacaccucauggauccccugaguggagagaaugcaugggucaaggagacucgugucccucagccccauggcccugccuccccaagcccugccccggcaccuguaugugaucugguucuugucccacuugggcuugcgagggaagaaguuguaguuggccacaucuggguugccgcagcguggcuuccgcauggucucgaugguauucuggucaagaucaccugucuggggcaguccaaagaacuucugcaucuucuuuaguguguccuucagcacaaacagguugcagcucuccuuggggcagccauagaagguguucagguauugcugaaagaaaugcacacccccaaggcaauuagccacauuaggauggcacaguacugaccaaagcaggcuguagcaaucagccccccaacccagugccauaguccagacaggaaauaagccaggggucccagagcacuggguggaguacuggguucccaaaccagcacggucacccauuaguugagcgacaggacauacagcuauagagagcauggcuaccacuuguuggugcugggugcugacuauauguccaggcacuaaagucagaauauguuaacucauuuaaugcucaaaacucuguaauguagauauacuaacccuauuauacagaggaggaaacugaagcacagagagguuaagaaacuugcuuacgaucacacaguucacaaaugguagaucuggauuugggacaaagcaaucuggcuccagaggcugugauauggaaucauuauacuccagcauccuuccuuuaccucuaucaacucauuuaucuaccuugcggcuggugacuuggggacuuuuuuccuccuguuuucuucuaaagagauucaaggacuaugugcaugggcucuggcaguagacagaccuggguuuaaauccugaaucagccauuugcaaaaagaaaguaguccuguccuucaugagucauacaacuggcccugcccaaacugaggcccaaacugagcaggucccugcagagguucagggagcaaccgacucauuuauuuauucaacaaauacuuuuuaauaccuaccauguaccaagcccagugcuacugcugaggaaaaacaggugaaaaagauagacaauucugucucuaagguucaaauccuagcagggaggcugauagaucccaaauaaaacaaaaugaaguaugugauaaguacuguguuagaauguugaaaggagccaggagaucuucugacaacgguccuagccuuguuggaaguaguuaggaaaggggaaauggaggacauaacaauaauaauaauauaauagaauaauggcuagugcuuauugaguacuuaccaugugcuagguaagcaccuaagauuaccucucuuuuaacccugagauaggaaauuucccaguuugcagaugaagaaacugagaagucacuugccuaacaucaucacuaggccagcugguugguucaugcacucuuugauuugaagccaagcggucuaaguccagaguuaucuucuuaagcccccacugcauugccucuggacaacacagacuuccauuugucagagguguucaaaccaggcaccuccaucuugaguggggggcuggguaagaugaggcugagaccugcugugcuucauucccaggagggcaggcaugcauucuuagucacagaaugagacaggagguugguaggacugauuucaccauauacaguucgggucacaaagaccccuaugauaaaacaggaugcaguaaagaagcuggagaaagcccacccaaaccaagacugcaaugaaagugaccucuagucguccucacugcucauuauaugcuaauuauaauguauuagcauguuaaauacauuagacacucccaccagcgcugugacaguuuauaaaugccauagcaacauugagaaguuacccuauauggucuaaaagggagagaaacccucgguuccaggaacuccccacccuuuuucuggaaaacucuuaaauaauccaccccuuguuuagcauauaaucaagaaauaaccauauguauacucaguccagcagcccauucccugcucugucuauggaauaaucacccuuuuauuccuuuaccuucuuaauaaauuuguuuucacuuuacucuguuggcucgcucuugaauuccuuccugugcaagccaagaacccauguggcccccaggcugaaccccaauuuagggguucauccugugacccauuggcuggaaaagguguaggaaaccaaguagcuuugucauugucccaaagcuccacucucacccccacccaacagccacaucauuaugccagccagcuccagauccuugaaaaaaguagcccucuaaaaauguauggagguuucccaacccaucuauccagagggggcugagaccuagcuguuuggaagggugagaguugggagaggguaguugucaccuccugaaggaguuccuagggugaccagagggcaugggcgucuucucccggacagguugagggggaggcuggagggcaggguggcugaagcaacaagggagcagauauccccuggacuggaaaggacaucuugaugggucccuggccugccucucuccucaggcccuacuuacgcaacacugcggccaggcucagugccccuccagccaggcgcgcgcacgcucacaagacaacaucugaaccgcgguuugggagcccagccaggaaggagggcucucuggccgcucuccgacccgagcggagcgcaguccgcccccgccccacgcgccgggcccuccagcgccugccccacuccuccucccuccugccgggccagcucucuccuucuuuucuccgacccuuuggagaaguucgaggaaacuuuccgaggcccagcccuugaccaauuuguccauuaagccaggagaaaaaagaugcgcucucugcuucccuccugccccaaucacuucccaaauggcccccucgagcuguuuguuuaaaggucccucuccggaucugugccgaagguuccuagaaauuugccaagccccgcuuugaccaagcucccucccauccuuaugcgcgcauaaguuuacccaaauugugugccagagcaccguucccaaaguccuacauuagcaaaaacgaccccuguagcuguuugccaaaggcuuaccuagacgcuuggcaagagcccuuagcaacugcccagauguguccaaaaguuguuuacaaagaccgccccccccccccgccaaaugucccagauacuagaggauguccccgcuauuuacauaagagucccuuuccaguaguuugccaggucaccccucucccacucucuggcuuguuuuucgccccacugcuguaugcugaagguugccaaauuguuuaucaaagguuuucuuugcuuacaaaagaucccccaccguuugcaagagaucacuccaauagcuugccaaagaccccccaagcuguuuaccgaagccccucccccacgcugugugcccaccgccgagggcagggggagagacacccccauccuuugccuccgaaguuugucuaaacgugguuccuugaggccagcgcagcaacucaccacugccaacucuuuguccguuuugggggcgacaucgccggggaacuugaugaugggcgacggcgcggcggcggcguggcucagcaggcagcccaggagacagagcgcccucaggggacccgugagcgcgccccgggccauuagcgccuccaucguagcgcucccuggccccgcgcgucgcccgggggucgcuggcucggugcguguggccgccucgccgccugguuggagccugcuccgcggcgcagggcugcgcuccgaggguccgcuggcucgguggccugggguuugcccggcucagcggcucaugguccggcccccgcgccccagcccccgccgccgccgccgccgccgcagguccuggcaaucccuuuguauguuuaaagccccagaugcgcagccuccagccaccgccugaggaagucuggaugcagcggaaacaagggagggcagccgccagauguagccggcuggg

SEQ ID NO: 21258 - RNA, 28070 nt, Homo sapiens
auuacaaaugagaaaaauguuuauuaagaaaacaauuuagcagcucuccuuuagaauuuuacagacuaaagcacaacccgaaggcaauuacaguuucaaucauuaacacacuacuuaaggugcuugcuuacucuacaacuggaaaguugcugaaguuugugacaugccacuguaaauguaaguauuauuaaaaauuacaaauuguuuggugauuauuuugaugaccucuugagcagcagcuccugaaaggaaaaaggagaaaagcaaaucuuugaaagaguaaacuucaagaguuacauacucaauucuguaaagaaacuuuuccuuuucaaaagcaaagguguuuuaaagugacccaaaacagaugcaguuagcuuacugagucauaucaacauaaaagccuauaauucuuuuuguuauuaaaggaaaucuaaacaguagugugguugaccaaacuuuaaaggauacacacaggcauaaaagauucucaaaggacacccuacugcugcauuugaauuuuaccuuguaucuguuuuauaauaaaaaaggagaaagguauauuuguucugaaugcauuuguaauuuaggaaggaucuauauuaaauaucgccagaccgcuauauuuacucaaaacaaaaaaacuacuaagaaaaaaacuugugcaucuucuauaaccugaagauuccucuuucccaaauauucauggacuggauagaauuuuuuuuuuuuuuuagacuagagucucacucugucacccaggcuggagugcaguggcgugaucucggcucacugcaaccuccuccucccaaguucaagugauucucuugccucagccucccaaguagcugggauuacagaugccugccaccacaccuggauaauuuuuuuguauuuuuaguagagauggaguuucaccauguuggccaggaugguuuugaacuccugaccucaagugauccgcccaccucagccucccaaagcggaggccuuacaagcauuagccaccgcgcucagccgacuggauagaauuugagacuacugugcaccaaauacuguucuaggcaguagggauacaguaaggaaaaaagacaagaagauccacuuacccucaugcuacuuuuuagcagcaagagagagagaauuuauuuacaaauaaauagaauguguaguaugucaacugaccauaggugcuaaggagaaaaagcaaauaagggagauauaaauacaagagaagggguuuguauuuuaaauaggagagucagggauggcaucgcagagaagacagcauuugaauaaaaccugaaggaagugaagggauauaauggcacugugcaaaaugauuacagaaugcacagaaguaaaaaacaaaaaaaaaaaaacaaagaaaaccuucaauuuauacuuuuuucugcuauaguuaagucauccaguccauccaucuggcuguaccucuucuuagauucuggacugcaucugaauaaauaauaauuugcccuuuucugugaauuggcagaaaauuuugcuacuuuggcacaagagacuacuugguuuuaguuuaaaauaaauuauucugaaucaggcuuuaauuuggauuugcuuagaaaauaguuuucuuaggucuguaugaugcauuuacauuuugaacacuucaaauauuaauuagaccuaaaucugccuuuaaaacauucaacaucuagaaggaaaaugccacaagcuaauagcucagucuacaggagaucacaggacaguaauuuuuuuugagggguguuauggacugaaugguucguuucccccucaaauucauauguugaaauccuaacccccaguguaauuguaugaggauagggccuuugguaggugauuaggucaagagcguagaaccuucaugaauaggauuagugcccuaagaagagaccccagagacuucucuugccauuuuuuuuuucaccaugugagaacacagaagagagagcugccuaugaaccaggaaaugggcgcucaccagaccugaccaugcuggcacccugaucccagacuucuagccuccagaacucugugacaaauuuuuauuguuuauaagucuaugauauucuguuacagcagcccaaacugacuaagacaagggggaaguagagugagggagggaaguaaagggagcuuuuaugaaagacaugucauuuuugaguugggucuugaagaacauauagguuuuggacaugcagaaaaacauauuuuuaaggcaaauaggcacagaggagcaaagaucuaggagcaggaaaucaaagggcauccuggggggaaagcaaguaauaugauaaaaccaaggcuggaaaggccgaguggaaccaaaacacaggguuuuuuaacgucaagccaaaguccuuggacuugcuuggaggacuguuguagaguguuauguauauugguggggcagaggguuaguaaaaggacacaaucagagcuaugcuuuagaaggauuaaugacucuuaaggaguuuaaguuggauggcagugggagagauggaaggcagggagaccaguauaggggcaacugaauaaauauccuaaccugagcaacauagugggacccugucucuacaaaaaauugaaaaauuagccaggcuuacuggcacaugccuguagucccagcuauucaggaggcggaggcgagagaucacuugagcccaggaguuugagguugcagcgagcuaugauggcaucaauacacuccaaccugggcaaaacagugagacugcgucucaaaaaaaaaaaaaagaaagaaauauaacauccugcuucacugaccucccuaauuaaaauagcuagacgacaaaacuuuguauuaaaauaguaacuguacuauguaacaacaggugagucuucucauauauggaacucaccccccaagaaugcagcaaugguauguggcucagcagcuccauaucggcaacuaaaggagaccacagagacaugaauuuugauuagccuuaugacagguguggaaucaucuccuagauacccuaaaaaauacucacaauucguggacauaaucaucuuucaccauuacagauaaaccauauuccugaaggaagccagugagacaagacuucaacuuuccuauaucuucuucaacuugauaguuagauacuccuaaaaauaaaaguuaguuuucauuaaaauaaaugugauucaaaauuaauggccaacuccuuuauuuaaucuaguuucagauguucuagucaaaauauguaugaaacugaagaacaaaaauaacaaaguaugagaccaauauuugcacauaucacaaaccuauaaucagagaccaacuaaaaccuaguaaaaauuugaauuuaauuaaaucuuuauuaauugcaucauauucacugucuagaaaagcaucuggcacauagugcuuaauaauuauuugauagaagaacuuaaugaaugagaaaguaauguccuacuuauacccuuuauaaaaguuauucuccaauucuaaaagacuaaaugauaaaugacacugaggacauaaagcuauuaauaauagguaacuuuuuuuuuuucuuuugagagagagucuugcuguuaccuaggcuggagugcaguggugcagucucggcucaccgcaaccucugccugccggguucaaaugauucucaugccucagccucccaagaaacugagacuacaggagugcgccaccacacacagcuaauuuuuucuauuuuuaguuucaguguuggcuaggcuggucucgaacuccuggccucaagugauccacccgccuuggccucccaaagugcugggauuacaggugugagccaccaugccuggccaauaauaggucacauuuauugagcauuaauagaugcuggacacuguucuaaggaccuuauaucuauauuaauugauugaauccucaaaacaguccuaugaaguauguauaguuaucuccauuuauagaagagaaaacuaaagcacagagagauuaaguuacuuagcucauaagugaugcuguaugacuuccaaagcuaggucauaaaaagcccuguaccuuccacuuggguuuuuuggaauguuaacugcagaagccaacugacaugccaaaaggaaguccaagcuagccacgugaagagauaccugaccagccgccagcuauucccacuguucugacuaaggugcuaguuacaugaguaaaaaugucuucuugcaugucuaacucagucagucaagccuucagaaugacuccacccccaggcucaagcaacugcaugccuccccaaggagaacugccugagaccaggcaacccacaaaaucacgacacuauuuauuguuuuaaaccacuaaguuuugaagugguuuguuaugcaacagauaacugaaauaaauacuaaucaaauaauacaaauaaagcaauacauauuugguguuuauucuuuuuuuuucuucuaguaagcuugcuuguuaggacuauaaacucugggcagcgcaguggcucaugcguguaaucccugcacuuugggaggccaacacaggaggaucacuugaggucaggaguucgagaccagccuggccaacacggagaaacccuguuucuacuaaaaauacaaaaauuagcugggcgagguggcgggcgccuauagucccagcuacucgggaggcugaggcaggaaaacugcuuaaacccaggaggcggagguugcagugagcugagaucacgccacugcacuccagccugggcgacagagcgagacuccgucucaaaagaaaaaaaaaaaagacuauaaacucuggagacacacuguaucagauggagcagcagguuuuaugauaccccuagaauguguugcuaugcaauaauccugcacaauuaaaauuaucaucccaaagaaaaauauucugagcaaccucagaucuuugagauuaugccaauucuccaaugacuacauuugcugaagauaaaaaguagauaacuaaacaaagaaauuccuacaucuucagaguuauugaguucagaaauuaguagcauacuuuuuuuuuuuuuugagacagucucaccacagucacccaggcuggaguuuaguggcacaaucacaacucacuguagccccaacuucccaggcucaggugauccucccgaguagcugagucuacaagugcacaccaccaugucuggcuaauuuuuuguaucuucaguagagaugggguuccaccauguugcccacgcuggucuccaacuccugggcucaagcaaucugccugaaucagucucccaaagugcuggcauuacagacgugagccaccguacuaugccuggccagcauauuucuuguggcuuuccuauuccacuaaauuaaacucagugugagucuuaguaacaaacuauggaaaaugacagaaaaaaguuuucuucuauacauauucaaccaacaucccccuguaauaguuuagaaucgaacacuauuuugcaaauaguuaaacuuaaaaaacaaaaggugguucuucacuggggaacguuugggguguaaucuguuuacaaugugaaauucaagcaacacuauuauaaauacccugagaacacuuucaauuuaaauguuuuauugaagaucuuauuauaucugguaauucaauugcuauucuuaccuggauaucuacccuguuguuuaugaaaucuaucaacagcccguaacauuaaguacaacacuauuucauuaucuggauuguccaugcuagaaacugaaaggaaaaaaaauuucaguuuaauuugguuaauuugcaauguaacaaacaaugaagggcugaauuuacuauauacuugaguuucaggacuauuaacuggagucacacaaucucuacugaaguaguaacauacugacuuuaacucauacauaucacacaauggacucagugaccuaaauaugacuuuaugcauacauuaaguuucauauaauauauaaauuauaauuaccuagauaagcuuagaauaaaauuagaauauguuuacguuaucuuuaauaucaucaccauauacucaacacuauuauacacaaaauauuuauaucuuuuaaauuaauuaaaauuaacccagaaucagaaggcuauuauacuuacuaauuucauccuuguuaauuguauccaaaccauauucuucagcuaaggaucgacaucuuaccacucgaagaaaugcagaauugcugccugaacagaggaaagauauucuggaaguaaugacugugacuggugaauauuaugaaucacaggugacuuuaagaacagagaauuauguguauacccuucucagacaugagaaugugaagaaauguuuucuccuugguucuaauagcagagaaagcacuagaacaugaaucaccuuaaauuuauaucccuggcacuacaaccaguucagaagcaaguaaggugauggccucucugaaccucaguuuucaaguguaaaauggggaugauacuguuuaccuuugagaauuguucuacagauuaaaugugacaucuguauaaagugcaucucuagcacaaugccugauauggcucuaaaaauaauaguuuucaucauuauuauggauaaguaguccuaaaggagagagguuuaugaauuguacucuugauauauguaaugacuuuaagcuuuguauuauugaaauuuucaaaaacgccccaaaguagaacagaauaauaaauguucaaauacccagcaucaaacuugugaucuaguauuauauaaucuaauacaacaaacgcuaauucaagauuagucuaauagaacaaacaaggugcaagauuaguaguggcagaaaacauuaaaaccgagccuaaacagacauuguggagaagucauaaaauggaaagcuuggauaaaucuauuuuaaggauggggagcaugcaaaauauaaacuuccacaggacguaggagcaguagcuacagggagaaaucuucagauggcaugcacaacagauuggguauuuugaaacugacucuuaaauaaaagaaaaugcuuuuggccuacugaggaguuacugagaagacuccuacgaaccuaaccacuccgaaacuagauggcaaaauucuuaacuccauuacagucauuuaacacagaucaaaaugaguauuuaaaccaauauugucaauguacaugugacucaagacuucacacccaaagucuucagacaaaaaaacuuccuaaauuacuuaaaauuuaaaaacugaaaauccuguauuaauggcaauuuucaauuaacugaccgucaagccuuuuuagcauugccacagauaaacauguucuaccucugauucagucuuaaaauacucgccauguauuguauuaugagaggaaaaaaaaaaccuuacccaauaauuaucuauaucuauaucacugaggccauggaaaacuuaaaauuucaaccauucaaaauaccugggaacauucccuguggcacauuucuaucaagcaaaauaaggaaauuaauucaaggggacuuacagaguaauuuuaauucuuucucugaaauggacucuggugccuguaaagagauaaauacagauucuguuccaguuuaaaagagaagauuaacaaagggugcggcacaaagccaaucacugugagaugggaaggcuuucuccaagagcugggagagcacuuuaaaaauaucuuguuuccuuaucacaagcuaucccauuaggcagggaaaugacagcucccucuaaagaagcacagaggcagugccacacccucugucucuaaacccuuucuggcuggaguuacgugcugaggccuguaugggcacagugugcccaguagcuuaccuggccaauggacugcagcaauuuggcaacaugauuacccacagcggcagcaucuuucuuugcuuuuucacgguaacuaaaaaagaauaaaaagcaauuacuaacaaauuuuuaaauuagcaaaauuuaaauuguuaccaugaacaaaaauuuucuuuccuuuucaugaaaaaacacaggucugacaauguaugaaaugugaaaaugccagggaaaugcuaucaacagcaccaugaguagcugggaaucuuuccaguguuagugacggacucucagugcccacuaaaacccagggucccucuaacagcacccaacuuaaaaacugcuccccuagagggaucuaugauuucggcuucugugacagaggaccugaaaaaauacauuacugaagaacaugacuuaucuccuggaagucaaguccaaggaaaguuaaauacauuaaaacuguucaucuccaauguaaaacuucuuuguuuuuugagacaggaucucgcucugccacccaggcuggaguacaguggcgcaguccuggcucacugcagccucaacuucccacgcucaacugauccucccaccucagcuucccaaguagcugggaauucaggcacacgcuaccaugcccgacuaauuuuugucuuuuuuguagagacggaguuucaccauguugcccaggcuggucuugaacuccuggguucaagugauuuagaaacugaaaauacuguauuaaugacaauuuucaauuaacugaccuucauaccuuuuuagcauugccauagauaaacaugcucuaccucugauuguuuuaaaauacucuguauuuauuaugagaggaaaaaaaaacccuuacccaauuauuaucuguaucuauaccacugagacagaccauggaaaacguaaaauuucaaccauuuaaaacaacugugaacaucccuuguggcacauuucaccacccgcuuuggccucccaaagugcugggaauacaggugugagccacugcauccggccauaaaaguuuucuuuacgucuauuuaccuuucacccucuaaaaaucaucaguguucaggcugacuaccucccauguaaggucauacuucuuucuauccucaauugaccuuccccaaguuuuaaguaguugaacucuuaggcuaggacaacaaaccaagauucguucaauggugacaugauaaagagugaaaucugucuggggaagagagaucaucucugugugacauuacuuggaccccaaagaaaccgagccagcagaccuggauucuuugcaccaugcccuaacuauacgagggucauauucauugagacccaucccugugauagucuaucuggguucaggcuagugauaccuggauagcaagaugucuagcuauagucauagacuauaacuuaugaaacauuaagauaaaaaauucaucaaaccuucaugguuuuaaguuacaaauacaagguaguauagggccauagcuaagcauacaggcucugguacuggguuuccugggguucaaaucuugguucugccauuuaccagcuaucugaccuuguauaaguaaccuuuucaauaccuuaguuucuucauguguaaaauggggccgguaacagucucucucucucucauaaggucguugugaaccuuguguguguguuaaauuacuuaauacauauaguucauagcacagaguuaagggaucaaauauuaaguuuaucaugaaguaugaaaaaaaacucugccuccuaggcguaugugguaauucuguauuucccauucaauuuugcuuugagcuuaacaagaauugcccccuaaguucuuuuuuuuuuuuuuuuuuuuuuugagacggacucuugcucugucuccaggcuggagugcaguggcacgaucuuggcucacugcaaccuccgucuccuggguucaagcgauuccccugccucagccucccgaauagcugggacuacaggugcgcaccaccacaccuggcuaauuuuuuguauuuuuuuaguagagacaggguuucaccauguuggccaggauggucuugaucuucugaccuugugauccacccgucucggccucccgaaguggugggauuacaggcgugagccaccacgcccggccuaaguucuuuuuuuuuuuuuuugagacagagucucacucugucgcccaggcuggagugcaguggugcgaucuccgcucacugcaagcuccgccucccggguucacgcuauucuccugccucagccucccggguagcugggacuacaggcgccugccaccacgcccggcuaauuuuuuuguauuuuuaguagagacaggguuucaccguguuagucaggauggucucaaucuccugaccucgugauccgccugccucggccucccaaagcgcugggauuacaggugugagccacugcgcccagccuggucuaaguucuucagcuuauuuuuacuuauuuauuugaaacagggucuugcucugucacccaggcugaagugaaguggcaugaucauggcucacugcagccucaaacuccugagcucaagagauccuucugccucagccuccugaguaguugagauuaaaggcgaacacuaccaugcccaccuaauuuuucaauuuguagagauggaagucucacuauguugcccacgauggucucaaacuccuggacucaagcaauucucccaccuuggccucccaaaguguugggauuacaggcaugagccacugcagcuggccuaguuuauuuauaagcaaugagguuguaauaaacuuucauuugauuucugacaggaugauaaaauguuuaucucuaauauaaucagacuuuuucuauuacauaguuugaaaacagugacauacacguuuugcaguuuuauauauuugccugaaucugcaaucauaucaggaauugugccucgaacagguaaauuuccuugacccucuuuggccacaaauuccuuuaaggcacgagcuaaaauccaaaaugauggagucuaaaagaauaagaaaaaauuaacauuaaguggcguuuuacuuugacccaaaguuuuagcagcaauguuuuuacuuuuguuguuguuaccuguuuggugauauuuaugcagcgaucaucauuaaauauaucuucaauacugcuugggaucuaacaaaggaacaugaaacauuuacuuacacaguauuaagaauucgcccaucuuuauuuucagugcuauuucuucagauauguucuuugaauucucaaauuguaaucaaauacaaacuucugauugguuuauaauuuuauuuagaaucaguaccauaugaagauuugauggggaaagaauggaagaaagaccucuccggcccacuguugcuaccauuuaauaccuauucucuuauaccauaaaugggguaaagaaggggccccaguaaauuauuuuauauaguuacaucugaagacaaaacagauuauagacucgcaguauaucaugauuuuccaucuugucaaaaaucugaaacccuugcacccuaauuagugaccguugagacaaccacucugaaaaaaacuaaaaccauaaaguaauuuuauugcuagcaagaucuucauacguuaaucaagaguauaaagcugagcacaauggcucauaucuauaaucccagcauucaggaggccaaggugagagggucauuugagcccaggaguuugagaccaaccugaacaaaacaggaagaccccgucuauagaaaacauaaaaguaaauuagcugcgcgugguggcacgugccuguggucccagcuacuugggaggcugagguggggggaucacuugagcccaggaggucaaggcugcagugagcagugauugugucacugcauucuacccugggcaccaaugugagacccugucucaaaaaaaaaaaaaaaaauacacacacacacacacacaaaucauaggcuuggauucuacugauggguggaaaaaagaaaugucucagugggaccuccuaacugcucucucugcuuccacucccaguccccucaauuguguucuccucaugaaagccagaauggucuuuuagaauacaaagcagcucaauccacuucccugacugaaaugcuuaaauagccugcaaggccuuuaugaucuggcccuuucugccucuccaaacucaaauccuuccuaccacuuuucccccuuuuacacuucacuccaaucacacugacuugcuuacugaugcuugaacaaaagucaagcuucaucccacuucugggccuuugcacaugugcucccuccaacugaaaagcucuuccaccagaccucugcgugucacuucacucaggcuucugcuuaaaugucuuuuggaaagucucccuggcucccuauguacaauugucucucaaccccggauucccuuguccccagcaugcucucugacccuuuguucugcuguaauuuuguucacagcaccuggugcauuuuuaucuguuuauuuagcuuacugccccccaacuauuagaaucuuuucuuuucaacugugguuuuauauucagugaaauacagagauuucaaauguccaauucaaugcauuuugauaacuauauauacauauuuuuaaccauaaccccaauuaaaacagaaaauguucaucaccccagaaaagugauucacaaagcacauuuauuuuuuggacacagggucucauaucauugcccaggcugcagugcaguggcacaaucauggcucacugcagccucaaccucccaggcucaagcgauccucccacuaccuuaggcuccagaguagcugagacuacaggugcaugccaccacacccaucuaauuuuuaaauuuuuuguagagacaagaucucccuacguuguccaggcuggucuugaacugggcucaagcaaucuuucugcccuggccucccaaaguguugggauuacaggugugagccaccacaccuggccagcaaacacuuuuuuuuuuuuuuuugagacagagucucgcucuuguugcccaggcuggaguacacugaugagaucucagcucacugcaaucuccaccucccagguucaagcgguucuccugccucagccucccaagcagcugggauuacaggugcccaccaccaugcccagcuaauuuuuuguauuuuuaauagagaugggguuucaccauguuggccaggcucgucuuggacuccugacuucaugugaucugcccuccucggccucccaaaaguguugggauuacaggugugagccaccgcgccuggccccagccagcacacuuuuaaucacucagcaacacugccuuguugucucuaaaaaguugguaauaauaucuuacgugccuuccuaacuugaaaggcagcauauuugcuguuuuaaguuacaagaaaauucuaacuuaaacuaccagguguuauuccaaagcuccccaaaaacuucaauggucagaccucaacaacuaagccauaacaaaaccaaaggcaucugaggcggagucuuacucuguugcccaggcuggagugcagugguguaaucuuggcucacuauaaccucugccuccuggguucaagugauucuccugccucagccucccgaauagcugggauuacagguauguucaccaugcccagcuaauuuuuguauuuuuaguagagacgcgguuucacuauguuggccaggcuggucucgaacuccugaccucaggugauccacccgccucagccucccaaagugcugggaugagccagcaugcccggcccuguauuuauuucuaacuauacauuuagaaaauauuaacuuaaaucauuauagucaaccauuuaauagccaaggacucuagaaaacaucuuguucaugugaaucccucagcaacucuuucauuaccugaguuguauuuagugcuguguucacauuuuuaauagcuucuucaaaauucucuucaucuucuggagccccauuuucauuuuuuagaauuccuauuguaaugggaaauuguuagcaaacagcccuuuucuuuucacucuucuguucccccauuauaaaaauaaccuugucagauccugcagaauauuaaaucuuaagaagaaauacggcuuaucauuaguccuuaaaacuauacaaggcguggcuucuuaacuucuccagaaggaaaauaaaagcucaugaugcuaucaucugacaaagguguuaacagaaauccaauaaguaccugccucuagcaauuugcuuuucaagcuuuauacaguauuuaaucauaucccauauuaccuugucuaaucaaaucucugaaguccucuuuuucuuuauacguuuuagguauucguccauuugucuaaauugguuaaaaauuuuaaaaaucuaguuauuaaaauucaaaauacagaaauugaaagucuaaagugucccccauucucuacauaagauuucaucaacaaauauauuucucugugaaaucagaggcucacuugauagaaaacagacacugugaccauuuaucuacauucauucccccugccaguuucauaaugacauuuauugaauuucauuuuaauuaaaauuaucaggaucaaaagaggaacugcuagauuuaaauuuaaaagcauccauuugcccuaccauacaacuccauaaggaaaaaaaauuaaucucccauuccccaucaaggaaauccuuuguaagaaacugaaaauacaguugcauaugaaauuuuuuuuaaaaaaggacauacuucacuauaccacugugcuaaauauuuagcuaugaucacaauccauggaguaugacugugguccuaaaaaugagagacaaauaaaagaaaauaucaguauuaugaauucuucacuguaccaucucguuuucaacaaauucaacaauauuuaugaucuccuaauauaugcagaguagugaauagacgaaaaugaacugaguuaauaaaaacugcuuuacaaauuuuucuagaggcagauaccuaguaugucacauauauacuaugauuguccccauuauaccagcaaaacagucucagagacugccacccaaaaacacagcucaaaucucaauuucagacaccaauccuaaguaagaaaggaggaucuuuucuguuuucugaugaaccaaauaagcaacugcauguuaauuaauauggaagugggaaaaaauacauauacgccuuauaguguuaugucauuauuucuauuuguuuagaaaaaguccauaaagagaacuucuuggaauuuuuuuauuucuguuuuuuguuuuaaaauuuuuuacuuucaauuuuuguggguacuuagguguauauauuuaugggguacaugcuuugauacaggcaugcaaugugaaauaagcacaucauggagaaugggguaucuguauagcauuuauccccucaagcguuuauccuuuauguuacaaauaauccaauuaaacucuuuuaauuauuuuaaaauguauaacugaguuguuauuacuaacuauagucaccuuguugugcuuucaaggaguaaaucuuauuuauucuuucuaauuuuuuuuugguacccauuaaccauccccaucuccccaccuggaauagguuaauguccaauuucuugaccuggguagugauuacacagauguucaguauauguacuuuucuucaguaaaaaaguuuuuuaauuuuggagaaaaauuaauauguugaaaacaagguaaaauacuguuauuggguaaucgggaugacaggaauauggaaguuuauaggauuuucucacuuuaguguaauucaaaaaccuuagguuaaaaaaauguuuuaagucuaucuguaaauguaaggucacacacacuaccaaccuuuuuuuccauaugauccaaaucauaggacugaaaauguucucucaguucaggaaauggcuuaucuagucguagauccucuaaugcauuaucuggaugagauucuauuacugugaaacaaagaauucaaaaggauaaauuuaacacuuaaaaaaaaaaaagagagagauggggucuugcuguauuacccaggcugaaguacaguggcacaaucacagcucacugcugaaacuccugggcugaagggauccucccaccucagccuccugagaaggugggacuacagucucgugucacugugcccagcuaauuuuuuuguagggauagggucucacuaugucacccaggcuagucucaaacuccuggauucaagggcuccuccugccucggccucccaaaguccuugcauuacaggugugagccaccgugcccagcucaaaagauaaacuuaauucuuuggcaauacugaugacaauacauugaauuauagaaacuuaggaaaucuuuaauuuuuaaauggacacagggcccacagguuuuuucacuguuuuauuaagguacgauuuacauauaguaaaaugcagaaaucuuaagucaacuauaaaguuuuaguaaaaguaaaaccaagauuccuuuagaacacaauuuguucuaacuggaaaagcucaacauugacaaacccuagguacagauagcaacuaacaaccuauccuuccuccucuuguggucuucaauagacagcaucaccaucuaccuagacuucuucuccagaaaccugaugggcauccuucacuucuugcuuccuuggccccaacaucaguaacuccccacuuccuaaucucacucuguacacugcucuccacaugagagaggacaggagaguguauaauuucagugagugcuuagagguaggcccaguucugucacuugcuaacuaugugaccuuaggcaaauaauuuaaucucucauugccucagcaucaucuauaaaaagcagauauuaaaguaucuacagauuguauaucucucuuauccaaaaugcuugggaccauaaguguuuuggauuuuguugaguuuuugguauauuugcaaauacauauuagaugagcucucuaacccaaaaaucugaaguaagaaauguuccaaugaguguuuccuuugaauauuaugucaguucucaaaaaguuuugcauuuuggagcauuucugauuuuggauuuuuggauuaaggauacucaaucuguaccuuauaaagguuuuggaaagaguaaaugaaauaauucuuauaaaggcaggcacacaacuaguaaugcugaaccuucauuauuaucuacccucucuucuucucuucccuaaauuaggaaaaagaacacacucucucuuacuuaggccacuggaaauuucuaacagcaaucacugccuccaaucuuugccccuuuaaauccauuuacuuuccacucaacuucaaagugacccauuuaaaauaaaauguuuacauggucacucucccacuuucaacucuuuuguucccucccaucaguugacaccacuuucaacucuuaaauggcucaccaccagcagccagagcuuauccugacaagcacucccuaacugcccacacagauauuacuccucagugaugcuaccaaugccaauggcuaucaccacauuagcagagugcuuggcucauaguaaaaauguuuucuugagucaauaaagagcacuguuuugaauacuggaugaaaauuuuaugaucaucuaagauuaaaauuuuauaaguaaagggcuuauauaaacccucagcugauggaggucugccuauaaacgacuuuggucucuuacaacaguuuccuugggaacaguaguuauguaaaugucuuuguugugugaaauugcaccugaauugagagaaccuaaagccugcaugagaaugaaauaaaagauuggacggaccuggugcaguggcucacaccuguaaucccagcaccuugggaggccaaggcggguggaucaccugaggucaggaguucgagaccagccuggccaacauggugaaauccugucucuacuaaaaaugcaaaaaauuagcugggcggccgggugcgguggcucacgccuguaaucccagcacuuugggaggccaaggcgggcagaucacgaggucaggagauugagaccauccuggcuaacauggugaaaccccaucucuacuaaaaauacaaaaaauuagccgggcacgguggcgggcgccuguagucccagcuacucgggaggcugaggcaggagaauggcgugaacccgggagguggagguagcagugagccaagaucgcgccacugcaguccagccugagcaaaagagagagacuccgucucaaaaaaaaaaaaaaaaaaauuagcugggcaugguggcgggugccuguaaucccagauacuugggaggcugaggcaggagaaucaguugaacccgggagguggagguugcagugagccaagauugugccauuguacuccagccugggcaacaagagcgaaacucugucuuaaaaaacaaaaaaaagacuggaguggggaaaggugguguaacuucaugggucagagugauccacauuccuuagcucuccacagccauacaugcccaauguggguuagggggcaaaagaagcuggguacuugcauaguugcuggaucuccuaauaagaugaagaagcugugccugugguauaucaugcuuuguauccuucuauaaugcuacauaaagaguagauugcagccuauugaaucugauugccacuuugaaucugcaacuagagaugugcugcuacaaauuuacuuuguaauuuaaaacugacuuucuaaauugucaaguuucuaaaauuauagcuaaagcaaccaauaguaagcccauaugcucaacaauuuuaccuggauguucuuuuauaaugauccucauauaaccaacuaguccauauguccuacagaucaaaagaggaaucugggaauuccagaggacaucugcuaagcguagugaagugcuguuuaaaaaaaaaaagcaaaauaugaacauaagcaaauggaaauaugccaaacaugaaaacaugcaaaacaugaaaaugucuuacagcaacuuucuuacuaaauaauagaugcaaagguacauaacugcauuuacauaagcaggucaagaacacacugaaaagcaagcauuuccacaggcugcagucucaaagaaaguacaucuuuggacaagagggaugugaaacuuuagucugucauauuaaggagaaacguuaaagaaagauaauucuaaacauuuccaugauagagaaaaaauauaaaacccacaaauacaccccuaacaauuccaauaaccaauucucuguugcccaggcuggagugcaguggcaugaucauggcucacugcagccucgaccucccaggcucaagugauucucccaucccagccuccugaguagcugggaccacaagcaggcacaccaucuggcuaaauuuuguaguuuuuguagacacaagguuuugccauguugcccagguggucuuaaacuccugugcucaagugaucugaaccugucucagccugguucugcuggaauuacaggcaugagucacugcacccagccuucaauaaucaauucuaacuaguuuuuaaucacuaaaacaaacaaagaacaaaaacaacaacaacaaaaaaacaauguucgguuuaacugcucuaaauauauuccaaaaguuucacaucuaagguuaggcuugguggcuccacaacuguaaucccaggacuuuggguggcugaggcaggcagaugacuuggggccaggaguuugagaucagccuggccaacauggugaaaccccgucucuacuacaaauacaaaaauuagccgggcacgguggcacaugccuauaaucccagcuauuugggagacugaggcacgagaguuaccugaacccaggaggcagagguugcagugagcuaagauugugccacugcacuccagccugagcaacagagcaagacucugucuaaagaauaauaauaaaaaaaaaaguuucaguauuuuucucuuccucaucuuuucaaugcuggaagauuucuaagaauuucuuuuauuuauuuauuuauuuauuuauuuuuuuuuuuugagacagagucuaacucugucacaagggcuggaguguaguggcacgaucuuuggcucacugcaaccuccaccucccugauucaagcgauucucuugucucagcuucccgaguagcugggacuauaggcgugagccaccacgcccagcuaauuuuuguauuuuuaguagagaugggauuucaccauguuggccaggauggucucaaucuccugaccucgugauccaccugccucggccucccaaagugcugggauuacaggcaugagccaccgugcccagccauaaaucugaaacucuugaccaggcacguuggcucacaccuguaaucccaacacuuugggaggccgaggagggugcauugcuugagcucaggaauuugagcucaagcucaaaaaaaaaaaaaaaaaaaaaguuucauauuuaaaguuucuauagaauuuaacaauuuuuaaaaccauaucaucauagacugugcaaagaaaauaaaacaaugcaaaucuaauaagauuaaaauaaaaacauauuaacauaaaaauuuaccuuucaggaagcugaguugcaacuacaacaguaaaccuacagaaaaaugagggaucauugucuagaagguuuucuggacucuaaacaggacagcaaagaaaaaaacaaacaaaaaaaaccaauuucacaaucauauuaaacauggcagagacaguuaagcuauuuuacaacaaaugaggcaacaauuccaauucaacuaaucauaaaugacacaaagauucaaaauucuaaauuucuggggcuuugaauuauuuaaaaaauuguauuucagcacagacauaauaauguguguacauauauaccucuuccacaaaacuuccagagacaucgcuauuuaauucuuguaagaauuccauggcagcuucagcucgguucuuuuuaaaaacaaagcauuuaacuugaauuagaaaaaacuuggucacaauauaaucccccaauuuauggaacaggcaaacauacuguaaaacuauccaaauuucaugcauaaguaugacaacucuguuucccuucuuuuuucuuuuuagagacaggcuuuugcucuguugcccaguuuguagcauaguggccugaucauagcucacugcagccuugaacuccuaggcuuaagcaaucuuccugccucagccucccaaguaggugggacuacaggcaugugcuaccaugcccagcuaauuuuuuaaaaaaauauuuuguagagacagggucuugacauguugcccaggcuggucuugaacuccuggucucaagcaauccuccugccuugaccucccaaagugcugagauuacaggcgugagccacugcucccagccaauucugcuucuccuaguguuuaagacucaacagaauauuacuuaaaacagagcaaaaccaucaucauccagaguucucaaaugacauuacuuguacucuacuuuuuugauuaggcaaaugaccaaaaaacucuggguagcaggcagggauauccuggaucaaguucagacucacucuaaccacccacaucuauaauccuguacaagagugguuaaucacuaagcuaaaagucauuucacuaaguugacuaacaugguuuuguaagauuuuuuaggcugggcgugguggcucaugccuguaaucucagcacuuugggaggcugaagcggguggaucacaaggucaggagaucgagaccauccuggcuaacacggugaaaucccaucucuacuaaaaauacaaaaaauuagccaggcgugguggugggcgccuguagucucagcuacucggaagacugagggaggagaacggcgugaaccugggagguggagcuugcagugagucgagaucgcgccacugcacuccagccugggggacagagcgagacuccgucucaaaaaaaaaaaauuuguuaaccagaaugaauauuaacauuacucaagauuuagcuuuaauacaggaugcaauguauaaacacagacaguacaccucuaaguucuuaaacuaccaaacauaugaagauuuacaagauuacaaaaauuaguuaacuuuuuucucagagaaauaauacacguuuuuaaagucaaagcuuuucaagcaaucaaaacacaggggcaucauuagaugcucacauccaacuauauucucuaauuguuuaccuugccgauacugcuucuuugaaggaagaaacuaaagugaacagaauaaaggaaaaaaaaguaaagcuuacugacuauaaaggaaaaguuguuuguaauagcaugcauauuucauucacaguauaaaacaaacuauauugugauuacagacuguaauggccuuccuggaggaagaaaaucagauggaacuuauaaagaaagauaggcuaauaaaucaauguuucuuucccaaauuguguaccacagcaugugaauuucacaagauccucugagagaaaaggguuccuuggcuaaaaacguuugggaaacaccggcgggugugguggcucaugccuguaaucccagcacuuugggaggccgaggugggcggaucacgaagucaggagaucgagaccauccuggcuaauacagugaaaccccgucucuauuaaaaauacaaaaaauuagccgggcgugguggcgggcgccuguagucccagcuacucggaaggcugagguaggagaauggcgugaaccugggaggcagagcuugcagugagccgagauugcaccacggcacuccagccugggcgacagagaaagacuccgucucaaaaaaaaaaaaaaaaaguuugggaaacaccauauacuauauuucccucuuggaaauucauaauacacauaauacaugugauacuaaaaucuuaugguaaagaaauuuuuacuucauuugauccauuucccaaacuaauuucacuauggaacccauuggcccauuuaacagcucuuaucguucccuagaaccgguguuccacagaccacucucgguguauugaaccauuuguuuuugcacguaacuguaacagauuuauucaggcuuccucccacacauacccuugacaugucucaaggcccagauaugaggcugcugaucagagucaggaugccacuuuucgguauaagcucacuggcuccauaagaagaaaccuuauuuuuaucacuuucuacucuaacccaccaaguaagcaaagauaacaagacuucuugguauauaucaauaaaaaagcugugcugugccuggcagaaacuggcacuacgauccaaagaaaaggcaucaaaacuaaauaugaacuaauugcugguuucccuuauauuuacucacuguuguuguuacugacaaacacaaugagagauaccagacuucaagucccugaaaaggugagcuuuaaauccaaauuugggcauguucugaaagucuaaauauaaucuuuaaagaauaauauacaggccaucuuuaaaacagcauuuuuguugacacuguaaagagagauaccccuagacuaagccuaaaagacaucacaaacaacaggcauuauuguuaauuauaugcuaacaccuacggaucaauacaagagcuuaggaagugcccauauuccaugaauaaaggaauaacgacuacuccuuuguauuaauaacaauaaagacaguaaugauggguaacauuuauuaaugcccuauuugccagaugcuguacuagcacuuuaccuauauuaucucacuuccucaccauaaucccaaacauaaggaugauuuccacugagagucgagucacccugacugaggaggugaagcuaagacucaggccuugccuuccuuaacgugaauauauuugaagagaauagaacauacuuguuuccagcaucuucuccgcugaccugauuuccaucaauaauuguaaacgaaccaauaccugagagccaaaacagagucagucaggaauacauaguucuaggucauaaacuuaaagaaguauauuuagaacacaaccacaaaccuacguuaccugguaguaccaaguuuuuaagaauuucaguuccuguggcuguugcauuuauuaggcaaacaugagcagauucuaaagccucuugcccaugaucaccccacaaccuacaaaacagacacaaauuugauguuuuuaaaacuuucaugaaaauacagcuuucuuauuugaauggugaucuuuaaacuuuccuugcauagacugauaugauaaccacagaauacagguaagacgggaacagauauuaguauagugauuauacaguaaucuagaacucagguugaugccuugaaugguuaggggaaaagagggagagggucaaauuagaaacagaaacuuggucuuccagccccuuaucagccugggcacaagagcgacacucugucucaaaacaaacaaacaaacauuuaaaaagcgucuuuggauuuaaacccucaucuguuuucuauuucauuuauucuuuguuuuguuuugagacagagucuugcucugucacccaggcuggaguguaguggcaugaucucagcucacuuggccucccaaaaugcugggauuacaggugugagccaccgugcccagcccuauuucauuuauucuuaaauuauguuagaugugccaggugcaguggcucacaccuguaaucccaacacuuugggaggccaaggcaggcggaucacgaggucaggagaucgagaccaucgugacuaacauggugaaacccugucucuacuaaaaaauacaaaaaauuagcugggcgugguggcaggcgccuguagucccaccuacucggaggcugaggcagaagaauggcgugaacccaggaggcggagcuugaagugagccgagauugcgccacugcacuccagccugggcgacagagcgagacuccgucucaaaaaaaaaaaaaauuauauuagaugcauuuaaguuaaguuagaugcauuuaagaucucgacauagggcuuauuacugugacuucugcaaaagcuuuaccaagaaaacugaauuaucaucugaaaagccucacaucaacuucuacaggagugcuuuaaaguauauuacccaaugaacauucuaauagagugauuaaugugccuucccuguuaccugauuuaaagcagauuaccccuuauuauguagucaguauguccuccagagcaugucaagcaacugccuuguuuuuuguuuuuguuuuugauacagggucuuacuauguuauccagacuggucuugaacuccuggguucaagcauuucucucgccucagccucuagaguugcugggacuacaggcacaagccacuguaccuggcuucauuuguuuuuguuugcugagcauccaucuuuccacuccacuguaugcuccauaagggcccagacagcugucaaauguauggaggaaucgccuagaagaaccagauggaccguaaacgccuguuuucuccaucaaaguauggcacguagaagacaccugacauauaugguugauggaugcuuagauaguuggagaguaaauuuaagaauacuggugcaucuuggcugggcgcaguggcucacgccuguaaucccagcacuuugggaggcggaggcaggcagaucaccugaggucaggaguuugagaccaggcuggccaacauagugaaaccccgucucuacuaaaaauacaaaaauuaaccaggcacaguggcacgcaccuauaaucccagcuacuagggaggcugaggcaugagaaucgcaugaacgcaggaggcggagauugcagugagccaagaccgcgccacugcacuccagccugcgcaacacagugagacuccgucucaaaaaaaaaaaaaaaaaaauacuggugcaucucaagcagggugagauagugugugugccuguagucccagcugcuugggagacugaggcaggaggaucacuccagcccaggagaucaaggcuguggugugccaauaaucauaccugcgaacagccacugcacuccagccuggguaacauacugagacccaccucaaaaauaaaacaaaaagaauacugaggccaggcacuguggcucaugccuguaauccuagcacuuugggaggcugaggcaggaggaucacuugagugcagagguacgagaccagccugggcaaacccccaucucuaaaacaguuagcuaagcaugguggcacaugccuguagucccagcuacucaagaggcugaggcaggaggaucguuagagcccaggaaguugaggcugcagugagcaguguucuugccacugcacucuagccacugcacucuagccugggucacaaagugagaccuugucccugaaaaaaaaaaaaaaaagaauccuggugugucucuaaguaacauguuucaagaauaggccaaaugaaucaguccucucuacuaucuugcuggcccaacuaacgugaaguaaggaggggcuuauugacugcugcauuuugcuucuaacugcuucccuuugacacuucaaaaccaguucucacuaugaaaguaaaguuugggacuuaaauggaaugcccucagcaaaaacccucuuuuguuagaguugcuuaguaaccucaacuaucuucucagcucugucauguacaguuauaccugcauuagaaacacaagaacuccaagaauuuacaagaaaaccuaaguugguuauaaggacuguuacccuguuucuucuccgaaaagcuuggaagcaggauguaacugaguaccuccgaaaaagccagaagagccuuaguuuacauccuggcucaaagauauggggaacucugggcaaauuaccuaacuucuccaagacucuguuucuccaacuguaaagcacaggaaaugguugcuuucaaggguacucucagaacuaagugccuaaagccucuacuacagcacuaggcugguggcgcaaacagaagcuccaguccuuggggacauauaacuucuguugucucagaggcuccaggaaggaggaaagcugagcagcuuuguuaucuccacagccucaagacacagaagacgcucaauaaauaaggaauggguagugcaaggagaaaaggcaaggguggggaaguacccaaggacccuccugauggcuuaggccugcacuguccauuaagguagcugcuagccacauguacuacugagcacaagcaaugaggcuaguguuaacugagaugugcugguaaguguaaaauacaauauuuauacgauaguuuugggggggcuuuuuugacggagucucgcucugucacccaggcuggagugcaguggcacgaucucggcucccugaaaccuacaccuccuggauucaaccgauucuccagccucagccuccagaguaacugggauuacaggcgcgcaccaccacgcccagcuaauuucugaauuuuuaaauagaaacaggguuucaccauguugcccaggcuggucucgaacuccugaccucaggugauccgcccgcuucggccucccaaagugcugggauuacaggcgugagccaccgugccgguccuccaagacaguuuuaaaaaggaaaauacucaugaccagcuuggggaaagguggcaaaaaccucguuucuacaaaaacaaaaauaaaaauaaaaauaaaaauuuaaguaaaauaucucaagaacuuuuuauauuguguugaaauaguaauguuuuggacauauuggguuaaauuguauuuaaaaaucaauuucaucuguuucauuuuaccuuuagugugguuacuagaaaauuuauaauuacauuugcggcucacaugagacuagcauuuuauuuccauuggacagcgcuggcugagaacaaaaccuaacccucugugccgcccucgcggccgggaugcggugcgccccgggccuccccauucggaaaacgaggagccugggcgcaacggggccggcagccgccuuagcuacccggcuggcgcuggggaccccgucccccgaacugcacaccgcguggcgggggaaggggucccagcccucgcggagcaccuuuggcccagggcgggagcuccgagcgccggcuucccgcgccccgcacggcccggcccagccuggaagaaggccugaggaaggcccgaccgcgccgcccgcgcccuuaggcccggcccgaaugcuggaaagcccgccggcccgcccucggcucggugagccucggcucaccucagcugccggucguacuucugcuccuugagcagcuuucccagcugcgccauggccgcgccugccgcgcggaaaacagccgagccccugcggagcgccg

SEQ ID NO: 21259 - RNA, 28070 nt, Homo sapiens
cggcgcuccgcaggggcucggcuguuuuccgcgcggcaggcgcggccauggcgcagcugggaaagcugcucaaggagcagaaguacgaccggcagcugaggugagccgaggcucaccgagccgagggcgggccggcgggcuuuccagcauucgggccgggccuaagggcgcgggcggcgcggucgggccuuccucaggccuucuuccaggcugggccgggccgugcggggcgcgggaagccggcgcucggagcucccgcccugggccaaaggugcuccgcgagggcugggaccccuucccccgccacgcggugugcaguucgggggacgggguccccagcgccagccggguagcuaaggcggcugccggccccguugcgcccaggcuccucguuuuccgaauggggaggcccggggcgcaccgcaucccggccgcgagggcggcacagaggguuagguuuuguucucagccagcgcuguccaauggaaauaaaaugcuagucucaugugagccgcaaauguaauuauaaauuuucuaguaaccacacuaaagguaaaaugaaacagaugaaauugauuuuuaaauacaauuuaacccaauauguccaaaacauuacuauuucaacacaauauaaaaaguucuugagauauuuuacuuaaauuuuuauuuuuauuuuuauuuuuguuuuuguagaaacgagguuuuugccaccuuuccccaagcuggucaugaguauuuuccuuuuuaaaacugucuuggaggaccggcacgguggcucacgccuguaaucccagcacuuugggaggccgaagcgggcggaucaccugaggucaggaguucgagaccagccugggcaacauggugaaacccuguuucuauuuaaaaauucagaaauuagcugggcgugguggugcgcgccuguaaucccaguuacucuggaggcugaggcuggagaaucgguugaauccaggagguguagguuucagggagccgagaucgugccacugcacuccagccugggugacagagcgagacuccgucaaaaaagcccccccaaaacuaucguauaaauauuguauuuuacacuuaccagcacaucucaguuaacacuagccucauugcuugugcucaguaguacauguggcuagcagcuaccuuaauggacagugcaggccuaagccaucaggaggguccuuggguacuuccccacccuugccuuuucuccuugcacuacccauuccuuauuuauugagcgucuucugugucuugaggcuguggagauaacaaagcugcucagcuuuccuccuuccuggagccucugagacaacagaaguuauauguccccaaggacuggagcuucuguuugcgccaccagccuagugcuguaguagaggcuuuaggcacuuaguucugagaguacccuugaaagcaaccauuuccugugcuuuacaguuggagaaacagagucuuggagaaguuagguaauuugcccagaguuccccauaucuuugagccaggauguaaacuaaggcucuucuggcuuuuucggagguacucaguuacauccugcuuccaagcuuuucggagaagaaacaggguaacaguccuuauaaccaacuuagguuuucuuguaaauucuuggaguucuuguguuucuaaugcagguauaacuguacaugacagagcugagaagauaguugagguuacuaagcaacucuaacaaaagaggguuuuugcugagggcauuccauuuaagucccaaacuuuacuuucauagugagaacugguuuugaagugucaaagggaagcaguuagaagcaaaaugcagcagucaauaagccccuccuuacuucacguuaguugggccagcaagauaguagagaggacugauucauuuggccuauucuugaaacauguuacuuagagacacaccaggauucuuuuuuuuuuuuuuuucagggacaaggucucacuuugugacccaggcuagagugcaguggcuagagugcaguggcaagaacacugcucacugcagccucaacuuccugggcucuaacgauccuccugccucagccucuugaguagcugggacuacaggcaugugccaccaugcuuagcuaacuguuuuagagauggggguuugcccaggcuggucucguaccucugcacucaagugauccuccugccucagccucccaaagugcuaggauuacaggcaugagccacagugccuggccucaguauucuuuuuguuuuauuuuugaggugggucucaguauguuacccaggcuggagugcaguggcuguucgcagguaugauuauuggcacaccacagccuugaucuccugggcuggagugauccuccugccucagucucccaagcagcugggacuacaggcacacacacuaucucacccugcuugagaugcaccaguauuuuuuuuuuuuuuuuuuugagacggagucucacuguguugcgcaggcuggagugcaguggcgcggucuuggcucacugcaaucuccgccuccugcguucaugcgauucucaugccucagccucccuaguagcugggauuauaggugcgugccacugugccugguuaauuuuuguauuuuuaguagagacgggguuucacuauguuggccagccuggucucaaacuccugaccucaggugaucugccugccuccgccucccaaagugcugggauuacaggcgugagccacugcgcccagccaagaugcaccaguauucuuaaauuuacucuccaacuaucuaagcauccaucaaccauauaugucaggugucuucuacgugccauacuuugauggagaaaacaggcguuuacgguccaucugguucuucuaggcgauuccuccauacauuugacagcugucugggcccuuauggagcauacaguggaguggaaagauggaugcucagcaaacaaaaacaaaugaagccagguacaguggcuugugccuguagucccagcaacucuagaggcugaggcgagagaaaugcuugaacccaggaguucaagaccagucuggauaacauaguaagacccuguaucaaaaacaaaaacaaaaaacaaggcaguugcuugacaugcucuggaggacauacugacuacauaauaagggguaaucugcuuuaaaucagguaacagggaaggcacauuaaucacucuauuagaauguucauuggguaauauacuuuaaagcacuccuguagaaguugaugugaggcuuuucagaugauaauucaguuuucuugguaaagcuuuugcagaagucacaguaauaagcccuaugucgagaucuuaaaugcaucuaacuuaacuuaaaugcaucuaauauaauuuuuuuuuuuuuugagacggagucucgcucugucgcccaggcuggagugcaguggcgcaaucucggcucacuucaagcuccgccuccuggguucacgccauucuucugccucagccuccgaguaggugggacuacaggcgccugccaccacgcccagcuaauuuuuuguauuuuuuaguagagacaggguuucaccauguuagucacgauggucucgaucuccugaccucgugauccgccugccuuggccucccaaaguguugggauuacaggugugagccacugcaccuggcacaucuaacauaauuuaagaauaaaugaaauagggcugggcacgguggcucacaccuguaaucccagcauuuugggaggccaagugagcugagaucaugccacuacacuccagccugggugacagagcaagacucugucucaaaacaaaacaaagaauaaaugaaauagaaaacagaugaggguuuaaauccaaagacgcuuuuuaaauguuuguuuguuuguuuugagacagagugucgcucuugugcccaggcugauaaggggcuggaagaccaaguuucuguuucuaauuugacccucucccucuuuuccccuaaccauucaaggcaucaaccugaguucuagauuacuguauaaucacuauacuaauaucuguucccgucuuaccuguauucugugguuaucauaucagucuaugcaaggaaaguuuaaagaucaccauucaaauaagaaagcuguauuuucaugaaaguuuuaaaaacaucaaauuugugucuguuuuguagguuguggggugaucaugggcaagaggcuuuagaaucugcucauguuugccuaauaaaugcaacagccacaggaacugaaauucuuaaaaacuugguacuaccagguaacguagguuugugguuguguucuaaauauacuucuuuaaguuuaugaccuagaacuauguauuccugacugacucuguuuuggcucucagguauugguucguuuacaauuauugauggaaaucaggucagcggagaagaugcuggaaacaaguauguucuauucucuucaaauauauucacguuaaggaaggcaaggccugagucuuagcuucaccuccucagucagggugacucgacucucaguggaaaucauccuuauguuugggauuauggugaggaagugagauaauauagguaaagugcuaguacagcaucuggcaaauagggcauuaauaaauguuacccaucauuacugucuuuauuguuauuaauacaaaggaguagucguuauuccuuuauucauggaauaugggcacuuccuaagcucuuguauugauccguagguguuagcauauaauuaacaauaaugccuguuguuugugaugucuuuuaggcuuagucuagggguaucucucuuuacagugucaacaaaaaugcuguuuuaaagauggccuguauauuauucuuuaaagauuauauuuagacuuucagaacaugcccaaauuuggauuuaaagcucaccuuuucagggacuugaagucugguaucucucauuguguuugucaguaacaacaacagugaguaaauauaagggaaaccagcaauuaguucauauuuaguuuugaugccuuuucuuuggaucguagugccaguuucugccaggcacagcacagcuuuuuuauugauauauaccaagaagucuuguuaucuuugcuuacuugguggguuagaguagaaagugauaaaaauaagguuucuucuuauggagccagugagcuuauaccgaaaaguggcauccugacucugaucagcagccucauaucugggccuugagacaugucaaggguaugugugggaggaagccugaauaaaucuguuacaguuacgugcaaaaacaaaugguucaauacaccgagaguggucuguggaacaccgguucuagggaacgauaagagcuguuaaaugggccaauggguuccauagugaaauuaguuugggaaauggaucaaaugaaguaaaaauuucuuuaccauaagauuuuaguaucacauguauuauguguauuaugaauuuccaagagggaaauauaguauaugguguuucccaaacuuuuuuuuuuuuuuuuugagacggagucuuucucugucgcccaggcuggagugccguggugcaaucucggcucacugcaagcucugccucccagguucacgccauucuccuaccucagccuuccgaguagcugggacuacaggcgcccgccaccacgcccggcuaauuuuuuguauuuuuaauagagacgggguuucacuguauuagccaggauggucucgaucuccugacuucgugauccgcccaccucggccucccaaagugcugggauuacaggcaugagccaccacacccgccgguguuucccaaacguuuuuagccaaggaacccuuuucucucagaggaucuugugaaauucacaugcugugguacacaauuugggaaagaaacauugauuuauuagccuaucuuucuuuauaaguuccaucugauuuucuuccuccaggaaggccauuacagucuguaaucacaauauaguuuguuuuauacugugaaugaaauaugcaugcuauuacaaacaacuuuuccuuuauagucaguaagcuuuacuuuuuuuuccuuuauucuguucacuuuaguuucuuccuucaaagaagcaguaucggcaagguaaacaauuagagaauauaguuggaugugagcaucuaaugaugccccuguguuuugauugcuugaaaagcuuugacuuuaaaaacguguauuauuucucugagaaaaaaguuaacuaauuuuuguaaucuuguaaaucuucauauguuugguaguuuaagaacuuagagguguacugucuguguuuauacauugcauccuguauuaaagcuaaaucuugaguaauguuaauauucauucugguuaacaaauuuuuuuuuuuugagacggagucucgcucugucccccaggcuggagugcaguggcgcgaucucgacucacugcaagcuccaccucccagguucacgccguucuccucccucagucuuccgaguagcugagacuacaggcgcccaccaccacgccuggcuaauuuuuuguauuuuuaguagagaugggauuucaccguguuagccaggauggucucgaucuccugaccuugugauccacccgcuucagccucccaaagugcugagauuacaggcaugagccaccacgcccagccuaaaaaaucuuacaaaaccauguuagucaacuuagugaaaugacuuuuagcuuagugauuaaccacucuuguacaggauuauagaugugggugguuagagugagucugaacuugauccaggauaucccugccugcuacccagaguuuuuuggucauuugccuaaucaaaaaaguagaguacaaguaaugucauuugagaacucuggaugaugaugguuuugcucuguuuuaaguaauauucuguugagucuuaaacacuaggagaagcagaauuggcugggagcaguggcucacgccuguaaucucagcacuuugggaggucaaggcaggaggauugcuugagaccaggaguucaagaccagccugggcaacaugucaagacccugucucuacaaaauauuuuuuuaaaaaauuagcugggcaugguagcacaugccuguagucccaccuacuugggaggcugaggcaggaagauugcuuaagccuaggaguucaaggcugcagugagcuaugaucaggccacuaugcuacaaacugggcaacagagcaaaagccugucucuaaaaagaaaaaagaagggaaacagaguugucauacuuaugcaugaaauuuggauaguuuuacaguauguuugccuguuccauaaauugggggauuauauugugaccaaguuuuuucuaauucaaguuaaaugcuuuguuuuuaaaaagaaccgagcugaagcugccauggaauucuuacaagaauuaaauagcgaugucucuggaaguuuuguggaagagguauauauguacacacauuauuaugucugugcugaaauacaauuuuuuaaauaauucaaagccccagaaauuuagaauuuugaaucuuugugucauuuaugauuaguugaauuggaauuguugccucauuuguuguaaaauagcuuaacugucucugccauguuuaauaugauugugaaauugguuuuuuuuguuuguuuuuuucuuugcuguccuguuuagaguccagaaaaccuucuagacaaugaucccucauuuuucuguagguuuacuguuguaguugcaacucagcuuccugaaagguaaauuuuuauguuaauauguuuuuauuuuaaucuuauuagauuugcauuguuuuauuuucuuugcacagucuaugaugauaugguuuuaaaaauuguuaaauucuauagaaacuuuaaauaugaaacuuuuuuuuuuuuuuuuuuuuugagcuugagcucaaauuccugagcucaagcaaugcacccuccucggccucccaaaguguugggauuacaggugugagccaacgugccuggucaagaguuucagauuuauggcugggcacgguggcucaugccuguaaucccagcacuuugggaggccgaggcagguggaucacgaggucaggagauugagaccauccuggccaacauggugaaaucccaucucuacuaaaaauacaaaaauuagcugggcgugguggcucacgccuauagucccagcuacucgggaagcugagacaagagaaucgcuugaaucagggagguggagguugcagugagccaaagaucgugccacuacacuccagcccuugugacagaguuagacucugucucaaaaaaaaaaaauaaauaaauaaauaaauaaauaaaagaaauucuuagaaaucuuccagcauugaaaagaugaggaagagaaaaauacugaaacuuuuuuuuuuauuauuauucuuuagacagagucuugcucuguugcucaggcuggagugcaguggcacaaucuuagcucacugcaaccucugccuccuggguucagguaacucucgugccucagucucccaaauagcugggauuauaggcaugugccaccgugcccggcuaauuuuuguauuuguaguagagacgggguuucaccauguuggccaggcugaucucaaacuccuggccccaagucaucugccugccucagccacccaaaguccugggauuacaguuguggagccaccaagccuaaccuuagaugugaaacuuuuggaauauauuuagagcaguuaaaccgaacauuguuuuuuuguuguuguuguuuuuguucuuuguuuguuuuagugauuaaaaacuaguuagaauugauuauugaaggcugggugcagugacucaugccuguaauuccagcagaaccaggcugagacagguucagaucacuugagcacaggaguuuaagaccaccugggcaacauggcaaaaccuugugucuacaaaaacuacaaaauuuagccagauggugugccugcuuguggucccagcuacucaggaggcugggaugggagaaucacuugagccugggaggucgaggcugcagugagccaugaucaugccacugcacuccagccugggcaacagagaauugguuauuggaauuguuagggguguauuuguggguuuuauauuuuuucucuaucauggaaauguuuagaauuaucuuucuuuaacguuucuccuuaauaugacagacuaaaguuucacaucccucuuguccaaagauguacuuucuuugagacugcagccuguggaaaugcuugcuuuucaguguguucuugaccugcuuauguaaaugcaguuauguaccuuugcaucuauuauuuaguaagaaaguugcuguaagacauuuucauguuuugcauguuuucauguuuggcauauuuccauuugcuuauguucauauuuugcuuuuuuuuuuuaaacagcacuucacuacgcuuagcagauguccucuggaauucccagauuccucuuuugaucuguaggacauauggacuaguugguuauaugaggaucauuauaaaagaacauccagguaaaauuguugagcauaugggcuuacuauugguugcuuuagcuauaauuuuagaaacuugacaauuuagaaagucaguuuuaaauuacaaaguaaauuuguagcagcacaucucuaguugcagauucaaaguggcaaucagauucaauaggcugcaaucuacucuuuauguagcauuauagaaggauacaaagcaugauauaccacaggcacagcuucuucaucuuauuaggagauccagcaacuaugcaaguacccagcuucuuuugcccccuaacccacauugggcauguauggcuguggagagcuaaggaauguggaucacucugacccaugaaguuacaccaccuuuccccacuccagucuuuuuuuuguuuuuuaagacagaguuucgcucuuguugcccaggcuggaguacaauggcacaaucuuggcucacugcaaccuccaccucccggguucaacugauucuccugccucagccucccaaguaucugggauuacaggcacccgccaccaugcccagcuaauuuuuuuuuuuuuuuuuuugagacggagucucucucuuuugcucaggcuggacugcaguggcgcgaucuuggcucacugcuaccuccaccucccggguucacgccauucuccugccucagccucccgaguagcugggacuacaggcgcccgccaccgugcccggcuaauuuuuuguauuuuuaguagagaugggguuucaccauguuagccaggauggucucaaucuccugaccucgugaucugcccgccuuggccucccaaagugcugggauuacaggcgugagccaccgcacccggccgcccagcuaauuuuuugcauuuuuaguagagacaggauuucaccauguuggccaggcuggucucgaacuccugaccucaggugauccacccgccuuggccucccaaggugcugggauuacaggugugagccacugcaccagguccguccaaucuuuuauuucauucucaugcaggcuuuagguucucucaauucaggugcaauuucacacaacaaagacauuuacauaacuacuguucccaaggaaacuguuguaagagaccaaagucguuuauaggcagaccuccaucagcugaggguuuauauaagcccuuuacuuauaaaauuuuaaucuuagaugaucauaaaauuuucauccaguauucaaaacagugcucuuuauugacucaagaaaacauuuuuacuaugagccaagcacucugcuaauguggugauagccauuggcauugguagcaucacugaggaguaauaucugugugggcaguuagggagugcuugucaggauaagcucuggcugcugguggugagccauuuaagaguugaaaguggugucaacugaugggagggaacaaaagaguugaaagugggagagugaccauguaaacauuuuauuuuaaaugggucacuuugaaguugaguggaaaguaaauggauuuaaaggggcaaagauuggaggcagugauugcuguuagaaauuuccaguggccuaaguaagagagaguguguucuuuuuccuaauuuagggaagagaagaagagaggguagauaauaaugaagguucagcauuacuaguugugugccugccuuuauaagaauuauuucauuuacucuuuccaaaaccuuuauaagguacagauugaguauccuuaauccaaaaauccaaaaucagaaaugcuccaaaaugcaaaacuuuuugagaacugacauaauauucaaaggaaacacucauuggaacauuucuuacuucagauuuuuggguuagagagcucaucuaauauguauuugcaaauauaccaaaaacucaacaaaauccaaaacacuuauggucccaagcauuuuggauaagagagauauacaaucuguagauacuuuaauaucugcuuuuuauagaugaugcugaggcaaugagagauuaaauuauuugccuaaggucacauaguuagcaagugacagaacugggccuaccucuaagcacucacugaaauuauacacucuccuguccucucucauguggagagcaguguacagagugagauuaggaaguggggaguuacugauguuggggccaaggaagcaagaagugaaggaugcccaucagguuucuggagaagaagucuagguagauggugaugcugucuauugaagaccacaagaggaggaaggauagguuguuaguugcuaucuguaccuaggguuugucaauguugagcuuuuccaguuagaacaaauuguguucuaaaggaaucuugguuuuacuuuuacuaaaacuuuauaguugacuuaagauuucugcauuuuacuauauguaaaucguaccuuaauaaaacagugaaaaaaccugugggcccuguguccauuuaaaaauuaaagauuuccuaaguuucuauaauucaauguauugucaucaguauugccaaagaauuaaguuuaucuuuugagcugggcacgguggcucacaccuguaaugcaaggacuuugggaggccgaggcaggaggagcccuugaauccaggaguuugagacuagccugggugacauagugagacccuaucccuacaaaaaaauuagcugggcacagugacacgagacuguagucccaccuucucaggaggcugaggugggaggaucccuucagcccaggaguuucagcagugagcugugauugugccacuguacuucagccuggguaauacagcaagaccccaucucucucuuuuuuuuuuuuaaguguuaaauuuauccuuuugaauucuuuguuucacaguaauagaaucucauccagauaaugcauuagaggaucuacgacuagauaagccauuuccugaacugagagaacauuuucaguccuaugauuuggaucauauggaaaaaaagguugguagugugugugaccuuacauuuacagauagacuuaaaacauuuuuuuaaccuaagguuuuugaauuacacuaaagugagaaaauccuauaaacuuccauauuccugucaucccgauuacccaauaacaguauuuuaccuuguuuucaacauauuaauuuuucuccaaaauuaaaaaacuuuuuuacugaagaaaaguacauauacugaacaucuguguaaucacuacccaggucaagaaauuggacauuaaccuauuccagguggggagauggggaugguuaauggguaccaaaaaaaaauuagaaagaauaaauaagauuuacuccuugaaagcacaacaaggugacuauaguuaguaauaacaacucaguuauacauuuuaaaauaauuaaaagaguuuaauuggauuauuuguaacauaaaggauaaacgcuugaggggauaaaugcuauacagauaccccauucuccaugaugugcuuauuucacauugcaugccuguaucaaagcauguaccccauaaauauauacaccuaaguacccacaaaaauugaaaguaaaaaauuuuaaaacaaaaaacagaaauaaaaaaauuccaagaaguucucuuuauggacuuuuucuaaacaaauagaaauaaugacauaacacuauaaggcguauauguauuuuuucccacuuccauauuaauuaacaugcaguugcuuauuugguucaucagaaaacagaaaagauccuccuuucuuacuuaggauuggugucugaaauugagauuugagcuguguuuuuggguggcagucucugagacuguuuugcugguauaauggggacaaucauaguauauaugugacauacuagguaucugccucuagaaaaauuuguaaagcaguuuuuauuaacucaguucauuuucgucuauucacuacucugcauauauuaggagaucauaaauauuguugaauuuguugaaaacgagaugguacagugaagaauucauaauacugauauuuucuuuuauuugucucucauuuuuaggaccacagucauacuccauggauugugaucauagcuaaauauuuagcacagugguauagugaaguauguccuuuuuuaaaaaaaauuucauaugcaacuguauuuucaguuucuuacaaaggauuuccuugauggggaaugggagauuaauuuuuuuuccuuauggaguuguaugguagggcaaauggaugcuuuuaaauuuaaaucuagcaguuccucuuuugauccugauaauuuuaauuaaaaugaaauucaauaaaugucauuaugaaacuggcagggggaaugaauguagauaaauggucacagugucuguuuucuaucaagugagccucugauuucacagagaaauauauuuguugaugaaaucuuauguagagaaugggggacacuuuagacuuucaauuucuguauuuugaauuuuaauaacuagauuuuuaaaauuuuuaaccaauuuagacaaauggacgaauaccuaaaacguauaaagaaaaagaggacuucagagauuugauuagacaagguaauaugggauaugauuaaauacuguauaaagcuugaaaagcaaauugcuagaggcagguacuuauuggauuucuguuaacaccuuugucagaugauagcaucaugagcuuuuauuuuccuucuggagaaguuaagaagccacgccuuguauaguuuuaaggacuaaugauaagccguauuucuucuuaagauuuaauauucugcaggaucugacaagguuauuuuuauaaugggggaacagaagagugaaaagaaaagggcuguuugcuaacaauuucccauuacaauaggaauucuaaaaaaugaaaauggggcuccagaagaugaagagaauuuugaagaagcuauuaaaaaugugaacacagcacuaaauacaacucagguaaugaaagaguugcugagggauucacaugaacaagauguuuucuagaguccuuggcuauuaaaugguugacuauaaugauuuaaguuaauauuuucuaaauguauaguuagaaauaaauacagggccgggcaugcuggcucaucccagcacuuugggaggcugaggcggguggaucaccugaggucaggaguucgagaccagccuggccaacauagugaaaccgcgucucuacuaaaaauacaaaaauuagcugggcauggugaacauaccuguaaucccagcuauucgggaggcugaggcaggagaaucacuugaacccaggaggcagagguuauagugagccaagauuacaccacugcacuccagccugggcaacagaguaagacuccgccucagaugccuuugguuuuguuauggcuuaguuguugaggucugaccauugaaguuuuuggggagcuuuggaauaacaccugguaguuuaaguuagaauuuucuuguaacuuaaaacagcaaauaugcugccuuucaaguuaggaaggcacguaagauauuauuaccaacuuuuuagagacaacaaggcaguguugcugagugauuaaaagugugcuggcuggggccaggcgcgguggcucacaccuguaaucccaacacuuuugggaggccgaggagggcagaucacaugaagucaggaguccaagacgagccuggccaacauggugaaaccccaucucuauuaaaaauacaaaaaauuagcugggcaugguggugggcaccuguaaucccagcugcuugggaggcugaggcaggagaaccgcuugaaccugggagguggagauugcagugagcugagaucucaucaguguacuccagccugggcaacaagagcgagacucugucucaaaaaaaaaaaaaaaaguguuugcuggccaggugugguggcucacaccuguaaucccaacacuuugggaggccagggcagaaagauugcuugagcccaguucaagaccagccuggacaacguagggagaucuugucucuacaaaaaauuuaaaaauuagaugggugugguggcaugcaccuguagucucagcuacucuggagccuaagguagugggaggaucgcuugagccugggagguugaggcugcagugagccaugauugugccacugcacugcagccugggcaaugauaugagacccuguguccaaaaaauaaaugugcuuugugaaucacuuuucuggggugaugaacauuuucuguuuuaauugggguuaugguuaaaaauauguauauauaguuaucaaaaugcauugaauuggacauuugaaaucucuguauuucacugaauauaaaaccacaguugaaaagaaaagauucuaauaguuggggggcaguaagcuaaauaaacagauaaaaaugcaccaggugcugugaacaaaauuacagcagaacaaagggucagagagcaugcuggggacaagggaauccgggguugagagacaauuguacauagggagccagggagacuuuccaaaagacauuuaagcagaagccugagugaagugacacgcagaggucugguggaagagcuuuucaguuggagggagcacaugugcaaaggcccagaagugggaugaagcuugacuuuuguucaagcaucaguaagcaagucagugugauuggagugaaguguaaaagggggaaaagugguaggaaggauuugaguuuggagaggcagaaagggccagaucauaaaggccuugcaggcuauuuaagcauuucagucagggaaguggauugagcugcuuuguauucuaaaagaccauucuggcuuucaugaggagaacacaauugaggggacugggaguggaagcagagagagcaguuaggaggucccacugagacauuucuuuuuuccacccaucaguagaauccaagccuaugauuuguguguguguguguguguauuuuuuuuuuuuuuuuugagacagggucucacauuggugcccaggguagaaugcagugacacaaucacugcucacugcagccuugaccuccugggcucaagugauccccccaccucagccucccaaguagcugggaccacaggcacgugccaccacgcgcagcuaauuuacuuuuauguuuucuauagacggggucuuccuguuuuguucagguuggucucaaacuccugggcucaaaugacccucucaccuuggccuccugaaugcugggauuauagauaugagccauugugcucagcuuuauacucuugauuaacguaugaagaucuugcuagcaauaaaauuacuuuaugguuuuaguuuuuuucagagugguugucucaacggucacuaauuagggugcaaggguuucagauuuuugacaagauggaaaaucaugauauacugcgagucuauaaucuguuuugucuucagauguaacuauauaaaauaauuuacuggggccccuucuuuaccccauuuaugguauaagagaauagguauuaaaugguagcaacagugggccggagaggucuuucuuccauucuuuccccaucaaaucuucauaugguacugauucuaaauaaaauuauaaaccaaucagaaguuuguauuugauuacaauuugagaauucaaagaacauaucugaagaaauagcacugaaaauaaagaugggcgaauucuuaauacuguguaaguaaauguuucauguuccuuuguuagaucccaagcaguauugaagauauauuuaaugaugaucgcugcauaaauaucaccaaacagguaacaacaacaaaaguaaaaacauugcugcuaaaacuuugggucaaaguaaaacgccacuuaauguuaauuuuuucuuauucuuuuagacuccaucauuuuggauuuuagcucgugccuuaaaggaauuuguggccaaagagggucaaggaaauuuaccuguucgaggcacaauuccugauaugauugcagauucaggcaaauauauaaaacugcaaaacguguaugucacuguuuucaaacuauguaauagaaaaagucugauuauauuagagauaaacauuuuaucauccugucagaaaucaaaugaaaguuuauuacaaccucauugcuuauaaauaaacuaggccagcugcaguggcucaugccuguaaucccaacacuuugggaggccaaggugggagaauugcuugaguccaggaguuugagaccaucgugggcaacauagugagacuuccaucucuacaaauugaaaaauuaggugggcaugguaguguucgccuuuaaucucaacuacucaggaggcugaggcagaaggaucucuugagcucaggaguuugaggcugcagugagccaugaucaugccacuucacuucagccugggugacagagcaagacccuguuucaaauaaauaaguaaaaauaagcugaagaacuuagaccaggcugggcgcaguggcucacaccuguaaucccagcgcuuugggaggccgaggcaggcggaucacgaggucaggagauugagaccauccugacuaacacggugaaacccugucucuacuaaaaauacaaaaaaauuagccgggcgugguggcaggcgccuguagucccagcuacccgggaggcugaggcaggagaauagcgugaacccgggaggcggagcuugcagugagcggagaucgcaccacugcacuccagccugggcgacagagugagacucugucucaaaaaaaaaaaaaaagaacuuaggccgggcgugguggcucacgccuguaaucccaccacuucgggaggccgagacggguggaucacaaggucagaagaucaagaccauccuggccaacauggugaaacccugucucuacuaaaaaaauacaaaaaauuagccaggugugguggugcgcaccuguagucccagcuauucgggaggcugaggcaggggaaucgcuugaacccaggagacggagguugcagugagccaagaucgugccacugcacuccagccuggagacagagcaagaguccgucucaaaaaaaaaaaaaaaaaaaaaaagaacuuagggggcaauucuuguuaagcucaaagcaaaauugaaugggaaauacagaauuaccacauacgccuaggaggcagaguuuuuuuucauacuucaugauaaacuuaauauuugaucccuuaacucugugcuaugaacuauauguauuaaguaauuuaacacacacacaagguucacaacgaccuuaugagagagagagagacuguuaccggccccauuuuacacaugaagaaacuaagguauugaaaagguuacuuauacaaggucagauagcugguaaauggcagaaccaagauuugaaccccaggaaacccaguaccagagccuguaugcuuagcuauggcccuauacuaccuuguauuuguaacuuaaaaccaugaagguuugaugaauuuuuuaucuuaauguuucauaaguuauagucuaugacuauagcuagacaucuugcuauccagguaucacuagccugaacccagauagacuaucacagggaugggucucaaugaauaugacccucguauaguuagggcauggugcaaagaauccaggucugcuggcucgguuucuuugggguccaaguaaugucacacagagaugaucucucuuccccagacagauuucacucuuuaucaugucaccauugaacgaaucuugguuuguuguccuagccuaagaguucaacuacuuaaaacuuggggaaggucaauugaggauagaaagaaguaugaccuuacaugggagguagucagccugaacacugaugauuuuuagagggugaaagguaaauagacguaaagaaaacuuuuauggccggaugcaguggcucacaccuguauucccagcacuuugggaggccaaagcggguggugaaaugugccacaagggauguucacaguuguuuuaaaugguugaaauuuuacguuuuccauggucugucucagugguauagauacagauaauaauuggguaaggguuuuuuuuuccucucauaauaaauacagaguauuuuaaaacaaucagagguagagcauguuuaucuauggcaaugcuaaaaagguaugaaggucaguuaauugaaaauugucauuaauacaguauuuucaguuucuaaaucacuugaacccaggaguucaagaccagccugggcaacauggugaaacuccgucucuacaaaaaagacaaaaauuagucgggcaugguagcgugugccugaauucccagcuacuugggaagcugaggugggaggaucaguugagcgugggaaguugaggcugcagugagccaggacugcgccacuguacuccagccuggguggcagagcgagauccugucucaaaaaacaaagaaguuuuacauuggagaugaacaguuuuaauguauuuaacuuuccuuggacuugacuuccaggagauaagucauguucuucaguaauguauuuuuucagguccucugucacagaagccgaaaucauagaucccucuaggggagcaguuuuuaaguugggugcuguuagagggacccuggguuuuagugggcacugagaguccgucacuaacacuggaaagauucccagcuacucauggugcuguugauagcauuucccuggcauuuucacauuucauacauugucagaccuguguuuuuucaugaaaaggaaagaaaauuuuuguucaugguaacaauuuaaauuuugcuaauuuaaaaauuuguuaguaauugcuuuuuauucuuuuuuaguuaccgugaaaaagcaaagaaagaugcugccgcuguggguaaucauguugccaaauugcugcaguccauuggccagguaagcuacugggcacacugugcccauacaggccucagcacguaacuccagccagaaaggguuuagagacagaggguguggcacugccucugugcuucuuuagagggagcugucauuucccugccuaaugggauagcuugugauaaggaaacaagauauuuuuaaagugcucucccagcucuuggagaaagccuucccaucucacagugauuggcuuugugccgcacccuuuguuaaucuucucuuuuaaacuggaacagaaucuguauuuaucucuuuacaggcaccagaguccauuucagagaaagaauuaaaauuacucuguaaguccccuugaauuaauuuccuuauuuugcuugauagaaaugugccacagggaauguucccagguauuuugaaugguugaaauuuuaaguuuuccauggccucagugauauagauauagauaauuauuggguaagguuuuuuuuuuccucucauaauacaauacauggcgaguauuuuaagacugaaucagagguagaacauguuuaucuguggcaaugcuaaaaaggcuugacggucaguuaauugaaaauugccauuaauacaggauuuucaguuuuuaaauuuuaaguaauuuaggaaguuuuuuugucugaagacuuugggugugaagucuugagucacauguacauugacaauauugguuuaaauacucauuuugaucuguguuaaaugacuguaauggaguuaagaauuuugccaucuaguuucggagugguuagguucguaggagucuucucaguaacuccucaguaggccaaaagcauuuucuuuuauuuaagagucaguuucaaaauacccaaucuguugugcaugccaucugaagauuucucccuguagcuacugcuccuacguccuguggaaguuuauauuuugcaugcuccccauccuuaaaauagauuuauccaagcuuuccauuuuaugacuucuccacaaugucuguuuaggcucgguuuuaauguuuucugccacuacuaaucuugcaccuuguuuguucuauuagacuaaucuugaauuagcguuuguuguauuagauuauauaauacuagaucacaaguuugaugcuggguauuugaacauuuauuauucuguucuacuuuggggcguuuuugaaaauuucaauaauacaaagcuuaaagucauuacauauaucaagaguacaauucauaaaccucucuccuuuaggacuacuuauccauaauaaugaugaaaacuauuauuuuuagagccauaucaggcauugugcuagagaugcacuuuauacagaugucacauuuaaucuguagaacaauucucaaagguaaacaguaucauccccauuuuacacuugaaaacugagguucagagaggccaucaccuuacuugcuucugaacugguuguagugccagggauauaaauuuaaggugauucauguucuagugcuuucucugcuauuagaaccaaggagaaaacauuucuucacauucucaugucugagaaggguauacacauaauucucuguucuuaaagucaccugugauucauaauauucaccagucacagucauuacuuccagaauaucuuuccucuguucaggcagcaauucugcauuucuucgagugguaagaugucgauccuuagcugaagaauaugguuuggauacaauuaacaaggaugaaauuaguaaguauaauagccuucugauucuggguuaauuuuaauuaauuuaaaagauauaaauauuuuguguauaauaguguugaguauauggugaugauauuaaagauaacguaaacauauucuaauuuuauucuaagcuuaucuagguaauuauaauuuauauauuauaugaaacuuaauguaugcauaaagucauauuuaggucacugaguccauugugugauauguaugaguuaaagucaguauguuacuacuucaguagagauugugugacuccaguuaauaguccugaaacucaaguauauaguaaauucagcccuucauuguuuguuacauugcaaauuaaccaaauuaaacugaaauuuuuuuuccuuucaguuucuagcauggacaauccagauaaugaaauaguguuguacuuaauguuacgggcuguugauagauuucauaaacaacaggguagauauccagguaagaauagcaauugaauuaccagauauaauaagaucuucaauaaaacauuuaaauugaaaguguucucaggguauuuauaauaguguugcuugaauuucacauuguaaacagauuacaccccaaacguuccccagugaagaaccaccuuuuguuuuuuaaguuuaacuauuugcaaaauaguguucgauucuaaacuauuacagggggauguugguugaauauguauagaagaaaacuuuuuucugucauuuuccauaguuuguuacuaagacucacacugaguuuaauuuaguggaauaggaaagccacaagaaauaugcuggccaggcauaguacgguggcucacgucuguaaugccagcacuuugggagacugauucaggcagauugcuugagcccaggaguuggagaccagcgugggcaacaugguggaaccccaucucuacugaagauacaaaaaauuagccagacaugguggugugcacuuguagacucagcuacucgggaggaucaccugagccugggaaguuggggcuacagugaguugugauugugccacuaaacuccagccugggugacuguggugagacugucucaaaaaaaaaaaaaaguaugcuacuaauuucugaacucaauaacucugaagauguaggaauuucuuuguuuaguuaucuacuuuuuaucuucagcaaauguagucauuggagaauuggcauaaucucaaagaucugagguugcucagaauauuuuucuuugggaugauaauuuuaauugugcaggauuauugcauagcaacacauucuagggguaucauaaaaccugcugcuccaucugauacagugugucuccagaguuuauagucuuuuuuuuuuuucuuuugagacggagucucgcucugucgcccaggcuggagugcaguggcgugaucucagcucacugcaaccuccgccuccuggguuuaagcaguuuuccugccucagccucccgaguagcugggacuauaggcgcccgccaccucgcccagcuaauuuuuguauuuuuaguagaaacaggguuucuccguguuggccaggcuggucucgaacuccugaccucaagugauccuccuguguuggccucccaaagugcagggauuacacgcaugagccacugcgcugcccagaguuuauaguccuaacaagcaagcuuacuagaagaaaaaaaaagaauaaacaccaaauauguauugcuuuauuuguauuauuugauuaguauuuauuucaguuaucuguugcauaacaaaccacuucaaaacuuagugguuuaaaacaauaaauagugucgugauuuuguggguugccuggucucaggcaguucuccuuggggaggcaugcaguugcuugagccuggggguggagucauucugaaggcuugacugacugaguuagacaugcaagaagacauuuuuacucauguaacuagcaccuuagucagaacagugggaauagcuggcggcuggucagguaucucuucacguggcuagcuuggacuuccuuuuggcaugucaguuggcuucugcaguuaacauuccaaaaaacccaaguggaagguacagggcuuuuuaugaccuagcuuuggaagucauacagcaucacuuaugagcuaaguaacuuaaucucucugugcuuuaguuuucucuucuauaaauggagauaacuauacauacuucauaggacuguuuugaggauucaaucaauuaauauagauauaagguccuuagaacaguguccagcaucuauuaaugcucaauaaaugugaccuauuauuggccaggcaugguggcucacaccuguaaucccagcacuuugggaggccaaggcggguggaucacuugaggccaggaguucgagaccagccuagccaacacugaaacuaaaaauagaaaaaauuagcugugugugguggcgcacuccuguagucucaguuucuugggaggcugaggcaugagaaucauuugaacccggcaggcagagguugcggugagccgagacugcaccacugcacuccagccuagguaacagcaagacucucucucaaaagaaaaaaaaaaaguuaccuauuauuaauagcuuuauguccucagugucauuuaucauuuagucuuuuagaauuggagaauaacuuuuauaaaggguauaaguaggacauuacuuucucauucauuaaguucuucuaucaaauaauuauuaagcacuaugugccagaugcuuuucuagacagugaauaugaugcaauuaauaaagauuuaauuaaauucaaauuuuuacuagguuuuaguuggucucugauuauagguuugugauaugugcaaauauuggucucauacuuuguuauuuuuguucuucaguuucauacauauuuugacuagaacaucugaaacuagauuaaauaaaggaguuggccauuaauuuugaaucacauuuauuuuaaugaaaacuaacuuuuauuuuuaggaguaucuaacuaucaaguugaagaagauauaggaaaguugaagucuugucucacuggcuuccuucaggaauaugguuuaucuguaauggugaaagaugauuauguccacgaauugugaguauuuuuuaggguaucuaggagaugauuccacaccugucauaaggcuaaucaaaauucaugucucuguggucuccuuuaguugccgauauggagcugcugagccacauaccauugcugcauucuuggggggugaguuccauauaugagaagacucaccuguuguuacauaguacaguuacuauuuuaauacaaaguuuugucgucuagcuauuuuaauuagggaggucagugaagcaggauguuauauuucuuucuuuuuuuuuuuuuugagacgcagucucacuguuuugcccagguuggaguguauugaugccaucauagcucgcugcaaccucaaacuccugggcucaagugaucucucgccuccgccuccugaauagcugggacuacaggcaugugccaguaagccuggcuaauuuuucaauuuuuuguagagacagggucccacuauguugcucagguuaggauauuuauucaguugccccuauacuggucucccugccuuccaucucucccacugccauccaacuuaaacuccuuaagagucauuaauccuucuaaagcauagcucugauuguguccuuuuacuaacccucugccccaccaauauacauaacacucuacaacaguccuccaagcaaguccaaggacuuuggcuugacguuaaaaaacccuguguuuugguuccacucggccuuuccagccuugguuuuaucauauuacuugcuuuccccccaggaugcccuuugauuuccugcuccuagaucuuugcuccucugugccuauuugccuuaaaaauauguuuuucugcauguccaaaaccuauauguucuucaagacccaacucaaaaaugacaugucuuucauaaaagcucccuuuacuucccucccucacucuacuucccccuugucuuagucaguuugggcugcuguaacagaauaucauagacuuauaaacaauaaaaauuugucacagaguucuggaggcuagaagucugggaucagggugccagcauggucaggucuggugagcgcccauuuccugguucauaggcagcucucucuucuguguucucacauggugaaaaaaaaaauggcaagagaagucucuggggucucuucuuagggcacuaauccuauucaugaagguucuacgcucuugaccuaaucaccuaccaaaggcccuauccucauacaauuacacuggggguuaggauuucaacauaugaauuugagggggaaacgaaccauucaguccauaacaccccucaaaaaaaauuacuguccugugaucuccuguagacugagcuauuagcuuguggcauuuuccuucuagauguugaauguuuuaaaggcagauuuaggucuaauuaauauuugaaguguucaaaauguaaaugcaucauacagaccuaagaaaacuauuuucuaagcaaauccaaauuaaagccugauucagaauaauuuauuuuaaacuaaaaccaaguagucucuugugccaaaguagcaaaauuuucugccaauucacagaaaagggcaaauuauuauuuauucagaugcaguccagaaucuaagaagagguacagccagauggauggacuggaugacuuaacuauagcagaaaaaaguauaaauugaagguuuucuuuguuuuuuuuuuuuuguuuuuuacuucugugcauucuguaaucauuuugcacagugccauuauaucccuucacuuccuucagguuuuauucaaaugcugucuucucugcgaugccaucccugacucuccuauuuaaaauacaaaccccuucucuuguauuuauaucucccuuauuugcuuuuucuccuuagcaccuauggucaguugacauacuacacauucuauuuauuuguaaauaaauucucucucucuugcugcuaaaaaguagcaugaggguaaguggaucuucuugucuuuuuuccuuacuguaucccuacugccuagaacaguauuuggugcacaguagucucaaauucuauccagucggcugagcgcgguggcuaaugcuuguaaggccuccgcuuugggaggcugaggugggcggaucacuugaggucaggaguucaaaaccauccuggccaacauggugaaacuccaucucuacuaaaaauacaaaaaaauuauccaggugugguggcaggcaucuguaaucccagcuacuugggaggcugaggcaagagaaucacuugaacuugggaggaggagguugcagugagccgagaucacgccacugcacuccagccugggugacagagugagacucuagucuaaaaaaaaaaaaaaauucuauccaguccaugaauauuugggaaagaggaaucuucagguuauagaagaugcacaaguuuuuuucuuaguaguuuuuuuguuuugaguaaauauagcggucuggcgauauuuaauauagauccuuccuaaauuacaaaugcauucagaacaaauauaccuuucuccuuuuuuauuauaaaacagauacaagguaaaauucaaaugcagcaguaggguguccuuugagaaucuuuuaugccuguguguauccuuuaaaguuuggucaaccacacuacuguuuagauuuccuuuaauaacaaaaagaauuauaggcuuuuauguugauaugacucaguaagcuaacugcaucuguuuugggucacuuuaaaacaccuuugcuuuugaaaaggaaaaguuucuuuacagaauugaguauguaacucuugaaguuuacucuuucaaagauuugcuuuucuccuuuuuccuuucaggagcugcugcucaagaggucaucaaaauaaucaccaaacaauuuguaauuuuuaauaauacuuacauuuacaguggcaugucacaaacuucagcaacuuuccaguuguagaguaagcaagcaccuuaaguaguguguuaaugauugaaacuguaauugccuucggguugugcuuuagucuguaaaauucuaaaggagagcugcuaaauuguuuucuuaauaaacauuuuucucauuuguaau

SEQ ID NO: 21260 - RNA, 57877 nt, Homo sapiens
gaggagccgccgccacccgccgcgcccgacacccgggaggccccgccagcccgcgggagaggcccagcgggagucgcggaacagcaggcccgagcccaccgcgccgggccccggacgccgcgcggaaaagguaggggccggcgggccucgggugugggagcgcgggccgcggccuccggucuccugugcgcggcagcacuuaaagccgccggccgggccgcgccgggaccuuugugccgggcgugggggugggggcgggggcgggggcgggggcggccgccagcgguugggggcuggggcaggauuccaggcuaguccaggaggaaguccgcacgccgccacccgccucggguccccggcgcuggcagcccccgggcgcagagccagcccagccgcguuccgaacgugagggucgccggccugggcgcugucacgucggggcugccggagcugcgggggaccgggcccgaacggccccugacaccugcggucucccgccgggcugggcaagcgcaggugggagccagcgaggccacccggggcucggcguuugggacucggcgcuccccuggacggguccggugccuuugucucucgcucccucgcgagcugcuguccuuggagcagcgucgagccagccgucggcgcccgcgacggggacuggucuccuccggcugccaggaggcggcccuggggccagcgccgcgggcgggggcggcgggagccggguagaaguuggcuuaguggagccgcuggggaccgggggugcgguggcggcagugcaguccacuuccccguguuuauaaacgucaagagucgccggucccugccgggcaccccgggaccaggacgcauggccauggccagcuugugcucagacccgguccgcgagccugagagcccggccugugucuaguaucauuuuaccgcgugucauuucuuaggcuucauaaauuggauuuaugagacuccuacucucuaaguaacuuuuauuuaaucaaauucgugcuuuugaguccaaaacuuugcacucauugguaugaucauuaguaaguugcauucucuaagcuuccguuuccucaucugugaaauaggaacaguaauaucuacauuaauaauucauuuuuauaauaaugacagugagggccaaguuuagcucuaggcauuuuacauguauuauuuaauucuggaaccgcucuaaugagauugguacuguuucgauucccauuuuccgagugaagaaacugaggcacagggagcaaaaguaaguugccuguggucaucaggagcuccuggagaaggcauggggucuaguuccagaguccgcguuuaaaccacaaguaaccuuccuaacuauaguucugaaaaucaaaugcaaaauguaaaaaacuuagcuugagaguagaugcucaaugaguauugacuccuuuucagcccuucuuuuauaguaaaaagauguuaaaaauaucucggaagauaauugguaacaucauugguaagguuucuuugggccaacaugccacaugguuaacuuagguggguagaauuacuagguuauuucguuuuguuuugagacagggucucuguugcccaggcuggagugcagaagagccaucacagcucacugcagccucaaccuccgaggcuuaaguuacuuuuccaccucagccucuugaguagcugggacuacaggcgccugccaccgugcccggcuaauuuuuuuauuuuuuguagagacaggauuucacuaugcugcccaggcuggccucaaacuccugggcucaagcuguccucucucaccgagcucccaaagugcugggauuacaggcgugagccccugaaccuggcccuuagguuuuuuuauuuuuuuuuuuuuaauuguaguuuuaaugcuacaaaaauaacaugcuagaggaauuuagauuagacaccuuucuuaaaccacauacguccuuuacgauagguuauacaguagaccaauuuuagaaaugauuaaggaacuucaguuggcaguuaccuguucauuuguggacaucaaggcccagagggguuaggacuuagagucucacuauaauucucauauuuuuaaauaauguugacucauugaucaauauuauauaagugacugaagauggugaaguguuaaauaaaaaacauugguauuuucauuacaggcauuuggggagaaagucauuuuacuuaucccaaaauugaguaugaagguggaagauguuauuagaaugcuaguuaaaaggacaaagaaugugguuaauacuuuaauucuguaaacaggaagcaaauagauuguuuaacucgucuguguugacuucagaccuaaaccuacaauuuuaaguguuugugauuuucuuaauguaaaguucuauauuaaaguuauuuuuuaauacccucaacauucugcacaugagaagcauggaaucagcaauucugaaagucacuggauuuaguaauuuuaacaauuaggcagcuuucuggucaguauaauuuaauuuaaaucagccccgaauuaccaucacgaaugaaaauguagcucuacauugguguucuuccuaacucugggagugacacuggggacaucuggucauauuauaauaaugaaaaguggucaaacaacuuaacauggugccaguuuuccuaagcgugcuugccacugauuguaaugcuuuuauuguuuggcuucuugauaaguaaguuauggcuuacagcggugaguaguauaguguucugucugaaaacauauucauuaauauucuguagcugcucugguuugcccuuaacuaugcugcuagugugauaagcugaaacaucuuguaacugguaaaaguuucagagaacuuaacuuucugaauauguaacaagcugcauguaucugaaaggguucauuuagacuucuguuagauauuagcagauuuucucacucugccagagaguuaggaucuguuagguuguggguggaauccuggagauuaugccggguaaauauguaaguaccuguauuguauuagcaguguuuacucugacuugguuuuagguucugagaguuuggcugguuauuuuuucagaggugggagguauggaguagagacguuaagauacagaaagguacauucgucuucugaauccugaaguguuaugcuagagguaucuauagcuguggaaaacugaaaagauauuaugguauguacccagcuuaaaggggguacaguccguaaaagucagaauauuagcagccuuccaauaugucugucgguaggugaaaaaaaaaguuucucucuuucaggagcuguguacaaaaggauccaaacuauacuuuguacauuuguuauuguuuuaaaaguggcugugaguuuuuagaggucagcuaacuuuaaacuugccguuugguuugugacuuuagaagguagaguuaacuauauuuagcaauaugcuuaagcgugugcauaucaccucaugaaacgugugugugcaugagaaaagcugccuccaguacacauacauauguauauacacacauacacacaagcacauauauguauguauuucuuauaggaccaaucucauuguacauaauuucaaagcacagguuccuaucuccagggaugcauaaaaagacucacugaaguauagggagaaaauuuuaggucuacuauuauguuuguugaucucaucacuuuaaaauuuaaaauuuugauuaugauugauaaucuuacuauauugcuguagaaguacauguaucugaauuuauaaauugcauuuauuuuggguacagguaugccuagaauuuuuuugcugauaaaggugaguggucagaaagcuuugcagaucccuauauggaggaugauuugagugggguucaagaacuacuguauuugggagggagaacugauaagacuugauaagagaaauaaaagaaacccagugugacacugguuucuggcuaggaggugcuguucacugaggugagagggugaccacaagcugggggugcugguuggcuggagcagaggggaaaugaugaccuuaugaggccaaguuuuuuuuuuuaaggugaccaugggacauagguggagaugucuaaauugcaguugaauacacagauugagagcuuaaaaaaagaaaaaacucugagagauuucaauuugacaauucuuagucuauugcugguugaagcuauaggcugugcaugcaaacaccaaaggaggguguggagugaaaaacgggcugaaggaggaccugggaacacuuuuaauagucaaggggggguggaggaagaggaaucuagaaaagcauuuaccuuccccaguuucuucucugaacuucuaauuccuuugaguggcauuuuugugagugacauagguauuucuggguuuuuccagugauuggcauguuugaguuaaagacagaaagacuucauuggucacauuucuuugugguaauuuauuuucagauaccugaucagagaagcaguuugauguacuaaaggcuucucgauugggagacaggaaaccugggugucagugccgggucugccacugaauuucugugugaccuuugucagaguacuguacuuccagagcguugguuuccacaucuacccuauaaagcagccugcauguuucucucauucucucguucgaggaguuggaggauagcugcugccugauguaaguagagugcaguucucucuccaugagcaacuuuuuuuuuuuuuguaucaccagagaguguaggcacugugccacuuacucuguuaaggauaccugccagcgcugaccagcaacaucugucccugucagcucugcaucaggauguagcuuggcuguacauuacauuuuauucuaucaguacauugaguaccaguuaccugaaaaaugcuuuacucaguggacaugaaucaagaaguuggcaugcucuuugauguugagucuguugucuaauuggaacaaguuguguucaguucaggaaaacauaaauaccaaagaguguuuuauacaauguacuguaccauaaaauacuguaccauguaauauucccuaacaauguuagaaaaaucucagcauuggcuugugugguuuuggaacacguuguguaggagaugaggccugagcuuggaaugguaugagcgaagguuggaugacagaugguugucacauucaaggacagcaugggaagaauccaaucuaauuucacagauaguaccuggccacuuuguuaccuauuaggaguuauguauaauaucauauauaucagaaggauaugugaaggcuauauaaaaugaaggccuggguucuugcccuccaauacuagccugaugagagacacagacaugaauacaauuaguuacaauagaaguuugaauagaaauaacacuauauuauuaagcaucacugaagauuugucauucacucugcugggcacuaucaaagcuguuuuggaaccacagagaaggaguaguuaauuaaguugauugugguuggugaggagaugaagaggcaauaaagacagaaaggaagaagaaaaaucagcauucuauuuuguguagggaguauaguuucaguggagugaugaggaaaauauuuacauacgaaauuagguauguaccauuuggaguauggaagucacauuuuucuguauaaauguuuauugaaugaauauguaaauaacuuaagcuuucguaaucuaugaaauuagcaauagauuauucuucuccauguacaauauuuuaugguuuauguaugauuuucuucauauuaugauuucagugcuucuuuuaaaggggugguacagggucauguuuauuggaggaggaaauuggaguuugaaaaagcacauuugguaguauaauguuauguuagaaaaauguuacaaaaaaguacaauagggaguaagauuuaugcuuauuaaagaagcauggauuaaaaagauugagaaacauuuauuaaagagucacugagguucuuguuuuagaaggccaugauuaaugaguuggagaacaagaagcaaauuugguaaucauguaaauuaugagcugcugaccaccuagaaauauauuugcugauaagagcuuucauauaaugaucauauuuuaucuuuccaacaauuagauacuguuuacagcuuacugauguguaaaaugagaaacuuuuuuuccuauguuuaucaugguuuuaaaacauuuaucauguauuuaaaauacuguaugcacuccaccacagacaggauggagaggaagaugugacaaaagauguggucaaaauuaguuuuaaucaaggaagcauuuuggaaugaucugcuuaaaaaguggauauaauuacgcaguuugagaagauaauucuccuuaauugaaauuacggggaauaagucuugcucucaggugcuuauugauaccguugaucaugcugguucuuuugcuggcuccacucacaauuaucuuugacaacuugccccaaaguaaacuuucucaaccaaaaccguucccaacuucuuuccuccucacagggaaaggcaaaaaaguccgcaggcauagagaguggaaagaaggaacagcauacuaggcugguuugaaaaacaaucaauugcuagguaauaaugucuuaccuuuugaguggaaggaggagcugggaagaauuaaguucgggcagguuuuuugcucauuuuggaucagcccuucauauuauggcuuaauagcuuuguuuauaguguauuuuucugcuuuuacguucauccucugaagucuugaguuaauuuugugccccuuuacccccauuugaauuaaaugcuucauuuuuuucccguuucucacauaaagcuauuuuuuuuucaggacagggaggggcuggugguggugguggugcuguaccaguugucuguuuaugagaucaccauuagacaacguuucucauuggcuugaauuauuugaauuuugugugauuuuccuguuauguugauucuguucuuggugucuaugaguucuguagaggauuccagccuaaauuuucuuccuuaguucuguuuacuuuuccucgacuuuugugguuuugcucuuugaucacugucaagaucuauuugagauuuucugacuuucuugaagagcagaaugagaucuagauuuucucuuauuuuuaaagaagauucuucacugacuuccuuucacuuuuuguucuguggaagucuuuccuagguguuaaguuuccaggcuuuaccucccccuacccccaacguauuaucuuuaggcauuuuguuugccaaugcguacuauauccauuauuuaucuuucccuugcacuuguagauuggguggugauaaaaaucuuccauauuucauuuuccuggagaaggcggguagagucacuagugaugaauuuuaucuucaaucuguuguauaauuuucuuaaaguaucucgccguguugugagcuguucucagauuucaaauuguuuugugaaccuauagcuuuggagcagccaaaccuuuguuguuagagcuucuuagcccaggcuaucauuaucauugugugagaagggguuagugcucuuuaaaaagccauuuuucuucugggugggaguggugaauuuuagaugguuuucuaauucagacuacuuuucuguuugucaaggagaggagaagaggacuucaaaugugguguuacaucuuugggaucccuuagccucuucucuuucaugucuccuuuuuuuucuucucuauucuuucugcgaaguuuuguuaaucauuaaugcuagcuuauuaauauuugggccauaaacaccucuguagugaccaacacaccucuuccugccagauggaaggaaaaaaaguguugaguuuuaauuguucuuccuguaaggggaaagguucccuuuccaugggaggaacucaucuccacaugucacccucucagaugguacagaauucagaaagauuucucaguuucuuccauucauguuuuucucguuuuuauuacucucuaugugggauaagugggaggaaccucaugucuuucaauuuggcucuguguucuucuucuggaauauauugauuuuuaaauacuaaaaucuguuauuggccuauuucuuccccuuuuaaaagcagauacagaaaauaaugaugguagaacagacuugggaugaauccaaguuuauuauaauuuuuaggagacauuuaugauauaccucuauagguaucagaaucuuuucuacuauuaaggugaaaagauuugagauuuugugaaaucuuuuguguauucuuuuuauuugaguuggcuuuuagguggcuuauuuuucaacucugaaaugaacauaacauguuacauauguuacauauguuacaauuuuuuucuaaaguguaguuguuuaauuucuacaaagauaguccauauaaaguuucuaaagauuguaaauuuaaaaggaaaugccaaaugaauuauuuguaaaauuguuuaaaaaaauuaauaaauaaugaguguguauuuaaaaguuugaacaugauauaaaaccauacuuuuauggauaaagauuaguuuacagugaagauuaaaacaauuaugcacuauuuuugacaguggaaacaauugcacauauuuggguuaaccacuaaaaugagauuauuugugggugguguuuaagauuguuuauuguucagggaaugaauuaugaccccuuagauaaaauuucauaugguaaaaaaugaccuuaaggugaaaugcuuuuauaggaacaagacacaaaaccuuugucuguacuuaugaaauauggcaauuaaaauaacuuuucuuggccucuauuaaguucaaaugcccaagaaauaaacucauagaacauuauaagcccuuuccauuucugugcccugagucaguucuaacacuagaaggauguucuuuguuuuaaaauagugauuaaguaggcuuugaaaaaauuacaguuuaaugaagucaggucauagcuucuggauacagauggucagguuucaauuccaccugugcaacuuuugauuccaccauugcaaguuguuuagucucucugguuuuguuuccucaucuguaaaacaaagacacuauuauucuucaccucauugaguuaccuggaggagauagaugcuauuauuuuaucauuauuauuaucauauccauuugaaggugcugaaauaaaauucuaauuuuuuaaaguucuaaaugaaauaacuuuuuguuacaaauuacuuuaaaucaucaaaacuuaguguauuauacucuucuucuugccugugccuagucuggcccucucaauugagaagucagucuuuuuuuuuuuuucaguaauccacagugagcagcagucccugaacgaaaucauauugcuaguuggguuugauuaauaaaacacagaauugguauucuaguccuuucagggggguuugcuuccuugugauguaagaaccuugucuuagucuuugugcugcuauaacagaaugccacagacuggguaauuuaugucaggguucugggggcugggaaguccauuaucaagggguuggcaucuaaugucuuucuguugcaucaucccaugguagaagguggaagggcaagagagugagagaagagaaggaggccaaacuccgucuuuuaucuggaacccauucuccacuccugugguaauagcauuaauccauucaugugggcagagcccucaugaccuuaucaccucuuaaaagucccaccucucaucacuguugcuuuggggauuaaguuuccaacacgugaaccuuggggacacguucaaagcauagcaaaccucaaagcuuccuccuuauuucuguuuguauuagguauguuauucccuccccucaaucuuuuuuuaaggguuucugugauaucaguguucagagcauuuguauuuugucuacuauguuuuuaugauauuaguguucagagcauuuguauuuugucuaacauuuacuaccuuaaauauuuugucaguauaaaauauuuaagguuuugcugcuuuuauuacuuuaugaacacauuugucaggaaucugauuguuagaaagcacauuaaauagaauucuacuuggauguggaaucuauaaagaguauaauaagguuuugauauugaggaugucaguguaugaacagcuauaacaauccacauuaaucuauuuucuguaguuguguuacuucuaacuuucagacuuuauccuuucuuucauaucuugugucuucccuaaaguggauccagucaguuuucugguuauaauuacaauugaaaaaaaaaaaaaauucaaccauaguuacuucuuuauucaauuacguuguuauugagcgcuuccuguaacauuugguaaugaucauaacaaguaacacccagguacuuacaauuggccagacauuguuuuaaauguuuuauguguaucaacuuauuuaaacuucacaaaaccccuacaagguaaauacugcuguccccauuuuaaagaugaggaaacugagacagauuaauuugccaguguaacucugcacuacacaauguuguacaacgguagaugccacaaauaucugcugucaugaagcucaguguuuuauuuuuugauaccucagaguaucuccaguuguuuuuaucguuaguuucuucauuuauucaauauaaagacauugcgcuagauacagaaaacauggagaaacuucuagaagaugacaauuuauaaggcaagucaaccauguacaucauuaguagauguauaagagcuacauaugccccaaacaggaaaccuuuuaaaugaagauuauuauauauguuuuaacauacuguguguauguacguacacacacacacacacacacacacacacacacacacggcuauaugugaaucaccuggcuuuagucuuucuuuccuccccaguucuugccauaauucgagggcuucaagaguucaugcagaugauacuucucacaccuuggucuagcaguuuucuuucuuucuuuuuuuuuuauuuaaugaaauuucaguuuauucagauaaagacuaauguaugccucauaaccuagugauaaucuauaaguuugggaguucacaacauuuuuacaaagcacauaauauuaacauucaagugaggcauuauagaaaguuuuauaaagaaugaaguaggccagguauggugccucaugacuguaaucccaccacuuugggaggcagagguggguggauugcuggaggucaggaguuugagaccagccuggccaacauagcaaaacccugucucuacuaaaauacaaaaauuagccagccgugguggcacaugccuguaaucccagcuacucagaggcugaggcaggagaauugcuugaacccaggaggcggagguugcagugagccaagaucaugccacugcacuccagccugggugaucaagugaaacugucuaaaaaaaaaaaagaagucuuuacuauaauucuuuuaaaaaaccuugguucaucuugaaagacugaugaauuuuugaaauaccugcagaaaaggaaaauaaucccccccccccccccagaaauacauacaaaccacuuauuggcacuuguguuuuaaguaccuggagaaaaacaggacagauuuuuaaaggcaauuaauaacagcuuauacaaggccuuguuucauuugcuuuagcaccaaguaaaguaagaguaaauaugcuguggaagauggucagguuuuuccuccuucucucauaugccccacuucuccuaccaggucacaguacaucagcagccauccuuguugccccacugaggaaucacuuuagauuccaguauuuaaauggcugcucagaugaaaccaguagaauucuuuccccuuaagauaagguggcagugaaugcuagcagguaucaauuucuuugaucaggaacaaagaacuccuucagaaaacucacuuuuuuggucuuuguuaaccuauccugugaauucuuuuuauuggcacaccuuguuuacgaaucaugauugauugcuauuuaugccaagggaacauuccgcaggcaugccugaucuauuuacuaaugacaaaguaugcuuacuuuacauaauuccauagguuuucucuuuuauuuuugggaggagggguauaauaacuuguuauuuaucagggcagaucauauauuuggaucaaaaagagaaacuggcaaguagauccuaaaacacauuucuuaacccgaguaacaucugaaaacauagauuucaauuauauuuuguugaaaauucauucaacuuuggugcuuauccaagaacuuauaaugucaauuucugacaaaaauuauaacccucaauacauauguauuuucaaaagaagagucaucuuaaaguaauauuuuucuguauguuaauugauacauuuuuauagcaaauugaaaauucugaguaaauugaaaguauguuuaacaacaaaauaaauacagcauauaugguuagcuuauauauuuauuaguguaaaggcagcagugaauuuguaucuuacaacaaaucugugaauccaguugcuuuuuuuucuggaauuuuauguaguaucaccaugcuccacaaugcuagaaauguggcauuaaucugcaaaaauuucugaugagauacuuuccccaaaugacauguaacuuuuuaaaacuuuuccaaaaaauauggacauuuuaucaaucacuuaaucuuuuuuuuuugagacagagucucggucugucgcccaggcuggagugcaguggcgugaucucagcucacugcaagcuccaccucccagguucacgccauucuccugccucagccucccgaguagcugggacuacaggcgccugccaccacgcccggcuaauuuuuuuguguuuuuaguagagacgggguuucaccauguuagccaggauggucucgaucuccugaccucgugaugcaccaucucggccucccaaagugcugggauuacaggcaugagccacugcacccagccuaucaaccacuuaaugaacaaaaaguuagauuacuaccaauuguucauuuaauuuugcucuaacguguuuuaaaaguuaagacaucucugaugguuuugcaggugacuggauaaaacacacuagaugauuucaaaagauuaaucuuaguaucugacucguuuggcacauccucaguauccagaauaaaaucaguagaaauaaaaguaauauaacuuucaaagaauucauacaugcuggaggucuuaggaaaagcaguuuuuaaauucaaggaauaggagguuugcucaucuuacuaguuacacacauuucuccucauggaguaauggcagcuuucuggcuucuuuguggaacuuuaguuuguagaaaagcuugguaauauuccaggacuggcuuuguuugggcuucauaagccuuuagucuuuugauaaccgucucugguuuaucauccucaugcugaaugagaggauccccagucagaucaucagugcccacaguuuugggaggguugaauucaauguuguagacucagccacuggcaggaugaaucuagcgagcaguaaggcauuguuuaaugaccucaaagggcacauucgggcuaaucacuuugucugucuaagaagcuuagucuagggcuucugccuguggaaguguccauggaaaaccacccaacagcuagcuauacuaagugagauuuuucagcucauauagggccagcugagucaugacaucaucucggaugaguuuccuuuggucaaugaaagcguuagcuaacacauuaauuucugugccccgcagcauguugauccuggagcaggucuccgcuagagaggugcuucacaguguuuggugacgcgcgacaacuagugcuguugccuagcccagggcccccaugaucacggcugcugccgcguagacgccccuuuacagaccaaggcccacgccgcacccgaacaagggcuuuggcccagccugugaacuuaccuucucugccgcccaggcccagccagcuggcagcgcugcuagugggcggggacuguggcucccaggccuucccugaacucuggucuagcaguuuucuugucucucaacuuuaguggccauuggucacuguacuggaaaccucgugugucuuucucacauccucuuggccucugauuccagcuggugcugcugggaacagucgguggcucacuccuggcugacugcaugcugccucaggugccucucuuuugcuuuuuccccugcggcuccucuaaccaacuuucuugucuguucccucuugucugucccugggcacgugcacuguaguucuuagaaguguuaguggaguuaaugcccuuugaggcgacuuuuuaccuaugcaacuggaguugauccauuuccccguugacuuucacuggacagacuuucuacguacuucucaaaaguuuuccacaagaucaagcccccagguacucaguaugguaaagauaguaucuuuguauuggcuuuuucucuuuuucuugguucacugucuucaaagugucucucucuuuuccuggggucaccuuccaauaaacugccugcacaccaguucuguucccaggcucugcuuuggacagaacccuagcuaaaacaaugaccugguacuguauuuuuaauacaggccuuuucccccaagacugccugucucugaaauuguaaauucuuaacugucguagguuccagcucuuuucacuuccuuguuuccgugguccccucuccucucaccucccuguugugaugucuggucuuuugacuuuuuccucuuguuaacuuuuugguagcacugcaccuucuuugccccccacccccaccuuuccucuugcaccugcccugcacaccagggaauagauuuagugauuccaaauuggagucugagggaccaugggagguauucucagagauuugggcauuucuacaaaauuuaaaaaaaaaucaugcuuucauguuaauaauaaacauuuaguuuaucugguugaccaucuuauaacccaguaauauaacuucagaaucuauguuuguacuuggaaguuaauuuugguuucauaauguuuaagagcuaugagcaugagacauuuuauaucuaucuauaaguuggcuuauauacuuaaaguaauugaaaauuuaaguugucacuuggaugucuauaguaacacuuuucuguuuagagaaguucugcacauuaaguaauucugagacauucuucugaguaaugucagagaaaaaugucauacaauucaauaugguucagugaaaauauuuuuaauuuuuuaacuuuuugaggcagggucucacuccauugcccagccuggaaugcaguggugugaucauagcuuacugcagcuuccaacuccuggacucauggccccuuccccuggcccccacuuccaccaaguuuugcuauguugcccaggcuaauuuauuuucuuguagagccaggaucucuaggugggcaugauggcucauaccuguagucccaguuacuugggaggcugagaugggaggauugccugagcccaggagguugaggcugcagugagaugugaucacaccacugcauuccagccuaggcgacagagcaagacccugucuccccccaaaaaaaaaaaaaagagagagagagagacagggucgaggcuagucuugaacucuuugccucaggcaguccucuuaccucagccccucaaagugcuaagauugcaggcaugagccuaacagcaaagaguuuugagcauggacuuugugccaaguauuucuaggugcaauagcuauaaauaagauacacccaggcccuauuuucuuggagccuagaauccaucagggaagacauguuaacaaauaguuagaagugaaaugaguguuacaaauaugccuguauaaauuaggguguccaauaccuggugggcucucaccauugcaggcucucacuguaaucccauugcaucuuccuaauuuucugcaaccccuaagccguaccucuuuuccuaggaguucuuccuauuucagaaaaaaacagucaugcaugaaugaacucucuuugcuuucucaccuccugcucugccuuagaagaaaggcaccaugucucuguuuagggugauccacccccuugggcugcacaugccaucccucuuugcuccaaggaggccuggcuucaucacuuuccuuuucucuuuuccugugucuucaccucuucaaguuugcccccaguucuccuuucuuccuaaguauucuuuucaucccaaucacauccauuuucauaaguucgguuagcaccuagauuaugacaacucucaugucugugucucuaacucuugacuuaucuccugagauccauacucauguccuagcuucccaauaggcaucuucccuagauuuugcaauaaaacaaaccucauuuuuuccccuaaccccauucucccucguacaucuucuuuauuuuaaagugaugauuauucuaaauuccuuucuuucucccauccuuccuucuccaaguaagcagcagaucccucauagcuaccuucuaaucauuguuuguucgucuucuuguuuguugcuguuaucugaauuuagacauuugucaccucucacuugaaccuuugcaguaaauucuguauuugucuuccagcuccugucuugcccccuguccuuuucuccacugaguuucugccauguauauguagagguauuacuagccugcccaaauuuuuucaguucccuuccuauuuauagaauggaauccaaacucuuuuagcauggaugguauuuggcucucuguaacguagcucuuccugcuugcuuggucuucguuccuguuauuuccaacucauaauuuaagucucagaaauacuucaagauuccuuuuggccuuucugauauuuuaagauuuuaagauaauauaacuuauacuuacaauagaaaauuauaaggauaaaauaaucacucauuccaccaacaagauauaguuacaaaaacauacauuuuucuagucuuuuuuucuauaaagagagaaaaagugagacaguuccaauuuuggguugcagggagcugcccaaaugcauaugcuuagaaauaagauuaggaaggaguuauuauaauucgccucgggacuucauggcuuuguauaugcaggccuuuugcuuggaauaucuucucuccacuuuucuccacacccaucuccuaugugccuucaggucuaacugaaacacugccaugugccugaugccucugaacuuguccaggcagauuucaguguccucagugcacuguguccuuguuuauuacugaaaccaucauaucauaauaauuuguauuuuuguccuugaacugaaaguucccugaagcagugacccuuguauuuccugauauggcucaaaaccugacagaguugucugaagaggaaccuccagaaaggcagggggaaaccaguagaguucaagggaguagaguguguuaaagaauggugaauagucuuacauguugcuuuguguaaauucuuugguaguaaaccgauguacuucuucaagugcauauuguagugagucaaaaaauuugugaaugaaugagugaugaacgaaugaaugcagagaguaagguaaggccuagaaaggguucuuuugcaagaguaauuucacauauaugguugggcauggacaucaguuacacaguuaugugccacauaaugacuuuucggucagugauggaccacauacacgacaguggucccauaagauuauaacggagcugaaaaacaccuguugccuaguaauguagugucauagugcaacacauuacucacauguuuguggugaugcugguguaaacaaaucgaccaugcugccagucuuauaaacgcauagcaucuaaauuacagugcauaauacuugauaauaaacaacuauguuacugcuuuauauauuuacugcacuauauuguuaauuuuuuuuuuuuuuuuugagauggagucuagcucugucgccaggcuggagugcaguggcgcaauuuuggcgcacuguaaccuccaucuccuggguucaagugauucuccugccucagccuccagaguagcugggacuacagaugcgcaccaccacgccaagcuaauuuuuguauuuuuuuguagagacgggguuucaccauguuggccaggauggucuccauuacuugaccuugugaucugcccaucuuggccucccaaagcgcugggauuacaggcgugagccaccgcccccagccuguuguuauuugagagaguaucucuccuuacagaaaaaguaaaacagccucaggcagguccagguccuucaggaaguggucccgaagaaggagaucuuuuaggagaugacagcuccaugugucauuggagacaggauaugcaggcgcaagacagugacauugaugauccugacccagggcagcugugcaggcuuuaggcuaauguaguguguauuuguguccacaguacuguguauaguaaugucaguaauguccuguucaguguguguucugugcaguguacucacuugccccucucacucacucacucacucacucacucacucacucacucacucacuuacccacccagccauccagagcagcuuccaguccugcaagcuauauucaugguaauagaggugcaucaauuuuaaaaucuuuuguaccauacuuuuacuguguaguuuuucugugucuaacugugcguagauacacacaugcuuacugcagcauuccaguugccugcaguauucaggacagucuugugcuggacagguguguagccuaggggcaauaggcuguaccguagagccuggauguguaggaggccacaccaucucgguuuguguaagugcacugugaugguugcacaaagaugagauugccuucgcauuucucagagcucuuucuuuguuaaaugacacaugaagguacuggguugaggagagggaagguagguaggaaauggagaccaguguagacaacuguuucuaggucuuugaccgugaagaggagacaagcguuagaauuaggacagcaacugaaaggcaucuuucccuguuauccccucauacucuguuuuauauggaaugccauugggaggaaaccccuucagguccuuuucucagcauaagaaucaccuggaguccaggccccaugcucagggauuguggauuuuaagccuagggcauccagguaaacccaaugcaguuguucucuaggcccacuuagagaagugcuguccugggagcuuuguggcguaggacuugggcaccuguuccuuccccuuccaugcgcaugugcagggggcacccaguaccgguagaagggaaggccagcagcauugaaagcgaggcucccuggcccucugccucuccuuuccuguccgggucucuguggcuugcuucccucaggccacuucuaacuguggucuccucuccgcccccugguccuguagcucuucuguguucuuaauuggagucauccucuagccuuucccuuucccugagagaaagccucgccuuuuacagauaucacuagccaauggcagugccucucuguuucuugccagugccccgccagucgccagucgcaggaucguugacaucugucauuaaacuguuuccagcugcuggccuuguucucucagcuguucuucaacacugaagccuuguuucgccugcuuccggguuuggagcucuuccggaggcacaaggguuucagaagguugacuuuuugccuugucaagguuuauagaaggaaaggacagugacauuuaaaguaguguggcuccgaauguuaggaaucauuuucuguuaccuaauaacuucaucuuaguggugauugucuaaauuguaugauauguugacagauuucucaaagcagucucuagugaucauuaaacagccugaguuguauccugaagaaacauguaucuguccauauauggaacaaauauuuguuccauucccuuuguguggaaacugccugcaugcuucauucaucacaguaaugcauuuccucaggaacuuuuaauguuucaggugucuguugucauagcuuuggaaucgugauaacauuauuugacuugcuuagaauuauagucuaauggauuuacuacacacuaaaccuuuuagacaggccuugaaaggugaauuugguaggcauuucacacuucugugacacucagauuuugcuggucucuuggauacagucacaagugauauguaagcaaaacugcaagcucaggcauaacagccugcugggcugagcacgauugcagaagugaaugacuuuucacguuacgcuuaacucuuuucucucgggugcucagagcacaacuuaaagcauucucucugagccaggggaauagcauccuggaauguaagcccuugaagauggaggucuguaaaagaaauauucaguguuaacuuggaauucagugaacuuuuuucauauuaaaggaaauuugucaagaaaaauaauugcacaguuaaauugugcuacaguuguuuucauuaagaaaguagaaagaagacccuaacaguuuaaaaaacaaauggcccucauugucuuuauauugugcauauaacucuuuguuaucuucagauuauaugaaacuauuaguauuauuuuuauauucuucucaucuuuuuuucuuuugccuugagaaagucacguucuucucauuguguacuuuacauccaaaauuauuuuguaacucuuuuuuuuuuuuuuuuuuuuuuuugagacggagucucgcucuuucgccaggcuagaguacaguggcgcgaucuuggcucacugcaaccuccgccucccggguucaagcgauucuccugccucagccuccugagaagcugggauuacaggaguaugccaccacacccagcuaauuuuugcauuuuuaguagagacgggguuucacuauguuguccaggauggucucgaucuccugaccucgugauccacccgccuuggucucccaaagugcuggauuacaggcgugagccacugcacuuggcccucuauaacucuaaauguugcugcauuuuauuauugcaaugacuaauaagucccuaaacuugaugcaguuagauuucccuguuauuggauauaggauauuuacauuuuugcucuugugaauauacuagaguacuauacugaauguguguguauaugugugucaccuuuuauauauuuaaguauuuccuuaggguaaauucccaguagcuggauuauuagaggguagaaauuuuuuuaugguuuuugauauaaauugucaaauuauuucccaaaaaguuguaucaguucacagagcuaccaguugguuucucgcagccaucugcuauaguuuuguuggguuaaaaaacuuucuauuuuugcuaguucaucuuauguugcuuuaauuuacauuuuccaauaacgauuaaaccuaaacuuuuuuuguauaaauuugcuuuuuugaguauuucuucuuguggagggacagauacuuauauauaauuauuagauuggcugcuaguccaagagcaguaaguaguuaagggaucaagucagcaaccaguggccguagccaucuuugaccaaucaaagauauagauucauaucaucgugaaagcuuugauucagagaaaauaguuauauauguaccuaaugguaggaaauugggguaguuguauuuaguauauagaauauuaccuaauuuuuugguuagagguucuagaagacaagacuuuuucaguuugucuuaugcccucuuuuuuuuuguugggggagagguggggggucuggacacucuaggaaauuaaaacugaguauuuuacuuauugcaugcauagaaguugauuuucuuuucuuuucuuucuuuuuuuuugagauggaguccugcucuguugcccaggcuggagugcaguggcauaaucuuggcucagugaaaccuuugccucccagguucaagcaguucuccugccucagccuccggaguagcugggacuacaggcacccacgacgaugccuggcuaauuuuuaguagagcugggguuucuccauguuggcuggguuggucucaaacuccugaccucaggugaucugccugccucagccucccaaagugcugagauuccaggcgugagccagcgcuccuggcagaaguugauuuucuuaaaaaagagagauaauaggaaaacaagcucaaaaaucuauuuggggccuuaugcaggauguuggccuuagccugaagaaauaaaaacugaugaagcgcauuguuagcagagggaugacuugaucagguuuuugaaaacgaauguucagcauugagguaacugaggcaucuggauaugcuggucugggccccugggagccgcaggagauaauggagauagagauucuaugggcugagaccauugguagguuuuaugguguugaggaauacuuaacacugauuuuuuuuuugagcgcuguuaauuaaauguuaaaauauaaucgguuugcuuuagagaaaggcacgaauggauucuggggcucugguauggaaguuauuuucgcaguguaggugcaaggugagggaaccagauagggaggggagaugggcgagggucuguggagaggggcuggagugaaaugguuugagagccaucauguuuauaaaagcaauagaagguacggugggguaauacuuucuauuuaaugcauuuuucauuuuauuucuuuauaacuaauauaaggcacauuuuacauuucagaugaauuuacaaccaauuuucuggauuggacugaucaguucaguuugcuguguguuugcucaaacagguaaaaacaaaaaauuuucuuaguugucuuuucauuuccguaucuuguauugcgcuuugaccaguuagguucauaugagaaccuaagucauaaucaugcugcuccuucuggaagcccugcaauuguuccucuuacucagagaaaggucaaguuccuucauggucaggcuccccucaccccugccaccugggaugaugggaggcaaguuggcuggugaaguacuaaaaugcuagggauugaacacacugcaagaagaucuuuugagaacaugagaguguguaagugaacagaaggcaaaagcaaguauauuuagaagcaaaugaaauaaauguguagaauggaggauuaugaacuguccauuauuaucugcaaagacuuucuagaagacauucucacucuuugauaaaaaagucucacaaaauguuggcaucaucuaggaaagcagugaaaauaaagcugaaaauguauuuaacccuucuauaaagauguggcuccacaucuggaauaauggauacgcaguucuguccucugaaucuugaaaaacuacacugcauagagcaguucgauaucaggauuggaaggacuuacuacaaguaguaaaaaugaagcaggagaccguaaaagaaaguauugauaaguuaguuacauaaaaucaguaauaacaaaaacauucugugucagaacaccguaaacaagaugagaaacuaaacaaagguuccacuucauuaauguguauagaaauccaauaaaaacugaggaacauaacaaaaaaauuugcaaaagacauaacaaaauuauaaaagaaaugguuaguaaaaauaugaaacaauguaaaaccugaaauugauaggcuucaccaaugaauugauauucuaauuuacacuuaugaaaugagcaacaguuuuuuaacauuaaagcacuucgguuggaaaugugguaaaaugguauuuguacacugccguuuugugggagcuuauauuaguaguguugcccuaugguauccauggggaauugguuccaggaccuccuucagauaccaaaauccacaaauacucaagucccugauauaaaauggcaugauauuugcauauaaccuacacauauccuccuguauacuuuaaaucuucucuagauuaccuguaauacuuaauacaauguaaaugcuagguaaauagcuuuuacacuguauuguuuagggaauaaugacaggaagaaaaguauguacauguucaguacagacacuuuuuucccccauuuuugauccgugguugcuugaauccacugauuuggaaaccacagacacagagggucaacuguauauuacuuuuggauagaaauuaguguguauagagaauuuuagaaauguuaauaugcucuucaacuuaguaguuaauuauucuuuuagguuuuauuauaaggaaauaaucagauguguacuaagguuuauauauaagaucaucagcauguguaugugcauguaguacaguauguguauauguguacuugggguguuuauaugugcaugugagcaagcaugugugaacugugcacacauacauuuggaaacaaucuaaauuuguccagcauuaaauagaguacacuuauauugaaauacauaaucauuaaaagcuuuuuaauucuuuuuaaaaagaauuugugaugauaagaauaaaacacuuaggauaagguauaaaaaacaguauacaaaacuguacaacuguauauauaaagugcauccucaguuucauguaaauaauacauguauuaauauauauaugcuugcuuccccuugcuauuuaucugcauaggaaaaagacuggaaagaaauaggcaaaaauguuagcaacaguccucucucaguuaacagauucagugaguugguucuuuaugcucuuguguguuuuccagauuuucuauaagaagcauaugcugguuuuauaaucucagaaaagauacguuggagacagucuguauuagcgcuuaccauguagaaggcauacucuuccuuagguagaugcaaagaaaccuaaaacauacuuugaacauagagccugagaaauucugggauuauggauuagaugaauauggacuuuucaguuauuuaacauacugaaagcaaagggaaagccuugaagauucuugugaguaugguaggaguuaaaugacaagaaauaauacuuugcccaguuuuaagagaacucaugacauuuaugacagucaagaaugauaaauucugaauuaugucuugucuuugauacagaagacaaggaagauaacuuaugucucucuguggcuuucagugucaaggugauccaaaaucacggucccaaauuuugcauuguucucaccgguuugugggagcuaaaaauuaaaacaauugaacucaugaagauaguagaaggaugguuaccagaggcugggaaggguagugagaagguggggaggaagucgggaguguuaauggguacaaaaaaauagaaagaauaaguaugaccuaguauuugguagcacaacagggugacuguagucaauaauaauauaguugcauauuuuaaaauaacuaaaagaguauaauuggauucuuuguaacacaaaggauaaaggccugaggggaugaauaccccauuuaccauuauaugacuguuaugcauuguaugccuguaucaaaauaucucauguaccccauacauguauacaccuauuuacccacaaaaauuaaaaauuaaauuaaaaaauccugcucucuuuggggaaggucuaguuuagaugguaacuaggucauaguauuaauauuuaacauauguauugcauugucauugugauucugauuuuucauuauuuucucucugacacuucacauaaaauguucuguucuuucuucuuucugacagaugaaaauagauguuuaaaagcaaaugccaaaucauguggagaauguauacaagcagggccaaauuguggguggugcacaaauucaguaaguaagguugcucaaguccuuuccauuuguucucuggucauuuaguguggcucagugcuguauccuucagaagcacauauuaauuuuuauguaaaucauaaaaugaauaaccuaaugguuuggagcuaugugguucaacacaguagccacuaggcagauguggcuauugagcacuuuuguacaaauuagaauugcucuaaguuucaaagauauacaagauuucaaagacuuaguauuaaauaaauaauaauggugaaaugauaauuuuuguauauuuaaaaauaauguuauaacaguguuaaaauuuucucuuuuucuuuuuuuaguguggcuacuaaacaauuuuaaaauacauauauuuguagcucaucuuuguggcacauauuagauuuuuaugggagaaccuucaaaaaaauccuagucauuuaguuugacuguuucagauuuccccuuuuuugauggggagguauaaauuaaccuucuuaauuauauuugaguuaaacuacuggaauugauuugcaucccaauauaagcuuauugagguuaauuaggguuuggauuuuauucacuuuugucaucucuauacuuuugcuaauaugguaccuuccacaaagccuacuaaauguucagugagucaaugaaugaaugaaugaauauaucaaaagagaagguaaggagaagucauuuugagguuguauaguuuauucacagaaugaauaacuaauaucagaagaucaagggguuacugauuuuguuuucaugcaggcauuugggcccaaguuucaagugccuauuuuuguaugccuaaguggucaagugucagauaugucguaugguuugaccacaugaaagaaaaaaugagagguuuuguuguuuuucaaaaauuuucuaaugguguuuucuaaaagugguguguugggauuacauuggcaacaguggaggaaauauggaguguugugaguuugucucaggcaaggcuuauguaacugaagcucuugguuuucauaucugaaaaugaggaugauaauauccgcuuuaucuauuguuacaauaauuagaauugaugaacuuaaagcaguuucacuuaaaaacuucuaaauaagugguagcugcuauuauuguuaacauauccauuuuauggggacuacaguuuaucuguaguuaaggauuaucuuagccuuugagcuuuggagcauaauccuuaaaauuuuaaaggcuuucugaauauauucagugaaauuguauuugggugucaugauuguaaauuucguggauugauuaguauuuagaaauguguaauucacuaggaucuugugcuuugguagguaguaguuuagguuuaauaaauagugcagcuuugaauuaucugauucuugguauucccuuccaguuguugauuacauaaauacucucauuaguaugauguuucucuuaaaaaaucuuauguaaaaacuauuguguauucuuuaaauuuaaauaucuucacuuacuguuacuuuauacagcaccguuaaauugauauuugauaaauaaauaccauauauaaugucacuguuucccccacauuuucacauuucuugaaacaccuuuauucacagucuuuauauagaucuuuaacagcaguguuuuugaauucacuaaggcacuuuucaguuauaugauuaaauuuuuauuucuaaguuguuugauguauaccacauuuaaaaucucugucauuacuagaaauuuuacuacugcaaauauccauucaccugccauuaagaacuuuuuuuccuuuuuugaaauuuaccugccauuaggaccuuuuacccuugucauauacuuacuccuuuuacccuugucauauacuuacuauuuugcuuuuuaaaaguuuuuuaaaaacuuauuuacaauaauagcuaauacuuaaaguuuuuucaaaccugugggaauacuuauuuaaucggugcuaaauuucguguuguccuuuuaaaaaaugcaauaauuaauugagauguuuuuaagcucgucuguuuucccuaaacaucggguuguucagcauauugcgauggggagagugccacauaauaugagacgcuuuguaaggacuuuucaaagggaaauuuuggagaaaugaucugauauuuggguguauguauacauuauuaguagccauuaaccaugcucaauuagugauuucacuaaagaaauugcuuuugauuagauacucugaauuacaagauagagcauuuacuguguacacuugggucaguucugggaaagguauuacuuucuuggaaaugauuguuuuuuaacaagaacacuuaccacaguuuggaugaagggagcauuuuguuuaaaagccagaauugggguacauuagaugugauuugauguuuugcaauuuaauugcuuauuugcaauuauuauguaaaaagguuugaccauuacaauuuucauuuauaccuauauuuuauaugucauuuagacauuuuuacaggaaggaaugccuacuucugcacgaugugaugauuuagaagccuuaaaaaagaaggguugcccuccagaugacauagaaaaucccagaggcuccaaagauauaaagaaaaauaaaaauguaaccaaccguagcaaaggaacagcagagaagcucaagccagaggauauuacucagauccaaccacagcaguugguuuugcgauuaagaucagguauggaagcccaacucugugaauaccugcguguuuacuugaggcauucgacaccagcuuuaugcaaacucugaccaguuucuguugaaggcucguuuuuacauguggacuggcacucaaaaauguggaauuguuuaaauuuuagaaaauuuuugcagauauaacaauuguaagacauauuuacuuggaauaauauuaaauguugccuaauauucaaaguaaauuuuguuaaagauucagaaaguauuaauuagcuuuagugaguuuuaaaaaugaaaguguucauccucuggucuaauuacauaauauauuauaaaagcaacauuuuaaccuguucuuuuccuuuguauuuguuuaguauuauuaaacuguuaagguuuuuguaauuaugucuguuagucccacaucuaaacaugaaggaaaaaacaagcccucauccucgcuuuucugguuuccgaccuuucuugucaggagaaugguagaguggcccuguccccugacuucccucccggccccuccucaaccaggucagcccucuccuccucauccugcucuagcaaagcuccaccaucgccuucagcccgcagacccaggggacccuugucaggauuuuuuuuaacucuucuguaccaaguaacacuuuguacuuuuugaaaugcucuguccuugaucaaugauaccacuccucgguuuuucuuugugucucuuaccauugccuuccaggccucuuuuugugucuuuuuucuuccucccuuuuugcaguccaccuaaaugucaguuuuccucucguggcuuuaaaacccaauuguaugcugcagcaacacagacuuuucuugagcuccaaacccauuucuccaauugccuauuagaaaucuauauagagaaaacuacaaguuaaaauuuuaauuacauuuucauccaaaccucucuccuguauuuccuaaguaaauuacauuaacgucucuuguaucucucucuucuccuccuucaucaucucucucuggguuucuuuuguagauuagcuagucucuuugccucauaaugauaauaaaaauaaaauaauaaauaauaaauaauaauaaauaaauaauuauuuuuaaagcugucugccaggcuuucuaaaguaaagaucggaucauguuauucacuugcagggaguggcaucccacuacacacagaacagaguucacaacuucagugucuaaaaagucaguuguacccuaucacguguucugccuugcccucuccagacuaauuuaugguguucuauuuguuuucuucucuuauaaacugacuuuuugucuguuuuguccacuguggauugggaauaucuuuuuuaucuuugcauccugaaggccugguguuuaaaguauuuguugaaugaaacugaauacauacccauugaguuacuuauggaauucccagguuuuuguaaaaauuaugacaacauguuuuauuuuauuguguuuaccguguaaaccacauuuauuugguuuuucucguuugcguuugauugccaacaggcaaguuucauuuucuaaucucuugucuaauuaggggagccacagacauuuacauuaaaauucaagagagcugaagacuaucccauugaccucuacuaccuuauggaccugucuuacucaaugaaagacgauuuggagaauguaaaaagucuuggaacagaucugaugaaugaaaugaggaggauuacuucggacuucagaauugguaggaauguugggaacauugaccauuuucauuauaaagucuuggcaauucucaaauguuguuuuauauuuuauuccuuuguuacucacaacauacuugugagauaaacaagccaguuuuuuagccuuuucugaguggaaguugauauuccagucacacguuuaauaaucuuuucugccaccuuguuccucugucacuggaugcuacuguuugacacagauuguaccucauagauaaugacuugcaugcuuauuuucauacuaacuugaucauuuaucuuaugacuuacuuuauuuuauuuuuaagaguuucacucuugucgcccagacuggagugcaguggugugaucucggcucacugcaaccuccgcuucccggguucaagugauuuuccugccacagccucccgaguagcugggauuacaggcaucugccaccacccccaacuaauuuuuuguauuuuuaguagagauggggguuucaccauguuggccaggcuggucucgaacuccugaccucagguaauccagcugccuuggccucccagaguauugggacuacaggcgugagccaccaugccuggcccuuaugacuuauuuuauaaacauguguugaauacccagauuuuaucuaauugcuaauuaguaugucugcaccugcccguacagccugaucucaucuuagaccuggauuuuucauaugaugaugaucugcuuuccaaaccuuauuuuucccauuucaugcauccccagcuuaaccucuuuuuugccugcuucucuccacuccuguugcucuagagguuuagcaacagaauauuagaaagauuugacaguuaugaggccuaagagcugccuuucaaaaauuagcccuauuuuaguggaaacauuuaaaaauagcacuugcuuaaaauguucuuuuauucuguaagcauaauucaaggaccauggcauuagggagcuccuaucaaauuaguguuuuuuaaaauggccagaauucuagaauauuuguuuauucauuuguucagcaugucauuauugagagcuggugugccaagaaaaugaaugugaguuauuuuuaaaguagggaggcaaaauaaaaagauugucuuaggucuuaguccauuugugcugcuuuaagaaaauacuauaaacuggguggcuuaugaacaacagaaauuuauuucucacagcucuggaggugagaaguccaagauccaggcagauugagcaucuggugaggucccucuucuggguucauagaugauaccuucuugcgauguacucacauagcagcagggagacagcagcucucuggggcuucuuugaugaggucacuguaggagucuauucuuacguugcuauaaagacauaucugacacuggguaauuuaugaagaaaagagguuuaauugguuuacgguccugcaagcucuacaggaagcauggcgcuagcaucagcaaggccucuggggaggccucaggaagcuuccaaucguggcagaaggcaaaguggggagcaggcuucucacauggugggagcaggagcaagaguuggggagagaugccacacaauuuuaaauaacagaucucaugagaacucacucacuguggucagaauagcaccaagccaugagggauugaucugcccccaugaucgaaauaccuuccaccaggccguaccuucaacauuggggaucacauuuuaacaugagacuugggcggggacagauacccaaacuguaucaguuacuaaucccauucaugagggcucugcccucaugaucuaaucaccuuccaaaggaaccacuuccuaauaccaucauguugggaauuagguuuucaauguaggaauuuugggguaacacagacauucaguccauaguaaccuacauuugguaacauagaugaauuuuuuaaacaaugcaaaucucugucuuuccaucuauccauccauucauucauuuauguaccauuuuuuucuuggcaggauuuggcucauuuguggaaaagacugugaugccuuacauuagcacaacaccagcuaagcucaggaacccuugcacaagugaacagaacugcaccagcccauuuagcuacaaaaaugugcucagucuuacuaauaaaggagaaguauuuaaugaacuuguuggaaaacagcgcauaucuggaaauuuggauucuccagaaggugguuucgaugccaucaugcaaguugcaguuuguggaguaagcgcauucauuuccuaucaggggauauuguuucuauuaugugugugaauuuuaagugugauuuuacuaugauaauagaaaaauugaccuuaauuuucauagauuugauuaucuuagagaaguaauuuuaaguaaacccuuaaauugccuguauacauaaagugccuuuauaaaagcauauuuaaucuuuaugcaaaccacacaguuaguuuauucaugcgggcuuuuaaaagacagaaugcuaaccauuugaaacagcggggcaaccucucuguacuguagcugguggucuggauuuuagaaaagcccauguguccuaacuuucuggcuuuguacuagagauagaauugauguuauuaucugaggcaucaccaggaaccuugaaauugcucaaagggagagugucuuguaucauuuuccuuuggucaguuuucuucucacugucuuugaaagacacaucuuucuccugugucuuaguaauucaaaaagagagaacuuuuuaagcucuaguuuuuaaccuauaugaauagauguauuuugagaagugauacaauauuuguaauuuuaauuguaagauuuucaguagcaagcccaucccuauugguucaauaauuuguauuuuaugauccauguagcagcuauguauuuugagaugacacuuuaaugauguggcugaggcugaaacuagaagacauugucaugucaaguuuguccugcguaccuacucuugucucauuuuuguucccuccagugcccccauucucuagaugaccuucuuugauuuuagaggccucuuagugguuauuuuucagucaauuuuugcuaaggugcuaauugaugcccaaaauaauaagugaaggaauauggauaguaauuaagaauuuuucuaucaccacugaugcugggcaauuuacucagccucuccagggcuguuuucuucucuuuaagaagggaucaugauaguaucuaccucauagggcucuugugaaguuaaaaugcaucaaucucuauaaaguaccaaugagcauucagcaaauacuaauuccuauauuguuauuacuuucgacuuuucacuagaguguuugcaauuuaagguuagucccugcuguuauagccgaagcaaguagcauuccagguaguaccuagccuuacaccucuuuucuuacuagccauugaugugugagccuguuagcagcucguuguggggagggcauucucugggcugccucuaacuaggccuuaaccugugguauuaaacaagccauaacacccuugauuguggcuguuuuucuguguuggucaugcugauccacuccucuagaugcaaaagaaucagacauuccacuuuugaaagauugccaguauuaauaaaugugauucccaccuuaaaguauuuuacugucuuaugaagaucuaaacagacguauuaaauaaauuaacgaaagcagguaaauuccuauaguccuaugauuuuauaauuauaaauuaccauagugacaagaagauuuuacaguuacuuuagauucuuuauuggaaagggcaaggauaaaguaaaugagugcauaaacaguacugauugaggaguuagaaugggugaaauuauccuuaaacaagauacuuauuucuguuauaaaaaaaggaagccucauauggugggcugauaaagaaggugcauggcauagaacauagagcagagauggguggauggggacaagacagcagcagugggguaaaguaaggauaggcucagacacuuucauuuauucagcaaaugcucaucaagggcuuacugcuugccaagcagugugcuggcuugcuagcugcuggagauaugaugauaagcagaacuaaaccaaaccaaacaaaacaaaaaaacaguuuuuaaaaagaacugagagauugagagauacggauggucaggcaagauaucguuguacaugggauggaagagcuucauucagugggcuuuguguguuucucagcaagauaauuaccauuguauaaagagaagacacagaaaauacagaauuagguuaaaaauacaaugguggccuauaugaaaauuaaaggauuuuuguugaauuacugugaauaguguuuuaaaauugaaauccuuuucuuuucaagucacugauuggcuggaggaauguuacacggcugcugguguuuuccacagaugccggguuucacuuugcuggagaugggaaacuugguggcauuguuuuaccaaaugauggacaaugucaccuggaaaauaauauguacacaaugagccauuauuauguaagugccugguuccuuacauagugaauguguuuauguuggauuuuaauguuuaauacuaagagcuugugggugacuggcuugggguuucucaggguuugagguuuugcuguuuugguaaguagggguccugauugaaagugcaggaaagcuaguguugcuguuugugaagaugcagcuuuguauuugcuuccuucugcucagacaagggccucacuggggugggaaagggaugcccagaugccacuuucacucuuugccucaacuccccgcccacagcauuugguagcacagucaguacucuuucuaaauaaauaauuuaucuagucucauacucuuuguuuuauacgauuuuuaaaagcagucacucugccuuuauugaaaauaaauauuggcaaagcauucaaguucuagaagaaauccaaaugguaaaucuuggucuuuuucuuaaguuguagauaauagaauauuuaauuacugacuauucuuuaauuucauuguccuuauauuuaauauacauagauaaacuuacuauuuaaaaccuuuugaauauggaauuuuuuauucauacaugaaaguaaagagaagaggauuagcaauucauguauacacacgacucacuucagcaguuuauauuugauacuguuauuugaaagcagucuuguaaucuaguuauauguaugcaacuagauguaaucuagcuauauauggauuauauauguaaucuaguuaucuaaagcagucuuguaaucgaguuauguguaaucuugcauguauaacuagauugaaaaauuagaagagauuauaaggguguauuuaaauacuaaauuauauuacuugauuucuuaggauuauccuucuauugcucaccuuguccagaaacugagugaaaauaauauucagacaauuuuugcaguuacugaagaauuucagccuguuuacaagguaaaugugugagauaaaaagaacaagauucuaaacauuuuugauuguuagaggcaaaucaugucugaauugaaaugugggaaaaugccaccagauaggcaaaccgaauuuuacaaaagugguuuauauuaauuuuuaaucacauauuauaaaacugguuucuagguuugacuccuaaaguuaguuaggaggaaacaugggaacuggcauuuaaagauaaaaguugcucaguggauccuaauugguugaaugaauagcaguuguauuuuacguguuuuaucuuuuaauugcaggagcugaaaaacuugaucccuaagucagcaguaggaacauuaucugcaaauucuagcaauguaauucaguugaucauugaugcauacaaugugaguacaucuuaaauaagaucaguuuuggacaauacccuguugagaauacuuuguacaaagaaaguaaaacuuccuucauacacacuuuagcgagcccaaaguacuacagaaaaacuuaaauucuguauguaucuagaggaaaaacuuuauacauauugucuuacaaaagcaagauucauggccuaaacaaagugaaaaugugauaaaggcauguggggaguauuuccaaauaacuguuuguuuaucauuaaggaauagaucuccuuguuagaaagcaauuguaaaacauaacuuacauuuaaacuuacaggauuucuccaaucuuuuuccuccccaaaauauccuuuauagagucaucuauucugaugaauugugcuagaaaaguuuuuuuuuuugccaauucuucucuucccauauauucagaggauauggguuucuauuucaggagguacacacucauauauacguauaccauaaaauauauaaaaauguaaauauacaugugauuugccuauuucaaaaagauuuauaguguuguuuuccccucacagaugggaggaaguugaauugaaauuaaagaggaauuggcuuauccuuuuugagcauaauucaguguacuuuaaucacaccgaguuagccuucauuaauaaucauuuaaauaaucugaaggcgguuguaauuugguagguaacccuugugugucucgugcaccacuuucagcccccaucccccuaacccuuuggcagcuugaauuuuagacauuuuuacuucaugucauggggguaccauaacgcuuuggaaaggccagccuaccauaugaggcuucccuuuuuuaugggguaccauaaugguuuggaaaggccugacuuggagggguuuuuauaaagguuuuuaauauuuuacuuguuccacagcuuuucccauucuccccugucuuagauaauuuuccuaacucuuguucuuucaggggugugaacaagagauagcuugccauuguacccuucuccauuuguccugaauagucucauauguuaaacaagcccuggcuugaauccuuccuucuugggggauuuuguuuuuuuuuuuuuuuggcugggcuacaaugguuccuuaagcaaauuuguuccuagacugcauaguugauuguuuacccuaguccauaguuagcuggagagguaggacuacagaaaugccauuuugccgauggggaagacagcauuuauuucguuuuuuuuugggggguuucuguuuuuguuuuuguuuuuguuuuuuagauggagucgcacucuguugcucaggcuggagugcaguggugugaucuuggcucacugcaaccccugccucccggguucaggcgauucuucugucucagccucccgaguagcugggauuacaggugcacacugccaugcuuggauaaauuuuuuuuuuuuuuuguauuuuagcggagaugggguuucacuguguuggccaggcuggucuccaacuccugagcucaggcaguccaccuaccuuggccucccaaagugcugggauuacaggugugagcuaccacacccggccuauuccacauuuuuaagacuccuccuaauuaguaacagcccucugcacugugugauccugaguauuuuaacucagugauuaaaacaggaauacucuuuucaauuguguauuuuauuuuaaagauuugauccuuauuaauuaaaaccuguuucucuggccucuguguuuucuaguuacucaauuggauuuggcuuguagauacuuuauugaaauauauuuuuuucugagcaguuuauccauugguuuuaugcauucaaguagcauuuuguuugacuuuuccuguguauaauuaggcauucuuuuagucccuuuccucagaagucauuuuggaaaacggcaaauugucagaaggcguaacaauaaguuacaaaucuuacugcaagaacggggugaauggaacaggggaaaauggaagaaaauguuccaauauuuccauuggagaugagguauguuguauaaagcauuuucuguagaaaacauugguuauuuauaagcaaauuuaguuuauaguuugagaaacauuaaaauaagugagcaacuuuuugaaauauuuuuuaguagauuuaaauuguuuaguugguuguuaaucuuuuuuuucccuucaagguucaauuugaaauuagcauaacuucaaauaaguguccaaaaaaggauucugacagcuuuaaaauuaggccucugggcuuuacggaggaaguagagguuauucuucaguacaucugugaaugugaaugccaaagcgaaggcaucccugaaagucccaagugucaugaaggaaaugggacauuugaguguggcgcgugcagguaagcuggguguugucagacagugacagagcuacauugguuuagagaguauaggcaggucauauuuugggacauccagagaauaucucucuauuuggagcaaauuauuuuuuccaaccacgguugcucaccacaagaucaguuugaugaucuugugugugauauuuauagaaaguuccuuccugccuuuuuuucuuaaagugauuacucuuuaaaauaaaagauuuuauagccaugaaagaaguauauucaacaaauuguuaagguagcguuucucucaugugagagcaaucaauuuucuagaacaaaauaagcuuguguaaaauaacguuuauaggaaaauguuuuggaaaaacaucaaaccgaugauggcgauuucgucugggaaauggaauuaugaagcaguagaagauguuugucuuguacuacauguacuucugcauuguuggaauaauuuuuaaaaaauaaauauguguuguaaaauacaaaagagaaaaugguauuuucaguauguagaaucuaguacuaagaaaacuaacaaaauuacuucagauuuuauuuucacacugugguuacuuuuuguaauugaaaaugaaaaacugaguauacauugaauaccgcuuucucuguaaaagaauaggaagagggaagaguguuuaauccagugucagccccaaaagacuaggcuuagaaggcuauugacuaugaaagaaauauauggcuuuagcucacuaucaauuuuuaauugucugugcuaaguaacaauuuaaauguuagaguuucuuuaucuuccauguuguacauauccuguuuuaaucaugcagguccauuuuuaguaaaaugucauuuaaccaaaaagauuaucuugaaaauacuuugccuuucuuuccuuuauauuuuuaccagauacagaaucagugcagucaguguccaugagcauuauguguucuaaaaauacacagggaaccugaaaagucugcacauguaggauauauuuauuuuuaaauaguauacuaguuauauuuuaagugguauacacaguauguuuuuuuucaacuuccauacacuuuuuugcauguguuuauuguauuuuuuuagguuaacagaccauugcuuuaaauuuagacaguucaccuggaauaguaaauguaauagcauaccauuugaaaauguaacuaacgugcucuuuaaaauuaaguuuauucugccuuuccacaugugucauucacuauucauugcuagauuacauuuuugucuugaccaaaaugguuacuuuccugaagaaauuuuuuuccuagacucuugcauauauuccauaugaacuugaguggcuggaauguacaugugcgccuguguauguuugucccugcuugcacauguguguacacuuuacuacacgacugugacuuguggcauggacacucccaccuaacagauuaggagcuugaagagauuuuuuauaguuuuauuuucuuucccaguuuuucccuuuuaaauuauuauuauuauuauucccuccaagaugauucuucuucuuuuuuauuauacuuuaauuucuaggguacaugugcaaaacgugcagguuuguuccauauguauacaugugacauguuggugugcugcacccauuaacucgucauuuacauuagguauaucuccuaaugcuaucccugcccccuacccccaccuuaugacaggccccagugugugauguuccccacccuguguccaaguguucucauuguucaguucccaccuaugagugagaaggugcaguguuugguuuucuguccuugcgauaguuuucucagaaugaugguuuccagcuucauccaugucccuacaaaggacgugaacucaucauuuuuuauggcugcauaguauuccauguuguauaugugccacauuuucuuaauccagucuaucauugauggacauuuggguugguuccaagucuuugcuauugugaauagugccgcaguaaacauacgugugcacgugucuuuauagcagcaugauuuauaauucuuuggguauauacccaguaaugggauggcugggucaaaugguauuucuaguccuagauccuugaggaaucgcuacacugucuuccacaaugguugaacuaguuuacagucccaccagcaguguaaaaguguaccuauuucuccacauccucuccagcaccuguuguuuuccugacuuuuuaaugaucgccauucuaacuggugugagaugguaucucauugugguuuugauuugcauuucucugauggccagugaugaugagcauuuuuucaugugucuguuggcugcauaaaugucuccuuuugagaagugucuguucauauccuucucccacuuuuuggugggguuguuugauuuuuucuuguaaauuuguuggaguucuuuguagauucuggauauuagcccuuugucagauggguagauuguaaaaauugugucccauucuguagguugccuguucacucugauggcaguuucuuuugcugugcagaagcucuuuaguuuaauuagaucccauuugucaauuuuggcuuuuguugccauugcuuuugguguuuuagucaugaaguccuugccuaugccuauguccugaaugguauugccuagauuuucuucugagguuuuuaugguuuuaggucugacaucuaagucuuuaauccaucuugaauuaauuuuuguauaagguguaaggaagggauccaguuucagcuuucuccauauggcuagccaguuuucccagcaccauuuauuaaauagggaauccuuuccccauuucuuguuuuugucagguuugucaaagaucagaugguuguagaugugugguauuauuucugagggcucuguucuguuccauaggucuauaucucuguuuugguaccaguaccaugcuguuuugguuacuguagccuuguaguauaguuugaagucagguagcgugaugccuccagcuuuguucuuuuggcuuaggauugucuuggcaaugcaggcucuuuuuugguuccauaugaacuuuaaaguaguuuuuuccaauucuaugaagaaagucauugguagcuugauggggauggcauugaaucucuaaauuaccuugggcaguauggccauuuucacgauauugauucuuccuauccaugagcauggaauguucuuccauuuguuugaguccucuuuuauuucguugagcagugguuuguaguucuucuugaagagguccuucacaucccuuguagguuguauuccuagguauuuuauucucuuugaagcaguuaugaaugggaguucacccauaauuuggcucucuguuugucuguuauugguguacaggaaugccugugauuuuugcacauugauuuuuguauccugagacuuugcugaaguugcuuaucagcuuaaggagauuuugggcugagacgaugggguuuucuaaauauacaaucaugucaucugcaaacagggacaauuugauuuccucuuuuccuaauuaacugaugggcuucccuuugugggaauauuguuauguguuauuucuuucuccugccugauugcccuggccagaacuuccaacacuguguugaauaggaguggugagagagggcaucccugucuugugccaguuuucaaagggaaugcuuccaguuuuugcccauucaguaugauauuggcuguggguugaucauaaauagcucuuauuauuuugagacacaucccaucaauaccuaguuuauugagaguuuuuagcaugaagggcuguugaauuuugucgaacaccuuuucugcauuuauugagauaaucauguguuuuuugucuuagguucuguuuauaugauggauuacguuuauugauugccuguguugaaccagucuugcccagggaugaagccaacuugauugugguggauaagcuuuuugaugugcugcuggauuugguuugccaguauuuuacugaggauuuuugcaucgauguucaucagggauauuggucuaaaauucucuuucuuuguugugucucugccaggcuuugguaucaggaugaugcuggccucauaacgugaguuagggaggauucccucuuuuucuauugauuggaauaguuucagaaggaaugguaccagcuucuguuuguaccucugguagaauucggcugugaauccgucuggucuuggacuuuuuuugguugguaggcuauuaauuauugccuccauuugagagccuguuauuggucuauucagugauucaacuucuuccugguuuagucuugggaggguguauuuguccaggaauuuauccauuucuucuagauuuuccaguuaauuugcauagugguguuuauaguauucucugaugguaguuuguauuucuguuggaucgguggugauauccccuuuaucauuuuuuauugcaucuauuugauucuucucuuuucuucuuuauuagucuugcuagcggucugucaauuuuguugaucauuucaaaaaaccagcuccuggauucauugauuuuuugaagggcuuuuuaugucucuaucuccuucaguucugcucugaucuuaguuauuucuugccuucugcuagcuuuugaauguguuugcucuugcuucucuaguucuuuuaauugugauguuaggguguccauuuuagaucuuuccugcuuucucuugugggcauuuagugcuauaaauuucccucuacacacugcuuuaaaugugucccagagauucugguauguugugucuuuguucucacugguuucaaagaacaucuuuauuucugccuucauuuuguuauguauccaguagucauucaggagcaggucauuuaguuuccaugcaguugagcaguuuugagugaguuucuuaaucuugaguucuagcuugauugcacuguggucugagagacaguuuguuauaauuucuguuauuuuacauuugcugaggagugcuuugcuuccaauuauguagucaguuuugcaauaagugcgguguggggcugagaagaauguauauucuguuguuuugggauggagaguucuguagaugucuauuagguccacuuggugcagagcugaguucaguuccuggauauccuuguuaacuuucugucucguuggucugucuaauguugacaaugugguguuaaagucucccauuauuauugugugggagucuaagucucuuucuaggucucucaggaccugcuuuaugaaucugggugcuccugcauugggugcauauauauuuaggauagucagcucuuccuguugaauugaucccuuuaccauuauguaauggcguucuuugucccuuuugaucuuuguugguuuaaagucuguuuuuucagagacuagguuugcaaccacugccuuuuuuuguuuuccauuugcuugguagaucuuccuucaucccuuuauuuugagccuguguuugucucugcacgugagaugggucuccugaauacagcacacugaugggucuugacucuuuauccaauuugccagucugugucuuuuaauuggagcauuuugcccauuuacauuuaagguuaauauuguuaugugugaauuugauccugucauuaugauguuagcugguuauuuugcucauuagcugaugcaguuucuuccuagcaucgauggucuuuacaauuuggcauguuuuugcaguggcugguaccaguuguuccuuuccauguuuagugcuuccuucaggagcucuuguaaggcaggccugguggugacacaaucucucagcauuugcuugucuguaaaggauuuuauuucucuuucacuuaaagcuuaguuuggcuuaauaugaaauucuggguugaaaauucuuuucuuuaagaauguuaaauauuggcccccacucucuucuggcuuguagaguuucugccgagagaucugcugcuagucugaugggcuucccuuuguggguaacccaaccuuucucucuggcugcccuuaacauuuuuuccuucauuucaacuuuggugaaucugacaaucaugugucuuggaguugcucuucucaaggaguaucuuuguggcuuucucuguauuuccugaauuugaauguuggccugccuugcuagguuggggaaguucuccuggauaauauccugaaaaauguuuuccaacuugguuccauucucccugucacuuucugguacaccaaucagacaucgauuuggucuuuucacauagucccauauuucuuggaggcuuuguucguuucuuuuuacucuuuuuuuucucuaaacuucucacuucauuucauucauuugaucuucaaucacugauauccuuucuuccacuggaucgaaucggcuacugaagcuugugcaugcaucacaugguucucaugccaugguuuuccgcuccaucaggucauuuaaggucuucucuacgcucuuuauucuaauuagccauucgucuagucuuuuuucaagguuuuuagcuucuuugcgauggguuugaauauccuccuuuagcucggacaaguuuguuauuaccgauuaucugaagccuucuucucucaacuugucaaagucauucuccguccggcuuuguuccguugcuggugaggaggugcauuucuuuggaggagaagaggugcucaaauuuuagaauuuucagcuuuucugcucugguuucuccccaucuuugugguuuuaucuaccuuuggucuuccaugauggugauguacagaugggguuuugguguggauguccuuucuguuuguuaguuuuccuucuaacagucaggacccucagcugcaggucuguugggaguuugcuggagguccacuccagacccuguuugccugaguaucaccagcggaggcugcagaacagcaaauauugcagaauggcaaauguugcugccugauccuuccucuggaagcuucgucucagaggggcaccgggcuguaugaggugucagucagccccuacuaggaggugucucccaguuaggcuacucgggcucagggacccacuugaggaggcagucuguccauucucagaugucagacuccgugcugggagaaccacuacucucuucaaagcugucagacacggauguuuaagucugcagaaguuucugcuggauuuuguucagcuaugcccugcccccagagguguugucuacagaggcaggcaggccuccuugagcugcaaugggcuucacccaguuuuagcuuuuuuuugcuuuguuuaccuacucaagccucagcaaugggggauaccccucccucggccucccugcugccuugcaguucaaucucagacugcugugcuagcagugagcgaggcuccaugggugugggacccucugagcugggcaugggacccucugagccaggcgcgggauauaaucuucugguguuccguuuucuaagagcauuggaaaagcgcaguauuagugugggaguguccugauuuuccagguaccgucugucacagcuucccuuggcuaggaaagggaauuccuugaccccuugugcuucccgggugaggcgaugccccgcccugcuucggcucacacuccaugggcugcaccuacuguccagcaagccccagugagaugaacccaguaccucaguuggaaaugcagaaaccaccugucuucugugucgcucacgcugggagcuguagacuagagcuguuccuguuuggccaucuuggaaccucuuaaauuauuuuuguuuugugugauugcaauuuuggcauguuucuucaggugcaaugaagggcguguugguagacauugugaaugcagcacagaugaaguuaacagugaagacauggaugcuuacugcaggaaagaaaacaguucagaaaucugcaguaacaauggagagugcgucugcggacaguguguuuguaggaagagggauaauacaaaugaaauuuauucuggcaaauucugcgagugugauaauuucaacugugauagauccaauggcuuaauuuguggagguaaguaaagggccugaagugguuguaagaugugaucccaucuaaugccacgaaaaaucuugaguuuaguuggugcauaaguagaaaagggguagcuugagggucagucucgccccuagguauacuuucucacauguuguugcuuauuuuacuuuucagucaauacugugauuguauauuuuuaccauuuugagaaaugauaugcuuaauugcaggaaaugguguuugcaagugucgugugugugagugcaaccccaacuacacuggcagugcaugugacuguucuuuggauacuaguacuugugaagccagcaacggacagaucugcaauggccggggcaucugcgaguguggugucuguaaguguacagauccgaaguuucaagggcaaacgugugagaugugucagaccugccuuggugucugugcugagcauaaguaaguauuuccuaauugcuugaaauaguugauacuuccucuuggcucuccuaagccuguauuguuucuagaaccagaacagugccaauauuaaaauauacuguaaauaaaaugccugccauguggaagccuacucuuuaauucuuaaaaguucuuucucaacagcuaguauauauuacaugguaugaagugugucaugugagaguuguacuauuauuuugaucugaaugugcuagauaauugaauuuacaugguaaccuuuauuuuggcaauuaagauuuaauuuaauuuaauuugucauuaccaauuucuuaauuacugucuuuugacaaaacuaagccaaauuaaagauuuuuccucuugaaggauuauuauacuaguaacauauuauuuaaauuauuaugauuuuggccgagcacaguggcucacaccuguaaucccagcacuuuggaaggccgagacagguggaucacuuaaggucaggaguuugagaccagucuggccaauguggugaaaccccaucucuacuaaaaauacaaaaauuagccagauaugguggugugugccuguaaucucaacuacuugggagguugaggcuugcuugaacccgagaggcagagguuacagugagccaaggucacaccacugcacugccuggaugacagaacaagacuccaucgcaaaaaaaaaauuauuaugauuuuauguuacauauuuaauaugugauagggcuaauuuauuuuacuaucuuuuauuucuuaauaggguuuuaauuugaacuguaauaaaucuuuaauuuuauuauggaaauuagcaucuuuuuacauaauuuuucuauccacaaauguaauguuccucuucauuuauugaaaucuuccuucauagcuguuuguucaauuuggucacaagaguuuagcaugggaaauauguuuaagcaaauauuuacugaaauaauaaaauguaaauaucauaauuuguguuuuuuguaacagagaauguguucagugcagagccuucaauaaaggagaaaagaaagacacaugcacacaggaauguuccuauuuuaacauuaccaagguagaaagucgggacaaauuaccccagccgguccaaccugauccugugucccauuguaaggagaaggauguugacgacuguugguucuauuuuacguauucagugaaugggaacaacgaggucaugguucauguuguggagaauccagguagaaaugcgaugauugcagacauucuuuucauaucuuguaugucuuguuucugcuuauuuaggccuaacauccagaaacagccuccagcuggaauauuuuaggucaaguugggaaauuuuucaucucucaaagcuuaaaauauuaucuaauuaacuguauaagaaauaaggaaaagagaguuccacuuuuaaguuuucugaguggagaguuugaagauuaaauacagugauuuauauaagacgcuuagugauuuauauaagacacuuagaacgaugccugacaccaagugcauauuaagaguuuuuugaugauugaugauuuuaaaauuagagcuugauuuaagcuugaauacugggaaagauaauuuguuaaaggauauuaauauaaaguguugaauuuguucaacuucuccggaggugaaacuuuuuuuuuuuaaucuuaguuuuccuaguagccuuuuuguagauucuuuggaauuuucuaccauaguguacauguuuuugugugaacauaagcuuucauuucucuuggguaaauacuaaaaauggcauuuuggagcauaugguaagcauauguuuaacuuuguuaagaagcugccagacucuuagacucccauacuguuuugaauuaucagcuagguguuuugcaaauauugucucccagccugugucuccuuaucauuucauuuuuuuaagugucuucugaacaccacagguuuuaauuuugauuaaguacaguuuaccaaguuuuucuucuguggcucuugcuuuuacauugucuuuaagaacucugccuaacccaagauuauaaggauuuuucuccucuguuuuuugguagaaguuuuauaguuucugggguuucacauuuagaucuguaacucauuuugaguuagugugugacaaaaggcucaguuuuuuucaugucaguguccacuuguucuaggggcauuuguugaaaaaagacugucuuuucuccaccuuuguugaacaucaggugaccuuacauguguaggccuguuucugacucuguauucuguuccauguaucugaguguuagcuauaccacauggucuuguagcuuucuuuauagcuaggccugaaagcagggucuuccaacuuuauucuuuuacaaaaguguuuuugagacacuuccuuaguucccugccuuccauguaaauuuuagaaguggcuuacugauugcuacagaaguucugccaggaguuugagugggauaccauugaguuuauagaucaaauugggaagaauugacgucuuaacgguauuagguuuuguaacuccugcacauggaauaucucuccauuuauucagucugaaagauuucuuuuuaucaguauuuaguaauucuuaacaugcaaaucuugcauauauuuuguuagacuuauauguaaguuuuucaugcuuuuucauucuguaguaaauauuacuguuuaaaaacuuauauuuucaauauguagaaauaaauuauauauauagaaaaauacaugauuuuuguucauugaucauguauccugcaaccuuguaaacucacuuguuaguucuaagagcuauuuuauagauucuuugggauagugugcguucacucucuuggguguuuauuccuguauguuuuuuauaagacacugcacagcucuuuguggugcucauuauuaccuucuuauuuuccagagugucccacugguccagacaucauuccaauuguagcuggugugguugcuggaauuguucuuauuggccuugcauuacugcugauauggaagcuuuuaaugauaauucaugacagaagggaguuugcuaaauuugaaaaggagaaaaugaaugccaaaugggacacgguaaguuacaaaacauccaaaaagcaaaguggcuuauaaaguaaauguaauacuccuaagacuuauguauuagcugucaggcugauuauuaaaguccuuucuaaguauuuuauucccccaaaaguuucuuacucaaggaauuugcauuuagugaaaaacagaaagcauccuaaauauaucccauugaaacaaaacauugauuauaagcauguauauucugguuacuguggccaguauuuuuauuucuuuaauaguuuugauccuaaaucugccuuuucaucuaaugugaaguagaauccuaaauaauguuaucuguguagcaagcuauucaauggaaagcugcuucuuucuuuaaaacaaacaaacaaaaaaaaccuucagugaaagccagauucaaaagguuauauaccaagcuuguccaacucgcagcucgucggccaggacaugcagcccagaauagcuuugaauguggccccaacacaaauuuguaaacuuucuuagaaauuguaauuauuauuauuauuuuuuuuugguaacuuuuuuuuaaagcucaucagcuaucguuaguguauuuuauguguggcccaagacaauucuucuucuuccaguguggcccagggaagccaaaagauuggacaccccugcuauauacuauaugauuccauuuagaggacauucuggaaaagcaaaacuguaggggcaaaaaucagugguugcuaggggcuggaaugggggaaaguguugaccacagaggggcguaagggaucuuccuugggaugaucuugauuguggguggauuuauguauuugaaaacucacagaacuauguacuuuaaaaagauguauguuccucuaugaaaauuauaucucaguaaacuuuggcuuauaaaaaucuuaaaagcccuaagugaccgaaagguuauguuagcauugagugcuuugaaauauggagucagagggugggguaaccaaauguuggccuuuguguauucaucuuuugauacaagaaagcaaugccaaucuucaguauuuuuaaauuguaaaugaauuuuguaguuaguugcacuuuacuacaauuugcuuggguuuuuaaaaauuaucaauuuuuuaaauuacaaauuucagaaggguagaaauaaaaaaaaagacauuuauaguguucaaacacuauaaagggauuuuuuuuuucugaugaaaucauuagaaacuauuucuuuuacuuuagcaagaaaauccgauuuacaagaguccuauuaauaauuucaagaauccaaacuacggacguaaagcuggucucuaaauugccguucguauuuuguuucacuuucugccuuugcaugugaacuucuaucuuuuuuacugcacuguguguccuuuaucacuauugcuguucuuuuuuuaagucuggcuuuaaauaucgcuauuguggcuuuucuuuuuguauguuaacuucgcguuuagaaagaccguaaaauaaguaaugugauauagaaacagcagccauguuguagugaaaagagaaugugcuuugcaaucaguuagaccucaggucaaaucccaccucuuccacuuaguaaguagaacagcauugagucacuucacuucucucaacugucacagggagucaguacucuguuuuguauggggugguuguauuuggcaaaugcacuccaguauaugaaaucagccugucagcucuaauccucauaacaguccugugccuagaaugauauuauccuauuaucuuuuguucuuuuucuguuuauuuauuuauuuauuuugagacagucucucucugucgcccagccuggagugcaguggugugauaucagcucacugcaaccucugacuuccagauuccagcaauucuccugccucagccucccgaguaccugggauuacaggugccugccaccaugcuaggcuaauuuuuuuguuuuuaguagagaugggguuucaccacauuggcugggcuggccuugaacuccugaccuccagugcucugcccaccucggucucccaaagugcugggauuacaggcgugagccacugugccccaccaguauuauccuuaaauaacaaauuuguuaugaguaaauuuuaggguuggauagugaaaauugaucacgaaauccaaauugcaaaauagaaaaauauaaccuacuaugauauuuguaugguaugcaacuacaauaucauuauugguucucaaaagauuugagaucaauuucuugaauauaacuugaaauuucauuaaaagccagaagaccauauauauguauguauauuauauauauaugugugugugucuguguguguaugugagaaugauucuaauuuucaaauguaaguuuguaacuguucauaucugaauuuucaugaaaugcuuccagcauauucuaauaaaaucaugcaagccccuaaaacucugauaacaaagguuaauugugauuagaacuaaauucuccugacuggugguugagaacucuucuucucuuucccaacugacugacuguaauagggccuggaagauuucugcuuuucucacugccuaccuuauugugcagauaaagaugguauugggaacacuuacauaaaaaucacugugucucaggcaugauucugaccacuuaaucuguguuuaaucuucauagugaaaguuguaggaauguuuuacauaugagaaaacugagacacauaaggguuauguaacuugaccgaguucccacggcugguuagucagagagcugagauuugaacccaggcaguugggcuccagaguccauguucuugucuaugacauuguacuugguagcaguuauguaucuucagaagucccguuaccugguuaggaagagguagaucacucuuuauagagauuuacagcccuuuuacaauuuguuguuacucugucagaguuaacacugcugcuguuggcaaacaucauguuagggaaaucacuuuaauacauggaacccagugcuguuguuguguuuuuugacuauugagagugugcuuacaaacugaucaugaauaagagccuacaguacaggaauguuuaauaguuacaagugauauaggaagugcugauaacauuagaaaucauuaacuugucagauuuuuauuucuaaguagaccguaagauuuuuaaaguuaaauuugauggcagaaaauuauauucaaauucacauaugggcagguugguacauauuuguauuagucugagacaauauauuuuucucguucucacuuaguacuuuacagaaagucauuuuuagaggaaaacugauuagccaaugacauugccaggcuuuuuuuuuuuuuuaauacauauuuuuuucuuuaguuguaggucaaaaauagucaaauguugacaauuucaugugguuauuucucacaagagaaaaaauuucuguccuacugaggugaaauuuucacccuugcuguaccuuucauuguauuuugaaggaaauuaucaguaaauguuauuuaaacuuaauguuuauaauguauauauggcuaaaauguugcuaaaauaagcauuuuauguaauucaggaagcagaaguuugguaaaaauuucucuaugcauuauugaaguccaggcaauuugauggcuacagauuauuuuaagagauguuuuucucaagaaaaaguagaaauuaacaauugaaauaaaugaaugagcaucaagaaauuacaucauggauuguaagaaacuuuucugauauggaccaagguuugccagucaauuaugucauugaaauuuuugaaauaaugggcaggcgcuaauuacuuuggcagaagacuaccauguaggaacauuaagaagaacaugucacauuaucagcuucuaacuguuggaguggguuaaaaaaauggucuguccucaucugcugcuaugcggguuuaaauguggcucccaaaucucccacacuucugcauuauguauuuaauacauuguagagaugguucugcagcuaccacugucagccauuccagagugagcacaaagaugacauuuuacugagcuugagggcuuccuuucauaauauaacccuguucucuugcugcggguuuuuuugggguggggugguguugcacucugaaugauggaaacuaauuugaauuauuuuaguuuaccuucauuuaaaaugaugccuaauacagauagugagcuuaauuuuaccucuaaccuugcauguuaaacuuuuguuugaguggacuuugaaauaauaaauacaaauguuuguguauacgacaagacagauuuuucuccaaagguaaguucuuccauauaaauuacacuuuggacucaucuauauagggcuuuuuuucuuuauuuuuuguuuucuuuuuuuuuuuuguccuucccuuauaauucuugaguauuaaauacuagauuuagcaaauauauuguauuaaagaaauuuaauuagaugcuaauuuauuuucccaacauauuugaaggaauguguagcacuuagccucaaaucagauaggauauaaauguggaguguaauuuauuugcacucuggcuuuuuaagauaguaguugccaaaauccaguuuccugacccccauuuugaaaugucugcucucacagcuguauaauguauuagcuucaguugggacuagagcugagaguuugauguacacaguuuugucauccacauuauaugcuguuugucucugagggauccugaguuuguccauguuucugaaacaaccagucaagguguauuuugaggagaggggagugagggcugagguauguugucugguucugauugguaucacaugagcugcugagcugaaaucacagugguuuauuuggugucuugcaggacccagccuuuauauguuaauguuuuucccucauugguaugggauaccuacaggaugaaguuucagacuucauagcaaggccucuaggacuguucuuccuuugucuccucaccuccaaucauaugcccccuuaauucuuuuuuuuccucuuuuuuuuuuuuuuuuuuuuuugagauggagucuugcucuuucgcccagucuggagugcaguggugcgaucucagcucacuacaaucuccgcuucccggguucaagugauuccccuaucccagcuucaugaguagcugggauuacaggcacccgccaccacacccagcuaauuuuuguauuuuuaguagagacgggguuuuaccguguuggccaggcugaucucaaacuccucaccaaaagugauccacccaccucggccucucaaaguucugggauuacaggcaugagccaccgcgccugcccuccccuaacucuagaaacuucugaacuguauguauuucuacuuaaaugucccauucuuuucccuacaccuugacuuugcauagauugcuauuuaccaaccaauaauuuuucuagucaauuucacaaugaaaaucuccuuaaucuucuuaaaguuaauaacuuuuuucuuauacuauucccagauuauguucauaacucuauuguaaacuucaucagagugccuuauuuucaugucucucacccaccaaacuauaccuuccuugagggcagaaauugugccaccaaaaggcagauccaaauacagucugcaaugaagugugaauaaaauuuaaaaacaaaaauuacuuuuagaucaaaaaauguuuuagaugcuuucuauaaauauuuuuuuaaaaaucaccugcaguugguucuauagugagauauaaaacugaacaacauuccaaaaucuuaauuuuuucuuaaaaaaaauuucccugguaguuaacaaguauuuuuuauuuguacucacuguaauuuucucugauuaaguguuauuuggucacacuucucacuuggcuuucaagccugcuuucaauuuauaagaacaggagaaaaaagaaugcuauagcaaguauuuaaauguagcaguuauaguauaagagaauuuuuaaggaaaagggugauacagugauauguuuuuuucugcuuaaaacaucacugucaguauauuuuuggaucuugaaagaucucuuguguuuauggcuuggggccugcuugcuaggcuugacuucaguacuguuuacuaaauuauagcacugcaauaagacauuucaccaauaugauauugaagcauaacaaguuauuucauaaggaaugguaauuaucuaacauucuaagcaaauuuggcagugugacuugguggggcgcagugcugucccugacacaaugacagccuuacucucuaaauuaguaacuuccguaggagaccccagaagcacaccucccucccagcagugaaagccgaggauucccguuuugauuagcaggcgccuucuguucacgauaaagggauaagaaucaggcagugauggcagcggaguucaugcuucauuaaggcaggcauugcaaacuaguucagaggagagaauccacgaugacagcacauucugugccauggagaacauucuuaaaucaagccuccaguggaggaaggacucaagaaugaaauagcaccagauaacggggcaucauuagacuuguaaagcaaagcuuccauuuucuauuuuuauauaaaccauuauuaaugccuuuaaaacaacugugauaucuggacaaauaaaauagaaaugacuucuuaagaugauugcaacuuuuagucuugauuuauaaaaauuauucuacauaauuuuaguaggguaacugauaauuuuucucacuuuuuuuuuguuguagggugaaaauccuauuuauaagagugccguaacaacuguggucaauccgaaguaugagggaaaaugaguacugcccgugcaaaucccacaacacugaaugcaaaguagcaauuuccauagucacaguuagguagcuuuagggcaauauugccaugguuuuacucaugugcagguuuugaaaauguacaauauguauaauuuuuaaaauguuuuauuauuuugaaaauaauguuguaauucaugccagggacugacaaaagacuugagacaggaugguuacucuugucagcuaaggucacauugugccuuuuugaccuuuucuuccuggacuauugaaaucaagcuuauuggauuaagugauauuucuauagcgauugaaagggcaauaguuaaaguaaugagcaugaugagaguuucuguuaaucauguauuaaaacugauuuuuagcuuuacaaauaugucaguuugcaguuaugcagaauccaaaguaaauguccugcuagcuaguuaaggauuguuuuaaaucuguuauuuugcuauuugccuguuagacaugacugaugacauaucugaaagacaaguauguugagaguugcugguguaaaauacguuugaaauaguugaucuacaaaggccaugggaaaaauucagagaguuaggaaggaaaaaccaauagcuuuaaaaccugugugccauuuuaagaguuacuuaauguuugguaacuuuuaugccuucacuuuacaaauucaagccuuagauaaaagaaccgagcaauuuucugcuaaaaaguccuugauuuagcacuauuuacauacaggccauacuuuacaaaguauuugcugaauggggaccuuuugaguugaauuuauuuuauuauuuuuauuuuguuuaaugucuggugcuuucugucaccucuucuaaucuuuuaauguauuuguuugcaauuuugggguaagacuuuuuuuaugaguacuuuuucuuugaaguuuuagcggucaauuugccuuuuuaaugaacaugugaaguuauacuguggcuaugcaacagcucucaccuacgcgagucuuacuuugaguuagugccauaacagaccacuguauguuuacuucucaccauuugaguugcccaucuuguuucacacuagucacauucuuguuuuaagugccuuuaguuuuaacaguucacuuuuuacagugcuauuuacugaaguuauuuauuaaauaugccuaaaauacuuaa

SEQ ID NO: 21261 - RNA, 57877 nt, Homo sapiens
uuaaguauuuuaggcauauuuaauaaauaacuucaguaaauagcacuguaaaaagugaacuguuaaaacuaaaggcacuuaaaacaagaaugugacuagugugaaacaagaugggcaacucaaauggugagaaguaaacauacaguggucuguuauggcacuaacucaaaguaagacucgcguaggugagagcuguugcauagccacaguauaacuucacauguucauuaaaaaggcaaauugaccgcuaaaacuucaaagaaaaaguacucauaaaaaaagucuuaccccaaaauugcaaacaaauacauuaaaagauuagaagaggugacagaaagcaccagacauuaaacaaaauaaaaauaauaaaauaaauucaacucaaaagguccccauucagcaaauacuuuguaaaguauggccuguauguaaauagugcuaaaucaaggacuuuuuagcagaaaauugcucgguucuuuuaucuaaggcuugaauuuguaaagugaaggcauaaaaguuaccaaacauuaaguaacucuuaaaauggcacacagguuuuaaagcuauugguuuuuccuuccuaacucucugaauuuuucccauggccuuuguagaucaacuauuucaaacguauuuuacaccagcaacucucaacauacuugucuuucagauaugucaucagucaugucuaacaggcaaauagcaaaauaacagauuuaaaacaauccuuaacuagcuagcaggacauuuacuuuggauucugcauaacugcaaacugacauauuuguaaagcuaaaaaucaguuuuaauacaugauuaacagaaacucucaucaugcucauuacuuuaacuauugcccuuucaaucgcuauagaaauaucacuuaauccaauaagcuugauuucaauaguccaggaagaaaaggucaaaaaggcacaaugugaccuuagcugacaagaguaaccauccugucucaagucuuuugucagucccuggcaugaauuacaacauuauuuucaaaauaauaaaacauuuuaaaaauuauacauauuguacauuuucaaaaccugcacaugaguaaaaccauggcaauauugcccuaaagcuaccuaacugugacuauggaaauugcuacuuugcauucaguguugugggauuugcacgggcaguacucauuuucccucauacuucggauugaccacaguuguuacggcacucuuauaaauaggauuuucacccuacaacaaaaaaaaagugagaaaaauuaucaguuacccuacuaaaauuauguagaauaauuuuuauaaaucaagacuaaaaguugcaaucaucuuaagaagucauuucuauuuuauuuguccagauaucacaguuguuuuaaaggcauuaauaaugguuuauauaaaaauagaaaauggaagcuuugcuuuacaagucuaaugaugccccguuaucuggugcuauuucauucuugaguccuuccuccacuggaggcuugauuuaagaauguucuccauggcacagaaugugcugucaucguggauucucuccucugaacuaguuugcaaugccugccuuaaugaagcaugaacuccgcugccaucacugccugauucuuaucccuuuaucgugaacagaaggcgccugcuaaucaaaacgggaauccucggcuuucacugcugggagggaggugugcuucuggggucuccuacggaaguuacuaauuuagagaguaaggcugucauugugucagggacagcacugcgccccaccaagucacacugccaaauuugcuuagaauguuagauaauuaccauuccuuaugaaauaacuuguuaugcuucaauaucauauuggugaaaugucuuauugcagugcuauaauuuaguaaacaguacugaagucaagccuagcaagcaggccccaagccauaaacacaagagaucuuucaagauccaaaaauauacugacagugauguuuuaagcagaaaaaaacauaucacuguaucacccuuuuccuuaaaaauucucuuauacuauaacugcuacauuuaaauacuugcuauagcauucuuuuuucuccuguucuuauaaauugaaagcaggcuugaaagccaagugagaagugugaccaaauaacacuuaaucagagaaaauuacagugaguacaaauaaaaaauacuuguuaacuaccagggaaauuuuuuuuaagaaaaaauuaagauuuuggaauguuguucaguuuuauaucucacuauagaaccaacugcaggugauuuuuaaaaaaauauuuauagaaagcaucuaaaacauuuuuugaucuaaaaguaauuuuuguuuuuaaauuuuauucacacuucauugcagacuguauuuggaucugccuuuugguggcacaauuucugcccucaaggaagguauaguuuggugggugagagacaugaaaauaaggcacucugaugaaguuuacaauagaguuaugaacauaaucugggaauaguauaagaaaaaaguuauuaacuuuaagaagauuaaggagauuuucauugugaaauugacuagaaaaauuauugguugguaaauagcaaucuaugcaaagucaagguguagggaaaagaaugggacauuuaaguagaaauacauacaguucagaaguuucuagaguuaggggagggcaggcgcgguggcucaugccuguaaucccagaacuuugagaggccgagguggguggaucacuuuuggugaggaguuugagaucagccuggccaacacgguaaaaccccgucucuacuaaaaauacaaaaauuagcugggugugguggcgggugccuguaaucccagcuacucaugaagcugggauaggggaaucacuugaacccgggaagcggagauuguagugagcugagaucgcaccacugcacuccagacugggcgaaagagcaagacuccaucucaaaaaaaaaaaaaaaaaaaaaagaggaaaaaaaagaauuaagggggcauaugauuggaggugaggagacaaaggaagaacaguccuagaggccuugcuaugaagucugaaacuucauccuguagguaucccauaccaaugagggaaaaacauuaacauauaaaggcuggguccugcaagacaccaaauaaaccacugugauuucagcucagcagcucaugugauaccaaucagaaccagacaacauaccucagcccucacuccccucuccucaaaauacaccuugacugguuguuucagaaacauggacaaacucaggaucccucagagacaaacagcauauaauguggaugacaaaacuguguacaucaaacucucagcucuagucccaacugaagcuaauacauuauacagcugugagagcagacauuucaaaaugggggucaggaaacuggauuuuggcaacuacuaucuuaaaaagccagagugcaaauaaauuacacuccacauuuauauccuaucugauuugaggcuaagugcuacacauuccuucaaauauguugggaaaauaaauuagcaucuaauuaaauuucuuuaauacaauauauuugcuaaaucuaguauuuaauacucaagaauuauaagggaaggacaaaaaaaaaaaagaaaacaaaaaauaaagaaaaaaagcccuauauagaugaguccaaaguguaauuuauauggaagaacuuaccuuuggagaaaaaucugucuugucguauacacaaacauuuguauuuauuauuucaaaguccacucaaacaaaaguuuaacaugcaagguuagagguaaaauuaagcucacuaucuguauuaggcaucauuuuaaaugaagguaaacuaaaauaauucaaauuaguuuccaucauucagagugcaacaccaccccaccccaaaaaaacccgcagcaagagaacaggguuauauuaugaaaggaagcccucaagcucaguaaaaugucaucuuugugcucacucuggaauggcugacagugguagcugcagaaccaucucuacaauguauuaaauacauaaugcagaagugugggagauuugggagccacauuuaaacccgcauagcagcagaugaggacagaccauuuuuuuaacccacuccaacaguuagaagcugauaaugugacauguucuucuuaauguuccuacaugguagucuucugccaaaguaauuagcgccugcccauuauuucaaaaauuucaaugacauaauugacuggcaaaccuugguccauaucagaaaaguuucuuacaauccaugauguaauuucuugaugcucauucauuuauuucaauuguuaauuucuacuuuuucuugagaaaaacaucucuuaaaauaaucuguagccaucaaauugccuggacuucaauaaugcauagagaaauuuuuaccaaacuucugcuuccugaauuacauaaaaugcuuauuuuagcaacauuuuagccauauauacauuauaaacauuaaguuuaaauaacauuuacugauaauuuccuucaaaauacaaugaaagguacagcaagggugaaaauuucaccucaguaggacagaaauuuuuucucuugugagaaauaaccacaugaaauugucaacauuugacuauuuuugaccuacaacuaaagaaaaaaauauguauuaaaaaaaaaaaaaagccuggcaaugucauuggcuaaucaguuuuccucuaaaaaugacuuucuguaaaguacuaagugagaacgagaaaaauauauugucucagacuaauacaaauauguaccaaccugcccauaugugaauuugaauauaauuuucugccaucaaauuuaacuuuaaaaaucuuacggucuacuuagaaauaaaaaucugacaaguuaaugauuucuaauguuaucagcacuuccuauaucacuuguaacuauuaaacauuccuguacuguaggcucuuauucaugaucaguuuguaagcacacucucaauagucaaaaaacacaacaacagcacuggguuccauguauuaaagugauuucccuaacaugauguuugccaacagcagcaguguuaacucugacagaguaacaacaaauuguaaaagggcuguaaaucucuauaaagagugaucuaccucuuccuaaccagguaacgggacuucugaagauacauaacugcuaccaaguacaaugucauagacaagaacauggacucuggagcccaacugccuggguucaaaucucagcucucugacuaaccagccgugggaacucggucaaguuacauaacccuuaugugucucaguuuucucauauguaaaacauuccuacaacuuucacuaugaagauuaaacacagauuaaguggucagaaucaugccugagacacagugauuuuuauguaaguguucccaauaccaucuuuaucugcacaauaagguaggcagugagaaaagcagaaaucuuccaggcccuauuacagucagucaguugggaaagagaagaagaguucucaaccaccagucaggagaauuuaguucuaaucacaauuaaccuuuguuaucagaguuuuaggggcuugcaugauuuuauuagaauaugcuggaagcauuucaugaaaauucagauaugaacaguuacaaacuuacauuugaaaauuagaaucauucucacauacacacacagacacacacacauauauauauaauauacauacauauauauggucuucuggcuuuuaaugaaauuucaaguuauauucaagaaauugaucucaaaucuuuugagaaccaauaaugauauuguaguugcauaccauacaaauaucauaguagguuauauuuuucuauuuugcaauuuggauuucgugaucaauuuucacuauccaacccuaaaauuuacucauaacaaauuuguuauuuaaggauaauacugguggggcacaguggcucacgccuguaaucccagcacuuugggagaccgaggugggcagagcacuggaggucaggaguucaaggccagcccagccaauguggugaaaccccaucucuacuaaaaacaaaaaaauuagccuagcaugguggcaggcaccuguaaucccagguacucgggaggcugaggcaggagaauugcuggaaucuggaagucagagguugcagugagcugauaucacaccacugcacuccaggcugggcgacagagagagacugucucaaaauaaauaaauaaauaaacagaaaaagaacaaaagauaauaggauaauaucauucuaggcacaggacuguuaugaggauuagagcugacaggcugauuucauauacuggagugcauuugccaaauacaaccaccccauacaaaacagaguacugacucccugugacaguugagagaagugaagugacucaaugcuguucuacuuacuaaguggaagaggugggauuugaccugaggucuaacugauugcaaagcacauucucuuuucacuacaacauggcugcuguuucuauaucacauuacuuauuuuacggucuuucuaaacgcgaaguuaacauacaaaaagaaaagccacaauagcgauauuuaaagccagacuuaaaaaaagaacagcaauagugauaaaggacacacagugcaguaaaaaagauagaaguucacaugcaaaggcagaaagugaaacaaaauacgaacggcaauuuagagaccagcuuuacguccguaguuuggauucuugaaauuauuaauaggacucuuguaaaucggauuuucuugcuaaaguaaaagaaauaguuucuaaugauuucaucagaaaaaaaaaaucccuuuauaguguuugaacacuauaaaugucuuuuuuuuuauuucuacccuucugaaauuuguaauuuaaaaaauugauaauuuuuaaaaacccaagcaaauuguaguaaagugcaacuaacuacaaaauucauuuacaauuuaaaaauacugaagauuggcauugcuuucuuguaucaaaagaugaauacacaaaggccaacauuugguuaccccacccucugacuccauauuucaaagcacucaaugcuaacauaaccuuucggucacuuagggcuuuuaagauuuuuauaagccaaaguuuacugagauauaauuuucauagaggaacauacaucuuuuuaaaguacauaguucugugaguuuucaaauacauaaauccacccacaaucaagaucaucccaaggaagaucccuuacgccccucuguggucaacacuuucccccauuccagccccuagcaaccacugauuuuugccccuacaguuuugcuuuuccagaauguccucuaaauggaaucauauaguauauagcagggguguccaaucuuuuggcuucccugggccacacuggaagaagaagaauugucuugggccacacauaaaauacacuaacgauagcugaugagcuuuaaaaaaaaguuaccaaaaaaaaauaauaauaauaauuacaauuucuaagaaaguuuacaaauuuguguuggggccacauucaaagcuauucugggcugcauguccuggccgacgagcugcgaguuggacaagcuugguauauaaccuuuugaaucuggcuuucacugaagguuuuuuuuguuuguuuguuuuaaagaaagaagcagcuuuccauugaauagcuugcuacacagauaacauuauuuaggauucuacuucacauuagaugaaaaggcagauuuaggaucaaaacuauuaaagaaauaaaaauacuggccacaguaaccagaauauacaugcuuauaaucaauguuuuguuucaaugggauauauuuaggaugcuuucuguuuuucacuaaaugcaaauuccuugaguaagaaacuuuugggggaauaaaauacuuagaaaggacuuuaauaaucagccugacagcuaauacauaagucuuaggaguauuacauuuacuuuauaagccacuuugcuuuuuggauguuuuguaacuuaccgugucccauuuggcauucauuuucuccuuuucaaauuuagcaaacucccuucugucaugaauuaucauuaaaagcuuccauaucagcaguaaugcaaggccaauaagaacaauuccagcaaccacaccagcuacaauuggaaugaugucuggaccagugggacacucuggaaaauaagaagguaauaaugagcaccacaaagagcugugcagugucuuauaaaaaacauacaggaauaaacacccaagagagugaacgcacacuaucccaaagaaucuauaaaauagcucuuagaacuaacaagugaguuuacaagguugcaggauacaugaucaaugaacaaaaaucauguauuuuucuauauauauaauuuauuucuacauauugaaaauauaaguuuuuaaacaguaauauuuacuacagaaugaaaaagcaugaaaaacuuacauauaagucuaacaaaauauaugcaagauuugcauguuaagaauuacuaaauacugauaaaaagaaaucuuucagacugaauaaauggagagauauuccaugugcaggaguuacaaaaccuaauaccguuaagacgucaauucuucccaauuugaucuauaaacucaaugguaucccacucaaacuccuggcagaacuucuguagcaaucaguaagccacuucuaaaauuuacauggaaggcagggaacuaaggaagugucucaaaaacacuuuuguaaaagaauaaaguuggaagacccugcuuucaggccuagcuauaaagaaagcuacaagaccaugugguauagcuaacacucagauacauggaacagaauacagagucagaaacaggccuacacauguaaggucaccugauguucaacaaagguggagaaaagacagucuuuuuucaacaaaugccccuagaacaaguggacacugacaugaaaaaaacugagccuuuugucacacacuaacucaaaaugaguuacagaucuaaaugugaaaccccagaaacuauaaaacuucuaccaaaaaacagaggagaaaaauccuuauaaucuuggguuaggcagaguucuuaaagacaauguaaaagcaagagccacagaagaaaaacuugguaaacuguacuuaaucaaaauuaaaaccugugguguucagaagacacuuaaaaaaaugaaaugauaaggagacacaggcugggagacaauauuugcaaaacaccuagcugauaauucaaaacaguaugggagucuaagagucuggcagcuucuuaacaaaguuaaacauaugcuuaccauaugcuccaaaaugccauuuuuaguauuuacccaagagaaaugaaagcuuauguucacacaaaaacauguacacuaugguagaaaauuccaaagaaucuacaaaaaggcuacuaggaaaacuaagauuaaaaaaaaaaaguuucaccuccggagaaguugaacaaauucaacacuuuauauuaauauccuuuaacaaauuaucuuucccaguauucaagcuuaaaucaagcucuaauuuuaaaaucaucaaucaucaaaaaacucuuaauaugcacuuggugucaggcaucguucuaagugucuuauauaaaucacuaagcgucuuauauaaaucacuguauuuaaucuucaaacucuccacucagaaaacuuaaaaguggaacucucuuuuccuuauuucuuauacaguuaauuagauaauauuuuaagcuuugagagaugaaaaauuucccaacuugaccuaaaauauuccagcuggaggcuguuucuggauguuaggccuaaauaagcagaaacaagacauacaagauaugaaaagaaugucugcaaucaucgcauuucuaccuggauucuccacaacaugaaccaugaccucguuguucccauucacugaauacguaaaauagaaccaacagucgucaacauccuucuccuuacaaugggacacaggaucagguuggaccggcugggguaauuugucccgacuuucuaccuugguaauguuaaaauaggaacauuccugugugcaugugucuuucuuuucuccuuuauugaaggcucugcacugaacacauucucuguuacaaaaaacacaaauuaugauauuuacauuuuauuauuucaguaaauauuugcuuaaacauauuucccaugcuaaacucuugugaccaaauugaacaaacagcuaugaaggaagauuucaauaaaugaagaggaacauuacauuuguggauagaaaaauuauguaaaaagaugcuaauuuccauaauaaaauuaaagauuuauuacaguucaaauuaaaacccuauuaagaaauaaaagauaguaaaauaaauuagcccuaucacauauuaaauauguaacauaaaaucauaauaauuuuuuuuuugcgauggagucuuguucugucauccaggcagugcaguggugugaccuuggcucacuguaaccucugccucucggguucaagcaagccucaaccucccaaguaguugagauuacaggcacacaccaccauaucuggcuaauuuuuguauuuuuaguagagaugggguuucaccacauuggccagacuggucucaaacuccugaccuuaagugauccaccugucucggccuuccaaagugcugggauuacaggugugagccacugugcucggccaaaaucauaauaauuuaaauaauauguuacuaguauaauaauccuucaagaggaaaaaucuuuaauuuggcuuaguuuugucaaaagacaguaauuaagaaauugguaaugacaaauuaaauuaaauuaaaucuuaauugccaaaauaaagguuaccauguaaauucaauuaucuagcacauucagaucaaaauaauaguacaacucucacaugacacacuucauaccauguaauauauacuagcuguugagaaagaacuuuuaagaauuaaagaguaggcuuccacauggcaggcauuuuauuuacaguauauuuuaauauuggcacuguucugguucuagaaacaauacaggcuuaggagagccaagaggaaguaucaacuauuucaagcaauuaggaaauacuuacuuaugcucagcacagacaccaaggcaggucugacacaucucacacguuugcccuugaaacuucggaucuguacacuuacagacaccacacucgcagaugccccggccauugcagaucuguccguugcuggcuucacaaguacuaguauccaaagaacagucacaugcacugccaguguaguugggguugcacucacacacacgacacuugcaaacaccauuuccugcaauuaagcauaucauuucucaaaaugguaaaaauauacaaucacaguauugacugaaaaguaaaauaagcaacaacaugugagaaaguauaccuaggggcgagacugacccucaagcuaccccuuuucuacuuaugcaccaacuaaacucaagauuuuucguggcauuagaugggaucacaucuuacaaccacuucaggcccuuuacuuaccuccacaaauuaagccauuggaucuaucacaguugaaauuaucacacucgcagaauuugccagaauaaauuucauuuguauuaucccucuuccuacaaacacacuguccgcagacgcacucuccauuguuacugcagauuucugaacuguuuucuuuccugcaguaagcauccaugucuucacuguuaacuucaucugugcugcauucacaaugucuaccaacacgcccuucauugcaccugaagaaacaugccaaaauugcaaucacacaaaacaaaaauaauuuaagagguuccaagauggccaaacaggaacagcucuagucuacagcucccagcgugagcgacacagaagacaggugguuucugcauuuccaacugagguacuggguucaucucacuggggcuugcuggacaguaggugcagcccauggagugugagccgaagcagggcggggcaucgccucacccgggaagcacaaggggucaaggaauucccuuuccuagccaagggaagcugugacagacgguaccuggaaaaucaggacacucccacacuaauacugcgcuuuuccaaugcucuuagaaaacggaacaccagaagauuauaucccgcgccuggcucagagggucccaugcccagcucagagggucccacacccauggagccucgcucacugcuagcacagcagucugagauugaacugcaaggcagcagggaggccgagggagggguaucccccauugcugaggcuugaguagguaaacaaagcaaaaaaaagcuaaaacugggugaagcccauugcagcucaaggaggccugccugccucuguagacaacaccucugggggcagggcauagcugaacaaaauccagcagaaacuucugcagacuuaaacauccgugucugacagcuuugaagagaguagugguucucccagcacggagucugacaucugagaauggacagacugccuccucaagugggucccugagcccgaguagccuaacugggagacaccuccuaguaggggcugacugacaccucauacagcccggugccccucugagacgaagcuuccagaggaaggaucaggcagcaacauuugccauucugcaauauuugcuguucugcagccuccgcuggugauacucaggcaaacagggucuggaguggaccuccagcaaacucccaacagaccugcagcugaggguccugacuguuagaaggaaaacuaacaaacagaaaggacauccacaccaaaaccccaucuguacaucaccaucauggaagaccaaagguagauaaaaccacaaagauggggagaaaccagagcagaaaagcugaaaauucuaaaauuugagcaccucuucuccuccaaagaaaugcaccuccucaccagcaacggaacaaagccggacggagaaugacuuugacaaguugagagaagaaggcuucagauaaucgguaauaacaaacuuguccgagcuaaaggaggauauucaaacccaucgcaaagaagcuaaaaaccuugaaaaaagacuagacgaauggcuaauuagaauaaagagcguagagaagaccuuaaaugaccugauggagcggaaaaccauggcaugagaaccaugugaugcaugcacaagcuucaguagccgauucgauccaguggaagaaaggauaucagugauugaagaucaaaugaaugaaaugaagugagaaguuuagagaaaaaaaagaguaaaaagaaacgaacaaagccuccaagaaauaugggacuaugugaaaagaccaaaucgaugucugauugguguaccagaaagugacagggagaauggaaccaaguuggaaaacauuuuucaggauauuauccaggagaacuuccccaaccuagcaaggcaggccaacauucaaauucaggaaauacagagaaagccacaaagauacuccuugagaagagcaacuccaagacacaugauugucagauucaccaaaguugaaaugaaggaaaaaauguuaagggcagccagagagaaagguuggguuacccacaaagggaagcccaucagacuagcagcagaucucucggcagaaacucuacaagccagaagagagugggggccaauauuuaacauucuuaaagaaaagaauuuucaacccagaauuucauauuaagccaaacuaagcuuuaagugaaagagaaauaaaauccuuuacagacaagcaaaugcugagagauugugucaccaccaggccugccuuacaagagcuccugaaggaagcacuaaacauggaaaggaacaacugguaccagccacugcaaaaacaugccaaauuguaaagaccaucgaugcuaggaagaaacugcaucagcuaaugagcaaaauaaccagcuaacaucauaaugacaggaucaaauucacacauaacaauauuaaccuuaaauguaaaugggcaaaaugcuccaauuaaaagacacagacuggcaaauuggauaaagagucaagacccaucagugugcuguauucaggagacccaucucacgugcagagacaaacacaggcucaaaauaaagggaugaaggaagaucuaccaagcaaauggaaaacaaaaaaaggcagugguugcaaaccuagucucugaaaaaacagacuuuaaaccaacaaagaucaaaagggacaaagaacgccauuacauaaugguaaagggaucaauucaacaggaagagcugacuauccuaaauauauaugcacccaaugcaggagcacccagauucauaaagcagguccugagagaccuagaaagagacuuagacucccacacaauaauaaugggagacuuuaacaccacauugucaacauuagacagaccaacgagacagaaaguuaacaaggauauccaggaacugaacucagcucugcaccaaguggaccuaauagacaucuacagaacucuccaucccaaaacaacagaauauacauucuucucagccccacaccgcacuuauugcaaaacugacuacauaauuggaagcaaagcacuccucagcaaauguaaaauaacagaaauuauaacaaacugucucucagaccacagugcaaucaagcuagaacucaagauuaagaaacucacucaaaacugcucaacugcauggaaacuaaaugaccugcuccugaaugacuacuggauacauaacaaaaugaaggcagaaauaaagauguucuuugaaaccagugagaacaaagacacaacauaccagaaucucugggacacauuuaaagcaguguguagagggaaauuuauagcacuaaaugcccacaagagaaagcaggaaagaucuaaaauggacacccuaacaucacaauuaaaagaacuagagaagcaagagcaaacacauucaaaagcuagcagaaggcaagaaauaacuaagaucagagcagaacugaaggagauagagacauaaaaagcccuucaaaaaaucaaugaauccaggagcugguuuuuugaaaugaucaacaaaauugacagaccgcuagcaagacuaauaaagaagaaaagagaagaaucaaauagaugcaauaaaaaaugauaaaggggauaucaccaccgauccaacagaaauacaaacuaccaucagagaauacuauaaacaccacuaugcaaauuaacuggaaaaucuagaagaaauggauaaauuccuggacaaauacacccucccaagacuaaaccaggaagaaguugaaucacugaauagaccaauaacaggcucucaaauggaggcaauaauuaauagccuaccaaccaaaaaaaguccaagaccagacggauucacagccgaauucuaccagagguacaaacagaagcugguaccauuccuucugaaacuauuccaaucaauagaaaaagagggaauccucccuaacucacguuaugaggccagcaucauccugauaccaaagccuggcagagacacaacaaagaaagagaauuuuagaccaauaucccugaugaacaucgaugcaaaaauccucaguaaaauacuggcaaaccaaauccagcagcacaucaaaaagcuuauccaccacaaucaaguuggcuucaucccugggcaagacugguucaacacaggcaaucaauaaacguaauccaucauauaaacagaaccuaagacaaaaaacacaugauuaucucaauaaaugcagaaaagguguucgacaaaauucaacagcccuucaugcuaaaaacucucaauaaacuagguauugaugggaugugucucaaaauaauaagagcuauuuaugaucaacccacagccaauaucauacugaaugggcaaaaacuggaagcauucccuuugaaaacuggcacaagacagggaugcccucucucaccacuccuauucaacacaguguuggaaguucuggccagggcaaucaggcaggagaaagaaauaacacauaacaauauucccacaaagggaagcccaucaguuaauuaggaaaagaggaaaucaaauugucccuguuugcagaugacaugauuguauauuuagaaaaccccaucgucucagcccaaaaucuccuuaagcugauaagcaacuucagcaaagucucaggauacaaaaaucaaugugcaaaaaucacaggcauuccuguacaccaauaacagacaaacagagagccaaauuaugggugaacucccauucauaacugcuucaaagagaauaaaauaccuaggaauacaaccuacaagggaugugaaggaccucuucaagaagaacuacaaaccacugcucaacgaaauaaaagaggacucaaacaaauggaagaacauuccaugcucauggauaggaagaaucaauaucgugaaaauggccauacugcccaagguaauuuagagauucaaugccauccccaucaagcuaccaaugacuuucuucauagaauuggaaaaaacuacuuuaaaguucauauggaaccaaaaaagagccugcauugccaagacaauccuaagccaaaagaacaaagcuggaggcaucacgcuaccugacuucaaacuauacuacaaggcuacaguaaccaaaacagcaugguacugguaccaaaacagagauauagaccuauggaacagaacagagcccucagaaauaauaccacacaucuacaaccaucugaucuuugacaaaccugacaaaaacaagaaauggggaaaggauucccuauuuaauaaauggugcugggaaaacuggcuagccauauggagaaagcugaaacuggaucccuuccuuacaccuuauacaaaaauuaauucaagauggauuaaagacuuagaugucagaccuaaaaccauaaaaaccucagaagaaaaucuaggcaauaccauucaggacauaggcauaggcaaggacuucaugacuaaaacaccaaaagcaauggcaacaaaagccaaaauugacaaaugggaucuaauuaaacuaaagagcuucugcacagcaaaagaaacugccaucagagugaacaggcaaccuacagaaugggacacaauuuuuacaaucuacccaucugacaaagggcuaauauccagaaucuacaaagaacuccaacaaauuuacaagaaaaaaucaaacaaccccaccaaaaagugggagaaggauaugaacagacacuucucaaaaggagacauuuaugcagccaacagacacaugaaaaaaugcucaucaucacuggccaucagagaaaugcaaaucaaaaccacaaugagauaccaucucacaccaguuagaauggcgaucauuaaaaagucaggaaaacaacaggugcuggagaggauguggagaaauagguacacuuuuacacugcuggugggacuguaaacuaguucaaccauuguggaagacaguguagcgauuccucaaggaucuaggacuagaaauaccauuugacccagccaucccauuacuggguauauacccaaagaauuauaaaucaugcugcuauaaagacacgugcacacguauguuuacugcggcacuauucacaauagcaaagacuuggaaccaacccaaauguccaucaaugauagacuggauuaagaaaauguggcacauauacaacauggaauacuaugcagccauaaaaaaugaugaguucacguccuuuguagggacauggaugaagcuggaaaccaucauucugagaaaacuaucgcaaggacagaaaaccaaacacugcaccuucucacucauaggugggaacugaacaaugagaacacuuggacacaggguggggaacaucacacacuggggccugucauaagguggggguagggggcagggauagcauuaggagauauaccuaauguaaaugacgaguuaaugggugcagcacaccaacaugucacauguauacauauggaacaaaccugcacguuuugcacauguacccuagaaauuaaaguauaauaaaaaagaagaagaaucaucuuggagggaauaauaauaauaauaauuuaaaagggaaaaacugggaaagaaaauaaaacuauaaaaaaucucuucaagcuccuaaucuguuaggugggaguguccaugccacaagucacagucguguaguaaaguguacacacaugugcaagcagggacaaacauacacaggcgcacauguacauuccagccacucaaguucauauggaauauaugcaagagucuaggaaaaaaauuucuucaggaaaguaaccauuuuggucaagacaaaaauguaaucuagcaaugaauagugaaugacacauguggaaaggcagaauaaacuuaauuuuaaagagcacguuaguuacauuuucaaaugguaugcuauuacauuuacuauuccaggugaacugucuaaauuuaaagcaauggucuguuaaccuaaaaaaauacaauaaacacaugcaaaaaaguguauggaaguugaaaaaaaacauacuguguauaccacuuaaaauauaacuaguauacuauuuaaaaauaaauauauccuacaugugcagacuuuucagguucccuguguauuuuuagaacacauaaugcucauggacacugacugcacugauucuguaucugguaaaaauauaaaggaaagaaaggcaaaguauuuucaagauaaucuuuuugguuaaaugacauuuuacuaaaaauggaccugcaugauuaaaacaggauauguacaacauggaagauaaagaaacucuaacauuuaaauuguuacuuagcacagacaauuaaaaauugauagugagcuaaagccauauauuucuuucauagucaauagccuucuaagccuagucuuuuggggcugacacuggauuaaacacucuucccucuuccuauucuuuuacagagaaagcgguauucaauguauacucaguuuuucauuuucaauuacaaaaaguaaccacagugugaaaauaaaaucugaaguaauuuuguuaguuuucuuaguacuagauucuacauacugaaaauaccauuuucucuuuuguauuuuacaacacauauuuauuuuuuaaaaauuauuccaacaaugcagaaguacauguaguacaagacaaacaucuucuacugcuucauaauuccauuucccagacgaaaucgccaucaucgguuugauguuuuuccaaaacauuuuccuauaaacguuauuuuacacaagcuuauuuuguucuagaaaauugauugcucucacaugagagaaacgcuaccuuaacaauuuguugaauauacuucuuucauggcuauaaaaucuuuuauuuuaaagaguaaucacuuuaagaaaaaaaggcaggaaggaacuuucuauaaauaucacacacaagaucaucaaacugaucuuguggugagcaaccgugguuggaaaaaauaauuugcuccaaauagagagauauucucuggaugucccaaaauaugaccugccuauacucucuaaaccaauguagcucugucacugucugacaacacccagcuuaccugcacgcgccacacucaaaugucccauuuccuucaugacacuugggacuuucagggaugccuucgcuuuggcauucacauucacagauguacugaagaauaaccucuacuuccuccguaaagcccagaggccuaauuuuaaagcugucagaauccuuuuuuggacacuuauuugaaguuaugcuaauuucaaauugaaccuugaagggaaaaaaaagauuaacaaccaacuaaacaauuuaaaucuacuaaaaaauauuucaaaaaguugcucacuuauuuuaauguuucucaaacuauaaacuaaauuugcuuauaaauaaccaauguuuucuacagaaaaugcuuuauacaacauaccucaucuccaauggaaauauuggaacauuuucuuccauuuuccccuguuccauucaccccguucuugcaguaagauuuguaacuuauuguuacgccuucugacaauuugccguuuuccaaaaugacuucugaggaaagggacuaaaagaaugccuaauuauacacaggaaaagucaaacaaaaugcuacuugaaugcauaaaaccaauggauaaacugcucagaaaaaaauauauuucaauaaaguaucuacaagccaaauccaauugaguaacuagaaaacacagaggccagagaaacagguuuuaauuaauaaggaucaaaucuuuaaaauaaaauacacaauugaaaagaguauuccuguuuuaaucacugaguuaaaauacucaggaucacacagugcagagggcuguuacuaauuaggaggagucuuaaaaauguggaauaggccgggugugguagcucacaccuguaaucccagcacuuugggaggccaagguagguggacugccugagcucaggaguuggagaccagccuggccaacacagugaaaccccaucuccgcuaaaauacaaaaaaaaaaaaaaauuuauccaagcauggcagugugcaccuguaaucccagcuacucgggaggcugagacagaagaaucgccugaacccgggaggcagggguugcagugagccaagaucacaccacugcacuccagccugagcaacagagugcgacuccaucuaaaaaacaaaaacaaaaacaaaaacagaaaccccccaaaaaaaaacgaaauaaaugcugucuuccccaucggcaaaauggcauuucuguaguccuaccucuccagcuaacuauggacuaggguaaacaaucaacuaugcagucuaggaacaaauuugcuuaaggaaccauuguagcccagccaaaaaaaaaaaaaaacaaaaucccccaagaaggaaggauucaagccagggcuuguuuaacauaugagacuauucaggacaaauggagaaggguacaauggcaagcuaucucuuguucacaccccugaaagaacaagaguuaggaaaauuaucuaagacaggggagaaugggaaaagcuguggaacaaguaaaauauuaaaaaccuuuauaaaaaccccuccaagucaggccuuuccaaaccauuaugguaccccauaaaaaagggaagccucauaugguaggcuggccuuuccaaagcguuaugguacccccaugacaugaaguaaaaaugucuaaaauucaagcugccaaaggguuagggggaugggggcugaaaguggugcacgagacacacaaggguuaccuaccaaauuacaaccgccuucagauuauuuaaaugauuauuaaugaaggcuaacucggugugauuaaaguacacugaauuaugcucaaaaaggauaagccaauuccucuuuaauuucaauucaacuuccucccaucugugaggggaaaacaacacuauaaaucuuuuugaaauaggcaaaucacauguauauuuacauuuuuauauauuuuaugguauacguauauaugaguguguaccuccugaaauagaaacccauauccucugaauauaugggaagagaagaauuggcaaaaaaaaaaacuuuucuagcacaauucaucagaauagaugacucuauaaaggauauuuuggggaggaaaaagauuggagaaauccuguaaguuuaaauguaaguuauguuuuacaauugcuuucuaacaaggagaucuauuccuuaaugauaaacaaacaguuauuuggaaauacuccccacaugccuuuaucacauuuucacuuuguuuaggccaugaaucuugcuuuuguaagacaauauguauaaaguuuuuccucuagauacauacagaauuuaaguuuuucuguaguacuuugggcucgcuaaaguguguaugaaggaaguuuuacuuucuuuguacaaaguauucucaacaggguauuguccaaaacugaucuuauuuaagauguacucacauuguaugcaucaaugaucaacugaauuacauugcuagaauuugcagauaauguuccuacugcugacuuagggaucaaguuuuucagcuccugcaauuaaaagauaaaacacguaaaauacaacugcuauucauucaaccaauuaggauccacugagcaacuuuuaucuuuaaaugccaguucccauguuuccuccuaacuaacuuuaggagucaaaccuagaaaccaguuuuauaauaugugauuaaaaauuaauauaaaccacuuuuguaaaauucgguuugccuaucugguggcauuuucccacauuucaauucagacaugauuugccucuaacaaucaaaaauguuuagaaucuuguucuuuuuaucucacacauuuaccuuguaaacaggcugaaauucuucaguaacugcaaaaauugucugaauauuauuuucacucaguuucuggacaaggugagcaauagaaggauaauccuaagaaaucaaguaauauaauuuaguauuuaaauacacccuuauaaucucuucuaauuuuucaaucuaguuauacaugcaagauuacacauaacucgauuacaagacugcuuuagauaacuagauuacauauauaauccauauauagcuagauuacaucuaguugcauacauauaacuagauuacaagacugcuuucaaauaacaguaucaaauauaaacugcugaagugagucguguguauacaugaauugcuaauccucuucucuuuacuuucauguaugaauaaaaaauuccauauucaaaagguuuuaaauaguaaguuuaucuauguauauuaaauauaaggacaaugaaauuaaagaauagucaguaauuaaauauucuauuaucuacaacuuaagaaaaagaccaagauuuaccauuuggauuucuucuagaacuugaaugcuuugccaauauuuauuuucaauaaaggcagagugacugcuuuuaaaaaucguauaaaacaaagaguaugagacuagauaaauuauuuauuuagaaagaguacugacugugcuaccaaaugcugugggcggggaguugaggcaaagagugaaaguggcaucugggcaucccuuucccaccccagugaggcccuugucugagcagaaggaagcaaauacaaagcugcaucuucacaaacagcaacacuagcuuuccugcacuuucaaucaggaccccuacuuaccaaaacagcaaaaccucaaacccugagaaaccccaagccagucacccacaagcucuuaguauuaaacauuaaaauccaacauaaacacauucacuauguaaggaaccaggcacuuacauaauaauggcucauuguguacauauuauuuuccaggugacauuguccaucauuugguaaaacaaugccaccaaguuucccaucuccagcaaagugaaacccggcaucuguggaaaacaccagcagccguguaacauuccuccagccaaucagugacuugaaaagaaaaggauuucaauuuuaaaacacuauucacaguaauucaacaaaaauccuuuaauuuucauauaggccaccauuguauuuuuaaccuaauucuguauuuucugugucuucucuuuauacaaugguaauuaucuugcugagaaacacacaaagcccacugaaugaagcucuuccaucccauguacaacgauaucuugccugaccauccguaucucucaaucucucaguucuuuuuaaaaacuguuuuuuuguuuuguuugguuugguuuaguucugcuuaucaucauaucuccagcagcuagcaagccagcacacugcuuggcaagcaguaagcccuugaugagcauuugcugaauaaaugaaagugucugagccuauccuuacuuuaccccacugcugcugucuuguccccauccacccaucucugcucuauguucuaugccaugcaccuucuuuaucagcccaccauaugaggcuuccuuuuuuuauaacagaaauaaguaucuuguuuaaggauaauuucacccauucuaacuccucaaucaguacuguuuaugcacucauuuacuuuauccuugcccuuuccaauaaagaaucuaaaguaacuguaaaaucuucuugucacuaugguaauuuauaauuauaaaaucauaggacuauaggaauuuaccugcuuucguuaauuuauuuaauacgucuguuuagaucuucauaagacaguaaaauacuuuaaggugggaaucacauuuauuaauacuggcaaucuuucaaaaguggaaugucugauucuuuugcaucuagaggaguggaucagcaugaccaacacagaaaaacagccacaaucaaggguguuauggcuuguuuaauaccacagguuaaggccuaguuagaggcagcccagagaaugcccuccccacaacgagcugcuaacaggcucacacaucaauggcuaguaagaaaagagguguaaggcuagguacuaccuggaaugcuacuugcuucggcuauaacagcagggacuaaccuuaaauugcaaacacucuagugaaaagucgaaaguaauaacaauauaggaauuaguauuugcugaaugcucauugguacuuuauagagauugaugcauuuuaacuucacaagagcccuaugagguagauacuaucaugaucccuucuuaaagagaagaaaacagcccuggagaggcugaguaaauugcccagcaucaguggugauagaaaaauucuuaauuacuauccauauuccuucacuuauuauuuugggcaucaauuagcaccuuagcaaaaauugacugaaaaauaaccacuaagaggccucuaaaaucaaagaaggucaucuagagaaugggggcacuggagggaacaaaaaugagacaagaguagguacgcaggacaaacuugacaugacaaugucuucuaguuucagccucagccacaucauuaaagugucaucucaaaauacauagcugcuacauggaucauaaaauacaaauuauugaaccaauagggaugggcuugcuacugaaaaucuuacaauuaaaauuacaaauauuguaucacuucucaaaauacaucuauucauauagguuaaaaacuagagcuuaaaaaguucucucuuuuugaauuacuaagacacaggagaaagaugugucuuucaaagacagugagaagaaaacugaccaaaggaaaaugauacaagacacucucccuuugagcaauuucaagguuccuggugaugccucagauaauaacaucaauucuaucucuaguacaaagccagaaaguuaggacacaugggcuuuucuaaaauccagaccaccagcuacaguacagagagguugccccgcuguuucaaaugguuagcauucugucuuuuaaaagcccgcaugaauaaacuaacugugugguuugcauaaagauuaaauaugcuuuuauaaaggcacuuuauguauacaggcaauuuaaggguuuacuuaaaauuacuucucuaagauaaucaaaucuaugaaaauuaaggucaauuuuucuauuaucauaguaaaaucacacuuaaaauucacacacauaauagaaacaauauccccugauaggaaaugaaugcgcuuacuccacaaacugcaacuugcaugauggcaucgaaaccaccuucuggagaauccaaauuuccagauaugcgcuguuuuccaacaaguucauuaaauacuucuccuuuauuaguaagacugagcacauuuuuguagcuaaaugggcuggugcaguucuguucacuugugcaaggguuccugagcuuagcugguguugugcuaauguaaggcaucacagucuuuuccacaaaugagccaaauccugccaagaaaaaaaugguacauaaaugaaugaauggauggauagauggaaagacagagauuugcauuguuuaaaaaauucaucuauguuaccaaauguagguuacuauggacugaaugucuguguuaccccaaaauuccuacauugaaaaccuaauucccaacaugaugguauuaggaagugguuccuuuggaaggugauuagaucaugagggcagagcccucaugaaugggauuaguaacugauacaguuuggguaucuguccccgcccaagucucauguuaaaaugugauccccaauguugaagguacggccugguggaagguauuucgaucaugggggcagaucaaucccucauggcuuggugcuauucugaccacagugagugaguucucaugagaucuguuauuuaaaauuguguggcaucucuccccaacucuugcuccugcucccaccaugugagaagccugcuccccacuuugccuucugccacgauuggaagcuuccugaggccuccccagaggccuugcugaugcuagcgccaugcuuccuguagagcuugcaggaccguaaaccaauuaaaccucuuuucuucauaaauuacccagugucagauaugucuuuauagcaacguaagaauagacuccuacagugaccucaucaaagaagccccagagagcugcugucucccugcugcuaugugaguacaucgcaagaagguaucaucuaugaacccagaagagggaccucaccagaugcucaaucugccuggaucuuggacuucucaccuccagagcugugagaaauaaauuucuguuguucauaagccacccaguuuauaguauuuucuuaaagcagcacaaauggacuaagaccuaagacaaucuuuuuauuuugccucccuacuuuaaaaauaacucacauucauuuucuuggcacaccagcucucaauaaugacaugcugaacaaaugaauaaacaaauauucuagaauucuggccauuuuaaaaaacacuaauuugauaggagcucccuaaugccaugguccuugaauuaugcuuacagaauaaaagaacauuuuaagcaagugcuauuuuuaaauguuuccacuaaaauagggcuaauuuuugaaaggcagcucuuaggccucauaacugucaaaucuuucuaauauucuguugcuaaaccucuagagcaacaggaguggagagaagcaggcaaaaaagagguuaagcuggggaugcaugaaaugggaaaaauaagguuuggaaagcagaucaucaucauaugaaaaauccaggucuaagaugagaucaggcuguacgggcaggugcagacauacuaauuagcaauuagauaaaaucuggguauucaacacauguuuauaaaauaagucauaagggccaggcaugguggcucacgccuguagucccaauacucugggaggccaaggcagcuggauuaccugaggucaggaguucgagaccagccuggccaacauggugaaacccccaucucuacuaaaaauacaaaaaauuaguugggggugguggcagaugccuguaaucccagcuacucgggaggcuguggcaggaaaaucacuugaacccgggaagcggagguugcagugagccgagaucacaccacugcacuccagucugggcgacaagagugaaacucuuaaaaauaaaauaaaguaagucauaagauaaaugaucaaguuaguaugaaaauaagcaugcaagucauuaucuaugagguacaaucugugucaaacaguagcauccagugacagaggaacaagguggcagaaaagauuauuaaacgugugacuggaauaucaacuuccacucagaaaaggcuaaaaaacuggcuuguuuaucucacaaguauguugugaguaacaaaggaauaaaauauaaaacaacauuugagaauugccaagacuuuauaaugaaaauggucaauguucccaacauuccuaccaauucugaaguccgaaguaauccuccucauuucauucaucagaucuguuccaagacuuuuuacauucuccaaaucgucuuucauugaguaagacagguccauaagguaguagaggucaaugggauagucuucagcucucuugaauuuuaauguaaaugucuguggcuccccuaauuagacaagagauuagaaaaugaaacuugccuguuggcaaucaaacgcaaacgagaaaaaccaaauaaaugugguuuacacgguaaacacaauaaaauaaaacauguugucauaauuuuuacaaaaaccugggaauuccauaaguaacucaauggguauguauucaguuucauucaacaaauacuuuaaacaccaggccuucaggaugcaaagauaaaaaagauauucccaauccacaguggacaaaacagacaaaaagucaguuuauaagagaagaaaacaaauagaacaccauaaauuagucuggagagggcaaggcagaacacgugauaggguacaacugacuuuuuagacacugaaguugugaacucuguucuguguguagugggaugccacucccugcaagugaauaacaugauccgaucuuuacuuuagaaagccuggcagacagcuuuaaaaauaauuauuuauuuauuauuauuuauuauuuauuauuuuauuuuuauuaucauuaugaggcaaagagacuagcuaaucuacaaaagaaacccagagagagaugaugaaggaggagaagagagagauacaagagacguuaauguaauuuacuuaggaaauacaggagagagguuuggaugaaaauguaauuaaaauuuuaacuuguaguuuucucuauauagauuucuaauaggcaauuggagaaauggguuuggagcucaagaaaagucuguguugcugcagcauacaauuggguuuuaaagccacgagaggaaaacugacauuuagguggacugcaaaaagggaggaagaaaaaagacacaaaaagaggccuggaaggcaaugguaagagacacaaagaaaaaccgaggagugguaucauugaucaaggacagagcauuucaaaaaguacaaaguguuacuugguacagaagaguuaaaaaaaauccugacaaggguccccugggucugcgggcugaaggcgaugguggagcuuugcuagagcaggaugaggaggagagggcugaccugguugaggaggggccgggagggaagucaggggacagggccacucuaccauucuccugacaagaaaggucggaaaccagaaaagcgaggaugagggcuuguuuuuuccuucauguuuagaugugggacuaacagacauaauuacaaaaaccuuaacaguuuaauaauacuaaacaaauacaaaggaaaagaacagguuaaaauguugcuuuuauaauauauuauguaauuagaccagaggaugaacacuuucauuuuuaaaacucacuaaagcuaauuaauacuuucugaaucuuuaacaaaauuuacuuugaauauuaggcaacauuuaauauuauuccaaguaaauaugucuuacaauuguuauaucugcaaaaauuuucuaaaauuuaaacaauuccacauuuuugagugccaguccacauguaaaaacgagccuucaacagaaacuggucagaguuugcauaaagcuggugucgaaugccucaaguaaacacgcagguauucacagaguugggcuuccauaccugaucuuaaucgcaaaaccaacugcugugguuggaucugaguaauauccucuggcuugagcuucucugcuguuccuuugcuacgguugguuacauuuuuauuuuucuuuauaucuuuggagccucugggauuuucuaugucaucuggagggcaacccuucuuuuuuaaggcuucuaaaucaucacaucgugcagaaguaggcauuccuuccuguaaaaaugucuaaaugacauauaaaauauagguauaaaugaaaauuguaauggucaaaccuuuuuacauaauaauugcaaauaagcaauuaaauugcaaaacaucaaaucacaucuaauguaccccaauucuggcuuuuaaacaaaaugcucccuucauccaaacugugguaaguguucuuguuaaaaaacaaucauuuccaagaaaguaauaccuuucccagaacugacccaaguguacacaguaaaugcucuaucuuguaauucagaguaucuaaucaaaagcaauuucuuuagugaaaucacuaauugagcaugguuaauggcuacuaauaauguauacauacacccaaauaucagaucauuucuccaaaauuucccuuugaaaaguccuuacaaagcgucucauauuauguggcacucuccccaucgcaauaugcugaacaacccgauguuuagggaaaacagacgagcuuaaaaacaucucaauuaauuauugcauuuuuuaaaaggacaacacgaaauuuagcaccgauuaaauaaguauucccacagguuugaaaaaacuuuaaguauuagcuauuauuguaaauaaguuuuuaaaaaacuuuuaaaaagcaaaauaguaaguauaugacaaggguaaaaggaguaaguauaugacaaggguaaaagguccuaauggcagguaaauuucaaaaaaggaaaaaaaguucuuaauggcaggugaauggauauuugcaguaguaaaauuucuaguaaugacagagauuuuaaaugugguauacaucaaacaacuuagaaauaaaaauuuaaucauauaacugaaaagugccuuagugaauucaaaaacacugcuguuaaagaucuauauaaagacugugaauaaagguguuucaagaaaugugaaaaugugggggaaacagugacauuauauaugguauuuauuuaucaaauaucaauuuaacggugcuguauaaaguaacaguaagugaagauauuuaaauuuaaagaauacacaauaguuuuuacauaagauuuuuuaagagaaacaucauacuaaugagaguauuuauguaaucaacaacuggaagggaauaccaagaaucagauaauucaaagcugcacuauuuauuaaaccuaaacuacuaccuaccaaagcacaagauccuagugaauuacacauuucuaaauacuaaucaauccacgaaauuuacaaucaugacacccaaauacaauuucacugaauauauucagaaagccuuuaaaauuuuaaggauuaugcuccaaagcucaaaggcuaagauaauccuuaacuacagauaaacuguaguccccauaaaauggauauguuaacaauaauagcagcuaccacuuauuuagaaguuuuuaagugaaacugcuuuaaguucaucaauucuaauuauuguaacaauagauaaagcggauauuaucauccucauuuucagauaugaaaaccaagagcuucaguuacauaagccuugccugagacaaacucacaacacuccauauuuccuccacuguugccaauguaaucccaacacaccacuuuuagaaaacaccauuagaaaauuuuugaaaaacaacaaaaccucucauuuuuucuuucauguggucaaaccauacgacauaucugacacuugaccacuuaggcauacaaaaauaggcacuugaaacuugggcccaaaugccugcaugaaaacaaaaucaguaaccccuugaucuucugauauuaguuauucauucugugaauaaacuauacaaccucaaaaugacuucuccuuaccuucucuuuugauauauucauucauucauucauugacucacugaacauuuaguaggcuuuguggaagguaccauauuagcaaaaguauagagaugacaaaagugaauaaaauccaaacccuaauuaaccucaauaagcuuauauugggaugcaaaucaauuccaguaguuuaacucaaauauaauuaagaagguuaauuuauaccuccccaucaaaaaaggggaaaucugaaacagucaaacuaaaugacuaggauuuuuuugaagguucucccauaaaaaucuaauaugugccacaaagaugagcuacaaauauauguauuuuaaaauuguuuaguagccacacuaaaaaaagaaaaagagaaaauuuuaacacuguuauaacauuauuuuuaaauauacaaaaauuaucauuucaccauuauuauuuauuuaauacuaagucuuugaaaucuuguauaucuuugaaacuuagagcaauucuaauuuguacaaaagugcucaauagccacaucugccuaguggcuacuguguugaaccacauagcuccaaaccauuagguuauucauuuuaugauuuacauaaaaauuaauaugugcuucugaaggauacagcacugagccacacuaaaugaccagagaacaaauggaaaggacuugagcaaccuuacuuacugaauuugugcaccacccacaauuuggcccugcuuguauacauucuccacaugauuuggcauuugcuuuuaaacaucuauuuucaucugucagaaagaagaaagaacagaacauuuuaugugaagugucagagagaaaauaaugaaaaaucagaaucacaaugacaaugcaauacauauguuaaauauuaauacuaugaccuaguuaccaucuaaacuagaccuuccccaaagagagcaggauuuuuuaauuuaauuuuuaauuuuuguggguaaauagguguauacauguaugggguacaugagauauuuugauacaggcauacaaugcauaacagucauauaaugguaaaugggguauucauccccucaggccuuuauccuuuguguuacaaagaauccaauuauacucuuuuaguuauuuuaaaauaugcaacuauauuauuauugacuacagucacccuguugugcuaccaaauacuaggucauacuuauucuuucuauuuuuuuguacccauuaacacucccgacuuccuccccaccuucucacuacccuucccagccucugguaaccauccuucuacuaucuucaugaguucaauuguuuuaauuuuuagcucccacaaaccggugagaacaaugcaaaauuugggaccgugauuuuggaucaccuugacacugaaagccacagagagacauaaguuaucuuccuugucuucuguaucaaagacaagacauaauucagaauuuaucauucuugacugucauaaaugucaugaguucucuuaaaacugggcaaaguauuauuucuugucauuuaacuccuaccauacucacaagaaucuucaaggcuuucccuuugcuuucaguauguuaaauaacugaaaaguccauauucaucuaauccauaaucccagaauuucucaggcucuauguucaaaguauguuuuagguuucuuugcaucuaccuaaggaagaguaugccuucuacaugguaagcgcuaauacagacugucuccaacguaucuuuucugagauuauaaaaccagcauaugcuucuuauagaaaaucuggaaaacacacaagagcauaaagaaccaacucacugaaucuguuaacugagagaggacuguugcuaacauuuuugccuauuucuuuccagucuuuuuccuaugcagauaaauagcaaggggaagcaagcauauauauauuaauacauguauuauuuacaugaaacugaggaugcacuuuauauauacaguuguacaguuuuguauacuguuuuuuauaccuuauccuaaguguuuuauucuuaucaucacaaauucuuuuuaaaaagaauuaaaaagcuuuuaaugauuauguauuucaauauaaguguacucuauuuaaugcuggacaaauuuagauuguuuccaaauguaugugugcacaguucacacaugcuugcucacaugcacauauaaacaccccaaguacacauauacacauacuguacuacaugcacauacacaugcugaugaucuuauauauaaaccuuaguacacaucugauuauuuccuuauaauaaaaccuaaaagaauaauuaacuacuaaguugaagagcauauuaacauuucuaaaauucucuauacacacuaauuucuauccaaaaguaauauacaguugacccucugugucugugguuuccaaaucaguggauucaagcaaccacggaucaaaaaugggggaaaaaagugucuguacugaacauguacauacuuuucuuccugucauuauucccuaaacaauacaguguaaaagcuauuuaccuagcauuuacauuguauuaaguauuacagguaaucuagagaagauuuaaaguauacaggaggauauguguagguuauaugcaaauaucaugccauuuuauaucagggacuugaguauuuguggauuuugguaucugaaggagguccuggaaccaauuccccauggauaccauagggcaacacuacuaauauaagcucccacaaaacggcaguguacaaauaccauuuuaccacauuuccaaccgaagugcuuuaauguuaaaaaacuguugcucauuucauaaguguaaauuagaauaucaauucauuggugaagccuaucaauuucagguuuuacauuguuucauauuuuuacuaaccauuucuuuuauaauuuuguuaugucuuuugcaaauuuuuuuguuauguuccucaguuuuuauuggauuucuauacacauuaaugaaguggaaccuuuguuuaguuucucaucuuguuuacgguguucugacacagaauguuuuuguuauuacugauuuuauguaacuaacuuaucaauacuuucuuuuacggucuccugcuucauuuuuacuacuuguaguaaguccuuccaauccugauaucgaacugcucuaugcaguguaguuuuucaagauucagaggacagaacugcguauccauuauuccagauguggagccacaucuuuauagaaggguuaaauacauuuucagcuuuauuuucacugcuuuccuagaugaugccaacauuuugugagacuuuuuuaucaaagagugagaaugucuucuagaaagucuuugcagauaauaauggacaguucauaauccuccauucuacacauuuauuucauuugcuucuaaauauacuugcuuuugccuucuguucacuuacacacucucauguucucaaaagaucuucuugcaguguguucaaucccuagcauuuuaguacuucaccagccaacuugccucccaucaucccagguggcaggggugaggggagccugaccaugaaggaacuugaccuuucucugaguaagaggaacaauugcagggcuuccagaaggagcagcaugauuaugacuuagguucucauaugaaccuaacuggucaaagcgcaauacaagauacggaaaugaaaagacaacuaagaaaauuuuuuguuuuuaccuguuugagcaaacacacagcaaacugaacugaucaguccaauccagaaaauugguuguaaauucaucugaaauguaaaaugugccuuauauuaguuauaaagaaauaaaaugaaaaaugcauuaaauagaaaguauuaccccaccguaccuucuauugcuuuuauaaacaugauggcucucaaaccauuucacuccagccccucuccacagacccucgcccaucuccccucccuaucugguucccucaccuugcaccuacacugcgaaaauaacuuccauaccagagccccagaauccauucgugccuuucucuaaagcaaaccgauuauauuuuaacauuuaauuaacagcgcucaaaaaaaaaaucaguguuaaguauuccucaacaccauaaaaccuaccaauggucucagcccauagaaucucuaucuccauuaucuccugcggcucccaggggcccagaccagcauauccagaugccucaguuaccucaaugcugaacauucguuuucaaaaaccugaucaagucaucccucugcuaacaaugcgcuucaucaguuuuuauuucuucaggcuaaggccaacauccugcauaaggccccaaauagauuuuugagcuuguuuuccuauuaucucucuuuuuuaagaaaaucaacuucugccaggagcgcuggcucacgccuggaaucucagcacuuugggaggcugaggcaggcagaucaccugaggucaggaguuugagaccaacccagccaacauggagaaaccccagcucuacuaaaaauuagccaggcaucgucgugggugccuguagucccagcuacuccggaggcugaggcaggagaacugcuugaaccugggaggcaaagguuucacugagccaagauuaugccacugcacuccagccugggcaacagagcaggacuccaucucaaaaaaaaagaaagaaaagaaaagaaaaucaacuucuaugcaugcaauaaguaaaauacucaguuuuaauuuccuagaguguccagaccccccaccucucccccaacaaaaaaaaagagggcauaagacaaacugaaaaagucuugucuucuagaaccucuaaccaaaaaauuagguaauauucuauauacuaaauacaacuaccccaauuuccuaccauuagguacauauauaacuauuuucucugaaucaaagcuuucacgaugauaugaaucuauaucuuugauuggucaaagauggcuacggccacugguugcugacuugaucccuuaacuacuuacugcucuuggacuagcagccaaucuaauaauuauauauaaguaucugucccuccacaagaagaaauacucaaaaaagcaaauuuauacaaaaaaaguuuagguuuaaucguuauuggaaaauguaaauuaaagcaacauaagaugaacuagcaaaaauagaaaguuuuuuaacccaacaaaacuauagcagauggcugcgagaaaccaacugguagcucugugaacugauacaacuuuuugggaaauaauuugacaauuuauaucaaaaaccauaaaaaaauuucuacccucuaauaauccagcuacugggaauuuacccuaaggaaauacuuaaauauauaaaaggugacacacauauacacacacauucaguauaguacucuaguauauucacaagagcaaaaauguaaauauccuauauccaauaacagggaaaucuaacugcaucaaguuuagggacuuauuagucauugcaauaauaaaaugcagcaacauuuagaguuauagagggccaagugcaguggcucacgccuguaauccagcacuuugggagaccaaggcggguggaucacgaggucaggagaucgagaccauccuggacaacauagugaaaccccgucucuacuaaaaaugcaaaaauuagcugggugugguggcauacuccuguaaucccagcuucucaggaggcugaggcaggagaaucgcuugaacccgggaggcggagguugcagugagccaagaucgcgccacuguacucuagccuggcgaaagagcgagacuccgucucaaaaaaaaaaaaaaaaaaaaaaaagaguuacaaaauaauuuuggauguaaaguacacaaugagaagaacgugacuuucucaaggcaaaagaaaaaaagaugagaagaauauaaaaauaauacuaauaguuucauauaaucugaagauaacaaagaguuauaugcacaauauaaagacaaugagggccauuuguuuuuuaaacuguuagggucuucuuucuacuuucuuaaugaaaacaacuguagcacaauuuaacugugcaauuauuuuucuugacaaauuuccuuuaauaugaaaaaaguucacugaauuccaaguuaacacugaauauuucuuuuacagaccuccaucuucaagggcuuacauuccaggaugcuauuccccuggcucagagagaaugcuuuaaguugugcucugagcacccgagagaaaagaguuaagcguaacgugaaaagucauucacuucugcaaucgugcucagcccagcaggcuguuaugccugagcuugcaguuuugcuuacauaucacuugugacuguauccaagagaccagcaaaaucugagugucacagaagugugaaaugccuaccaaauucaccuuucaaggccugucuaaaagguuuaguguguaguaaauccauuagacuauaauucuaagcaagucaaauaauguuaucacgauuccaaagcuaugacaacagacaccugaaacauuaaaaguuccugaggaaaugcauuacugugaugaaugaagcaugcaggcaguuuccacacaaagggaauggaacaaauauuuguuccauauauggacagauacauguuucuucaggauacaacucaggcuguuuaaugaucacuagagacugcuuugagaaaucugucaacauaucauacaauuuagacaaucaccacuaagaugaaguuauuagguaacagaaaaugauuccuaacauucggagccacacuacuuuaaaugucacuguccuuuccuucuauaaaccuugacaaggcaaaaagucaaccuucugaaacccuugugccuccggaagagcuccaaacccggaagcaggcgaaacaaggcuucaguguugaagaacagcugagagaacaaggccagcagcuggaaacaguuuaaugacagaugucaacgauccugcgacuggcgacuggcggggcacuggcaagaaacagagaggcacugccauuggcuagugauaucuguaaaaggcgaggcuuucucucagggaaagggaaaggcuagaggaugacuccaauuaagaacacagaagagcuacaggaccagggggcggagaggagaccacaguuagaaguggccugagggaagcaagccacagagacccggacaggaaaggagaggcagagggccagggagccucgcuuucaaugcugcuggccuucccuucuaccgguacugggugcccccugcacaugcgcauggaaggggaaggaacaggugcccaaguccuacgccacaaagcucccaggacagcacuucucuaagugggccuagagaacaacugcauuggguuuaccuggaugcccuaggcuuaaaauccacaaucccugagcauggggccuggacuccaggugauucuuaugcugagaaaaggaccugaagggguuuccucccaauggcauuccauauaaaacagaguaugaggggauaacagggaaagaugccuuucaguugcuguccuaauucuaacgcuugucuccucuucacggucaaagaccuagaaacaguugucuacacuggucuccauuuccuaccuaccuucccucuccucaacccaguaccuucaugugucauuuaacaaagaaagagcucugagaaaugcgaaggcaaucucaucuuugugcaaccaucacagugcacuuacacaaaccgagaugguguggccuccuacacauccaggcucuacgguacagccuauugccccuaggcuacacaccuguccagcacaagacuguccugaauacugcaggcaacuggaaugcugcaguaagcauguguguaucuacgcacaguuagacacagaaaaacuacacaguaaaaguaugguacaaaagauuuuaaaauugaugcaccucuauuaccaugaauauagcuugcaggacuggaagcugcucuggauggcuggguggguaagugagugagugagugagugagugagugagugagugagugagugagaggggcaagugaguacacugcacagaacacacacugaacaggacauuacugacauuacuauacacaguacuguggacacaaauacacacuacauuagccuaaagccugcacagcugcccugggucaggaucaucaaugucacugucuugcgccugcauauccugucuccaaugacacauggagcugucaucuccuaaaagaucuccuucuucgggaccacuuccugaaggaccuggaccugccugaggcuguuuuacuuuuucuguaaggagagauacucucucaaauaacaacaggcugggggcgguggcucacgccuguaaucccagcgcuuugggaggccaagaugggcagaucacaaggucaaguaauggagaccauccuggccaacauggugaaaccccgucucuacaaaaaaauacaaaaauuagcuuggcgugguggugcgcaucuguagucccagcuacucuggaggcugaggcaggagaaucacuugaacccaggagauggagguuacagugcgccaaaauugcgccacugcacuccagccuggcgacagagcuagacuccaucucaaaaaaaaaaaaaaaaauuaacaauauagugcaguaaauauauaaagcaguaacauaguuguuuauuaucaaguauuaugcacuguaauuuagaugcuaugcguuuauaagacuggcagcauggucgauuuguuuacaccagcaucaccacaaacaugugaguaauguguugcacuaugacacuacauuacuaggcaacagguguuuuucagcuccguuauaaucuuaugggaccacugucguguaugugguccaucacugaccgaaaagucauuauguggcacauaacuguguaacugauguccaugcccaaccauauaugugaaauuacucuugcaaaagaacccuuucuaggccuuaccuuacucucugcauucauucguucaucacucauucauucacaaauuuuuugacucacuacaauaugcacuugaagaaguacaucgguuuacuaccaaagaauuuacacaaagcaacauguaagacuauucaccauucuuuaacacacucuacucccuugaacucuacugguuucccccugccuuucuggagguuccucuucagacaacucugucagguuuugagccauaucaggaaauacaagggucacugcuucagggaacuuucaguucaaggacaaaaauacaaauuauuaugauaugaugguuucaguaauaaacaaggacacagugcacugaggacacugaaaucugccuggacaaguucagaggcaucaggcacauggcaguguuucaguuagaccugaaggcacauaggagauggguguggagaaaaguggagagaagauauuccaagcaaaaggccugcauauacaaagccaugaagucccgaggcgaauuauaauaacuccuuccuaaucuuauuucuaagcauaugcauuugggcagcucccugcaacccaaaauuggaacugucucacuuuuucucucuuuauagaaaaaaagacuagaaaaauguauguuuuuguaacuauaucuuguugguggaaugagugauuauuuuauccuuauaauuuucuauuguaaguauaaguuauauuaucuuaaaaucuuaaaauaucagaaaggccaaaaggaaucuugaaguauuucugagacuuaaauuaugaguuggaaauaacaggaacgaagaccaagcaagcaggaagagcuacguuacagagagccaaauaccauccaugcuaaaagaguuuggauuccauucuauaaauaggaagggaacugaaaaaauuugggcaggcuaguaauaccucuacauauacauggcagaaacucaguggagaaaaggacagggggcaagacaggagcuggaagacaaauacagaauuuacugcaaagguucaagugagaggugacaaaugucuaaauucagauaacagcaacaaacaagaagacgaacaaacaaugauuagaagguagcuaugagggaucugcugcuuacuuggagaaggaaggaugggagaaagaaaggaauuuagaauaaucaucacuuuaaaauaaagaagauguacgagggagaaugggguuaggggaaaaaaugagguuuguuuuauugcaaaaucuagggaagaugccuauugggaagcuaggacaugaguauggaucucaggagauaagucaagaguuagagacacagacaugagaguugucauaaucuaggugcuaaccgaacuuaugaaaauggaugugauugggaugaaaagaauacuuaggaagaaaggagaacugggggcaaacuugaagaggugaagacacaggaaaagagaaaaggaaagugaugaagccaggccuccuuggagcaaagagggauggcaugugcagcccaaggggguggaucacccuaaacagagacauggugccuuucuucuaaggcagagcaggaggugagaaagcaaagagaguucauucaugcaugacuguuuuuuucugaaauaggaagaacuccuaggaaaagagguacggcuuagggguugcagaaaauuaggaagaugcaaugggauuacagugagagccugcaauggugagagcccaccagguauuggacacccuaauuuauacaggcauauuuguaacacucauuucacuucuaacuauuuguuaacaugucuucccugauggauucuaggcuccaagaaaauagggccuggguguaucuuauuuauagcuauugcaccuagaaauacuuggcacaaaguccaugcucaaaacucuuugcuguuaggcucaugccugcaaucuuagcacuuugaggggcugagguaagaggacugccugaggcaaagaguucaagacuagccucgacccugucucucucucucucuuuuuuuuuuuuuuggggggagacagggucuugcucugucgccuaggcuggaaugcaguggugugaucacaucucacugcagccucaaccuccugggcucaggcaauccucccaucucagccucccaaguaacugggacuacagguaugagccaucaugcccaccuagagauccuggcucuacaagaaaauaaauuagccugggcaacauagcaaaacuugguggaagugggggccaggggaaggggccaugaguccaggaguuggaagcugcaguaagcuaugaucacaccacugcauuccaggcugggcaauggagugagacccugccucaaaaaguuaaaaaauuaaaaauauuuucacugaaccauauugaauuguaugacauuuuucucugacauuacucagaagaaugucucagaauuacuuaaugugcagaacuucucuaaacagaaaaguguuacuauagacauccaagugacaacuuaaauuuucaauuacuuuaaguauauaagccaacuuauagauagauauaaaaugucucaugcucauagcucuuaaacauuaugaaaccaaaauuaacuuccaaguacaaacauagauucugaaguuauauuacuggguuauaagauggucaaccagauaaacuaaauguuuauuauuaacaugaaagcaugauuuuuuuuuaaauuuuguagaaaugcccaaaucucugagaauaccucccauggucccucagacuccaauuuggaaucacuaaaucuauucccuggugugcagggcaggugcaagaggaaagguggggguggggggcaaagaaggugcagugcuaccaaaaaguuaacaagaggaaaaagucaaaagaccagacaucacaacagggaggugagaggagaggggaccacggaaacaaggaagugaaaagagcuggaaccuacgacaguuaagaauuuacaauuucagagacaggcagucuugggggaaaaggccuguauuaaaaauacaguaccaggucauuguuuuagcuaggguucuguccaaagcagagccugggaacagaacuggugugcaggcaguuuauuggaaggugaccccaggaaaagagagagacacuuugaagacagugaaccaagaaaaagagaaaaagccaauacaaagauacuaucuuuaccauacugaguaccugggggcuugaucuuguggaaaacuuuugagaaguacguagaaagucuguccagugaaagucaacggggaaauggaucaacuccaguugcauagguaaaaagucgccucaaagggcauuaacuccacuaacacuucuaagaacuacagugcacgugcccagggacagacaagagggaacagacaagaaaguugguuagaggagccgcaggggaaaaagcaaaagagaggcaccugaggcagcaugcagucagccaggagugagccaccgacuguucccagcagcaccagcuggaaucagaggccaagaggaugugagaaagacacacgagguuuccaguacagugaccaauggccacuaaaguugagagacaagaaaacugcuagaccagaguucagggaaggccugggagccacaguccccgcccacuagcagcgcugccagcuggcugggccugggcggcagagaagguaaguucacaggcugggccaaagcccuuguucgggugcggcgugggccuuggucuguaaaggggcgucuacgcggcagcagccgugaucaugggggcccugggcuaggcaacagcacuaguugucgcgcgucaccaaacacugugaagcaccucucuagcggagaccugcuccaggaucaacaugcugcggggcacagaaauuaauguguuagcuaacgcuuucauugaccaaaggaaacucauccgagaugaugucaugacucagcuggcccuauaugagcugaaaaaucucacuuaguauagcuagcuguugggugguuuuccauggacacuuccacaggcagaagcccuagacuaagcuucuuagacagacaaagugauuagcccgaaugugcccuuugaggucauuaaacaaugccuuacugcucgcuagauucauccugccaguggcugagucuacaacauugaauucaacccucccaaaacugugggcacugaugaucugacuggggauccucucauucagcaugaggaugauaaaccagagacgguuaucaaaagacuaaaggcuuaugaagcccaaacaaagccaguccuggaauauuaccaagcuuuucuacaaacuaaaguuccacaaagaagccagaaagcugccauuacuccaugaggagaaauguguguaacuaguaagaugagcaaaccuccuauuccuugaauuuaaaaacugcuuuuccuaagaccuccagcauguaugaauucuuugaaaguuauauuacuuuuauuucuacugauuuuauucuggauacugaggaugugccaaacgagucagauacuaagauuaaucuuuugaaaucaucuaguguguuuuauccagucaccugcaaaaccaucagagaugucuuaacuuuuaaaacacguuagagcaaaauuaaaugaacaauugguaguaaucuaacuuuuuguucauuaagugguugauaggcugggugcaguggcucaugccuguaaucccagcacuuugggaggccgagauggugcaucacgaggucaggagaucgagaccauccuggcuaacauggugaaaccccgucucuacuaaaaacacaaaaaaauuagccgggcgugguggcaggcgccuguagucccagcuacucgggaggcugaggcaggagaauggcgugaaccugggagguggagcuugcagugagcugagaucacgccacugcacuccagccugggcgacagaccgagacucugucucaaaaaaaaaagauuaagugauugauaaaauguccauauuuuuuggaaaaguuuuaaaaaguuacaugucauuuggggaaaguaucucaucagaaauuuuugcagauuaaugccacauuucuagcauuguggagcauggugauacuacauaaaauuccagaaaaaaaagcaacuggauucacagauuuguuguaagauacaaauucacugcugccuuuacacuaauaaauauauaagcuaaccauauaugcuguauuuauuuuguuguuaaacauacuuucaauuuacucagaauuuucaauuugcuauaaaaauguaucaauuaacauacagaaaaauauuacuuuaagaugacucuucuuuugaaaauacauauguauugaggguuauaauuuuugucagaaauugacauuauaaguucuuggauaagcaccaaaguugaaugaauuuucaacaaaauauaauugaaaucuauguuuucagauguuacucggguuaagaaauguguuuuaggaucuacuugccaguuucucuuuuugauccaaauauaugaucugcccugauaaauaacaaguuauuauaccccuccucccaaaaauaaaagagaaaaccuauggaauuauguaaaguaagcauacuuugucauuaguaaauagaucaggcaugccugcggaauguucccuuggcauaaauagcaaucaaucaugauucguaaacaaggugugccaauaaaaagaauucacaggauagguuaacaaagaccaaaaaagugaguuuucugaaggaguucuuuguuccugaucaaagaaauugauaccugcuagcauucacugccaccuuaucuuaaggggaaagaauucuacugguuucaucugagcagccauuuaaauacuggaaucuaaagugauuccucaguggggcaacaaggauggcugcugauguacugugaccugguaggagaaguggggcauaugagagaaggaggaaaaaccugaccaucuuccacagcauauuuacucuuacuuuacuuggugcuaaagcaaaugaaacaaggccuuguauaagcuguuauuaauugccuuuaaaaaucuguccuguuuuucuccagguacuuaaaacacaagugccaauaagugguuuguauguauuucugggggggggggggggauuauuuuccuuuucugcagguauuucaaaaauucaucagucuuucaagaugaaccaagguuuuuuaaaagaauuauaguaaagacuucuuuuuuuuuuuuagacaguuucacuugaucacccaggcuggagugcaguggcaugaucuuggcucacugcaaccuccgccuccuggguucaagcaauucuccugccucagccucugaguagcugggauuacaggcaugugccaccacggcuggcuaauuuuuguauuuuaguagagacaggguuuugcuauguuggccaggcuggucucaaacuccugaccuccagcaauccacccaccucugccucccaaaguggugggauuacagucaugaggcaccauaccuggccuacuucauucuuuauaaaacuuucuauaaugccucacuugaauguuaauauuaugugcuuuguaaaaauguugugaacucccaaacuuauagauuaucacuagguuaugaggcauacauuagucuuuaucugaauaaacugaaauuucauuaaauaaaaaaaaaagaaagaaagaaaacugcuagaccaaggugugagaaguaucaucugcaugaacucuugaagcccucgaauuauggcaagaacuggggaggaaagaaagacuaaagccaggugauucacauauagccguguguguguguguguguguguguguguguguguguacguacauacacacaguauguuaaaacauauauaauaaucuucauuuaaaagguuuccuguuuggggcauauguagcucuuauacaucuacuaaugauguacaugguugacuugccuuauaaauugucaucuucuagaaguuucuccauguuuucuguaucuagcgcaaugucuuuauauugaauaaaugaagaaacuaacgauaaaaacaacuggagauacucugagguaucaaaaaauaaaacacugagcuucaugacagcagauauuuguggcaucuaccguuguacaacauuguguagugcagaguuacacuggcaaauuaaucugucucaguuuccucaucuuuaaaauggggacagcaguauuuaccuuguagggguuuugugaaguuuaaauaaguugauacacauaaaacauuuaaaacaaugucuggccaauuguaaguaccuggguguuacuuguuaugaucauuaccaaauguuacaggaagcgcucaauaacaacguaauugaauaaagaaguaacuaugguugaauuuuuuuuuuuuuucaauuguaauuauaaccagaaaacugacuggauccacuuuagggaagacacaagauaugaaagaaaggauaaagucugaaaguuagaaguaacacaacuacagaaaauagauuaauguggauuguuauagcuguucauacacugacauccucaauaucaaaaccuuauuauacucuuuauagauuccacauccaaguagaauucuauuuaaugugcuuucuaacaaucagauuccugacaaauguguucauaaaguaauaaaagcagcaaaaccuuaaauauuuuauacugacaaaauauuuaagguaguaaauguuagacaaaauacaaaugcucugaacacuaauaucauaaaaacauaguagacaaaauacaaaugcucugaacacugauaucacagaaacccuuaaaaaaagauugaggggagggaauaacauaccuaauacaaacagaaauaaggaggaagcuuugagguuugcuaugcuuugaacguguccccaagguucacguguuggaaacuuaauccccaaagcaacagugaugagaggugggacuuuuaagaggugauaaggucaugagggcucugcccacaugaauggauuaaugcuauuaccacaggaguggagaauggguuccagauaaaagacggaguuuggccuccuucucuucucucacucucuugcccuuccaccuucuaccaugggaugaugcaacagaaagacauuagaugccaaccccuugauaauggacuucccagcccccagaacccugacauaaauuacccagucuguggcauucuguuauagcagcacaaagacuaagacaagguucuuacaucacaaggaagcaaaccccccugaaaggacuagaauaccaauucuguguuuuauuaaucaaacccaacuagcaauaugauuucguucagggacugcugcucacuguggauuacugaaaaaaaaaaaaagacugacuucucaauugagagggccagacuaggcacaggcaagaagaagaguauaauacacuaaguuuugaugauuuaaaguaauuuguaacaaaaaguuauuucauuuagaacuuuaaaaaauuagaauuuuauuucagcaccuucaaauggauaugauaauaauaaugauaaaauaauagcaucuaucuccuccagguaacucaaugaggugaagaauaauagugucuuuguuuuacagaugaggaaacaaaaccagagagacuaaacaacuugcaaugguggaaucaaaaguugcacagguggaauugaaaccugaccaucuguauccagaagcuaugaccugacuucauuaaacuguaauuuuuucaaagccuacuuaaucacuauuuuaaaacaaagaacauccuucuaguguuagaacugacucagggcacagaaauggaaagggcuuauaauguucuaugaguuuauuucuugggcauuugaacuuaauagaggccaagaaaaguuauuuuaauugccauauuucauaaguacagacaaagguuuugugucuuguuccuauaaaagcauuucaccuuaaggucauuuuuuaccauaugaaauuuuaucuaaggggucauaauucauucccugaacaauaaacaaucuuaaacaccacccacaaauaaucucauuuuagugguuaacccaaauaugugcaauuguuuccacugucaaaaauagugcauaauuguuuuaaucuucacuguaaacuaaucuuuauccauaaaaguaugguuuuauaucauguucaaacuuuuaaauacacacucauuauuuauuaauuuuuuuaaacaauuuuacaaauaauucauuuggcauuuccuuuuaaauuuacaaucuuuagaaacuuuauauggacuaucuuuguagaaauuaaacaacuacacuuuagaaaaaaauuguaacauauguaacauauguaacauguuauguucauuucagaguugaaaaauaagccaccuaaaagccaacucaaauaaaaagaauacacaaaagauuucacaaaaucucaaaucuuuucaccuuaauaguagaaaagauucugauaccuauagagguauaucauaaaugucuccuaaaaauuauaauaaacuuggauucaucccaagucuguucuaccaucauuauuuucuguaucugcuuuuaaaaggggaagaaauaggccaauaacagauuuuaguauuuaaaaaucaauauauuccagaagaagaacacagagccaaauugaaagacaugagguuccucccacuuaucccacauagagaguaauaaaaacgagaaaaacaugaauggaagaaacugagaaaucuuucugaauucuguaccaucugagagggugacauguggagaugaguuccucccauggaaagggaaccuuuccccuuacaggaagaacaauuaaaacucaacacuuuuuuuccuuccaucuggcaggaagagguguguuggucacuacagagguguuuauggcccaaauauuaauaagcuagcauuaaugauuaacaaaacuucgcagaaagaauagagaagaaaaaaaaggagacaugaaagagaagaggcuaagggaucccaaagauguaacaccacauuugaaguccucuucuccucuccuugacaaacagaaaaguagucugaauuagaaaaccaucuaaaauucaccacucccacccagaagaaaaauggcuuuuuaaagagcacuaaccccuucucacacaaugauaaugauagccugggcuaagaagcucuaacaacaaagguuuggcugcuccaaagcuauagguucacaaaacaauuugaaaucugagaacagcucacaacacggcgagauacuuuaagaaaauuauacaacagauugaagauaaaauucaucacuagugacucuacccgccuucuccaggaaaaugaaauauggaagauuuuuaucaccacccaaucuacaagugcaagggaaagauaaauaauggauauaguacgcauuggcaaacaaaaugccuaaagauaauacguuggggguagggggagguaaagccuggaaacuuaacaccuaggaaagacuuccacagaacaaaaagugaaaggaagucagugaagaaucuucuuuaaaaauaagagaaaaucuagaucucauucugcucuucaagaaagucagaaaaucucaaauagaucuugacagugaucaaagagcaaaaccacaaaagucgaggaaaaguaaacagaacuaaggaagaaaauuuaggcuggaauccucuacagaacucauagacaccaagaacagaaucaacauaacaggaaaaucacacaaaauucaaauaauucaagccaaugagaaacguugucuaauggugaucucauaaacagacaacugguacagcaccaccaccaccaccagccccucccuguccugaaaaaaaaauagcuuuaugugagaaacgggaaaaaaaugaagcauuuaauucaaauggggguaaaggggcacaaaauuaacucaagacuucagaggaugaacguaaaagcagaaaaauacacuauaaacaaagcuauuaagccauaauaugaagggcugauccaaaaugagcaaaaaaccugcccgaacuuaauucuucccagcuccuccuuccacucaaaagguaagacauuauuaccuagcaauugauuguuuuucaaaccagccuaguaugcuguuccuucuuuccacucucuaugccugcggacuuuuuugccuuucccugugaggaggaaagaaguugggaacgguuuugguugagaaaguuuacuuuggggcaaguugucaaagauaauugugaguggagccagcaaaagaaccagcaugaucaacgguaucaauaagcaccugagagcaagacuuauuccccguaauuucaauuaaggagaauuaucuucucaaacugcguaauuauauccacuuuuuaagcagaucauuccaaaaugcuuccuugauuaaaacuaauuuugaccacaucuuuugucacaucuuccucuccauccugucugugguggagugcauacaguauuuuaaauacaugauaaauguuuuaaaaccaugauaaacauaggaaaaaaaguuucucauuuuacacaucaguaagcuguaaacaguaucuaauuguuggaaagauaaaauaugaucauuauaugaaagcucuuaucagcaaauauauuucuagguggucagcagcucauaauuuacaugauuaccaaauuugcuucuuguucuccaacucauuaaucauggccuucuaaaacaagaaccucagugacucuuuaauaaauguuucucaaucuuuuuaauccaugcuucuuuaauaagcauaaaucuuacucccuauuguacuuuuuuguaacauuuuucuaacauaacauuauacuaccaaaugugcuuuuucaaacuccaauuuccuccuccaauaaacaugacccuguaccaccccuuuaaaagaagcacugaaaucauaauaugaagaaaaucauacauaaaccauaaaauauuguacauggagaagaauaaucuauugcuaauuucauagauuacgaaagcuuaaguuauuuacauauucauucaauaaacauuuauacagaaaaaugugacuuccauacuccaaaugguacauaccuaauuucguauguaaauauuuuccucaucacuccacugaaacuauacucccuacacaaaauagaaugcugauuuuucuucuuccuuucugucuuuauugccucuucaucuccucaccaaccacaaucaacuuaauuaacuacuccuucucugugguuccaaaacagcuuugauagugcccagcagagugaaugacaaaucuucagugaugcuuaauaauauaguguuauuucuauucaaacuucuauuguaacuaauuguauucaugucugugucucucaucaggcuaguauuggagggcaagaacccaggccuucauuuuauauagccuucacauauccuucugauauauaugauauuauacauaacuccuaauagguaacaaaguggccagguacuaucugugaaauuagauuggauucuucccaugcuguccuugaaugugacaaccaucugucauccaaccuucgcucauaccauuccaagcucaggccucaucuccuacacaacguguuccaaaaccacacaagccaaugcugagauuuuucuaacauuguuagggaauauuacaugguacaguauuuuaugguacaguacauuguauaaaacacucuuugguauuuauguuuuccugaacugaacacaacuuguuccaauuagacaacagacucaacaucaaagagcaugccaacuucuugauucauguccacugaguaaagcauuuuucagguaacugguacucaauguacugauagaauaaaauguaauguacagccaagcuacauccugaugcagagcugacagggacagauguugcuggucagcgcuggcagguauccuuaacagaguaaguggcacagugccuacacucucuggugauacaaaaaaaaaaaaaguugcucauggagagagaacugcacucuacuuacaucaggcagcagcuauccuccaacuccucgaacgagagaaugagagaaacaugcaggcugcuuuauaggguagauguggaaaccaacgcucuggaaguacaguacucugacaaaggucacacagaaauucaguggcagacccggcacugacacccagguuuccugucucccaaucgagaagccuuuaguacaucaaacugcuucucugaucagguaucugaaaauaaauuaccacaaagaaaugugaccaaugaagucuuucugucuuuaacucaaacaugccaaucacuggaaaaacccagaaauaccuaugucacucacaaaaaugccacucaaaggaauuagaaguucagagaagaaacuggggaagguaaaugcuuuucuagauuccucuuccuccacccccccuugacuauuaaaaguguucccagguccuccuucagcccguuuuucacuccacacccuccuuugguguuugcaugcacagccuauagcuucaaccagcaauagacuaagaauugucaaauugaaaucucucagaguuuuuucuuuuuuuaagcucucaaucuguguauucaacugcaauuuagacaucuccaccuaugucccauggucaccuuaaaaaaaaaaacuuggccucauaaggucaucauuuccccucugcuccagccaaccagcacccccagcuuguggucacccucucaccucagugaacagcaccuccuagccagaaaccagugucacacuggguuucuuuuauuucucuuaucaagucuuaucaguucucccucccaaauacaguaguucuugaaccccacucaaaucauccuccauauagggaucugcaaagcuuucugaccacucaccuuuaucagcaaaaaaauucuaggcauaccuguacccaaaauaaaugcaauuuauaaauucagauacauguacuucuacagcaauauaguaagauuaucaaucauaaucaaaauuuuaaauuuuaaagugaugagaucaacaaacauaauaguagaccuaaaauuuucucccuauacuucagugagucuuuuuaugcaucccuggagauaggaaccugugcuuugaaauuauguacaaugagauugguccuauaagaaauacauacauauaugugcuuguguguauguguguauauacauauguauguguacuggaggcagcuuuucucaugcacacacacguuucaugaggugauaugcacacgcuuaagcauauugcuaaauauaguuaacucuaccuucuaaagucacaaaccaaacggcaaguuuaaaguuagcugaccucuaaaaacucacagccacuuuuaaaacaauaacaaauguacaaaguauaguuuggauccuuuuguacacagcuccugaaagagagaaacuuuuuuuuucaccuaccgacagacauauuggaaggcugcuaauauucugacuuuuacggacuguacccccuuuaagcuggguacauaccauaauaucuuuucaguuuuccacagcuauagauaccucuagcauaacacuucaggauucagaagacgaauguaccuuucuguaucuuaacgucucuacuccauaccucccaccucugaaaaaauaaccagccaaacucucagaaccuaaaaccaagucagaguaaacacugcuaauacaauacagguacuuacauauuuacccggcauaaucuccaggauuccacccacaaccuaacagauccuaacucucuggcagagugagaaaaucugcuaauaucuaacagaagucuaaaugaacccuuucagauacaugcagcuuguuacauauucagaaaguuaaguucucugaaacuuuuaccaguuacaagauguuucagcuuaucacacuagcagcauaguuaagggcaaaccagagcagcuacagaauauuaaugaauauguuuucagacagaacacuauacuacucaccgcuguaagccauaacuuacuuaucaagaagccaaacaauaaaagcauuacaaucaguggcaagcacgcuuaggaaaacuggcaccauguuaaguuguuugaccacuuuucauuauuauaauaugaccagauguccccagugucacucccagaguuaggaagaacaccaauguagagcuacauuuucauucgugaugguaauucggggcugauuuaaauuaaauuauacugaccagaaagcugccuaauuguuaaaauuacuaaauccagugacuuucagaauugcugauuccaugcuucucaugugcagaauguugaggguauuaaaaaauaacuuuaauauagaacuuuacauuaagaaaaucacaaacacuuaaaauuguagguuuaggucugaagucaacacagacgaguuaaacaaucuauuugcuuccuguuuacagaauuaaaguauuaaccacauucuuuguccuuuuaacuagcauucuaauaacaucuuccaccuucauacucaauuuugggauaaguaaaaugacuuucuccccaaaugccuguaaugaaaauaccaauguuuuuuauuuaacacuucaccaucuucagucacuuauauaauauugaucaaugagucaacauuauuuaaaaauaugagaauuauagugagacucuaaguccuaaccccucugggccuugauguccacaaaugaacagguaacugccaacugaaguuccuuaaucauuucuaaaauuggucuacuguauaaccuaucguaaaggacguaugugguuuaagaaaggugucuaaucuaaauuccucuagcauguuauuuuuguagcauuaaaacuacaauuaaaaaaaaaaaaauaaaaaaaccuaagggccagguucaggggcucacgccuguaaucccagcacuuugggagcucggugagagaggacagcuugagcccaggaguuugaggccagccugggcagcauagugaaauccugucucuacaaaaaauaaaaaaauuagccgggcacgguggcaggcgccuguagucccagcuacucaagaggcugagguggaaaaguaacuuaagccucggagguugaggcugcagugagcugugauggcucuucugcacuccagccugggcaacagagacccugucucaaaacaaaacgaaauaaccuaguaauucuacccaccuaaguuaaccauguggcauguuggcccaaagaaaccuuaccaaugauguuaccaauuaucuuccgagauauuuuuaacaucuuuuuacuauaaaagaagggcugaaaaggagucaauacucauugagcaucuacucucaagcuaaguuuuuuacauuuugcauuugauuuucagaacuauaguuaggaagguuacuugugguuuaaacgcggacucuggaacuagaccccaugccuucuccaggagcuccugaugaccacaggcaacuuacuuuugcucccugugccucaguuucuucacucggaaaaugggaaucgaaacaguaccaaucucauuagagcgguuccagaauuaaauaauacauguaaaaugccuagagcuaaacuuggcccucacugucauuauuauaaaaaugaauuauuaauguagauauuacuguuccuauuucacagaugaggaaacggaagcuuagagaaugcaacuuacuaaugaucauaccaaugagugcaaaguuuuggacucaaaagcacgaauuugauuaaauaaaaguuacuuagagaguaggagucucauaaauccaauuuaugaagccuaagaaaugacacgcgguaaaaugauacuagacacaggccgggcucucaggcucgcggaccgggucugagcacaagcuggccauggccaugcguccuggucccggggugcccggcagggaccggcgacucuugacguuuauaaacacggggaaguggacugcacugccgccaccgcacccccgguccccagcggcuccacuaagccaacuucuacccggcucccgccgcccccgcccgcggcgcuggccccagggccgccuccuggcagccggaggagaccaguccccgucgcgggcgccgacggcuggcucgacgcugcuccaaggacagcagcucgcgagggagcgagagacaaaggcaccggacccguccaggggagcgccgagucccaaacgccgagccccggguggccucgcuggcucccaccugcgcuugcccagcccggcgggagaccgcaggugucaggggccguucgggcccggucccccgcagcuccggcagccccgacgugacagcgcccaggccggcgacccucacguucggaacgcggcugggcuggcucugcgcccgggggcugccagcgccggggacccgaggcggguggcggcgugcggacuuccuccuggacuagccuggaauccugccccagcccccaaccgcuggcggccgcccccgcccccgcccccgcccccacccccacgcccggcacaaaggucccggcgcggcccggccggcggcuuuaagugcugccgcgcacaggagaccggaggccgcggcccgcgcucccacacccgaggcccgccggccccuaccuuuuccgcgcggcguccggggcccggcgcggugggcucgggccugcuguuccgcgacucccgcugggccucucccgcgggcuggcggggccucccgggugucgggcgcggcggguggcggcggcuccuc

SEQ ID NO: 21262 - RNA, 50666 nt, Homo sapiens
aggccagccggcucugcucagcauuuggggacgcucucagcucucggcgcacggcccagguaagcggggcgcgcccugcccgcccgcgaugggccgccagcuagcgggguguggagacgcugggaagaaggguacggccuggcagggaggccccggcaacuggccccggaggccgucgggggcagggggcugaagggacggccggcacuggagagucuuuggggagggggcucagggacaagguguuuggggcaggggugaggggccaccggcccucgggccgggagggugcagggcagaggugguggggggucgggcuucucuaagaagcccuagcgggagcggggcgaggcggcguggggagaggggcggagggaggccccgcauuccagacgcgccaggcgccgccgaggcagggcguggccgcccagggagccgcagguccccggcgcagcaguagcaagugggcuuuccacugcccucuagaaagugccccccaucugcucuaaguuacuguacucgaaacaaacgcgcgcuuguggaguugaaccgaccagcaggagggaaguagcgggggaagacgagaggggggagugugaguaggcaccccucagccccccauaaaagaagacauuaaaacgucaguuauuccccuugcucuagguuaucuuguagcauagcaacuucggauuucacucuacccggagaguuucccgcuugguugaacacauuggccucaggaagguagugucccccaugauucuguggggaggguuguccuguuacucgccaugaugugacaaugagucaggaacugagaguagagagaagggcguggccccggggccucucccuucuggccgcucugugcagcuggccccacugcugguguggagggcuuggguuccaucagccggcuguugagaagaaggaggggaacacagauaaguuuccucaucugggaagguggcuuaaggaugccuauucuuaccaccacccagaguuauuggagauuucaaaaaacacagucauuagguaauaaauguguaaaguacacaaaaaacaaagugcugugcaaaugcaaagugucauuuuuguaguaagauugccguuuuaaagcuguggguguucugagugcguguguaaaagagcaguggccucaugggugcacgcugggccauuaccaagaaccuuaaguuguuggugugcaaaggccugggccccagacuguacugauggauucuguucacacgugugugcuacugugccugucuggaacuuggugacuuggaaugcagaaugcacuuucccacugaaacaguguugcagaaggugcugacguucccaggcuagcccugaaagaccuuuuuaacaugcacugccugauuaugggauuggugguggggagguggaggguagugaggggcaauguguguguaggaagacuaaaucacugaaauauuuuucuggaacuuuuuuuagcuuuaagguugacacugaguaaauuauuuuaauuggaaaauuaugucuuugccccuguuccacuuucuuuuuuccaccuuccaccuccuuagagacgcucuucuggcucuuccgugacgcauuacaacagccauccaggccgguccaguuacgcugcauuccuuccuccuucccauuucggcggaccugcauccagcuagagacuagcagauugaaucgauauucauuaaguuaggaaugguuggugguccuaagagccucagcaaccgagaggagucuuguuauuuaaaaaacaacgauacugggcguggucgugggccuguagucccagcugcucaagcuaguggaucucuugaguccaaggccaaugugagcaacauagcaagacccagucucaaaaaauaaauacauaauaauaauaaaaaacccucguucaccuaaacagaucuauaauuuauagaauguaaagcagcaauauucaggcaauauuaaggaagauuuuugguaagacuggggcagcagaggugcccuugaugggcaagggccaggaguguuaacacaguccugcuuaguaauuucuucccuucuuccaagucugucgauuaucuaaaggucaaggguuuguccaaaaaugucccuugcaucugcaguggaaggaugugacauguaugugcauuuuuacaauuggagguuugugauuuggagaccguuuagauuuuguaauuucccgcagugccaacuagacugccugugguaaaugcccaggaaauauugcugacucacugacuuugauuaggagcucagucuugcacuggagucucaauauuuagcaucuugugucuuugagcuauuaaacuaugguauugauugacauuaggcucgcagucauggccguuaguuuccuggcuaauuucugauuuaaguaguuuuccuggcaaaguagaugugcuucuauaauugcuauugauuuugagggcuguaggcucuuccuacaccacugggccuagaaucuggcacuaaugcauugucuggagccuuuguucucacccuucgcuugugcagagccuggagccugcggagacauuuuucauuaaaggagagcgggauugucacaaaaggagucucaggcucuagugggcugcuuuaaacaaccauuuauuccacaaaauauuaauuaccuacuguguuccacucauaguuaugagcacuagggauacagcagugaacaaaacagacccccgccaaaaauaaaaucccugcucuuuagaccuuaaaucuggcggagagagaaggaaaagagacaaaauaagugaauuguuggauuuuaaacuuuauauuuucccaaauuaauacuaguuucuaaacuuggugggaguucauuuccccuuuaauccagcuguuccacagaccuaaacuucacauuuuaccuaccucggggaaguuuugcuuaaaauuauggugucuuaagcugccuuccagauucaauugugagaauuaaauagaaauggaauguuccucuuuuuuuucacaugagaauccucuucacuugcccuggugccacacccuauucuaguuguaggccacaccagaggaaauuccaguccuucaaaaaaauucuuuccacccauucacugccugguaucuuuuuucuucugcuguugccagaggcaguccucaucuacuuucuccagggacaggucagcaguaggggucaggagaugcccauauuuguccuucugggugguucuaccagaugacuuccaaaucucccuucuaggguacacccugaagcuguuuuuuuuuuucuuuuuuuuuucuuuugagauggagccuggcucugucacccagccuggaguguagucgcacgaucucuccucacuguagccuccgccucccagguucaagugauucuccagccucacccucccgaguagcugggauuacaggugccuaccaccaugccgggcuaaucuuuguauuuuuaguagagacaggguuucaucauguuggccaggcuggucuggaacuguugagcucaagugauccgccugucucggcuucccaaacugcugggauuacaggcgugagccacuaugccuggcccacccugaagcuuuuaauccagcugagcucaacuggacaggucgguagcacccaaguggccugaguuuuaccccaggugugguguagaaauuucuuauucuagggagugacuguguuauggagcccuuuguccauguccuuugucucccugccacacccaggcuauacacucacagcucagaggaaaucagaguccuaaggccacucguacauccugccucuuugcugccuucuugcuaggaguuguagguuacguucccaugugguccuauggacagagcuaggguccaaguaucccugacagcacagagguggggggcauggcuauauguugauaagaggcugcccugaagcgaccugcugggcuuugcuaagauuugcagaaguuggugauuuaagccuccaacucugaaugcacggaacuggaacugcauucgaaauguccagucugagggagagagaaaauugaggaaggagaguguguuggaaaagaagaaaaaaagacuuucuaauauagaaagacccaguguguguaaaccaucccaagaugaaauugaaugccuaucgugugccaggcacugugcucagaccuaugaggaaacaggagggaguuaaguuggaaacccugugggcggauaauacggaagacagacuuuacacauguaacucuaauguugcacagacacacaaaaagcugcagaagcacagggcaaggaggggugugugagaaaggcggcauuuaugauuuccuguauccuaaagacucauucagaugucagcuaauuaagauugagguuccugguggagggaacuuagaaagugcugagcguguuuggagaagaguuaacaguccaguuaacucuucugugcaggaugcguguaugcauguguguguguauagaagauauuuaaggaaagguagguaaguccacaguguggaaggucuugaaugcugacauuagacuuuuuucuguaggcggccaggcccuguugaaaauacaauaugugggccauaaaacacugaaauugaguugcagacuugaaggccuggauuucccaacccugaaagugcuucaugccaagugacaucauucuuccugccggucucuuuccacccacuccaaccccagaucaggauaccagcagagagaggcugugagagcaugaagcugcaacaagucaguagggagcaaacaaauauugauucagaucaggccacagaagagacaagcuggagcaagugcugugugucccuccugcucaguuugaucgaggucacugggccgaauuccaggaauucuggggaaugaguuggcccugugacucagucauuaaucaagaccauaaaaccaaggagaagaauaucugcuuucaaaaagguucugauaaauaaagaugcaguagguggguggaggauggaguacagugggaaccccucuccucacccaguacauuuuuuuuuuuuuuuuuuuuuaguuuaaaauuccaguguggccuguagacuguguguccaggacuguguacaguaagagcuuugauggagaacccaacucuccacacucccaccucuacccauuuuugcuuuaaaaucuucauuugaaucaccagucccugauugauucaccaugguugcuaagaaucuguuuugcgguaacgcaucaacacuccacguuuaaacugugaaguggguguguccacaaaacuucuggauuagacucagauuugccugugcagaccagcccuguugcaguauguuuuuguuuguucagauuaacauuugggcuuuuuggaacugguucuuaauuuaguucaguagaauguguuuuuacuauuugaaguguugacuuuuaaguuuucuuuuguuuguuuguuuuaaccuuuuuguaaacuuuuacucuucuuuuugggaguaaaguuaaaacugcuucacuuguccuuuuuuuguuuguaacugcacuuucguagugaagcaauagaauacaauaaaaucuauagaguuuuuuuuuuuuuaauaaggacaaacccuuaaauuauuagguugguacaaaaguuaauugugguuuuugccauuaaaaguaauggcaguuauuuuugcaccaaccuaaauaauauaguccuuauguuaaauguaaaugacuuguuucucaauaacugcacugauuucauuaaugaucagccuugcacugugagcuuuuuuagccaggcauucacagucucauuuaucagccuuuucaaggcagaagaaacuguucuuuucauuaggguggggccaagugaccuguuuuccuacccaaguagugaaugauuuuaaaccaguuugagguggguauggcucuuaucagugagucucccuguaccucuaguuuauuuccuuaaacagaaaaacguucucugauaaagggucauuuuaaugauguugucuagugacccugcccucccugggaauggaaggcacggcacugauguguauguagauguacucaucaacagauugaauuugcugauuuuuuuuuuuuuuucuuguuggagaguugaaaccagucggcaagcugggugagguugaaguguuggaaagaguggugcaaacugccauuuucauguucuuuagagaagucugccagaaaaggaguagugguucuguuuuuaauggauuuaugaguuuuauacggugaugaggagugaguagaggugaaauugucucauacagcauguaggcuuuauuuuuuauuuucauucaaaacaguaaguacacugaagucagaguaguuguuuucaguaagaaaauucugccuccagagcaaauguuuuggugaauagauaaauaugaguacugagucccaaucauuuuggcucauagguuccccaguauuuccauaggcaagcuuaacuuugcaccauucagagacuuauauuuuagguuccccacagggcaccccacuggacguggcucauuuuccagccuguagucuuguucuucugccacccuggggcauuauuccucuuccccucuccccaggccuucccccuugcuucuuggcuggaaccucccauggugauucacccuucucagccuaggcagacagcaccucccuguuaagcccuuaacuaaucccgcucugauggcugugaucuuucucucugugucuuaaucacuuggaauaaagaaccauuguggugagguugaaagggcauuggcccaggagucuggggaucuggguuuuggcccugccucagcuacuuaauucacugggugacccuggacuagacucucagugugucacagaggcacgaagggaagagagcucaaagguccugcaggguggaagucugcauuucacaguuuuauaagugucuuuuguauccuuuaauauagugcaggcucagcguaugcuugguauggguucguugauuaauuccuugcguauuaccaguguuuguaaccuacaguagcacugccaagacuuccuuuuccugcuuucaaggauagcagcacacugacacauucucauuagucaaauaugcuauauuaaacuaauguuuuaacaaacagugaaucgcaaagccaacuguuccuuccagcgaauaauagaucauaugcaaaaugacuuugcauugcuaggggauuugauggagugaagaagcaagcacuguauuuuauuucuuuuuauuuuguuuuguuuuuuggacauaaccucaagauuuuauuguccucauaauaaaacaaaagaugaugcuuagaacuggaucacuuggcccuuucuuuuguuaucuccucccaguugaaaauguuugcaugucuuaacagccagcauuuucuuagaucugcagauggggucagcacacucaagccucagcacaaccuccuuuguaauuuuacccguuuuccagaaaauugccuuagucuacccaccauagucacucugcuucuugucauaacgccgcuuucccugggcauacagggaguccugguauugugccguuuugugggguuggugcuugccacacuucuuacagaaagcccaguggguuuuaggaauguucaccauguuuuccggaaugcuaucggcaugggaggaaaguggccauauuuuauuucuagggugaaaauguuugccauuaaacucacaugaaguaggaaauauuuauauggauacaaaaggcaccugcaugggauaaugucaaauuucauagauacugcuuugugguaagugugacuuugugguuauugugauguuuguguuuuguuuuuuuuuucugcaaaaugguuauacauaguauaaauguuaugcaaaauagcaacucauuguuuucaaguugauuuagcaccugcauuauguaaagauaaucugaaaucuguagggggacugggacuauguagggaagaugaggucaaccauauacuuucuacugcuuugaauuguaccuaugcauucaccauuugaauacuuggcacguguagggcacuuaaaacauucugccgaauggaugaaugaagugguaucaaaaagugcccuggcagugaaaggcaagauagaguucuguagaguaggggucguggugacccuguuggagcagauacugaaguaguggugagugcggagaggcaagucacauuuuggcccuagucaacuguagcugaggaguaaacagagggaacuguuuacuguuuacaggauucugaugcucaucuuugaaggcugggcucugcuggaggacugauuuugaaugaugucaaaugauuuugacaagauuaaauggggagauuuaguuggugguggcaugcaggacugauuugaugaaagagcagcacaguuaugaauggugaaaccgaaaggaagauuuguggggcuuuuaacagucuccucaagguguuguggcugugggagaagaauuaacaugaauggagaguguaaagaagccuaucagauugucuuugaucugcacaguacuggggagucccaugugggacacggguaggcagcagucuacaaagcucagagcuggaaagacaacuugaaagaacaacacaaugaaaaguuaccgugccucuaguugagauuuucuaaacaucggaaccaaugugaggugucugauuucauaaacaaguggaauuuaaucuauacucucuaaguggaaacaacucuguuugcaacucugacuugcuaguucccugguuuugcuuuuguuuuacguuuggcauuuuuuauuucuugccuguuuaugguagagacuagaauucugcacagcagaugacaacaguuuauccccugcugcagaccugguccaguucugacugaguccaggggugauaguuaaggccagggcuugggugguuugauguccauccuaggaguuucaccucugcuucgguaauucucgggcugagggauacugaugagacccucuagaauguuucuugguccauguugaaguuagagauuucuugcucugucaagaagacugucagccugggcaagguaacgcgacauuaucucuacuggaaaaaaaaaagccagguguaguggcacacgccuguagucccagcuacuugggaggcugaggcaggaggaucucuugaguccuggagaucaaggcugcagugagcuaugauugcaccacugcacuccagccuggguaacagagagagaaacccugucucagacaaaaaaaaaaaaaaaaaaggucuaggugugguggcuaaccccuguaaucucagugcuuugguaggcuaaggcggagggauugcuugagcccaggaauucaagaccagccugggcaacacagugggaccuugucucuacugaaacauuaaaaaaaaaaggaaaaaaaauggaaaaaggaaaaaggaaauuaaauggaaauaagauauauucaacauaucauaguuguaauuguaauauaugaucaauauauaaauuauugggcuggacacagugguuuaugcccguaaucucagugcuuggaucacuugaggcuaggaguucgagaccagccugggcaacauagcaagacccugccuuuaccaagaaagaaauuauaaaugagaaauuuuauauaauuuuuucauacuaugucuucaaaauucagaauguccuuuacacuuauagcacaucucaguuugaacugaccacauuucagaugcuuuguagccacaugaggcugguggcuacuguauuggacgguucugcuacagagcaagacuauucuaaauugucuuuuuuuuuuuuugagacggaguuuugcucuuguugcccaggcuggagugcaguggugugaucuuggcucacugcuaccucugccuucugguuucaagcuauucuccugucucagccucccgaguaguugggauuacaggcgcccgcccccacgcccagcuaauuuuuguauuuuuaguagagaugggguuucaccauguuggccaggcuggucucuaucuccugaccucgugaucugccugccucggccucccacagugcugggauuacaggugugagccaccgcacccggccgauugucuucauuuuuaggaaaguuuuagguucauggcaaaguugaauagaaaauacaaagaaugcccauguuccccuguucccacauacgcauagcuuccacugucaacaucccguaucagggugguacauuuguuagaacugaugaaccuacauugacacaucguuaccacucaaaguccaucguuuacauuagcauucacuguugguguuguacauagaugcauccaccauuacaauaucagauagaaucauuucauugccuuaauaauccccuccccugaaucccugaucuuuuugcuguccccauaauuuugccuuuuccagaaugguaugaaguuggaacuauacacuguauuaccuuuucaguuggcuucuuucacucagcaaugugcaauuuagguuccucugugucuuuucauggcuugauggcucauuucuuuucagugcugaauaauauuccaugucugaauguaccacaguuuauuucuagagcaauacuuuuuacaaaccagaauuauaccccaacggugggacaaauugggguggggaggcugucugagaguugugagugugggggaaguggaaggucuuugacugacuuuucgcugugcauaaaaagcuucugugagcaucaagaagagaguaguggucugggggagagcccaggaugagaaucuugcaaaaauacauccuucaccacaacuaaaggcgaauccucuccucuuacauuuccccacuuucuucccacaccaggccugggaucugcuuaguccaaaauguuccuauaaguuagcaaauaucuaugucacauacucucgccaaaccaguuuuaugaaaauauuuagacuaaacaaagugaagagaauagaaagcuguauuugcaugugugcaguuuccuugaucaaagaauauuaagcaaaaagagaccaaagcaggagucacugcaauuuaaaugucguuccugucuauuucaggacgcagcucuacucuguuuucuuuauucuuggggugauuauguugaugaccugucuugucucuguugagauaaauuuaccaccaauugagcacuccuuauuggcagggauuggguguaucaauuccgagaacuguaugauugcaaagguggaaagccaauucaucaggcuauuguuuugcugccccauuaaguauauuaacuggaagaugacuucauuucaaccauuucaaaucuuaaauacaacagauucaguccuuuauggaaugaguuaaggucagaaaaucuguccaucgucuuucucauaaauacuuuaauaucuuccaaguaucauuggacuaagaaaguaauuauggguaauaauaaagauuccaauuaagaauuagggcaacaugaaaaugcuacuaauuucgauucacaucguagcuuucagguccuucucaauauguuuaauuacuugugagaaauacagaaguaguggcugguucggcaagcccaucaccuuuuaugagaaguagaagacucaguuuuauccugucugaacagguugcauuagccauggggaacauuuuguuuuugcauucacacaucagucuccccagguucuguuuacacagaggaagagaaagacuggcuaguuuaguaguccaucccaacccaaggcagaccaucucugagguuuaguuuuuacagucguaagaugggaauugcaucuguuugcaaaaacuacuccaauaucgucagaugaaaugguccaaggaguagaaauuagcauaaugaaucgcugugcuucagaguaaaggagagccucuucauaaagacuuuuuguuguacuuuuuuuccagcuuccuucaaaaugucuacuguucacgaaauccugugcaagcucagcuuggagggugauguaaguauaucacuuucacuuuauauaauuuuugcaaguuggacaucucucuggauaaccauauuacucucuauccuuguacaucuaaggaagauggggacaauucagacagucaucauuugguucuccucuuucuuaauacuucagcuguuccuaguaguucaauuugaaggaaauaucauggcacuggaaacuuuucuuggccucacauuaaaauuggacagaauuagugacacuggaauggcuggaauuuuauucugccauacuuagcaugucauugguaauaacuguuaugaugguacaugacuuuuaaugucauguccugggauuuuauuacugguuggcauaagccacagccauaucaaaacuaauucugcaucuuuuggauuucuuacaguguccaggaaguuauuccagaugaagacuuauacuuuuauuuuauuuauuaauuuauucauuuuuugagauggagucucacucuguugccaggcuggagugcaguggcgugaucucggcucacugcaaccuccaccuccuggguucaagcaauucuccugccucagccuccccaguagcugggacuacaggugugcaccacuacacccagcuaauuuuuguauuuuuaguugagacuggguuucaccauguuggccaggaugguuuugaucucuugacuucgugaucugccugccuuggccucccaaagugcugggauuacaggugggagccaccaugccuggcucgaggaccuauacuuuaaaaaauuucacaccuggaaaauauuuucucuaaaaaagcuaggauauuucuuuuaaaaaaccaagaauauaaugaaauuauuguaauucaucuguuuccuuuuuuucuguggcuauuagggaauuuagaacuaaacugaauuuucuuucauaggaaauaugugaaccuagaaauucuguugcauuuguuucuuuuuuuuacaaauaaaaaauuuaagcuauaugugaaguuaaaauuauuucaaauacuuuuagaaucaaguggaauauaaauuaugaauauguaaaauagcuaaugguacuauacaucuuccaggucauccuggcagaaauggcuuuuacgcagacucagcacugauacugguuuguagccauauccgacagaucuuucaaaauauucuuugauugaaauuaaaaugcaaugaaucacucaacagaggguugacagugacuugggucacauggugcaagacccucuguauuguucaugguacuugccaucaaaauguucaaauuaauggagccugugaaagcacagguuguauggaguauaaagccuauagaguuuuuuuaaaaucuuuuuucuucuugaaacgugugcaugcuguuuuugggaacaauacaaacugcauguugaagucagacaaauucaggugcuaaauaauuuguuucucuaauggacuuagauuguauuugcuaucagguuuuauaagagggcuuuuuguguagccucugaaguuacucuaguauauuucuuauguguggagagguggggcagaaauagaaaaugucacauguuccccauuauuuuaaggaaagaaaagauaacuuugucucacuaauuucauuucagacaaguggauuuuauagguaauagguucaauucucgauuuaauuucauuuccagagacacuauaaaaugacacaaaacuuuucccccucacuguuguuuuuggaacaagacgacauaucuccugguaaaugcagucauacaugauauggcucaaugccuggacugccugccuuguaaauaaccgauggcacucuuaauaaaugggaaaauguuuuuccuuagauuucauccacauuuuauagcuaccauagcaaacacacugaguauuucaaaauagcacuuugccuuuuuccugaaugugugcuccaugucaucaaguucaucuuacuggaaaguuuaaguggugaaauuagauggaacauacuuugauaaugcauugcaugucagguuauaaauaugaacuggauuuaauauuuggccaagauaguccucacaagugcguuuggaaacauuugucaaaugcugaacuuagauuucuggccucuccugggagucaucuagauauaggaaggcaucuuagaugcucaccuauacagucucagugcuaauaaaauggaauggcgugggugcugggugguuuauaaugugaugccuguggguggagaaguaacucacggaucuuggccuuuucacucuucacagaaacugcgccaaggccaagucaucacauuauacgggcauuaugugcuggggggguugggguggguugcaggaugggagccuugaugaugaggaugggcagugaugcugccuccaccagccaucagccaaccacaaccacaauguacauccucuuugucugcccuuagcuuugggacuggguagcagggagagggaaaacuauaagagcauuucaaagaaggagggaaguuaauaccuugaaaggagaacugacguagaagcacuccauuguccuuaccucaaucuggaaugggagauucccaucugucagaucaggaaggauaaugagcuuugaaaagcacugaaaggcugggcgugagccaccacgccuguaaucccagcacuuugggaggccaagaugggaggaucacuagagcccaggaguucaagagcagccugggcaacacggcgaaauccugucucuacaaaaaauaugaaaaaauuagcccggugugguggcaggugccuguaaucccagauacucaggaggcugaugugggaggaucaucugagcccaggagguugaggcugcacugagccaugaucacaccauugcauuccagcaugggcaacagagugagacccuaccuaagaaaagaaagaaaagaaaagaaaagcauugggaaaggaagaggguaugguuuagaaggcaauaagaaaucuuaggaagaguggagggugguaggcacaagggaugguauuaauaaaggcagagggaaggauacagaggagagggggggaaacacaaggaggaugugggccgucuggccagaccaccuuggugccacaguggugaccaaaguaaagaggugggagaagcugcuucccucauuuaucugaauuguaagcucagcaacacuggcccaguagaaauucauguaccuguagcagaaacuuagcuaaacacccuuguccuugaggcauuuccacauuuucagcuuauuucgaauuguugccagcccaguuuaauggucuucagagccauccugaguaaaugcuggcuucaggucuccagcuuugcauugucuacuuuugaucucucacuaaaaguaagaugagaaguugaaauugagacagcauauucuaaacuagcugagccuuugaagaauucuuauuagaaaaaaugaaauugcuugcgugaagugugaugguguguuaauaccuaccuaguuaccuaguaugagaaugaucugaauuguuaaaagaaacaauaggaaaacauauuaggcauuguuauuucaacaagaggauuuuaaaugugugucauuugaguauguuuaucuuuuaaccucagcacucuacacccccaagugcauaugggucugucaaagccuauacuaacuuugaugcugagcgggaugcuuugaacauugaaacagccaucaagaccaaagguaggugauacauuuguccucuucuugucagggucuuacugagacauuuuugguugucucuuuauucucccucaaaucgccauacguuggcgauuugaaauugucaucgagcuuuaauggaguagauccagaccuagcucaacccaugccuccuuuccuuccuucccuccuuccuuucuuucuuuuuccuuuucuccuucccucccuucucccuuucuuccuucucucccucuuucucuuucucccuucuuccugcucuuccuuccuuccucccucccucccucccuccccucccuucuuuccuuuccucccucccuuccauucuuuccucccccaccccccguuucuucucuuuggagagauguacagcaugagauaguauuuuaaccaaguaaugguuaaaaggaaucagucugggagccggaucugguccuagggguaugcuuuugggugcagcucuucacuuugaggcuucagucccucuucugcaaggaagaaguuggucauaguggucccuaagggcauuuuuuguuccaaguccccuuuaauuuaauuacauuugcugggaaaaucuuacugcauugcucuuagauugaucuagagagugaaaaauucagacuuuuuuuguuuuuuuuaaaccccgguaaguucugcugcuccuuaggccuggagcuggaauuagaagagcugucagaaugaguguauuuccucaaguucuaggaugaguaagagaagaccaggaggcguaaaagccuuccucuugaaauaaagcaaauaaagugcuaacugguuaggguugagcaagagcuucuuauggucauuauauuguuuucugggucuacaaaauaggauguucagacuuucugggcuuauauuaauuaagcaauccuugggguugucccauccccugaaucccugaaaaauauugcagcucucguggugacuuuugugauucuccacuuuuccccccuuggauaaagcacuuccuuucaccaugaggccagauugggaugcagacgugacccagcacaauuagagcugcugcugguucgugccccuggugaagagccaugucacauuuuucucuucuauguacagcguuuuaacuuacugacacacuuauauaguucacauacgguucguugaaagacugagaaaccucaaccaggcugaccugggaaccuauaacuaggaugacguccugguuuaugccugcguauuuacuaauagugcaccuuucacucucagaacugucuuauuuuggaggauacauuacauggucaccuuuccuaaaaccauguagaaucuggugaccuuguuuccagagacaggaaguagaguagaaaaacccgcuuaacguucuaugguucuaacaagaugugaggauuuauuugcaucaucugccuuggggaagccuuauguucugcaguugcuguggaccaccccccagaugacugucugcacagcugagggcagaauaaugaagcauccaaauuagaccuuuaaaaaaaaaaucuuuuuuuuuuuuuuuuuuuuugagauggaguuucacucuuguugcccaggcuggagugcaagggcaucaucucagcucacugcaaccuccaccucccgggcucaagugauucuucugccucagccucccuaauagcugggauuacaggcacacaccaccaugcccagcuaauuuucuguuuuuaguagagacaggguuucuccauguuggucagccuggucucgaacucccucaccucuggugauccgcccgccuuggccucccaaagugcugggaguacagguaugagccgucgcacccagcccaaucuuuuuucuuuuuuuuuuuuuuuuggugcauuuaaaugaccauucuugccaaaaguuacuacucagaaaauuaaacuaaaaucugcagggcuuauuucacuacagccaguuccagucaguggagcauaguggaugagagcguaugugagcccagguucaaaugcuggcuccacaacucacucauuagccacccgacuuggggaaaacacggaacuuugcuaagacugaguuuccuugccuauaaaggggugcuaaucaaaguucccaccucacgggauuguuguaaaguaugaagcauuuagcacgaugccuggcauauagaugguacucaaaauauguuaccuuaaaacacacacacguacaagcacaugcacacacacaugcacauacacauccaugugguuugcuuuccuaaaacccauccuauuucacuauuuggaugugccuagauucaugugguuucccagcaugucauugcagcagcccuaaguuuagcaguuaacucaucuagcaaagauggugcuuuucacaagcaugggacaaagacuucuuuugucccugcgugagaaagcacuuagugcacuggaauguaaagauugcgcaaaugaacucuggucacagcugaaacucucaugguaauaaaaauaccuucaggccuuuuggaguuaguagaaaaauacuguaguuuuuagacagaaacgucuggagggcuaagauuuagauuccgacauuccaguuugaucaaaagcagcugacauuaucaucauugcaacuauuuauaaaaugcucguugugggcagauacugcaccaggcacuucaggaacauucaucuuagaugaacuucaaaguaaccucugauguaguguucugucauccccaggucuuggaugauacaagucaggauuaguaugccugaggucuuuuggccuuggaucaaacugggauuugaacacaccucuguccaccccuaggccuguguucuuaggcaccauaauguuguagcacucaccugugaggaauggauuuuuuucauugccuuggauuuuuuucauugccuugaauuauuuucagauaugaaaaacauuguucaucuguggucuuacugacuucuguuaagucucauauuuguggucuagcuuuagauucuccaucuccuuuuuuuucccccagacuuaauguucagugaguuucacuuagguccacuuuuuauuuauuuuauuuuuauucauuuauuuuuuugagauggaguuucgcugugucacccaggcuggagugcaguggugugaucuuggcucacugcaaccucugccuccuggguucaagcaguucucugccucagccucccgaguagcugggauuacaggugugcgccaccacaccugguuaauuuuuguauuuuuaguagagacgggguuucaccaucuugggcaggcuggucuugaacuccugaccucgugauccacccgcuuuggccucccaaagugcugggauuauagccgugagccaccgcgccuggccuauuuauuuauuuacuuauuuauauauauauuguaagacagagucuugcugugucaccaggcuggagugcaguggcacaaucucggcucacugcaaccucugcuuccuggguucaagcuauucucaugccucagccucccaaguaguugggacuauaggcgugugccaccaugccuggcuaauuuuuguauuuuuaguagagacgggguuuugccaucuuggccaggcugcucucgaacuccuggccucaagugauccgcugaccucagccucccaaagugcugggauuacagguaugagacaccgcacccagccuacuuauuuuugaugcuuagugauuuuagagaguaaguagguuuugcaaguccauugguccuuuaaaauaauuucuagauuguuggcauuauuaaaacccuaaauccuuuuaggaacuauugcgaagaaagaauaugauauucguaagagcucagugcuaauauuagcauugguuaugguagugaaagaccagauaaaucuuuuaguugggaaguaugucuugagguauacuuccuuauaaucauuaaguaaauaaguaaaacuauauuacauagauaauguguaacucucuguauuacauagaaugucugcagaauguagauaggaaaaauaaaguuugucaauaauuuucaacaucuuuauugagauacaguuaaucugccauacgauuugccuauauaaaguguacauuucaguguguuuaguaguguauuugcagaguugugcagucaucaccacaguaacuucccuaacacucauuuuaacauccauucaccuuaaaugugucaguugcaucaagaaauagaaaugggaugguauaugcuaugugaucacaaccacaaccauuuuuuuuuucuuuuugaggcggagucucacucuguugcccaggcuggggugcaguggcaugaucuugacucacugcaaccucugccuccuggcagaacccuccuggguucaagcaauucuccuguuucagccucuugaguagcugggaccacaggcaugcaccaccacaccuggcuaauuuuuguauuuuuaguagagacaggguuuaaccauguuggccaggcucgucucgcacuccugaccucaugugauccaccugucuuggccuccgaaagugcugggauuacaggugugaaaucauaggccuggccuaugauuucuuuuaaucaaaaaagaaaaaauaaaaggcauuagcaauggaaacagacguacgucacuucaugguccuuccuuuacugcacuguguagauauuaugguuuuuacaaauugaagauuuguggcaaugcuauucacuuugucucugugccagcauuuuuuagaaauaaaaguauuuuuuaaauuuaguuauguguuuuuuagacauaaugcuauuacacacuuaauauaauauaaucacacuuuuauaugcauugggaaaccaaauugugugacuugcauuauugcuauauuugcuuuauugugauggucuggaaccgaaccaguaguaucuccgagguaugccuguauauggaauugugggcaauugcuccuuuuccuuucuugggcuuucaguauauucuguauuucuguauuuugcaaauuuucuaugaugacuuguauuacuuucauaguggaaggcaguaaacuuaauuaaaaacaaaaaugaagucauuaguuggaaaggauaacaacccuuuuguuccuuccuccuucuccuugauauuauuagauacuggauaacuaaaaccacuuaaaaaugagcuaauuaagaucuuaccuucuuuuuuuagaaugccuuuugccuuaaguguaauuaagaagcuuacaccacaccuuggccccacucccaccucuaacccuucaucgggaagagacaauacuaaguaguugguguuuccuugacaucaaaggacacgguauaaaccucaaguauugauagaaacaaaagccagaggaccaugugacgaugacuggcccucuuucucuccuagacggggguagccguguguacacacgugugugugagugugccgggacgcuacccacuccauguaauguuccauugauuucccuguggucugugugcucucaggaagaagagcugggagcaggccaccuuggaggaggcuuaaucagcugcugucgaguacacggauggugcacaggagcaggccuggagugggaugauggcgaggaggguagagcuggucagagaccuguuugggggcacugcuugccauggccagggcauggcugcaggagucacgaaggcuguucucacagacgaacugucagucacaccugcucuucuuggugugagcuaaagcuccucacuugcagcccucuguuagaggagagaggcuacuuuucccagccagucugccuccuggcacccucgagagaauauauuccuaauugcugugcucaacugaaugaauauaccuccaggugugcagacaaaaccaaaaauaccuguccuggcucacuuuccagugcuugggaggcagcucuuauucaccccuuccccuaacucuugucaccccucuccugugagcuguuauggcaucugucgucgucgucuucuuuuuuuuuuuuugagacagaguuuugcucuuguugcccaggcuggagugcaaugcacaaugucggcucacugcaaccucgccucccggguucaagcgauucuccuaccucagccucccgaguagcugggauuacaggcaugugccaccaugcccggcuaauuuuuuuuugcauuuuuaguagagaugguguuucuccauguuggucaggcuggucuugagcuccugaccucaggugauccgccugccucagccucccaaagugcugggauuacgggugugagccacugcgccuggccuauggcaucugucuucuaagggaccucccugcuucagccuuuacagaguaucuuucuagccucgucucuggcucuguucacggcccucuacagagcaugccucugccuuuguucuuugaggagcguguagccuccuuccuccccaccucaaacaucugcgcaguucccauuuaccucucagccugggccagugcacagcaucaacaagcuuucucugagaaggcagaaccagcuauuucuuggucuguguucucaucauacucuacauacucguuuauugugcuuaugagaaggggggagaagcacaauacugcuaaaaucaaaauaagucugcuuuguuucuaguuugaagggaucucaguauuuuuugccugugcugccuaaaccaaaugcaggauuguuuuauguaugcuccguccugagguagacuaugcaacgacuuaccuuaauuuaugucugguuagaaacugaguacagucaugcaaaaguaguaauacugcuuaauuaacaagagguugcugagacuuaaucuguaggagucucuugguuuagauuggccuuggguuaaauauauacgauggcguguacaacacagcugugaaugguuuaccauauggguccaaauaacuagaaaggagagucagcuaaauuagaaaaggaugaaucgagacuccagaaaauagacuguaauuagcagcagcacaaccccagaguuaguguaagugccaauaaacugguacagcuuuggucucucucuggaaggggaggguaaugaauuacccuauuauuauugccaguuuugauuuuagcaguauuuguguucuccggaagggaugcaaaagugggugauuuuucuccccccuuucucagaagcgcaaguauagaagcauaacugcacgaaguuuugcacuuauuuuuuucuuauacuuuuaaaauagaacugcuuaagauuucuguggccaaaagacuaacaucccaugccacugcagaacaagccaggauggauauuuuugguuucaccugcacgccagguauauucauuuggcugagcagaacaauuagaaauauauucucuugagggcgccaagaggcagacuggcugggaaaaguagccucucuccucuaacggagggcugcaagugaggagcuaaaccaacaagagcaggucugagugugagcucuucugugacucacguagcccagggccuucucacccuccuggaagggaacgggagggaacggacccuucccaguugcugaggccuuucucucuguguucaaguuuacuuuagacugacuucucaucuuacagcagugcugggaacaaagaggccagugcugagucacagccacccugugacucugccagcacagauuuucuuuguagugauauuugucuauguaucuauguaggugccagaccugagccacguagcuaucaaacacuggaaaaggaguccuuggugccuuucuaauuguaagcaucagcuuucaucaccugccucucuucagcucuuucuuuuuuuaaaaaacaguuagcucuuuucccugaggaaauccaaauaccaguuucacccagggacaauggcaguaaccagauucuaaucuggugucagcaaugccaagaaaauucuccaauaucaagugaguuaaggguggcugcguugguuucucucgcaucuguucacauuuuuuaauuuucugucccaugaggcugacggaguagcagagcacaauacagggcuugcauuuuaugcauguuccuucacugacgauuugauuugaaucuugagcagugguguacuuuguguuuuccugcuggucuuguagcuuguuucagaaauauaauucugcauggaaggcagacaagguucuagauuauuaaagcagccggugagauuaccaagucgaugauaccuuaaauccuuucuaaggaacucagcugaagugagaucaaagcagaauggaaauagaagaaaucugauuuuuggaccaaaaccacuucuuaggcacuuagcuaaacuacacuuuccccgaguugagacugugugccccagcugugccaggcuugggagaggcacccaacuccccugccucauuucacccugugcaaugccuacuuucucucccaucucuuggcagcugccagaguuugucauguaacuggacuacucauccaugugugccaauggcaaaaauguucucuaucuuucuuugccccauauuucacaggcagaaauucaaaugcaggcaggggccaggcuugugacagagaagcugaaugaaggcaguagauguguuucuagucguuaacucagccagucuuuucugcauccugguaaaauaaguauuaucauuaucucuguucuauaggggugagauaccuaggccuaggaagagaacuaaugugccccaggaucucacaggucugagucccauggaguuuccaaagcacuauauuguggcugcuacuuauccagaggccuccccuggcaucugucagccugcuggguguccugucuugaugagagacgcucuggagacacagugcucgcuugugcuggaugacccagaggggcaacuuuuacagcagggguuccgggccagccagcacccuggcugaaggugcuuuuggguaguccuauggcuagaggggagcuuuucucucccuaaaaaucucucucacuagauggaugacuggcuggccuaacaggcuuguuuggaaggacuuccucccuuugcugaguuauucaugucucuccucagaagagagucuucuagcucuuucugcugaagaaaaccucaacuggguuaucccuuuaguggccaugcauuauuaccagguggcaaaucauuaucuacagauuaccaaauguaagugcauuuguauguaaaaauuucagcccaguucucuacacguguugacacauuauuguaccauauccuuuguaggagcuagaugguggagugugguaugaaaaaguaucaaaguauaauuuuaaaaagguacaaacuugacucauaggauaaacauauacuaaacuuuuaaugcacugagguaaggcugguucagagggaauuugagauacuggauguugguaaguguugagaaaagaauguuggaaugagauuguugggccaggcugggugugguggcucuugucuguaaucccagcacuuugggagggccugggcaacaaagggagaccucaucccuaaaaauauuuuuaauaauuagcuggguguugguggugagugccugugcuuccagcuacucaggagguugaggcaggaggaucauuugggcccaggaggucgaggcuacagugagccaugguuguaccacuguacuccagccuggucaacagagugagacccuguuuaaaaaaaaaaaaaaaaaaaaggaaagauuguugagcugaauacaagaccauuaauguccuauaggguagugaagccacaaccuuugggguuaucuuuucuacuggaccaaaaucuacaaguuaacauguaaccccacagaguguaugcccaaaucaguaguaaguagcacgucagguaagagcaggccccuugagcaggagucuuugggccugugagauagugcuccagcacauaccuggaggauaugcugucuuccucuugcuuuauuuucaaguuuugcauaauuuucuaucacaggaggcagaguugccuagugcagugagccagggucuuuagucccgguuugaaucucagcccugcaagugucuugcuugugugaccuugagugagucucugccuucuaugagcauugguuuccucauuaguacaaccgggaugacaauggcacccaccucagauggguguggugagaaguacgugauagaauaugggcaucugauaaaaaugccuguaacauaguagguacucaguaaaagguuacuauuauuauuauuauuauuuugagauagaguuucgcucuuguugcccaggcuggagugcaauggcucaaucuuggcucaccucaaccucugucucccagguucaagugauucuccagccucagccucccgaguagcugggauuacacgcaugugccaccaagccuggcuaauuuuguauuuuuaguagagaugggguuucuccguguuagugaggcugaucucaaacuccugaccucgugguccgcccaccuuggccucccaaagugcugggauuauaggcgugagccaccgcgcccggcaaaagguuacuauuauuauaauaaaugaacuacguccacguguacacacccauaacucuguggcauuguccucucuuuguggcaugccucugaccuucuuuuaguaaagaugauuucuucucagcuuugauacugguaugcucaguaaucuuagucaagucaagucguggucuuccccauaaucuagguaaggagaggaucuggacaguuuuccuuuguuuuccaagucaacccccacucucccgagaccuucaucaaacacaaaugaaauccauuuucuuugugcagucagugugucucggcagaugugagucagcauccuguucagaacggcuguuggugccuugccauggacaauaaagacacacauuuuccauggaaugccaggcgcuugagcugacuugggguuuccacccgcagagaggaggaggaaacuccaggaggcugauuuugugguuuuggauccagccaucauuuuaaacugcaaauauucucugugcuugaaaaauauggugaaugauuuaugggacccaugacccccagguuucuacuggcaccuugcugucagcaacaccuccccguggcauucccuuggcaaagcuauugcuucggacugacuggcauuuggaacagugacugaccucugggggugcccacgauccagguguugaaaauauuguuguaguuagcuaauuagauuaguuggcuauuuucguucaacgaguaaaugcuuaaagauuuccuugugcuguuucuuaucaggagccaaauacauuugugucuugguuccucaccaauguuggaaaacuguaacuucuguuaguuuugaaaaaaaauuguaaaaaaucugccuggaucacagaauucauguucucacccauauucuguggggucacccuauccacaucacucuucuuuggggagagccuuugcuuagaugacuuugugaucacucauaucagacacacgaggaagaggauggaaaagaaagugauauucagguuuucuguuucuucuuuaugcccucgccccacccacacaguuucuuuagacccugugcccuuccgcccagcaaacacuuccuuaagcacuggaacacgagaggucagagaguauaaaucaagggaggcagagccccaucuccugggccucuggcacuauauucaauuuagagcuuuucugguguccuggcacugguugugcauuguugaugaugauugugcugacauagguauucgagguuccguccgaguccuucaguugcauccuggguagaaauggugaguaaccggaugacccuugcaaccucaaccuguacugaacaauuuuucacaggaauaaauggccucaccaauuacaauagcagggcaagaggaagcagcaguguucuaaagauaagaugguucaaucccauuugcagaugcauguauuugguauuacaauauaggacaugacuuaaguggcuuugacuaggcaguugauccuggcuccaugauuuuuuccucuuuccaguucaauuugaaacaugcagacagugguaugggagaaauagcugaugcaggugagguucuugggcagggcgguaggaggggaaucuucugcuggcagaaacagccuccauuucauuucuuuguaguuaguggcauuagcacuugugcaaugcauuacggcuguucacuuguaaagucccagcauguuagauacugcaucucagcuggcuguuugcuugguaaauaauuuagguaaaauacauuuugauuccuuuagacuaugguuguugcugccuccuagguaagauucacguuaaccacccaggcucuuuauggggaucuccgauaauuggauuaaauucuaucagugcuggcuggacacuuagcugcuauggaaagaagggcaaaaagcugugucguuggcuaagagugugggacugcauugcggcuuguggagugaacucuuuagauguuacuucuuaccuggguuguuuggacaaaaguaagcacuucuuuuccuaaaauuguagucgauccuguaccucacaaaagcaguugguagaagugacauagaagucuuuuagauagguagauuucuagagacauuuccauuucccaccaugguuauccauuucuguuggugauucucaaauaaggaauuacuagggaguuuguugaagugcugcuuccucggucccaaguucuacagagccuuccuuaguaguucucaggugcagccuaagggacuguguuuuuaauaagugcuucacgugauuuuaaugcagguggggccaagaaccacauucugacccaaacacagacuuugcauuuguuuuuaagagagaauacuuuuuuaugggucacuguucuugguaugccuucaggccagcggccccuagguugacuucuggaaguauuagaauugagguuagaggauagaauuguauuuugugaugguucuucaguauuuucaguuguggguaauaaaauuaaguacaaggcaaaacacguuaauaaacaagugguuuuccuaauagaaaccuagagccauagaauuuugagagacagagcaagggagcaaacgagcaagcgaacacgcauguguggguaggcaugaaugcacagcagcccaggcacacguccacuuuguggguauuuuagagucuuugaaucaaucucuucugcccguuccuaaaugaaacaaaauauaaguuaaagcuuaauuauauccauuaguguuuuguggaagcagaaguggggggucauuguucaagcccccuucuugugcagauauagaagcugagaccccaguaggacaaauguuuacacacauaacacauacagggaugggcugcagucccucugagcuuuagagccuccacuuaugaaauagaaagagaaauagcuauccccucuugguuguuaugaggauuaaauaacauagcuugucuuacgauguuuggaaacugaagagaauuauauagauguaauuccuaauuaccaugcauacuguguuuucuaacugaaguauuuagaguuauacagggacucucuugaagugaagucacuagucgauucuggagcaaugacugccugccacucaccggguauuaaaaaaaacccauuuauggucauuauggugaacuuugaaaguacagauaaucaaaagaaagauuauacauaaucccaucacucacaugaucacuauuaaaauuuugauauagagacuucuagguauuuucuuauacgugcauacacauuuuacaaaaaugagaguauacagagcauacugcuuugcaaccuuuuuuuuuuuuuacuuaacaguaccuuuauuguggauauuuuccaacauuaauuaauacuuccaugccaucauuuuaaaugacugcauaguaucccauuacauggaaaaaagaacauuuaaucagccucuuauuggacacagguguuuuuucuacuuuacuuuucaauauuguauacaaugcugaaauaagcaucuuugaagcugaaucucauauccagcaauuggauuuauuuuuauuuuauuuuauuuuauuuuauuuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccucccgcaguguuugugucccuggguacuuaagauuagggaguggugaugacucuuaacgagcaugcugccuucaagcaucuguuuaacaaagcacaucuugcaccgcccuuaauccauuuaacccugaguggacgcagcacauguuucagagagcacaggguuggggauaaggucacagaucaacaggaucccaaggcagaagaauuuuucuuaguacagaacaaaaugaaaagucucccaugucuacuucuauccacacagacccggcaaccauccgauuucucaauuuuuuccccacccuucccgccuuucuauuccacaaaacugccauugucaucauggcccauccccaaugagccgcugggcacaccucccagacggggucguggccaggcagaggggcuccucacuucccaguaggggcggccgggcagaagcgccccucaccucccggauggggcggcuggccgggcgggggcugaccccccaccacccucccggacggggcggcuggccaggcagagcggcuccucacuucccaguaggggcggccgggcagaggcgccccucaccuccuggauagggcggcuggccgggcggggggcugucccccccaccucccucccggacggggcggcuggccgggcagagggguccucacuuccuaguaggggcggccgggcagaggcgccccucaccucccggacggggcggccggccggaaggggggcugacccccccccccaccucccucccggacggggcggcuggccgacccccccccgccucccucccggaccgggcggcuggccgggcagaggggcuccucacuuuccaguaggggcggccgggcagaggcgccccucaccucccggacggggcggcuggccgggcggggggcugauccccccaccucccucccggacggggcggcuggccgggcggggggcugaccccccccaccucccucccggacggggcggcuggccggacggggggcugacccccccuccccccucccggacggggcggcuggccgggcggggggcugacccccccaccucccucccggauggggcggcuggccaggcggggggcugauccccccuccccccucccggacggggcggcuggccgggcggggggcugaccccccaccucccucccggacugggcggcuggccgggcggggggcugacccccccaccucccucccggacggggcggcuggccgggcagagggguccucacuucccaguaggggcggccgggcagaggcgccccucaccucccggacggggcggccggccgggcggggggcugacccccccaccucccucccggacggggcggcuggccgaccccccccccccccgccucccucccggacggggcggcuggccgggcagaggggcuccucacuucccaguaggggcggccgggcagaggagccccucaccucccggacggggcggcuggccgggcggggggcugaccccccccaccucccucccggacgggguggcugccgggcggagacgcuccucacuucccagacggggugguugccggacggaggggcuccucacuucucagacggggcgguugccaggcagaggguuuccucacuucucagacggagcggccgggcagagacgcuccucaucucccagacagggucgcggccgggcagaggcgcuccucacaucccagacagggcgguggggcagaggugcuccccacaucucagacgaugggcggccgcgcagagaugcuccucacuuccuagaugggauggcggcggggaagaggcgcuccucacuuuccagacugggcagccaggcagaggggcuccucauaucccagacgaugggcggccaggcagagacgcuccucacuucccagacgggguggcggccgggcagaggcugcaaucugggcucuuugggaggccaaggcaggcggcugggaggugguuguagcgagccgagaucacgccacugcacuccagccugggcaccauugagcacugagugaacgagacuccaucugcaaucccagcaccucgggaggccgaggcuggcggaucacucgcgguuaggagcuggagaccagcccggccaacacagcgaaaccccgucuccaccaaaaaaaaacgaaaaccagucaggcguggcggcgcgcgccugcaaucgcaggcacucggcaggcugaggcaggagaaucaggcagggagguugcagugagccgagauggcagcaguaccguccagcuuuggcucggcaucagagggagaccguggagggagagggagggggagggggagggggagagggagagggagagggagacucagcagcaauuggauuucuauguuuaccuuggcuacucuaaaaaugagagcuaaaguuauagaugcuacaguuaagauagcaagcauauugguauggacuugcuuugaaaugagcauauacauuuuaaaaaguuauuuauuuuuauacccagaaauucuaacuuuauacuuuuugaucuaacacacuugagaauucaaaauacuuccucugucaaucugcuguuugucuuugucucaagcguuacaguuuugaccuuucuguuucuucaggacuccucugauuuucuucaggccaagccauuuguaguuugcaagugacuuuguagguuuagcaacucuacucucucacccaagaguuaccuauccaguuauggcaaagacuguuucuuucauuaaacaaaguuauuaaucagucaggagagagacuuuucacauucugaauuuacaaacugugcuuucuuaaguuaaauggcauguuaggaguauuucugauaugaaauuggaaacuugcagacaccagaaggcauugcuuaucuuuguaaauacacauguuccaauuaaaauagguacuaaaauauuuugguggcaccucaaaacucccaauuuagauuuaauuuagauuaaaacacuuacucuuuuuaauaaaguuauaaaauuaauuauuaaaauugccuauugaagauuaaaggcaguggaacguuuauuuuccuuacaaaacaauuuugucuucaauaagugugauuguguuaaucaauuaugcuauuaaaaauacaacugccguguuaaaucugacucauuugucaugacaguuuuuauaauuauagaaauuauaccuagcugcuuauauagccauaauccugcaauaaguauaaauaauuaucucuauuaauucaguuugcaguuacucucuauuaaaucccgaguuaaauggcaauuuggggaccuucauuuaaaauccuacuaaaucucuguuguuccaucugacugccaaagccccacauaugcaccuccuacuguugauuccagaaaccaauuuaugaauaaaauaguuuuuaaaccacaaguauuuaaaagguccauuuaagcuugagguuugaggcucucaagaaaaaaggaaagagaguguacacauuggguagaggaugcugacgaaagagauagaacaaaucuuggugucuggguauuucaguuuggaaaacaguauauaaauuucaguuugaaaaagucugcuugacaccuucuauguaagcccaaaauacuagaguauacugaguaacgauuaacaacuuguauuuccauagguguggaugaggucaccauugucaacauuuugaccaaccgcagcaaugcacagagacaggauauugccuucgccuaccagagaaggaccaaaaagguacaggcaauuccagggauggagggcauuucuuguugaauuuuuguuuccucagacauugcuuuuucuuuucaugaauuguggcucucaugcgcaaaagacuugugggacccuuggauaucuaagauuuucuucuuaaauccuuguaagagucacugcacaugugugugugcgugugugcacgcgcgcgugcaccucaggucaucaggcauuagguucucauaaggaguguacaacauagaucccucgcgugugcaguucacaguaggguucgcgcuucugugagaaucucaugccaccguugaucugagaggaggcagagcgcagauggucacgcucgcuuuagagugcuugggagcuccuguguaaggacaguacccucccccaacccaggcuaccuggagggagagcuucugggaauagaaaguuaggaauagggaacaacaacaauaacaacaacaggcaccauuuauugagugcuuacuuugggccaggcacugugcucaguuuuguacauguagcaacucauuucaucuuuaugacuucugcugguucuugauaagauguuucuaauuuaauuuuaggauacuagccuccacugaguguugauccuaacaagcuccucucauuuuaaaaauauacacuugaauucuuaagcuuuuugcaacgagugggcuuaguuguuaguucauuuggucugcaaagcuaucuucaacaugccaugcuccuacuauuuaaagggucuuugugugcuuuuucccuuugcuuguccacuagugguuaagaaacaaccagugcguguucguccuuuauuuugucaguuguaggaaauuuuauuuuuaaggacgugcugcuuuauuuuuaacuucuugcuauuaaaagcuuuugauuuauucuuggacagugcaguaaguguggcuuccugcagcucccguuugacuuauggcuuucacuuguagccacaguggaggugagcuggaaggauucuagaagagauauuucugcccuugggauugacaugaccagcaggguccugggaguugcaggucaagccuugcuacacuuccaucccccgcacucuaaaugguuggaaaggacauaaauaggaaagcaucuggcuucuuucaucucaagugcauuaaaauucuucuuucacuagaaguguauuaaucuuguguagugaggcauagaggggaguguuuuauuucugcagcuucccaaaggggucugugagcugguagagccaaguucccaguggagcagaaggcucaucucuggauagcaagcaaaaaauuugaucuuucagcugucacagaguauggucuuggaauacauuuggguguguacacacacacauagaagccugaaacuuuuuuuuuuuuuuuuuuuuuuuuuuuuugugacagggucuugcucugucacccaggcuugauugcaguggugugauucggcuuacugcaacuucugccauguggacucaaaugauucaucucagccucccaaacugcugggauuacagucauaagccaccacacccaaaaccuagaucuugguuuuagauuagauauauguagaacaaagcucccacauacccucuaggagggaagauauuaccagaauuaugaugaggucccaagaucucacaggcuuugcugugugcuggggacagcucaucauccuacuaauucuugacucucagccuuaggccaaggagaauuauguaucuuuuauaaaagauauguaaacuacuugagauaguuucaagugaaacaaucggcuguuugugaaauaaagaagaaaauuugugaaauaaggaagauuugugcugcagaguucuuuagggauacgggcugcagcugcccaggugaugagcuugaagaaccuaggcccggcuggcagaguggagaggagcugggagagacagcugcuuuuacgacucuuucauguucuagcagacgccagaugcgaggcuucuccuuacagggaaggguuauguuugauuuaucauacauuucuggaguuuuuguuuaguuuuuguuaaaugcaaagcucugugcuggacauugugagaaacaggaaguugaacgcccauaaggaguuuagaauagaaguggaagaagucaguaggugcccaaaugcuauuugagguuugaauagagaauggguagaggggagugucaaggguaggcuaaguuuggaguuaccuaaccucaaaguuccaaacugggagacugguguuauaauugggagcuacugcuuuuacaguccccuccuaagugccguguguucccgggacauugggaagcaggagaaaauggguggugaaagccagguggcuucuaagauccaugucaguucuaacacuuuugacaucuacgaaugauucagcaugguugucucugaagcaugcugcaaaucaccucucguagccugcaaguaccuguaggggcuaagcuuuguagaugccacaggugcucuuagaaagcaaggaaagaaagaagagagagaagaaaaaaaaaaaagcgaaaagaagaacauuauuucaguaggaggcuucagucaucagccaugauuuguaggaaguuuagcucgaggaagcaucgcuaaaagacacauugaguuggggugucugucuacauacaugggugcugaccagaccucugacaaauuuuuguguucauggugacaguggauccaacccuuaagaaauuacaugcagcagggaauucaagggggccaguucggggguguuaguuuccuaucacuuccauuaaacaccguccgaguuugguguggacaaggagauauuuucucaguauuagaugaaguguuuugcauaggaaaguuucaugaccucacuuccaacuguguugcggccucugguuccuucuggugacuuugaggagcugccgcuggaauggcugcccccacgucuuuuacaguauaucgggaggccacaagaucugcuugccaggaggcugucugcucaaacaucuccuucuuagcaggggccuugaucuccgaaagcguccugccuuccacggaguguuacugcuuucaagcauauugcaaagugccugcacucucacagcuuucuuaggaaucacauacgacuccaguuuccuuuuauugaccggggaagacggcaaaauuaacuuggauuuuaaggaauuucguugaagcaaagccugauguuuauguuucugagaugugggucuguugaagggaaugcaguugagggcguuugacccaagacuccggaguggucaaagacucacaaccugcuucacaaaaagaucccucuuacuuuuguuuuacucacuaguuuuaaaguaaaauaaauauuuuccuuaugauugccuguuaucuugaaggaacuugcaucagcacugaagucagccuuaucuggccaccuggagacggugauuuugggccuauugaagacaccugcucaguaugacgcuucugagcuaaaagcuuccaugaagguaaaugcaugugagaugucaucucugucaaaucugcuauuaauuuugugaauuacagcuuucugaguguaauuuggugauuuucaguuuuguugaauucucauuuggaaccauuuuuuaaaaaugaacugaaguuauaugucucaggauuuguaccaaaaauauuucaauuacuuguuuuaagacuguaaagaaauuucaugaugcugagaagucaguuaccagcugcuacuacucagcaccugggcaauuggaauaccauuugggaaaacuacuuccuugauuacacuuccuccuuuaaaaagauauguugugauauuaaggcaagaaaaaaaaacucauagcuuuuguuaagugaagcuugcaaauucugcccauccuuucguggguguuucuuccucccauacucucucugucaguaccauuuguuucaaauucaggcagaaucagaacaucauagugcauauaagggguaauucuggaugaagaaucguaccugaaucguaccugugagaaaguaacugugaagucucaaugcacguuaucuuuuauguuuuucuuuuguaaaguucuuuugaaccuggaauuuuagguuaaauuaaguaaaaacuguagauuggaaaccuccugaacuuugugcauacuuaaaauaucaaguuuuuuguuuuguuuuguuuuguuuuuugagauggauuucgcucuuguugcccaggcuggagugcaauggcgcgaucucaguucacugcaaccucugccucccggguucaagagauucuccugccucagcaucccgaguagcugggauuacaggcaugcgccacuacgcccagcuaauuuuguauuuuuaguagagacgggauuucuccauguuggucaggcuggucucaaacucccgaccucaggugaucugcccaccuuggccucccaaagugcuaggauuacaggcgugagccaccgcgccuggccaacaucaaguuuuauauaaaugcaauagaugcacacacauuaauguauguuguacugcaacacauuuggacccuuuucuuagugugggucugcagcauuugaacaguccgacacugcccucugcugauauacauggguaaagucugcgcuguagaugagggaaaccauuggucuugauuuuuuauuccgagucuguuuucucugaugccacuguuccugaauuaugaacagucugagcuguaagccugucaccagagcuaaugucacaguucaguugucauccuuuucccagagaacacaagagugagggugcuucggacacugggcaucuccaaagccuggaauuugauagcucagggcugcuguaagauuuguuguuaagucucuuucuuccuuuaguucuucagcuuagcccaagcugugcucaguuuauuuuagcggacuugucugaguuuccuaaguagacuguacugcagaaaagacgucauuaagaaugauaaaaugucgacaacauuucaugauccugguugauaaaaauagcgcuccugaaaaccgagucuguggaccuuuggaggcagggaugagucagccucuccuagguuucuucugaccaucaacacuucagaucaguuugucuuauuuucaucaagaaucuauuuaguugugauucgaguggcuuuacugguaucuauuacuagguauuagggacuugaaacagaccuuuuugagcugucagucacuguuguaaucuauguaauugggcccaauggaaggugcuuuaacugcugaagcuuugacccugugccagcucuuccauuagcuaucacaguugaauacccguccaaaauccauaaagcuugaagugacauuaacugaacuaugcuuaaaaaaaaaucuguuuugacuucuggcaguaccgguggcaguaucugccauauguuacaguagaauuugcccuugugauaggaauuguggacagucuguggagaguuugggccgggcuuuggaaauugccaaggucaccuuugaauguagacauaaaaacacuauuggaauucucagauauuaccacugguauaucagugauggaaggaaacacaucuuacauuauucugccugucuugcaauucuacaaugucaggauauaacauuucucccacuguguguuauuuuuagacuauauuucuaucauccuugagauugaacaacugccucucaaaauauucaaagauacucgguagucauuuaauaacauuuguguagaaugcuguauggaccuuuugcuaacaaggggagaauuuuuggcuuugcuggaaccucuacaaaucaugauuaaaaacucagaaagaagagccauuggcucaaagguuagaugaagaauaaaauucaaaauuaaccauuaaccugaggcuuagcuuauauuauacaaacuacuuuuucggggcauauaaacgcuaauaaguuuaauuaauagcugacacgcuuuucauguggguaaguuucuuauuguauuaacaccuuauaauugauuuacauuuuaaacaguuguaauucuacuuaguucaaagugauaguuccauauucggaaagacaaguauuaaagaauccugauuauuaaaucuugacuuugaucaugaagccagcuuugaaauacauguuucauugaguccuuucaagcuaucugacaugcucaaaaguguauauauuaaauuugaauacaucacccaucaaauucuuauuccuuaauaaaguguuggugucuagguuuauuuggcacuucauuauuucuuuuugcuucccuaaagugccugaagagugcauaauuaucaagcaaaaauggaaggacaagaaugaaauuuuuaacauuaacccaauuuuacauuucaaagagugcagcuaaaaauuuuuucuuaacuauaccuuugccugguaaaaagacuuacucuaacaaugcuggcugcaagugacaacauaaaauuucuguauuccuuuauuuuagcgagaauuguuuaacaaagaaauuucuaaucuguuaaaauagugagugguuauuguagaaagugaaaaauaauaauaagaaaaaguuacuuuaucuacccacagcaaaaggcaauugccaguuuuaguauuuuggcauauucuauugcugccucuuccuauucacuacuuuuuuuuuuuuuugagauggggucuuacucugucguccaggcuggagugcaguggcgcgaucucggcucacugcaagcuccaccucccagguucacgccauucuccugccucagccucccaggguagcugggacuacaggcgcccgcuaccaugcccagcuaauuuuuuguauuuuuaguagagaugggguuucacuguguuagccagaauggucuugaucucuugaccucgugaucugccugccuuggccucccaaagugcugggauuacaggcgugagccacugugcccagccccuauucacuacuuaaaaaaaaaaaccauauuaacaguugaacuccaacaugccaguuccaccaucuugugcucuggugaagcauuuuuuaaaggaauagaaaaugccauuacuuugugcuaagggguaggaguauagauucuucagaaggaauguagaaagcaggaugcuaacagacccaauccauguuugcaauuuacuugauggagaucagagaaguaggcuaaugguggggaagcauuucccugcugauguucgugcuuccugguucacaggggcugggaaccgacgaggacucucucauugagaucaucugcuccagaaccaaccaggagcugcaggaaauuaacagagucuacaaggaaagugaguagcuugauuucugugauucauccucucagcccaauuuaugugacucuaucauggccacugggguuaggguucgggcuaagaugccugcauuagugaugugcagaagugccugccaccuugacuaugcaggcaagguuggcugugguccaaguuucucuccuucaccuccucauugccugcauuuugauuauuacauuccacuagaacuucuguguuagaagaaggguagacaggagggaaaggagagaaaacaaaacuuguuuuuaaacaagaucggaugaggagaaguagcaaguauuauauauggauuccacuuauugggcgcuguucagugucugcucaagagguugccaacucuggacuguggauaauugaagaauuacagcaagagaccccuguggacuggugcacacuuagcaguauagaaggcuaugaggggaauaaacaaugcaacuuacaucgcuacugcauuucuuuuuuguuuuacuuuuuaaaguuauuaucauaguuuuacauauuuuggggguacaugugauauuuugguacauguauuauauauaauauguaauuaucaagucaggguaauugagauauccaucaccucacacauuuaucuuuuuuuuuguaucaggaacauuacaguucuucucuagcuacuguauuucaauauagaugcuauuuugaauauugaaauauacuuucauucaaaagcauuguuuaauucuuaguaguuuuugccgcugugcauuuucucaguggacaguaaagcacaauugugugugugugugugcguguguagaccuccaauuuuuuugauguucagaacaaguacucacagucaggagggcugggagccaguauuuaaacuacacgagaggucaccaaucaacggugagccugaggaucccugauuugaucuagcccugcugcccccuguuauggauaauaacucuggcucugauuucaugagggcgaaaaucauucuagugaauccuuccucuguuugggguuaaggagaauggauauguccagcugacguagcuguucugcuucucagagucuuagugggaaauggggagauugggguggaugguuggcuacacaggcagaaagcauaaaaccagauguauuuuccuccaaguguacaagacugaucuggagaaggacauuauuucggacacaucuggugacuuccgcaagcugaugguugcccuggcaaagguugguuucccaguuucuuucuuugcccuugcuuccucccaaggcaagucacauaccucauuuuauacuuggagugaauuaacuaaauccccugugccugcaucagaaauucagcugcauuuuugaaaguggguuugcacugucacugcagaguugucaauuuuguauaauaggauuucuuauccugcaaaaccucauggacaaguggacuuugggagccagagaagggaugggcggcucucaaguccuggccuggauuuaugugccagagccuuggccgugugacuuagggaaggucacuuugccucuaucuguggucaugcaggacccagugggaagugaccuucugguuucuuuuucacugcguuuacuucucauggaagaauuugcccauauaguccuuugucugggguggaguugucuuuguggagcugauugcuaauauuaacacauuaacauggaggaaggggcauuuccccugugaaucccuaguucuggccagcguguagcuuaauacuuaugugccaggggagggacgagagacccugggaacccugaugacaaaugacagauagugcguccggcccacucacaucuccauuacugcaacaacuccuaugccauucucccucgcucuccucucuucgcuaccaccugccccauguaccaccauccacggaucucugugaaauacacuuucaccauuuuacuccucuguucaaaccccauuucugcugcaucaaauuuaaacuccuaacugcugugaaagguccucuaaacccucccugcaucuucuuugcucaucuuucccgcucagcucugcucugacagggcagcuccuuacuuaccugagagcgugcugugccaucccuugugugccagcuggcucucccgcucugcuuggcuagcugcaucugacugacccuugaaguuucagcuuaagcccaggcccaucguucacacucuuugcugacucugcccucugagaguucuuccuccgcccgcauuuugugucuuucuagugcuguggguucccgggcugcuuuacauuuguuuccacauauuccuccaucugcauugcaagcucucugugagaaagagcuaaaucucaucagcuuuuugugggggauggggacagggauucuguaagguguguaggccaggacuggguaucaagggggggauuguugauggcaaggcacagcccccacuuccuugcucaaugauuuuaccacuccuuggcuggucuagguuucuuuuucuuuuucuuuucuuucuuucuuuuuuuuuuuuuuuuuugagacagagucucacucugucaccaggguuggagugcaguggcgugaucucagaucacagcaaccugguucaagcgauucuccugccucagccucccgaguagcugggacuacaggcaugugccaccacgccuggcuaauuuaguagagacaggguuucaccuuguuagccagguuggucuccaucuccugaccucgugaucugcccgccuuggcuucccaaaguccuaggauuacaggcgugagccaccgugcccggccccaucuauguuucaaaguaagaaaaaucuuacgugguuacuuauuuaggaaauuaaauaauggcguacauggacuggggagaaaacauuuucaguuuuaaaauacacaaagaaauguauuugaaguucuuuuucuuucccccauaggguagaagagcagaggauggcucugucauugauuaugaacugauugaccaagaugcucggguaagugcugagcuuuuugcuuugaguuuuuguuuucugguaagucucuggauagucuauauaguaauuuaacucugugugacaaaugacucccaaacucuguggcuuaaaacaacaaacauguauuauuucucaguuucugugugucaggaauugaggaguagauuagcccaauuguucuggcucagggucuuuucugagguugcagacaaaauguugcauggcugcagucaccugagggcuugacugggucaagggaaucugcuuccaagauggugcacuucacaugacuguugguaggagaccuuagaaucgcuccacauaugccucuccaugggguuguuugagcguccucacaacauggcagccggcuuuccccagagcaagcaaucugcaaagaggaagccacagugucuuuuaugaccuaaccucaggagucccaccuugcacugcugucauacucuuuucauuaaaagugagucacugagucuagcccacacucagugggaggggauuaggcucuuccuuuggaagggaggaaccucaaagaauuucuggccguauuuuaaacccaccauagucugacagcaauguuuauuagaagacauucucuuauaaugcugguguuacuuacagaaucaauacgugacucacauaugcucacucaggcuuugcuuguauggaagcaucaguuucugcagaguguaauguggcugugcauaccaaucaggcaggcaggugggaagcagaagaagguggaggagacacagccagggacaggaugguguacugcucuguuguggugggggagaaagggaggccagcagagaccuguccuuuucuggcugaauaagacuuuugccaguucuaguuccauuaucucugagaacuauuuguuaagcuuauucagacugcaaugaacuauauucuuuacucagagggacaacgauuaucucaaaguaagucauaaaagcugcagaaaaaaauuaauuuaaauuaauguuaguuuuaaaauucaauauauuccacacggcacuucuagcagguaguagagaaggguuuuaaauaaaguaauagaaguuggguuuugcaguuccuagaugguggaagaucacggaaugaauaucuacccuugcauaagccuuucuuccucuugcccucccugccauuguuagggcuacuuguagccccuaaauuuuccagaaacugaaagugagaugagaugggcuccuuuuccagcuccaucacucccugagucucugagaagcuugagaaugagagccuggucuguagcuguccaguaaacaucugcuagcuuaucugccccuaaaugugcccaaagggaggagggccagauguguuaaugaacauuuacuuguucuucuuuauaugaauacaagcucuuggucccuccuuucuuauucaaggaaggagauuguacagcagaccucacgaacuaucugcagucucauaugguauccaucugugccuaaggaagacugcuugugauuaagacuuuugaccuaaauaguaggucucugcccaugucugcaguauaaucaucuuuccucguuuggcauuuugaauguguagcuuuuuuuguuuuuuuugcaugacauuuuuuuugacguuacauuggauguguaguuaacuuuuccugguugguuguacucguaggaucucuaugacgcuggagugaagaggaaaggaacugauguucccaaguggaucagcaucaugaccgagcggagcgugccccaccuccagaaaggugggcacugugcugagggagucucagugccuuggggcccuggcuggggcggcuggguggauguccauguugggauggagucugccagaaugagguucugucuccgcuuggcacucucauaggcucacccauuuucccucaccuuucucucccauucuggauucuuuucucuugcaaauaguuucugcauuuggugcuuuauucugcagcuccuucuuguuugaugaucauuuggucuugccauuauuuguugaaguaguggacuuuggugcaugcucuguacuguuuccuaugguuuucggauggaauggguuccacucaggggagauagagaugguccaaauauguggccugggcagugccauucaggacaggugguauggcuguuccacgacaaacuuggccaauguuggcucuggucaccgugguaaccucuaagcuccuaggaugcugugaucauccucaauuuuuaaaaaaauuauggugcauaaaacuaggugggugaucguugacagcuuugacuaguggcucggaucugauaacucuuuguuguuuuuccucaguauuugauagguacaagaguuacagcccuuaugacauguuggaaagcaucaggaaagagguuaaaggagaccuggaaaaugcuuuccugaaccuggguaagugaauguggcccccauuccugguagacaucagcuaccagagcagaagugacagauggccauccuguuaauccaaauguguuugggagguguggcuucuaugcaugcuuuggauaguuuuacagucuuaauuguauagauuucagaauauaaaacugaagaaaggccuaacuugguaacagauuguugccagggaggaguaagagaacaggaggagagagggguguguuguggaaacucacguaugcacuuggguucugcaggccucagagaccccugguuuaaaaccgugguggaacuuaguauugcagaggauuucuagauuucccuuagccuguccuauuuugcagcccuuuuccauugcauuaggucacuucugguuuguggcccagggccagggcauccucucucauugguagaggagagaccagagcagcugcagcgcugacucccuuucuucucuccacaguucagugcauucagaacaagccccuguauuuugcugaucggcuguaugacuccaugaagguaagggcagcuggcugagagagcuguguuuccacacucagcuuuucuucuuuugggucccaaauugagucuccuugauucauggauggaggaaggggaccccacuguguggaugcaggaacacacuagucagcugugguuguaugugacagcugagagaaccacaaaucugucuucuuucucucagcugcuugaacauguauuugcguacagacaaaaaguaaagugccaugggagagagaaaaugcgacaugguagucgugucugaucccugcuuagguuucuccgugauuucuuccuguuacugccagagucaagacaagcgaggaagggagcgauuauuaagcacccacuauacaguggacaagugcuacuauuuuaccuuaaaucauugcauaacaaccucugaggcuuaugauuaucuucuuuauaaaugcagagauggagcucagaauaccucagccugcuugaaguuacacagacagauuugaaccugggucuaucagaccccaaagacagccccacaacccuucccuaaacgaaccaccucuucccguagacccaucccauuuucuacaccucaagugugccauguguuuucuggcuucuaggcuuuugcauuuuccuucuggaacaucucccuugucugugcugccucugccaucugucuuugaguuccauaucaaauagcaccccuuggugccuucgcucugaugcucuggaaguaaacucaguggucuuuauugcacauaucauuagaaauggcacagagcgaugauagaaauguguuggcauguucccucuaagccugcaagagucaggaaccucuuguuacauauggagacucagacugcuugaacugagccuugcaguaguaggugcucaguauauauuuauugaaugguggcauagagugggagucugugcugacuacagccugguguguuuggaauucccagaugcucuucuuucuuuucuuuucuugucuugucuuuuuuuuucuuucuuuuuuccucccucccucccugccuuccccugccucccugccuuccccucccucccugccuuccccucccucccugccuuccccucccucccugccuuccccucccucccugccuuccccugccucccugccuuccccucccucccugccuuccccugccucccugccuuccccucccucccugccuuccccugccucccugccuuccccucccucccugccuuccccugccucccugccuuccccugccucccugccuuccccugccucccugccuuccccugccucccugccuucuccugccuccuugccuuccccugccucccugccuucaccucccucccuuuccuuccccucccucccuuuccuuccuuucccuuucccuuucuucucucuuucucucuccuuccuuccuucccuuuuucuuucuuucucucuuucuuucucucucucucucugucuuucccucucucucucugucuuuccuuucuuauagguuuuugggaaacaaguaguguucgguuacaugaauaaguucuuucguggugauuuuugagauuuugguguacuuaucacccaggcaguguacacugugcccuaauaucccuuauccaaaaugcuugggaccaggaauguuuuauaucucagauuuauuuuugauuuuguaauauuugcauauauaugaugaaauauuuuagggaugggacccaagucuaaacuugagauucauuuauguuuuauauagaccuuacacacauagccuaaagguaauuuuauacaacgcuuuugauaauuuugugcaugaaacaguuuguguuaagugcuguauguggaauuuuucauuguggcaucaugucggcacugaaaaaguuuuggauuuuggagcauuuuagauuucagauuuucagaucagggaugcucaaccuguagacgcuuucuuuaacgauaacauucucagcgaauguaacaaauaucaacuugauuuucagggcaaggggacgcgagauaagguccugaucagaaucauggucucccgcagugaaguggacauguugaaaauuaggucugaauucaagagaaaguacggcaagucccuguacuauuauauccagguaagcccgaggugcagugucagccugcccugccguccagagcaccccgggcccuggcagguggccuggcagaaugaugacagaguggcgauuuucuguuuucugacucucuggggaagagaugcuagucaucaacuaucagggauuuauuuugaaagcaccauuugugauuuguccuggacuuuguacaaucaggcagauguuuuauauuuuucacaucuguuacucuacaaugaucaucgguguucaugacgaugauccugcaaggcuugcugacaucccgaagaggcuuggaagaucaguuacauuuuacuuuuuuuuuuuuuuuugagacggagucuugcucucucgcccaggcuggagugcaguggccacaaucucggcucacugcaaccuccgacuucuggguucacaccauuuuccugccucagccucccaaguagcuaggacuacaggcgcccgccaccacacccggcuaauuuuuuuguauuuuuaguagagacaggguuucaccguguuagccaggauggucucgaucuccugaccucgugauccgcccgccucggccucccaaagugcugggaugacaggcgugagccacugcgcccggccacauuuuacuuuuauuaugcauugguuccuugaaaaauccucugggauaggccuaacaacuuucaguuauucagaacucccaucucuccaaucaguuuagcaucugucuguuuugaugugaugucgcauuugcaguaaggaagugauggcauucacagugguaccacuguguagauuucagacagcccuugcaauuccccuuucuagaaguuccucagauguccaaaggcaugcccaugguuagcaaggauaaaguuagagcuggauuuuuuguagccagguuuauuagggcacauguuuaaagucaaaggaccaguuagacucuuaguaauuguuccucaccucaccagcuuauuuccacuugaccuuaauaaugcaggaaauaggagagugagcuaggaaaguacccuguuuucuguggaaagacgaggacgagagaggaaaguuaggguguuuguaggaccuugcugcaguaagaacagcccuggucacuaaccuaugucaauccucagcaccuugcacucccuccaccccacaguccuaaggagccuugagugucuuccccagcaccuccuccgaccacacuccuggaggcuucccuggcaaugguuuggguguggccuuccaggccuuuguaucagggcaggucuccugcagagucuucucuuugucaugggagaagcuucauugugcguugaggcuacuucuguguuauugaggagucugggcuuuuuucugauaccacguuucuuuucuuuccugggccauuguagcaagacacuaagggcgacuaccagaaagcgcugcuguaccugugugguggagaugacugaagcccgacacggccugagcguccagaaauggugcucaccaugcuuccagcuaacaggucuagaaaaccagcuugcgaauaacaguccccguggccaucccugugagggugacguuagcauuacccccaaccucauuuuaguugccuaagcauugccuggccuuccugucuagucucuccuguaagccaaagaaaugaacauuccaaggaguuggaagugaagucuaugaugugaaacacuuugccuccuguguacugugucauaaacagaugaauaaacugaauuuguacuuua

SEQ ID NO: 21263 - RNA, 16877 nt, Homo sapiens
agcgccaguguacagcggcggcuggggcggcaggugaggcggcuggggcguugcugucgugcguccgcaggcgucaggugcucagacccgagggccgggaagggauuuggguuucacaggaaccuggggcggggguccgcuaucuuggggcugucgggaccgcugcuuaaauuuggcccaguccagaccucgagucgggcccccagccaggcccacgcccagguccaggcccaggccgguagggauccucuagggucccagcucgccucgauggagcuccucccgccgcugccucaguccuuccuguugcugcugcuguugccugccaagcccgcggcgggcgaggacuggcagugcccgcgcacccccuacgcggccucucgcgacuuugacgugaaguacguggugcccagcuucuccgccggaggccugguacaggccauggugaccuacgagggcgacagaaaugagagugcuguguuuguagccauacgcaaucgccugcaugugcuugggccugaccugaagucuguccagagccuggccacgggcccugcuggagacccuggcugccagacgugugcagccuguggcccaggaccccacggcccucccggugacacagacacaaaggugcuggugcuggaucccgcgcugccugcgcuggucaguuguggcuccagccugcagggccgcugcuuccugcaugaccuagagccccaagggacagccgugcaucuggcagcgccagccugccucuucucagcccaccauaaccggcccgaugacugccccgacuguguggccagcccauugggcacccguguaacugugguugagcaaggccaggccuccuauuucuacguggcauccucacuggacgcagccguggcugccagcuucagcccacgcucagugucuaucaggcgucucaaggcugacgccucgggauucgcaccgggcuuuguggcguugucagugcugcccaagcaucuugucuccuacaguauugaauacgugcacagcuuccacacgggagccuucguauacuuccugacuguacagccggccagcgugacagaugauccuagugcccugcacacacgccuggcacggcuuagcgccacugagccagaguugggugacuaucgggagcugguccucgacugcagauuugcuccaaaacgcaggcgccggggggccccagaaggcggacagcccuacccugugcugcggguggcccacuccgcuccagugggugcccaacuugccacugagcugagcaucgccgagggccaggaaguacuauuuggggucuuugugacuggcaaggauggugguccuggcgugggccccaacucugucgucugugccuuccccauugaccugcuggacacacuaauugaugaggguguggagcgcuguugugaauccccaguccauccaggccuccggcgaggccucgacuucuuccagucgcccaguuuuugccccaacccgguaagcugaaagaaggggcccuuacuugugagcugcaugcacauggcugaacacaggcugcuucccuuccaucacugaggggaucugggggcgcggugggggggcaggcggaaagaagcauucucucucacccaguuccuaagugcugggguggugugagaaaccagccagacaaaggcuacacuggaggcuuagcucccaggcuggcccuuguggcugccucaucuugcucuuuccccuaccugcccaucauggccucugguuuuuuagguaguuucccuggcuaugugaggauaggguuacauaaccgugucucuguuagcauagcuccugaaugcuggguagaaugaugggcauucccuccuacuuguccaccacccauauccucagggacacacgcagaaaaauagcacuccccccuccccucccccacccccgccaccaccaccaccaccacgcacaaauacacagggagaugcucacagauucacagacucacagcugcuugccaacaguuucacuuucccuuguuuugcucugcuuuccaaagggggugggacgggaguugucagagaaucuccccuuccuccacacccccuccccccacccacccccauccuucugccagccaccacguuccagggagccuccugggccuuggaaguugggagcuuguuagggagccugcauguccugggcuucacuaacguuuuugccaugauugggggugauugggggaguacccagaacucauggaauggcagcuugguucuagaagguucugggagccucacucuagucuugugcaagcaacuauaaacaucuggggauaaguaaaggccuaggaagggcugguuggaauugguccaucccagacuuuuuuuuuuaacuguauuuggagcccuaccccaggcaggaagucucaaagccugugcugaacugggggcuccuuccacagacucuaucuagguucucuccagccaucguguaggcaacagcaguaagauuggaccaaggaaugggacccacagcuacuguucuuagauucucuagcuaucauccuguggcccugggccugcugugacauucucgaaagacuccuuuccgcuccuauugaugccucggagaugggagaacuuacacccaaugugagguugggggucuuuagccucccucccucugcugaguacaucuggguugagaggcccuaggguuggggacuccuugucugggccugggcaggccugccuggccccuucuccuucccaauggggagucagaaccucuccccagcuugccuaguggucagugggucagaagacacccagcacggcugggcagugccaggcuccaggaagacuaaucuuggucccugcucacaggcuggccaggcccccaggaggugugugaaucaccccgugcaguguuugcccagcaacucugggcaugcagccacuagggcagcacccacauagugguuggccucaggaggccugagggacucagagcuggugccuguccuccaugggacauuggacacuuacguguuuucaggagcugggggccccuaccuaagccugggaacguagagcuaagguccuggggcuagggacaagcaggcuagggugugggccugacuaagguagggcucuauuccccuucagagccccaccugucccugagucaugcuagaaacaccuggcagccuuccggcucgggccaagccaagccgauuuccugccucaagugaggacaaaaucccaguccccacccaccccaagcuguaggcacaagguguaugggguuucgaggcucagcuccacaucuacuuuugccuccagggcuacuaaucagugcugaggucucaggacuggguuaagccucuguggucugauggagccuucagaggcuccugcuucgaggagugcccuccgggcuggugagagagaguccuaagcaccuagggcuggcuacugagccccgucugcaccucgcacucagcuccaacaccgcgaguucauacccugguguacugguuucccagagcuuccacaguccuccccuggagcgugauugcagcccccaaaaacacccccuugcuaaaagcaggggagagguuaguacccccuagcuuccagaacuuaguucuggcacccaggcuguagggguuugguuuaucccuuuuguacccugaagggggguauaggaagcagccaggaguacaggcagaccuuuggagucuagggagaaggaccauguccccaaccuugugcuggccaauuaacuccagcauucagccccuuaugcaaguggggaaaccgaagcccagaggagacaggguuugcugaagugcacacagagagucagagaagagccagcagggggcaggagaagacucuugcggagcugagacuuccaacugggcucuccucuugagggucuaugaugccuuggaccagagaccaaaccucuugagccuguuuccucaucugugagauguacggggugggccaggcaccguggcucaugccuguaaucccagcacucugggagaccaaggcggacuaaucacaaggucaggaguucgagaccagccuggccaacaucgugaaacccccaucucuacuaaaaauacaaaaaauuagccaggggugguggcgagcaccuguaaucccagcuacucgggaggcugaggcaggagaaucucuugaacccgggagguguugcagugagcugagaucacaccauugcccuccagccccagcaacagugugagacuccgucucaaaaaaaaaaaaaaaaaaaaaaaaaaaaaaaaagauguacggggugguugugaggauggaauggggguaacucaccaucaggaugggcauggcaggguggggcagggagaaugaggaguggaccuuccagccugggccuucucccugcccuugcuacacugagagcccugugggggcaaugugggaugguaaccggcaggcccagggccuucuccagucaggccaggugaggggugagaguguugggcugcuguggccacugacaaaggccccagagggucggggcacaaggcugaacccugacuccuucccuucccugaccuuucccagccuggccuggaagcccucagccccaacaccagcugccgccacuucccucugcuggucaguagcagcuucucacguguggaccuauucaaugggcuguugggaccaguacaggucacugcauuguaugugacacgccuugacaacgucacaguggcacacaugggcacaauggaugggcguauccugcagguggguccucauccccacaguccccuagcccuggguccuugucuccauccccauuuugcucacaucugaccuguccuagguggagcuggucaggucacuaaacuacuugcuguauguguccaacuucucacugggugacagugggcagcccgugcagcgggaugucagucgucuuggggaccaccuacucuuugccucuggggaccaggugaggugggcaggggcagggccuggggccaggguugugggaucacagacucuccauccaauccagggaggcauugacauacaggcccuaccacccuagccuacuguguaccgggagggucuauagggcccaaucucucccuccaggcaccccugagucaccugucuuucacccacagguuuuccagguaccuauccaaggcccuggcugccgccacuuccugaccugugggcguugccuaagggcauggcauuucaugggcuguggcuggugugggaacaugugcggccagcagaaggaguguccuggcuccuggcaacaggaccacugcccaccuaagcuuacugagguauggcuucccuggcagggcacagguaagagugggacaggcugggccuggggugguggucagcaagucuugaucacaauuuuucucaggucugggggguguccuucauaucuacaaggagggcauucuugucagaggggaugccacaugcaaagacuuggaggcaggaaagugcuugaaugcaagugacuccaaauggcuggagcguggggaaggcaagggguauggcaggagacuuuggggaagcagguggggcugagagagcccaaccccacaugaggacucaggcuguuucccccauuucaguuccacccccacaguggaccucuaaggggcaguacaaggcugacccuguguggcuccaacuucuaccuucacccuucuggucuggugccugagggaacccaucaggucacugugggccaaagucccugccggccacugcccaaggacagcucaaaacucagguacaaucuggucccuccccucccuuucccugaagggggaaaccaagcagccccuuccccaugagacccuguucucugcuuaucagaggcaaggggggaugggggaagcugcagugguucugacugcuuuuugagagucaaaaaggucucugucccuuuuugagcuuucaugugcccuuccugucuguucacucauggaccagccaagguuaaucucugccccaccagaaccuuccuuccauggagggaggcauggguggagaaaugccauucucuggcucagaggagcccuguggcuuguggcaggcaugcaucuaggccuguguaauuccuggcugaccucagggguuccccuggugccccagaccagugccccggaaagacuuuguagaggaguuugagugugaacuggagcccuugggcacccaggcaguggggccuaccaacgucagccucaccgugacuaacaugccaccgggcaagcacuuccggguagacggcaccuccgugcugagaggcuucucuuucauggugaggcuaccuugcccugucugugcccuuggccagugcaugguacgggaagggaggggcuuggaguggaggaccugccuaagccaccucuauguccucuuaggagccagugcugauagcagugcaaccccucuuuggcccacgggcaggaggcaccugucucacucuugaaggccagagucugucuguaggcaccagccgggcugugcuggucaaugggacugagugucugcuagcacgguaaguaccaccaggcaggcaugggaggccgcaggguucuauccagguggggacccggauucugucaggauggagggaagagugcuuguuacauggucagugugguguggagagcagguccaggaagaaaagacuacugcccucuucagcccagaggcaagagagcccaucacagaguccaauggcuccagccaaggcuguggggaaccuguucccuccuuacccucuugggaugucuuccugggaccaccuuauuuucagacagaccauggaguggggcaggugggagagauaacagacgaacugggagaggucaacaggccccuggaagaagugggccuggccaucacaaagaggguaaccuugagcccaaucucuuguuccuguagggucagugaggggcagcuuuuaugugccacacccccuggggccacgguggccagugucccccuuagccugcagguggggggugcccagguaccugguuccuggaccuuccaguacagagaagacccugucgugcuaagcaucagccccaacuguggcuacauguaagcacugccucuuugcccacucuggccucuggggaaugagagagccagcuuuggagaacacccaaagccuaccacccuacccucuuccacagcaacucccacaucaccaucuguggccagcaucuaacuucagcauggcacuuagugcugucauuccaugacgggcuuagggcaguggaaagcagggugagugagugcuggccaggagggaggaaggcuggaugaguucccugagcugcagcccaaccucgugcugggcugaggcgaggagcaaucacaggugggguuccuggcuaaucacucucauauuggucccagcagugugagaggcagcuuccagagcagcagcugugccgccuuccugaauaugugguccgagacccccagggauggguggcagggaaucugagugcccgaggggauggagcugcuggcuuuacacugccuggcuuucgcuuccuacccccaccccauccacccagugccaaccuaguuccacugaagccugaggagcaugccauuaaguuugagguaaguguaagggauaggggcagggacaguuggggaucugaaaguaggggccagccuacuggcugguccucaugacccucucugcaguauauugggcugggcgcuguggcugacuguguggguaucaacgugaccguggguggugagagcugccagcacgaguuccggggggacaugguugucugcccccugcccccaucccugcagcuuggccaggauggugccccauugcagguaggcagcccagcuggaccucccugggaaacacgggcagagggccuacaggcugggccugaguugccaccugcccccaggucugcguagauggugaaugucauauccuggguagaguggugcggccagggccagauggggucccacagagcacgcuccuugguauccugcugccuuugcugcugcuuguggcugcacuggcgacugcacuggucuucagcuacugguggcggaggaagcagcuaggugaguucucugcuccuaccuuuaaucagccccuacccccaaccaauggcaucuucaagucccuacauccucucucugcccaggacuuagggaucuaaguccuccccagaggggucggccccuaggagcuuggaaagccaagccaccaaggauucucuuuccacaguucuuccucccaaccugaaugaccuggcaucccuggaccagacugcuggagccacaccccugccuauucuguacucgggcucugacuacagaaguggccuuggugagauaguggaggcaugagaagcuaaagccacccccugucccuacaagcuccucauucccucuccccacagcacucccugccauugauggucuggauuccaccacuuguguccauggagcauccuucuccgauagugaagaugaauccugugugccacugcugcggaaagaguccauccagcuaagggaccuggacucugcgcucuuggcugaggucaaggaugugcugauuccccaugagcggguggucacccacagugaccgagucauuggcaaaggugugggggccagguggggcuggggcagagauggagucucaagaugacauaggcuaggccaggcgugguggcucacuccuguaaucccagcacuuugggaggccgaggcgggcagaucaugaggucaggagaucgagaccguccuggcuaacacagugaaaccccgucucuacuaaaaauacaaaaaaauauuagccagccaugguggcaggcgccuguagucccagcuacuugggaggcugaggcaggagaauggcaugaacucgggaggcggagcuugcagugagccaagauugcaccacugcacuccagccugggcgacagagcgagacuccuucucaaaaaaaaaaaaaaugacaugggcuaaagggacaguuggaacagauacugcucuaaccuucucaccaaccugugugaccuuggguauaccacuuaaccucucugagccuccauuugcucaucuguaaaauggggaugagaaaaguucugucuucaguggguucugguguggaucaaucaggcauaggaagauuguagccucugccaucaaguggcugcuguuuguuuuugguuuuauuuaugguuuuguuuuuguuuuugugacagggucucacucuguuacccaggcuggagugcaauggcacaaucauggcucacugcagccucgaccuccccagccucaggugauccuccugccucagccuccugaguagcugggauuacaaucaugcaccaccaugccuggcuaauuuuuuguuuauuuuuuguagagaugggccucgaaucauguuguccaggcuggccucgaacuccuggacucaagcaaucugccugccuaaccuucccaaagugcugggauuacaggcaugagccaccgaacccagccuguuuuauuauauuuauuuuauuuuauuuuuauuuuuauucuauuuuauuauuauuauuuuuuuugagacagaauuucacucuuguugcccaggcuggagugcaauggcgcgaucucggcucauugcaaccuccuccucccggguucaagugauucuccugucucagcuuccugaguagcuaggauuacaggcgccugccacaacacccggcuaauuuuuaguauuuuugguagagauaggauuucaccauguuggccaggccggucucgaacuccugaccucaggugauccgcccgccucagccucccaaagugcuaggauuacaggcaugagccacugcccccagccuauuuuauuuuauuuuauuuuuuuuuuuuuuuugagagggagucucacucuuucacccaggcuggagugcaguggcgcgaucucgacucacugcaagcuccgccucccagguucaugccauucuccugccucagccucccaaguagcugggacuacaggcgccugccaccgugcccggcuaauuuuuuguauuuuuaguagagaugggguuucaccguguuagccaggauggucucgaucuccugaccucaugauccacccgccucagccucccaaagugcugggauuacaggugugagccaccgcgcccggccuauuuuauuuuuucaagauggagucuugcucuaucacccaggcuggagugcaguggugcaaucuuggcucacugcaaccucccccucccagguucaagcaauucuccugccucacccucccuaguagcugggauuacaggcgcccgccaccacaccuggcuaauuuuuguauuuuuaguagagaugggguuucaccauguuggccaggcuggucucaaacuccuaaccucaggugaucugccugccuugaucucccaaagugcugggauuacaggcgugagccacuguauccagccuauuuauuuauuuauuuauuuauuuauuuauuuauuuauuuuugagacagaaccucacucugucacccaggcuggagugcaguggcaugaucucagcucacugcaaccucugccucccggauucaagugauucuccugccucagccuccuaaguagcugggauuacagacgugcaccaccaagcccgucuaauuuuuguauuuuuaguagaaauggaguuucaucauguuggccaggcuggucucaaacucccgaccucaggugauccgcccgccucggccucccgaagugcugggauuacaggcgugagccaucgcacccgacccugcuuuauuuacuuauuuauuuauuuuuauuuuuuugagacagagucucacucuauugcccaggcuggagugcaguagugcaaucucggcucacugcaaccucugccuccuggauucaagcauuucuccugccucagccuccugaguagcugggauuacaggggccugccacugccaccacaccugucuaauuuuuguaguuuuaguagagacgggguuucaucauguuggccagacuggucuugaaccccugaccucagcugauccucccgccccagcaucccaaaguauuaggauuaaaggcaugagccuuuuuuuuuuuuuuuuaauuuaaaaaaaagacagcaucucacuauguuacccaggcuggccuugaacuccugggcuuaugcgauucucuugccucagccuccugaguaacugggauuacaggcgcacugcgcuuggcuucugcugcuuuucuuugagggggauggagucucgcccugucucucaggcuggagugcagugacacgaucuuggcucacugcaaccucugccucccggguucaagcuauccuccugccucaggcucccaagcagcugggacuagagaugggguuucaccauauuagccaggcuggucucaaacuccugaccucgugauccacccgccuuggccucucaaagugcuggcauuacaggugugagccacugcacgcagcccugcugcuuuuuuaaaaugucagauugggccgggugugguggcucacaccuguaaucccagcacuuugggaggccuaggugggugaaucacaagaucaggaguuugagaccagccuggccaacauggugaaacccagucucuacuaaaaauacaaaaaaauuagcuguguguaguggcaguugccuguaaucccagcuacucaggaggcugaggcaggagaaucacuugaaccugggaggcagagguugcaaugaguugagauugcaccacugcacuucagccugggcaagagugagacucggucucaaaaaaaauaaauaaaaauuaaaaauaaauaaaaugucagauuggccaguuuagugcucugaggucugguugccaaugagaauguguggugugagccuugggcccuggauccccucucaucgacucauuaugcaccucacaccaggccacuuuggaguugucuaccacggagaauacauagaccaggcccagaaucgaauccaaugugccaucaagucacuaagucguaaguggggcagaagaugggaaggcagagggaggggccucaggcugggaggauucuuuuucucuguguucccaccuuacugagugacccugagcaggagaccuucauuucccauuuccccaucugagccuuauaaagggacgcccugcccugugccugacuugcgcugcucugcaggcaucacagagaugcagcagguggaggccuuccugcgagaggggcugcucaugcguggccugaaccacccgaaugugcuggcucucauugguaucauguugccaccugagggccugccccaugugcugcugcccuauaugugccacggugaccugcuccaguucauccgcucaccucagcgggucaguguucaucuggcucuggguugggggcugggcagcagcuggagaaggagcugcugugcccuugcccaccaacccaccugugcccccagaaccccaccgugaaggaccucaucagcuuuggccugcagguagcccgcagcauggaguaccuggcagagcagaaguuugugcacagggaccuggcugcgcggaacugcaugugagaguccagaguagcuggggugaagcaaaaggacagggcaugagggugugcggugcucaaggccgccucagggaagggcccacuccagccuuguccuccccucucugcaccuuacuuuuuuugucugcccagugcagacuuggacuggacacuguggcuuugaaauuuggccaggcgcgguggcucacgucuguaaucccagcacuuugggaggcugaggaaggcggaucaugaggucaggagaucgagaccauccuggcuaacacggugaaaccccgucucuacuaaaaauacaaaaagauuagccaggcgugguggcgggccccuguagucccagcuacucaggaggcugaggcgggagaauggcgugaccccaggaggcagagcuugcagugagcggagaucgcgccacugcacuccagccugggugacagagcgagacuccgucucaaaaaaaaaaaaaauucuguaagggccuagaacagguggguucagggccugguaagggccaguccuaagugugauccucucccuaccccuaaggcuggacgagucauucacagucaagguggcugacuuugguuuggcccgcgacauccuggacagggaguacuauaguguucaacagcaucgccacgcucgccuaccugugaaguggauggcgcuggagagccugcagaccuauagauuuaccaccaagucugauguggugaggccccaccugcccuacaguccacauggcuuuggcacccaagaacacugggccucacccauucagcucugaaugaucugagcccagggaguccccaggguagaugacccccacagcccaucugcucaccucuugggcagauguaagauggaaucugacaccugccagggcuagaggaggcugggaacucacuggcuccucacagauaauccagggccugcccagccccaacucuggguaggaugagguagugggaggagacagaggaaagacacaggugauguauugaggaaugagcucucaguggaggguagggucuuccauuuccagcugaaggacucugggagguagaagcccugggggacccaccugcccccaaauuuggggugaguugaguccccucaccucccccuuuccacaguggucauuuggugugcugcugugggaacugcugacacggggugccccaccauaccgccacauugacccuuuugaccuuacccacuuccuggcccagggucggcgccugccccagccugaguauugcccugauucucugugaguauguggaggugguaguggggagggaacugggccccagagacauggaagagacaggagacagagcuccugccuggcuuccugacugaacuucugguugacuaggaaagggacucucgcugggccucaauuuccucaucugugaacuggucccacccucaugcagaguaggacccugggaggaccucacaguugccaugguaacagcauucugagcucagaguugggguugaggcccgugguuugauuuucccagugcuccuccuacccgacucccacuaacggggucugcuuuccaccuuuuccucucauuuaaucucgaggaaagauuccauaacccccacagcaacccccucuggaucuccaggucagguuuuuucacuguaugugguuucagauuccccauuccuggagggauggcggcagcugcauuguccucagugccuacgggguggguucggugcugagguucagcuucauacguagcaggugugccugagcuguggcuaggucugcuggguuagaacagagagaaccaggacauagguaaaaguaguuaacgccuccugucucaggcugugcuccaagaaggaugcgaguagcccuuccucacaguccuaccugccuuggguuugcucuuacuauucacuucuuuaauucacugccuacccauauccagauugggcuccuggaaacagacucagcuggagauuuauguacggggauuuacugagagguugggggcaagggaagaaggacugggcaggagaaaugucacagaaacugcagcccaucccacagggacugcuugaacugggaugacccaccacaguuuucugaaauugagaccaacaggccaggucuuuguaccaggcauuaaucaguuacuagucacaggcugucccuggugaggggaugugagcuuggcagaggcaguucucuucugccuagggcaauuccuagagagagccucagucaagaaccaucagcaggcaacacuccuagccacugggaaaguaaagggguaucuggguggcacaccauaggguccacuucagcaguccagcccuucuccucucugggccucaauuuccucaucuguaaaguggagacaacaguaccaccuuccgagagucugagaauuauaugagauauuguguguaggguagaguauuauuucaggcaggaaugacauccccaagauaauggggcaggcacuaggacccagcagguaaaccuggggaaccucugcuucaggaccagggugccacuggugcugccccaaaugcucuugcuucagaauuuuuuuuuuuuuuuuugagacagagucucacucugaugcccaggcuggagugcgguggcgcaauguuggcucacugcaaccucugccucccagguucaagugauucuccuaccucagccuccugaguaacugggacuacaggcgugugccaccacgcccaguaauuuuuuuuuuuuuuuuuugagauggagucucgcucuguugcccaggcuggagugcaguggugcaaucucggcucacugcaagcuccgccucccggguucacgccauucuccugccucagccucccgaguagcugggacuacaggcgccugccacgacgcccggcuaauauuuuguguuuuuaguagagacgggguuucacuguguuagccaggauggucucgaucuccugaccucgugauccacccaccuuggccucccaaagugcugggauuacaggcgugagccaccacgcccagcuuugcccaguuaauuuuuguauuuuuaguagagaugggguuucacuauguuggccaggcuggucucgaacuccugaccucgugaccugcccaccucagccucccaaagugcugggauuacaggcaugagccacugcccccggccacuucaggauuuuuaauuccugcuuugcuggacccaggcuuccuuccuggaagaacugugaugaugaccauuguaccucgugagcugggccuugugccuagcacuucacaggcaucagccuauaugccuacuucucugugaucagaggaggacccagaggcacagagaaguuaaggaacuuauccaagaucacauagcccaggccacagggcacaggagcccaagcucuuaacaccugagguaguucgaccucugccagggugggaaggcaggacuggaacaguaaucauagggaugagaagagcugccccugauuggguagugcuagguacuagguccugucaucuauccucaucccuguguggccugccagagguuuaacagcaaguggguggcccagaauccuuggguggaaauugccuuaaccugacaucccuuucccccaacagguaccaagugaugcagcaaugcugggaggcagacccagcagugcgacccaccuucagaguacuagugggggagguggagcagauagugucugcacugcuuggggaccauuaugugcagcugccagcaaccuacaugaacuugggccccagcaccucgcaugagaugaaugugcguccagaacagccgcaguucucacccaugccagggaauguacgccggccccggccacucucagagccuccucggcccacuugacuuaguucuugggcuggaccugcuuagcugccuugagcuaaccccaagcugccucugggccaugccaggccagagggcaguggcccuccaccuuguuccugcccuuuaacuuucagaggcaauagguaaauggggcccauuaggucccucacuccacagagugagccagugagggcaguccugcaacauguauuuauggagugccugcuguggacccugucuucugggcacaguggacucagcagugaccacaccaacacugacccuugaaccaauaaaggaacaaaugacuauuaaagcacaa

SEQ ID NO: 21264 - RNA, 61481 nt, Homo sapiens
cuugcccccggccccgcccccuuuuuggagggccgaugagguaaugcggcucugccauuggucugagggggcgggccccaacagcccgaggcgggguccccgggggcccagcgcuauaucacucggccgcccaggcagcggcgcagagcgggcagcaggcaggcggcgggcgcucagacggcuucuccuccuccucuugcuccuccagcuccugcuccuucgccgggaggccgcccgccgaguccugcgccagcgccgaggcagccucgcugcgccccaucccgucccgccgggcacucggagggcagcgcgccggaggccaagguugccccgcacggcccggcgggcgagcgagcucgggcugcagcagccccgccggcggcgcgcacggcaacuuuggagaggcgagcagcagccccggcagcggcggcagcagcggcaaugaccccuuggcucgggcucaucgugcuccugggcagcuggagccugggggacuggggcgccgaggcgugcacaugcucgcccagccacccccaggacgccuucugcaacuccgacaucgguaagcgcuccuggugccccgcccgagccccacgcugcagccaggacugcagcgcugcuuagggaggcagggcgagccccacuccuuuccucugccccaggagaggggcagacgggguuggggcggaguggagaaacucgauguccuugggcgggggcgcuggcauagcugagaggggaagaugcccugcagaggaaacucacaguggcugagggagccccuggccgccuuugcuuuccuaacuuaggucgugagguuccuaccgguccuuuugacaucuggaaaauguccccauucacuacuaacggaggaagggcuagaagagaaggguggggaaaggguucccaaaacuuggaaugcuaacuaaagugcugggaaauugaauaguuaaaaaaaaaaaaaaaaguugcccgccaugugcacggaaaguugcaggagaaacuuggaguacuccgagucugcaucaucuccugcgccuaugaaauucauucuuuucacugagacccaacccagcugcaggcuucccaggcaagcgcuaaccgagcuucugggacugccaaguuuggguggauuuaagggggaaaaugaggagaaagcuguggcauugacccacgcccuggaggcacuguguuugagaguguugauagccagcagaaggugcgaggggucacucaccacauagcugugaaaauucacaggaaggcuauuuuuuucccccuugaauguguguggggagggggagaauggguaguggaaaacagauuugucaccaaaagaacaaaccugccaagggucacaucacggugacaguuccagacuggacuuagugucuugaguagagagacccuguaaagagaccuccuacuccuuaguguguauggagggccccgagagcauccugggaggcuugucugggaguguuugggacacuuguguuuggauggcuaaagguggaguggcaucugggaaacaucucucuccuccuuuccagcccauaaagcgugcaaguccaguggcucugcugggagagugugugugugugcacugggcugggcugggcgguggggugggacagccuugccgcccucugccugugucgauucagaggugaagaauggagcguguguguuuuaaguacagucauaaaggagaaggaaauuuuccacugagucuugggugagggacucuaccagcguguuguggugaggagggggaggagguaggagcuuggcaggggaggcagugagggccgggaggggcacugcuggugggcugggcugagccuagaggucagaguggggguguggugaccagaaugucagugcaguuggcagcugaggguguuugugugaccugaggucacccuuguaagaggcucccuggggccugcaugguacauccuccccucuccugggggaacccagcuggcccaggauuuguggauugcuuagaaagauccuuuugggcagccugaagacuggggaggguuuuccucccuccuccaccuccacccacauuccacuuacccuuucccuccucaucccaguugguaacauucccaccugauuaguguggggaguugcugcugcagcugaguucugguuuugcccagcaggaucacacacgugcggccaggaggcuggcagguggaaucagggugugcaggggugcagcccaaguccuuuucugcuggaaaaugggcugggugacuucacuugcguuuuuuugguauguagugggaguagguccccauucuucccccuugcccuuugcuuugggguuucuacccuaaaaauugaccacggaaaagugaaaacaagcaugaguagauccugcuuccaaugggggccuucccgucugcuuacugcuuagguuuccugcggugggucugagcaaugcagaaaguuucuuacaauuucucuggauugaaacaagaaauagcucccucgcuccucuucauaaauuucucagagaaaaucuaaguuaccaggaaguagccaaagaccaggagauuguggaaucaaaaagaaaaaaagaaacaaaaaaucuucgaugcucuggcacggaucccaaauuguucugccuggguuuggugagcugcacuaguggcagggaugagcuaaugcuuuuaaaaugggaggugugggugugagcugcuugccugccgaccucccucgccuugcacagcacccugcuggcguccaguacuuggcucccaaguuucauugcucagagccuuucugguuuccagucuggguugaaacugucuauucucgcccucaaacaaauaugaaggagcuccccauuccuugggacccacacaaccccaccagucaacuuuguagcccccuaaagguguucacaucagcccaucaacuuccuguuuuaaaaccaucauggugguuuucucuucauggcuuggugccauguuggccuagcaaaaggcacaggaggccuggccugguccucuccggggggcugcccgauggccuuuccuccugucucugcucauccacaggugucucuuuuugucuuuuuuccccaaaguccuagggccuggcauggcauucugggggaggaggaguuaaaagguguuucuauggcaacuccaggcccugcacccuauggaaguguuuaggagaagaauaaacuacaugccggcuuauaagacacacugugggggaaagaaagggacuuggcagcaggcaggaugucuguggucccccucccuggccagucauugccccugaaacuccugacaaaaccuugacucuagaagaggaaugggagggggcuggagaugaagaaggcggccucggcccgggcaaaucugcccuggcagcucuguccagcucaggaaggggugggcugugccaagggcuuucugaaaaugugcgugugugcgugugugugugugugcgcguguguggcuucugcaaagguggcuggcagggcugagggggguugcagcagagaaagagaauuuugcuucagaaugccaagcccuucucuccuucucucuugccgccuuugcaugggaggaauggggcuguaggaugaaguguguucggggccugccucugagccuguugggaauuugagcaugaggcucagcuggggggccggcugccagccccagaggauggccccuggauagcuccaaauuguucugacaggggccagugccagcagauucuuucaguaucagaucugagguugucguuuuagcaaagaagccauuuucaaagaaaccagauccauccccucucccucuuacacacaauuacaccucaacacugggcuuugcaacuuaaggaaaauagaaagaaucagacuuuggagaggcgccagcacuugguagggcaagucugggggacccaggcuguggaugucuuggaaccauggaaggaggagagcugcuauccagcuggaggagggaagagacaugucuuaggccccuccugguugcacgcacuucccaaaugccaucucuuucacccccucccccgaccccccacagcaaccuuaagaguagguauugcacccauuuuucagauggaaaacacugaggcugaagagacugugcuuguccaaggccacccaguugcuaaaugauaaagcuaaaacguauuaucaguuauaccaugcuucaaaaaccuuucaacuuucauugacacaugacauucuaaggugaccaggagauggaauggaugguuaacauuugaagaaugcuuuucuucuacaucuggguuuucuuuaaaaauaugaagauagccaaaauggccagagguuuuaauuaaacaucaucuuuagggagggagagcuuauuauuauucuaguguaucauagaggaaaauucuaauguucuuuggcuauuagaucuggaaaagacccuugaaaccaucaagccacaguaauaaaaggacuugguuugucucacuguggcccaaggagaaguaagguuaauagagacaagacauuucagggcuucaagacucuucccuuaaaggugggaucaguuagggcuccccagugggagguacccggucugccagugugguaggaggaaagccagggggagucaggagacugggucccagcuggagaaggugccccucugacaguucugugucccuuucacagucccuggauagauaaggcuagaaaaguggccacagaaguagcuuggguggagggauuuuuguuuguuuugcaugaacagcaggaaccauucagcuccacugcugaauggcacauuccaacagguucauuaauuaaaaacaaaaacaacaacacgauucuccaucgcacuuggcuuuuaccauuccagccaguauggacaaggaggccccuucuucuaccuuuugucauagucuacuccuggguggccuugagaggcaggguggagugguggaaaggcaauggggagggcagaucugagcuccacuccuuccucuggggcuuguuggcugugugugccuaggcacauaugggcuaccuuugagcuuuaguuuucuuauuuauacaaggggaauaacaauuuguaccaucuuggccuguuuuaucuauauuuuaaaagcuacaaguauaugaauacauucuauguccauguauguaucucucuguauaucuaugauauauccauuucuauuuaucauuuaucaucuaucuaucuaucucucuaucuaaaaucggagaagaguaaaauccuuucugauuacuuuuucuaacucuagucccuucuccaaauccuuuucuuccuauacauuuacauacauagguauccauagcaaauuuauaguaguuuuucccuuagaaacaugaauaguagaacauuaaacaucauggaauaccacauaauaccacauauaguauucugcuuguuucccauucaacaaugcguacuagagaucuuucuacuuaauauauauauaaaacugucagaggagcaccuucuccagcugggacccagucuccugacugccccccuggcuuuccucccaccacauuggcagacuggguagcucccccuggggaccccuaacucauccccaccuuuaagggaagagucuuggaaccuugaaaugucuugucucuauuaacuuuacuucucccuggccacagugagacaaaccaaguccuuuuauuacuguggauugaugguuuggaggauauauauauauaaauauauaauauauaaauauauaauuuauauauaauauauaaauauauaauauauaauauauauuauauauaauauauauuauauauaauauauauauauuauauuuacauauauauuauauauauaauauauauauuucuuuuauguauuucaugagguuauaauuuuaaacagcuaauaaguauagagugauuacuaugugccaggcauuauucuaagucauuaacuuacauuaacucauuuaauucucucaguuuuaugagggaggugugcuauugucaucuccauuuuacagcugaggaaacugaggcuuagaaaaaugagguaacucguuuaagguuauacugcuagcaaggaauacagccuguauuuaagccccuucacccuggcucuaaaauauauuuaacaacuauacuauaggucacauuauaccauaucauauuauauauacuacuacauacucuuauauuauuauaauuauauaauaugcauuuucaauuuuaauaguuccugccaauuuggccuccacaguggcuguguuaacacaguucuuuucauauaugcaacaugaggggauggaggaauguuagagcccugugcuuaagagacucccaugcuucucucaaauagaaaaacaauuuauaauuuuuauugacuuacugaguguuuuuuuuccuucuuuuugucucuuugaaagggagcaaaauuagggccacgaagaucaaguuaaugggaguauuuucauagggagaggaaggcugcaaugccaggaaagcugugacccuugacuuguugcaugcuggaguaauucgguugaagauagcuuuauguauuuauuuugcuuucagaauaagcaguggaccauuuauuacaccaaguuguuugacuuugaggacuuacauggacucagguucaaagguauauguggcuguguuuugaacacacauacacaggguuuugcuuucugacucaaagcuguccgcuggccaggcucaugguggcagcaagggcacucacucaucugucucccuucuuguugccuauggauggcacuugggugagagcagugggauggucacaaggaggaggauggacugccgagagggaggcuggguggaccccagccaagaaggacgcuggggucucauuauuaugggagcuagaaggccugguuuaggaaagaauuccuguucugaugaaagcucuucaguggacucuuaggauaaaguaucaucaaauggcuuuuacaagggccaguguggacccugccuaccucauccucauagucucaucacuggucuguccugcuccagcuguucauacucugucucucuggcucuuggcccaugacacccccucgguuuugaacaguccucauuaacuucucauucucuaggucuccuuugguuccuuucccugaucacuccuuggcauugguacagacgaacagucauaaaccuugcccauauuuuaagcaugcugaaaaacaccaucucuaguaaaacccaaauucuccaaagcugcaugggaaacucccagaggggaucauuccugcgcugggagaaagaacuuagggcugcgugccacccagagggauaaaccuaacccacuuuagaggguaagcacccacuaugcucucugcauuacuugauaagucuaguccugucuucugguggacaugauacccuagcacccucccagagaagaaaguggagauuucuaaaugccaacccugcaggagaucacaaacauaauacuguaauuuucauaguaaguuuggugcccuuacuaugugccaggcacuguaccaagcuccuuacuugccuaucagucaucccagcugccugaugagcugucucaggcuagggaagccaaauggcuugcccaagcucacaccacuugcaaccuauacuugcuuagccuaucuccaaaaccuguguuuccaaucagucucucauauagaccaagggcuacaacuuuuuagacuugggaagauucuacccauuuugcgaccucuccacaugagucuuuggcuccccacuguugggguccccgucagucugcuuaucuuugguuuucuuccucuccagacaugccuucccugcugcccccaaauuuuauuacuguauagucaguucugggauccuaacauaaccaagccuuaccuccuaacccagugcccuuucaacucucucagugguucccagacuuuucaacacuauggaauuuuuuaaaauuaauuuuucccuccaauaaguucuguguuuggaacaguuauccgacacaauuucauguguugaguguugauuaacuuuccauuaaaaaacaaauuaaaauauaacuagaacugcugauacuagccagucauuauucugacacaaucagcuaauauacuaauuaauuauagccgaaagcaaggacgguugguguuuucauaagccugggaaguuuucucauggguuccugggugauugcauugucggauuuggguuggcuuacugauaugccuaaaauagcuccuggcuucuuugguauaucgcuguccuuugccccuccugagaaucuuuaguuucaugccagcuuagcaucucuucucccugugggcaggucccaugcauuuacugccauugucacuucucccuguuacccacagugcugccaccaugccugggauagacagcagguaacugauguguccuaguugaggucccuauccuuucagaggaggugacauggguucagauauuuuccuauguucaugucuggcauccagggguacacaaaguauugauucuagcuaaagggacuuacuaaauacuguuugacaggaggcccacaggugucuaugugggcugcaguggaacuaagaggucuuuuuguucagcuguuaaaaaauuaguguuuguagcuucagaggggccccagagaaccuuuccugacccauuuagaggccaucuguguggcuaggauggcuuugcugucacagaagggacaguccacacuacccaacacucaagucugauuuauguucauguaaauccgaucaccuaaugguggcauucacggcuuggagacaagaaacuauaaguguuuccaagccugcagccaccuggcuuuuuguggggguggggaagggaaggaaagcuguacgaucuggccucagagagcccaagguaaaguucaguuaguggaaaaacagagcccuagaugauugggcgggggguggguacuggggaguggagaggggaaguccugagcugaccaagccuccaagagccauuccggaacuagagaucuuaaauacuacaugguaauuauccccucugccucugcccaugagggugucaggcacagggccgccuggcugccugcagagaagagcuguuucauucagaaacuucagagcuccugcaaugccuggauuaggauguggggauggugaguuucgcaaccagggucagauuucaugaagacuugguuucgugacuugagguguuugacuaagguguuugcaucucauguauuuaggaagggcucccuuuugacuuagacuuuaucaucaugaauaagcucccugccuuuucgauuuggaaacaugauagcucuagugagcucugcuacucccaagcuugggcagguucuuugccucaguuuccucaucucuaaaauggggggaaauauauuauguaccacgugguaacuucauuggcaauuaagugaaauacuucauggaauguuuagcacuaaauauuccuuaguguugaaaaggcugggaaccacugagacaguugaaagggcacuggguuaggagguaaggcuugguuauguuaggaucccagaacugacuauacgguaauaaaauuugggggcagcagggaaggcaugucuggagaggaagaaaaucaaagauaagcagacugaggggggccccaaaaguggggagccaaagacucagguggagaggucgcaaaauggguagaaucuucccaagucuaaaaaguuguagcccuuagucuauacaagagacugauucuuggcacagaauagcucaauaagaauaagcaugagcuuuuaguaguaguguuguuauagagcagagcugauauucucacuucacuuucggugaggaaaauggcgcucuguggugugaugugauguuuuccagggucauauagagagagcugaguuucaauucaaaaucgugguuugauccccccgccuccaaaucuaauguguuccauuuugucacagugcuucccacagggcagagaaagaaacaacaaaguuccuacucuauuuucacaacucuucacauuuuagagucuuaaguccauuugaucucauuugaugacaacuucgcaacgaggaaagcaggauggugauuggggggucggucauaguuccuaguuaguggaugucaguauugagaauggcgggguucuguggcuuagccauauagccaauacauggaaugggauuggaacccaugucuucugagggcaagcccaacacuugucaaggaucuggugcugcccuucccucuuuagacagcucccauugauaagcagagguagaagucacuaggguagccaaagagagggcccuagaaauggaauggugacaaugaacuuggcugaagagucagcaaccgcuccccuauccacugccagggcuaggaggugcaguguggcauggaggaggagcacuggcuggaguuaggaggccuaaggucuaguccuaguucaucaucugacucuggaguccccuuggugauacugaccucccuggguuuggucucuuaucuguaaaacagcaggauauuggcucuaugugguguguauuucacugaaugccuacuauggucaaguuuuucuggcucuaaguucccuuggaaagggcucucuacuuuagcugaauaacucagcaccuaaaucugucaaccacacccuucaguagguaacuuuguuagaaauauggucuauuaagguaagagccaggauuucugugguugcaaaaguggaugcgggcucugaacaaaaccucuagugagcugagauacuuuaucagaugacauauuugaccaccaaacuucuguuggagcagggcugauuugccaaacagacagcaaccuugcagacuuagucgauggcuagaauuaagacucaaggucacuucagggccugucacugauugugggagggcuugguaaaaauugaaccucauuaacaccacugaagaagcugauagacaagaaaugggauuaagacucaauacucaucaaaauaaggcuuuccuuauccacagccuaccugagcagugccucacucuggaaaaugugguucauggcucggcucaaacauuuucuguugcugagaggacuucucucauggaagucuggcucagaugaacacaugugugaucugauggaaccuuuguuuaagugaaugaggaggguauuuggaagacuuagaucaaacgugugccccauugggcagucacuaucugcuccccugacagggagaaaccccagugacaggauagaaagcuccaaagauccugaggaaguuuggaaggucaaacuucaccacugcaaggacugagagauccaagaaucucagaauccagguuggucuccagggugcaguucugaacaaaugagugcaguggauaaaaagcuuauacuuaaggugggaagguggguguggguuccaguuccuucuuuggcugauucucuuuuggccuggauuuccucacuugucauccaugccaugucacaaacccagugccuacagggaccaggcacagaagcuggauauuugaguaucagacauauuggaauauuacucacuccuaccaaauauguuuaugguuccccauucucuugguuuccauuuuggagagcuaaacagguacuaaaaaugauuucuuuauuauaagacaagcaauaaaacagugggcaagugugaugauaaacagcaucugagcuuuggcuuuggaguuggggagacaauagagaguggcaguaacuguggugaaccguacaguccaggucccuucuggaggggacagcugcuguccagcuccagccuaucaggaugugagucuagugaugccagauuuccagucucuuaggacaagcaagaaauccaaauuuuuaauguaacaucuucugaaaagauacacacacacacacacacacacacacacacacacacacacacacacacacguggaccaaacaaaacauguccaugggccagauucagccuugugggucaccaguuuugugaucuggaauccauuuuauuucuagaaucuccuuucaauucucggaucucugagugaguaacacccaauuuuuuuuuuuuuggcaaaauguguccugcauuucccacacuuucugagcuggagcacagguucuggaguuagaccacuuggcucaaaccuuggccucguucauggcuaguugccugucccuggacaaguuaauucccuggucucauuuuuccuaucuguaaaauggaguaugcaauaauaguacucuuaaccucauagguuguggaagaauucacagacacaauggaaauaaaaggccuggcucauugccuggcauguaguaaggaccugauaaaugucagccaucauauuauuacuacaugguauuacugccuccccuuagaugggagccaagucuugcucaccagcucauugccugauguuaguaggcauucaauaaaaguaucaugaaugaauaagaacauuugagaaagacagcauuccagccuuuccaggcaauacucgugugugugugugugugugugugugugugugugugagagagagagagagagagagagagaaagagaaagaaagaaaagaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaagagaaagaaagagagaaagaaagaaagaaagaaagagauugguuugaaacauugggagcugagcuuaaugagaaaaggccauuccuaacugcuaagcuaccguauuaaacaguggcaaguaccuuggaaaauaaaacagaaaccacugcccaucuuuuucuaacggagaaagacaagagauggcuugaccagaguggagauuuagaacuucaggugcugauaaauaugguaacaucauggggugcuuuggcagcuggauagauuuuauuuauucagggcuccuuuaagccagaggagauuccuggaggcugcuaaaauagaaugcuccaccuggauaguuaacaucuggauuuuauuuuguuucaaaaaguuaauuacaaauaguucgaauuccuucugguaucccucugagaagaguuucuuacuggguggcucacaagcggggagacagaaagggaaaaaaacuagauugauauugcucaggagaaacaggauuguggcuacacgugagccauguaugcaauuuugaauuuucccauagucauguuuaaaaaaacgaggaaaaagugaaauuaauuuuaauacuaaacccaauauguauaaaauaugaccauuucaauauguaaucaauuuuacacuuauuaauaagaucuuaauauuuuuaaaauuaaguuuuugacauccauuauguauuuuacacucauagcauaucucaguuuggacuaguugcguuucagcuaccugugguuaguggccgccauguuaauacuacagcacaggucaagauaacauuugcaaaggcaaggcaucuuccccuccccauuucuaguuucaugaacugugcacagggauauggggcuguucgagguacuuuugggcugaccaaggcucagaggcuacugacagcuuugcugcaaguaacuucuaggccuugugggucccagugcagggaacccaugugcggugacacuggagaagccaucugauccaggucucucacuugacagauggggaaacugagguccaaagagguacagcagcuugguuuaagagauagagauggaacuggaacaaaaauaauaaccauuugauaauauuuuaacauuuauugauuuguuuuuauaugccaagaccuuuuaaagcauuaucuccuuuaaacucucauaaccacucauugagguaggcacuccuauuucuacuuugcagaugaaaaaaauugggacuuaagaggaauuaaauaugaaagcagcuacuauuuguugacagcuauuuuaagaucuuuauauacauauauacauguaauaaauucuauucuuuacuauaaacauacaugucagaaauuauuaguguuaucauccuuguccuccucauuccacuuugcagaugaaaauacugaagcugagagagacuagguaacuuaccuaguauguaccuacauagugaagccagauuugagccggaccuccugacuccagaguccgagcaaucucaccaauucugcccacggucaccccacugcaugauggcagagcuaguauuugagcaggugugucuguucuguggucuguggucuucaccgccccacuagacagccuggauuuuucugcucuugagucucaacacuuucugccuuacugugccacuaguaaggaacagaacagggagguuuuugaccccagcacugauugaagggcccaggcaaagcaggcucgucuccucuggcuuggcugguucccaggcugcccuaacccaugaagccagauucuuggccaaguuaagcagggugggaagaacacuuguccauuccgccuucccaguugggcgaggucaguguaccagguuggaaagugguaugugucuaauugcaggggcggggguaggggggaggccagaggauuaacacucuuuaaauagacaucagaaaacuaagaauagccuugcugccugguaauugaugggcauuccugacuacgggccacacacucaguaggugcucgauaaacaugggugaaauacaggaauaaacaaauacugaaaaugggucauugggugagcacuuagccaguaaaaaucugugcuuuguauaaaaagaacuuuggacugagguuauaugagucuuccugcaggcuggagaccucuguuaccuuuacuucucuacuuuuguugucuugagaccagcuuuuuuauuuuuggugaggagaacagcaggcaguucaaaugucagggaaagacaaguucagcuugcuuuuuccuuauuucugucuuguuaccugcuauccugccagguuagaaagauggaaucacucccuuuugcccuaucaucaagacuucaguguucccuggagcacucuaaauuugccaucagacuuggaucauccucuaauaccaagcuccuggguccuuccugaaggcugccuccuugucuugcugagaagaauuaaggucgcuucccugggaggaauucagcagcaccucuuguaagucaucaggugugcuguaaggauggggcaggcaacauuucuuuguacugugggaaggccuaaaucaguguuucucaaggugugauccuugcaccaccaaucuuaagaaauguucuuuggagccgggcacagcggcucacgcauauaaccccaccuugggaggcugaggcgagaggaucgcuugagcccaggaauugaagaccagucugggucacauaguaagauucccugucucuacuaauuuaaaaaaaaaaaaaagaaaaggugguugggccuguagucccaguuacucuugaggcuuaggugggagaaucgcuugaguccacgagguugaggcugcagugagccaugauuguaccacugcacuccagccagggugacagagcaagacucuaucucaaaaaaaaaaaaauguuauuugggagagcuguuuauuguauuccccucuuggagagacauguggcuauuagcauaguaaaagcucugagaaguccugcugcauggugaccuguuuagcucuguuuaauccaguguucucugaacauaucuagccaaggaacuaauuuucccaagaagcaccuacaaaugcaguuggugagacacugcccagaugaggauucugaaaaccccuuuugcccacuugccugccauugugauugcugaguagggaagaagaaauuaggaaguaucaucugcauuacacagggaagcugcucuccuaggguugccaaacagaaauggcuguaguggugccagugggugcuuuguagggaccagaagaaaaaggaggaagggaaggcugaccuucaaggucacacauuugccagauuuaaaguuccuuccuguggucaugacuuguuuuauaaucuugcuuggcucaguucugggcacacaucagauuuuuaaauccuaggaucuuguuuauaccguuaaggacaugauugaaggacauuguggugagugugaaggugagauguuucugauugaagguccauggggcaggcacccugcgagcagguaaugaacaguaggggacauaccggugcaaccccacccugguccccuggucgucugggccagaucucuccccucucuguucuauacuucucuuacaucaccguccuaccuaaucauuuuaccgauaggagcaccuuugggauucugauuaaagcuaugcauacaaauuucaagagcuucagaaauucuccuaaaagcuaucuuggaucauuagaacacuugcccuagaguaucacugagucaauaaugguguugaaacuaaacagcaacaaaauccccccaaaaagguaaccuaacuuagucugaaauugucugaaaauuaauggcacugccaguucaguggcugcucagagcguuuuggugaagaaauuggcugauggauauuuugcaguagucuacaggauuugacgugggaugccaucuuuauggacauggcucugcugggcaaagcaaggacgggcacauccagccuaugcgguccaucaggggcacucacauuuagaaugggggagucuuaguuagcccaggggcugggggcagcaugguaguguagaaaaaggggccagugccuccagaaaaugggaccccaggccuggcucugcuccuucugcugugugauucugguugaguggccuucccuuugaguccucuggaugaaguuaaggagaagucuuggguucucaaguagucacuauucagacucucgcuuucagaguauuuaaaggaggaaaggaaacagaaggauagggcugguggacuuaaaaggccguguguuugccgccaccccauuugcucccagggcuggguguuugucuccccuccggcgcugggccuccugcuuggccuccagcucuugcaccauuaacugcagucagaaaagcugaugucacuguggccggccuagggggaaagucucaggauaaaacugcuuccaccuggaucuggagaaggggaagugacuggcaagagauucgcagguagggcucagagaccaggaggaauccagucuggguaagaauucccugucauggggcucugaagccacgggccaggcagguaguggauuucaagccagccagcggggucacuuggccccugcagcuacuccucgcccccuccugcauaauuuccuauuuccugccuccuccuccucugacacaguuauaaauaaccucgaggcuggccucugcgcuuaaguauaggugagccagaggaaaguggaggggaucaagguggagcuggaucugccacuuggccagggggucacaggguuucagauugcucaggggaauuuuguuuucuuguuuuuuccacuagggagugagguagugaaagaggaaauaagcuguguuggcauggggaggcuuggccuugcaggccggugcuggguuucacccgcaaggagcugccucucugcucacugcagauccccaggaccaaaggucuggaaagaggcuuagugagaaggcaucucaggacacaaagaggacacgaugccuugcuggugagguccugcggucuccuucucgaggcccagcccggccccauauuggaggccaaacauguagaaggguguaucucauuuuuuaccuuuuuuucucaaccaccagccaacgauggguaugugauuucuaaggauguccauugacuauaaaggucccauuaauacauaugcuauggacagauucucuccuugaacacagguuuauggagcaccuacuauauuccaggugcugggcagagugcuaaggucacaaaaaugaaucagcuguggccucuacagccuguuccccucuuggcauagaucugcccuucccccuccacagucuggacaaucaaggaccuggaguaagcacacucuaggggccgcgucucccagcauaucuuuuguuuucgaaaguucaaaaaacagaagaggaggauucugaaacagcaaacuugcugggucauccauagaguauauuaacuggcuaucuugcuaucuguccauaacuugcuaccuguccauaguguauauuaacuuccugggagcccacucacugccugacuuccuguucugcgcaugggcccaagggaaguucucgcaaccauaguuuucugugauauccauccuaccacauggcuuccugggaaacccauuagcuuuuuuguuuguuuuagagcccaagggaaucagggccuugaggggauuuuuuggugugggggguggugcaagcuucuaacacugagagugggugcuuuucugauuccuaugaagguggaguguaggugucguuccuggcucagcagagucagcccucucauccuauucaggccgucucugaggcuggcuccugugcccaagcccuuccucacucccucagggcaugaucacagggcauuuccuuagcauuccuccuuucuccccugugugugugugugugugugcgugcgcguguguguguguguguguggugugugugguguguguucuacuccgugugugugucauccucugcucauccacccauuccacugcgugugugugugugugugugugugugguguguucuacuccgugugugugucauccuccucugcucauccacccauuccacugcagcaccuagcaucaccuaggggccuggaaaaccugcaccugaaagccguaacuccccggcaccuggcugguugacuucuucccccuuaaccccauuuacuuugaggauggagguagucuuuagggucaggcugagauuuguccugacccaugcuuaguuggcacaucuugcuucugcaacaugcuugcuuaggguugggcaggggcccggagaaaacaagucguggcaucaccaggaccugauuacccccaggcaccaaggagcaccugggaccaaggggagguuuggggcuugggauauguuuuagggugaaggaucacagaagcuuacucauaccuauuugaaagccaagucaacagauguggguucuuggaaggagaaaaggagguuaacugcuuacuuauuagauuagaagugauguaugaaugauaaagagcagaguuugccagauauugcuaauuaauucucucacugcuuauuuuauggaugauaaaggguagggagagacauguuaauuggcuucaaggucucugagccaagcaugaccaauccgagaaacccagguggcuucaugcucuuucaauaugaucucaucccugcacuagagaauuuauauuuuugagcauaaagaauacccaccggugcaaucucccaggcucuucugaaggguuuggagagacaguggaggaugucaaaagagaugaacuuagagucaaaaaaagcagagauggaaucccgucucugccuuuuaccacuggaguuaguugacuaaaauguaaacucugagccuugguuuucccaauugcaaaaugggaaagaccccauuuauaaugcaggugggugagagaugccagcagugacagggacuuucaguaaaggcugagcugaagcugaauuugaaaagcacauucuuuacguuccauugaagaucugcacuugcucuucugcuaaccgcuaaggugucaucagugcugugcuauuaaaaucagaagucaaagaagguggguguggcccucauagccagaguugauagaaauggauuuauuaauauaauggaugguccauagaaaggugaaugaccugguuaacagacagggauggaguggagaccugucugcccuggucuucaggcugguucugaaaucacagaauuaagaugaucucagcugaggggcaaggcaaaucggauggaagagcggaggcccagagaagcgaagcccuuucccaauaucucacagcagguggggagugggggaaagcagcuuccaggggguggauuccugaaccagguauuugucacugucccacguagcuccucuugucaccauaugucccacucaguggagggauacuuccugcaagacaaagagggccucaugguucccccgucacucacugccuuccacucccugcuucugauuauucuguaagaaguugaggccgagcgcaguggcucacgccuguaaucucagcacuuugggaggccgaggcaggcggaucaccugaggucgggaguucgagaccagccugaccaacauggagaaaccccaucucuacuaaaaauacaaaauuagccgggcgugguggcgcaugccuguaaucccagcuacucgggaggcugaggcaggagaauugcuugaaccugggaggcagagguugcaaugagccgagaucgcaccauugcacuccagccugggcaacaagagcaaaacuccaucucaaaaaaaaaaaaaaaaaaagaaguuggagcucugucugucuguccuuuccccaacuccccaucuccgaggcuggcuccugugcccaaagucuuccucgcugucucuggguauguucacaggguaugaucacauuuccccugcaugcccugcgugggaugugcuccaugugcugaugccucuggggauuuccagaugaugucccuggacuuggcagagcaguguggggaaucugggacuugcacuuccuauccucauggagucuggucucucaccuucacaggccacuaagaggaaaggcaacuggugugacgucuggggagggaaguauguuccugugcaucgaaagccucaaacaugugcauacacuuuaacuagcaaucuuacuucuagaaauuuaguccuaagaaauaacuaggcaauggaguccauugcuacauuguuuauccccaaauuaaucuaaaugucuauugcaaauagacugcuuagauuauggugcguucauacagugaagaucugcacuuccucuucugcuaaccgcuaaggugucaucagugcugugcuauuaaaaucagaagucaaaggagguggguguggcccucauagccagaguugauagaaauggauuuauuaauauaauggaugguccaaagaaaggugaaugaaagagucauaaaagauguugagguaguucucuauugaugccagaauagcccuauggugcacuuuugaguaacagaagccaauuuguuaaaaacaacaacaacaacaacaacaaaaaaaaaacagagagagagagaugaaugugcauccagaugcuuagagaagagucugaaugucuguauacuaaauaucaacacuaguuacucugcgcugugggauuuuggaugauuuuaauuugauccaguguuuucuggaaaauaaaauuucacuacauugacacaucauuugauaaucagauaaaagaacaauggugggaaagcaaggacucaagugacccuugcuuuugggucuagagcaucauguaggaagccagcacagcccaucccuuuccuaggcgccaccuucuggcuccuggugggacuuguaagucccguggucaguuaccugauugcucuuacggaccugacgcuggaaauccucucucuccaaggucccugcaggagaugggaccugccacagagaaugccgcaagggauguuucuguugggagcugugagugggguggauguccucugccucucuuaaauagaugagcuagauuugaaccuggggcuggccaaagggagucuccucucagaaaccaggaugcagugggccgucugugucccagccccaaagcagccaggguccaguggauuagcacagagccgaccaggccuggagggugguggucugggauugggugagcagccaccagcaggaauagcaauuggagggaaggagaagcauugccaagagcaacuuagggggccgugagugcaggucucuggacagacagcaugguaacuggcugaggcaggaagaagcuuggugggcucccauggugcuaauaauaggccguguaggagcaggggaggcagcuccagacuuggagugaaaagacguggggugcagucagaaugaacuccccagccauccauguggucucaggcaagucacucugccuccagagccccauguccacuccuauaagaugguacauccccacagugcccugccacaggugauuauaggugaaggucuuuugacaccuauaugucuaagggucauggagugacaucuuaugaagucagcacauagaaagucaaaaaacccuuacauuccuguaaaauacagugcaggccaggcgcggugacucacgccuguaaucccagcauuuugggaggccaaggguggcggaucaugaggucaggagaucgagaccauccuggcuaacacggugaaaccccaucucuacuaaaaauacaaaaaauuaaccaggugugguggcgcacaucugaagucccagcuacuugggaggcugaggcaggauaaucacuuaaacuugggagguggagguugcagugagacgacaccucgccacugcacuccagccugggcgacagagcaagacuccaucucaaaaaaaaaaaaaaauacagugccaucucuccauaacuccaccugagccagcaguuccaucaguguugugacagauuacuauuuuuuuuuuguugucaaguacccucagguugagcagcugagaugcuuuuagggagugagacaaucucaggaucugucuuuaaaccccguagucauauagggacuggcaccaccagagacaacagcagaucccugucuggagcucacugaagaaucaggggugggaggaauugcccuuuuaaaauggaguguauauauguauauauuuuuugcauaauuaaauaauauauauaugucauugaacucaggcugguuagaggcaugcauguaugauauaaauucucuguauacaaauaaaaggaaguuacuuguauucguugaauggguuguuaugaugacucccuucauaggaaacauuuggauccauuuccucugcuuucgauguuguucuuucgcuucugaaccaguguuugaggcagaugucuuugauacugaguaaagacauggcaguuugcauucacucucugaccaaaagagaugcucccuacucuugcagaauacugauugcccaugacaaccagaguacuuuuauaagaaaaggagcacacagaaggcagaaagggaccuuguuuggggaggcggcuuugagcagugacuuuaugacauaaacgauuaggcucuuccuggccccgccugucuugggauaucuacucagacccuggaacuuugaaaucgcaggcuggguccaaugagcgcagaaaagggacaggacucaggcagauaggauuucuuucggguuugguaaacagcuggccucuagggguagggacaggggcagugggugggaggacuugggggagggaugggugagcucgugggaacugagaaacugugucuagggcuuccuuaguuauacugaaugcugcauguagaggucugcaggguggccagcugauggcuggcggaagaucugcugacuuggauucaguuacuacuaaaauggcagguuuagaaagaggagagaacuucuagauccagaggaaauaaucagguaaguaugcuaagauguguguauguguuagccaggcacgguggcucacgccuguaaucccagcacuuugugaggcugaggcagguggaucaccaggucaggagcucaagaccagucuggccaacauggugaaaccccgucuuuacuaaaaauacaaaaauuagcugggugugguggcgggcgccuguaaucccagcuacucgggaagcugaggcagagaaucacuugaacccgcaaggcagagguugcagugagccgagaucaugccacugcacuccagccugggcgacagagcgaguuuccaucucaaaaaaaaaaaaaaaaaaaaaaaaaaaaaaaaaaaaaaaagauguguguauguguguaugcuuauauauauaauacauauuuauuuguacauaugugcauguacagauauaaacacacaaggauguuuaucauagaguuguuuauaaaagcauccaacuaacauuucuguaucuaugcaauugaaaacaacauagccauucaaagggaugaggcagagcuauaugaacugauauauugggauugaaauaaaccagaucaccaagcacauuuuggaugauucuauuagcaggggacguauccacaaguuuauaguagcauagggaaaagucuugaagguaauauaaauauaaagcauaguuauaacuggacagugggaguuuaggucauuuacacaauuauuuuauagguuuuuguuuguuuguugacuucuuuuuuucccaaccuuucuuuagugaaguuguauuacuuaaguuaaaaaggaaauaaugagccuggugugguggcucacgccuguaauuccagcacuuugggaagccgaggcaggagcaucacuugaggucaggaguuugagaccaggcuggucaacauggugaaacuccaucucuacuaaaaauacaaaaaauuagcugggugugguggugacaccuauaaucccagccauucaggaggcugaggcaggagaaucgcuugaacccgggaggcggagguugcagugagcugagauugugucacugcacuauagcuugggagacagagcaaacuccgucucaaaaauaaauaaauaaauaaauaaacaaaauuuaaaaagguaauaauguaagaaaauaaagagcauggagaaaguagaaaaccagauaaccucgguccuauuuuguuaaauuuugggaaauuucaguaucugcauuguacagaugacaggcagaaucuugagaaguuaacacuuuaaaagaaagaaagaaaaaaacuagauauucacuaugugucaucuuguugacuauucucuucucugaacuuccuggcaucuuaguuagccuauuugagcuggaauaaaauguacuacgugucuucagauucugcaaacauuuaccaggcaccagggcguccacuauccagucccaagccugccacucaggaguucaugggggagugagugcauguggcaggcauuaggcaggguuuuugcauucugcucucccacuugaucccugugacaacccuaggagccugcugccacugaucuucuuauuccacuugagggaaccuagaggcagagacaggauuugaauccaagccuccagcuccaaaccccagcugaaggaagcaagcuggaacccaagaugcuuucaaucccugcugcucugagcacugagauuuguucacuggaaugcuggaguuuugcugaucauugaccucgcaggggcccacucugaaguuaaaaauccccgagugaauaaaucuccagccucuccugcuguuuccuucccaguucugaaagugagggcaggagagaugagcuuuggccaggaauucagcgagugacuuugcguggagugucagcuucuccacauugcuggguguuagcuuaccccugucuggcaccagcagcaaaaacagagccaggcguggccuauagcaaagcucccaguuuaaauaugugaauucauuugggccuggacagcugcauagcucaggcugggcagaaucugccacccuaccccguuuccuugaaaucuauacaggaacacaguuccaaauacccuggugccagucccugcaagcuccuacuuguacaaauggauuuuaaaacaugugaugauaucuaccuccucccguaccucugggcuuuucuaggugucagcaugaaucucaugugagcuuuacaaugaccccagagugggugggcaagggagaggugguuaugacuaucaugaacucccuugcuuuuacaagccacuccccuacaauccuuucuccaacaaguagacagugaacuuuaaaaaaugucagucacaucucugccaaugcccugcucaaagcccuccaguggcuucuuaauuccucaagaagcucuagaaguuucuacgggaucuggccucugucucccuuggccuugcuguugccacauacuucuagcuauuccucaaaugcuccaggcuccaaguuugucacugucucuuuugaacuugcuguccucucuuccaggaacaccucaucccccagauacucacuggcuggccccuucucaucauggaggucucaacucaaaugucaccuucguagagaggccuuccuugccucccuuccccuccuaccagccuccuugucuauuccccuuugccuccuagcaccugccaucauauuggguauuugucuuauuguuuggccugauuccuccuccguuacuuaggcaccaggagaguagagaccuuguuggucuuguucaccaucuagaagauacuugaaacucuaacauuuguuaaaugcaggaaagaaugcccuuuugacagcuaggaaauugaggcugagacaagugaagugucuugcccugguuucccagcuagugagugucugugcuggauucaaacuuagcucuuaugcuccagccuucaagugggggaaacucaagagggcaaguucuuacggggccacuuaggagcagacagcuucuuaggacaacauucuuuuauguugaugugaaguagcaaaucuuucagagauacaggccucuaaaaaauucugccaucugccggcugcuguguuagagccagccucagaaaaaggucagagauccaaucccuggcugggugcugugcacccaggaaagaaggagcagaauugaaauaagucuuuuccacucuucuagaugagccuucuaggccacaggcagggcauacccaugcauagacuuuaagggccuuuauuuggucuguuugcuucccaguuggggaaacaggcccagggacaggaagugaccugccugaugcuaccucaugaguuagugguccaggcaguuagaaccaagguuucccaauccagcgggaguucuuaccuacccacuauagacuucuuggccgguucugggagacugagcucuuuccuucccuguguuugccucaucagcacgcuggacugagcguucccagauucagugcuggagccagcgguggggaggggaguaggggcugaagaguauaucagccaagcuugggggagacagucacauaaggaaauucacacucuuccucucucauuagggggccccacaaugaggaggggaaagacaaaaaacaaggaucuuggguacauugguccuuaccuccccacugccccaggagcggucuugaggguuggaggagacuaccagccuccucccuauagcggacuugaacuuggcacauggaaccagcugaaacuggcaccauuucuacccucagaggguaccgcugaagaagacgggcagagaugaaagaggaacugcuuaauucagcucggcacuucuuagcagcucccccaucccauugccggcuuuagucccaggccagagacccaugaggugcguugaacauuacugauacccucuuugaucuaaacccuccuuucgugaucacgccugguggcucaaagaauugcucccccagcuuacuguuccuguuggugcugaaagaaugcucguaauuguuaccaaacaguggacggagcaaggcaacauguccccuuugcccagcuggcucccaguuggcacuucauuauggcaaagacagagggggugggguccccgggccuucggcauuucauuugcacccacauguaggcucacuucuuggccugggaauugaucggugccagaugcuccaucuagccagcauccccaccgcagcagggcugcccgccuccuguuucgugaaaaacggcccggauuuucaucagaccuuaauuggccugggucuggccuucauucuaccccagccucuucacagacugcuggccacuggcuguucccuccuccagccaggacaaugccgguccccgggcacugacccuggcccaggcaggccugccaacuccauagcucucauuucucacucugcacaucagugcuggcuucccacacccacagcuccuccagaaggaagguuugucagcgggcuucaccaugcacucugacguaccacuuuuggcccaaccaaacuacaccccacccuuggguagaaugggaccaagaugcgacccugacagacuuaaaugagaaaugagcauuuuccagugacgccuccucuuccugccucuugcugggccucucucugcauugcucugggguguucacugcacuuggacugauaccagucaaugucccucgcuucaaccugaccugaaacugaaaugcuccaaacaagaguaaguggggcagccgacauuucaggaggaggaagguuggcagccaggcugcugugagcuugcacggcccauaugggucccagcuaguacuuugcauuuucuuuucucucuucuuggaaccccuucguccuuuuucccgcugcccucuagccucuucacugucuugggaaagggggccucucacaaaacaguagucaccgcugcuguucacugagugguuacuuugcaccaggcacugugcuaaguaccucaaggggaguaucucccuuaaugccugcaacauccuaugagccuuguaugauugcaucucccuuuucaagcugaaaagaaguuacaugcuuugcccgacagucuauagcuaggaggagcuggagcugagauucaaccccagguucucuggugcccaagugcucaugucuuugcccugugugccccucuuucacagaaacagagcuucagccaaauccuggaacggaagcucuugggaagcugccugugaccuuucuuauuguguccccucagcacaggucaugcacaggcagcugggaauagauaugcgaguuaaaggaauucucguuggaaaacaccagagggauccacagggccacccccccgcccccgcaauaccacugugugucugucccugcagggcccuggaaucccacaguuguuuccuguacccaggccuggggagccagccagucacauggaccgugaguguauccgccucacgcuucucuguggccccuggcuucucccaguggauuccgcaagguguuuccugcaaauccugcugauggucuucgcuggcacguagcaaaauccacccagaacaccgcgaucugcuggccucagccuggaugggguuuuguuuuuguuuagcuuuuaaaaaaauguguguuuuuuuuuccccaaccaggggcacaggggugggggaagaggagaaacaugaagguaaaaauauugacagagugaaaaguauugaauauuccuucuauuucaaaaauagcagcuuccauggcugggaugcaggcuggcuaaguucagguugggcugagguugaaguugagaucaagguggcagcgugacccuuaugccucaagcauguccuucaggagggugugggagccugaggcagaagagagcuccuuccuguuuuaaaaacaccuuuuucugagacucucaaagaauguuugaaaucagccauccaaggugcucugccauuuuuaagagggaggacggggcuggauggugucccugggaauugaagggacccagagaagaggugaauuguuuaaaguuaacucagagcauuagagugggcugauauccucugaagagucuacuugucugugagagcuguuucagcuacuucaaagccagaugaucagggcagcggggcuggauuuucaucuucauggcugugcacaucuccacuugauaugugggggucggaguuggggggcaguaaagccugguccccauggagaugcuauccuggaagcauuuuuauuaccaaggacuagcauauaauuggaagauugaaggcagaagcccuuaucuucucggcauucuuuagaauucuucuguauguagauuucagaacacacagagccagagcaaaagaccuuacuuggcauuaacaccaggauccaccugccccucccuuccuggcauuaauguccagugcuccccuaaugcacuuuaagcugugaaguuaucccagguuuauuuacacuguaacuaauuuacucuuggcuggacugucagccuggaaaauaggaugucacugcaccccccccaaccuccaccaaaaaaagacaguggcuaaugaagaaaacagauuguugaagggcacuaaaauugaggcaaggagcugaauaaugugcccuccucaggggcaggcagggcaggcguggcaggcugucggcauuguuacagaucagcaaugucccacuaguuagcaaaugggccccucucaguuugaaugugcagcugauggaccagguggggugauuaggggccaacuccguacuuguuucuguccccaguuuuguuaagugcagaucacccagacagaucccaggcugagaaagagacugaagacaaagcuagaagaggcagcugaagcauccuaaugucuuaacucaaguuugacuuuucagaaaugugauuuuagaacauagcaaacaggaagcacgugacaacuuggaccacuacaacgaagagaaaguggaacccaggggaaaugcaugaguuagaaauauaaagugaugggacucuuagauucuaggguuaauugggacacuagaauauguccaguccaacguguucauuuuguacaauaaaaaacaagggcuccaggaggaaaugauuugucaaacucacauagaaaaugaauggaaaaaaacagaaagaguaucuagcuuccaauuccuggcccagggcucuucuugcuauucaauacuuucuacguaauaagccuggguuuuuuuuuuuuuucaaaaaaauuauuauacuuggccacccagaugaguacaguuauuuaguagaguacguagaguuauucacuaaaucacaucaaaguugggagacagagucugguuugaaaacccucgaguauuuuauuuuauuuuauuuuauuuuauugugauaauacuuaacaugagauauacucgccccucucuuuuucugagacagagucucacucugucguucagcuggagugcaguggcaugauacuggcuuccugcagccucaacuuccuaggcucaagugauccguuucccucagccucccaaguagcugggacuacagguacguacuaccauucccagcuaauuuuuuuuucgugguuuucguagagacaggguuuuaccuuguugcccaggcuggucucgcacuccugagcucaaggaauucaccugccucgaccucccgaaguccugggauuacaggcgugagccaccgcgcccagcaagaucuaccuucuuaacacauuuuuuaacacuagaaguacuuaaauagaugauggugaagucucaagcuguccuaccagcaguaaaaagauuccaaguggggaaggugaacucucaaccuuguauacugaucgguggcuccugggaaauuugcauuuauccccuaacaaagccauuaagagagucauuggcccccagcaagacugagauggucgaaggacaugggaccaugucauaagcagggagagaccauccuaaucuaugaaaauauuuauccuggagaugauuugggaaacaugacccuucuuuucaaauaucuuguuuuuuuguaagcccaagaugucaccuaggugggagaaagccacagggaagcaguccaaaggagaauuuuuuuauagucaaaaaaaauggcuugacauggaacaggcugaccuaggucagagaugguugcacacugggcaguuuaaccuugggaugggacuguagaagaaauucaaaggagcuuacacugagugacccugaaggucccacccaaccuaaagucuguggccugugaaaugugcccaugccacugugccguaguuuaacauguccuucuggaaggcagguaggacccagagaugagaaguaggggcucccaauucaggcugccuggacuggcaugcuauguccaccacuuccgcauuagaugaucuggggagagucacuucuucuuuacaggccucgauuucuaaaagaugggcuaaugacaacacuuacuuuauagggcccuagugaggcucaaaugggaaaauccacggaaagcauuuagcacugaucaugcauggaaagugccugauagcugauggcaccuauuguaacuaauaauaguauuagaauuaguauuguaaucauugacaauaggauuuuuauaauuagggaaaguggggaacuacccacaugaccauccuccugcuuucugugucaguguuugaccaaauguguucaucccugguacucucauugcuuauccuccgagagcacuggcauauaauggaaaauguauuccaauuuguucuguuauuccagccaggaacaucuaggaacagggguuggaggugugcuucagggacuaccugagcccagcuuuuuuuuuuuugagauggagucucauucuucuugcccaggcuggagugcaguggcacgaucucggcucacugcagccuccgccuccaagguucaagccauucuccugccucagccucccaaguaguugggauuacaggugcccuccaccacaucuggcuaauuuauuuuuuuuuuuguauuuuuaguagaaacgggguuccaccguguuggccaggcuggucucaaacuccugaccucaggugaucagccugccuuggccucccaaagugcugggauuacaggcaugagccacugcacccggccaagcccaccuuuugauaggagccucccaugggcaggcagaguaagaagugucacaugcagccacuggucacuuaggcaaaacccugccagcuuucagaugugcaguggagguggcagggggagguggcuggugcuguguauguuuugcagauacucugugguguggcaauugcucuagaggacucuaguguccagaagcaggcaugugcaguuuaucauuacagcccuccuucaaagaggacagcuggcccugugcuuugcagggagaggugcacuccggguggcccauaaacccagaaaauaugauuccuaucugguacaggguaccauccuggcaccuggagaggggucugcaugagacccagaaaugacuggauccacaacagaccuaguuuguggaacaguccuaaagaauccuccauucaagcuuauaucugucacccagggaacuggacauucccuucagucagaaugaacuaguggccuccccuucucuucagccagggucuuugcaguccucagccaugugaccuccgaccugucagucuuggucugauugcuguacccuuguuugugcuguuuccauugccuggaccauccuucuuuucuuuccaugaucaaaacccuauacauucuucugagucaguucaugcagcggaauuggcauuggaauguugcagcuaauugcacauacugggugacagagugcacaguagagaaagguagggugauacacucuucuuaggaagcaaucaauaagggccaagauggaaaagaugucuuauuucacccacugagcaccuacuauguuccagacacugugagauguugcgguuagauacaauugugagcaaagcaagauguaauuccggcagaauuuagugaguguaugggggcagggaagaaagaggaugagacaugauucaaaugaaucuacgaacauauaguuacauacacacuagggccccugagaauacaaaacagggguucuguucuagucuuaugcuugcaggaggugguuggggauggcuuuaugugaggaaguguuuuuugauuuuaaaugugaaguaugaguggcaguugauggguaauggggagcagaagagggucucaugcagauagaaugguaugugcaaaggccccaaggcuuugcaacugagagauuuagaccagggcugccgaucagaugucuaaaaaaguauacuuguucgccccuugccauacucuuugguccaaagggcugagcucccugucuucaaaccagggggcuucaggucaguuacuggacuucucucuuccugcccuuugucugcaagccaagguacccucaaucuggcauugagagcccuggggcccacccagcuuguaaguggagauuugaauccagacuucaccauuggaugagauucuuagacauuacaagaguuauggagaguuaacuccaccucaaaguucucaccaucuguaacuuauacaagcccuucucucauaauucagucuugggaauuuucccuaucuccgcauuuccaaugcauuugacuuggugggguguuucagauuuguuaaauauuuaguaguagaaagaagaugagcuuugcugcugggcauauuuggauuccuagcugugugacuucugacaaguuucuuaacuauccugagacuuguuuucuuccuauacucaguggaaauaaagcuacacauuuuggggaaugguuuuaagaguaagauguacuguuuguaaagugugucugucuuguucacuuuucuguuucugccaccugacacaaugccuggcacauaguaagugcucagugaauauuuacugaaugaauaagagguuuaggcaccaugauugcacagacacgauguucauagaguaguuggucuucuccuucuuuaucaaugacuccaucucccugucacacuucaaggccagggcaggugguucagaaauaccagagguuggcuuuauaguucugccauuacccacuuugaccaaagagggcagcaguuagcauucuuuacuuauuuauuuuauuuaaaaugaagguuuccuuaaaaggauuuggaucuucucuuuaaucauuccuccgcaccuucagugcuauugauuccugauaauggucuuagggcuugaagaccuauguaugggcucguuuuucucguaccuguuccuaccugagugcccacuaugugagugaugugguugugagcuggaagggaggugcugagugaguaggggaacacccgcugcagcaggugggccuuccaaacuauggcccuggguguccacaaccuuacagaaugaagcuuguggaacuuaaaggugaggaaagccuacacuauuuuaaaagccacaugaaggguaaguuauagauguaccagggucuccuuggcaucugugcuguauaaaauccauagacagagcagccauuggcucuuguucaaaccacaagaaagucuccugcccacuccuggugcauucugggaacagauuugcugucugcaaaggcugcaucugcgggucuggcgugcaaaggagggugguucuuuggcuaaugguggacuugcuccuaggccuaucccagagucccucagcucuccuagcaaacaaaaucccaauuaggagaaaaauaaaaugcuauagauggcuccugagauguugccagcuguuugggcuucaaaaaugccccgaccugaaagcuggaaguucugagaaccguuugagggcaugguauuuuucugggcacugcuucaaaggggcugugguugaagaccaugcugcuauucugguggccacuugugugggauaaaguuucccaugggcccccguggagaggcuggagcacucucaggggauaggggguggucucagccccccucaccgagugcacuugcauggcaguaagcaagucggcgccucugaccccugagugggcuugagcuuuugagaggucagcaugcccccuuaaacuugaugucuccucagagcacagcacagaugcccagccaaaacacccagggcgaaaccacuccaagaggugaaagggcuugaggggagacaggguacggcgggagacagagaugcaugaaauacuaacguugaagauuagaaaugggaugugcacuggaaugagaucauuugugguucugaugcaaagacccaggcuuguuucuagggguuucuuggggcuucgggggccuccugucaauggacuguuuggacacccauuuggauacaugcaauccuaaagucuaugggcagugacagagugauaagucuuuaucacuagccucagggaguagaagcccaccuaagaaauggcacugucccauguuggagcaagacccaaccuaccaagcugggaguuaccgcccacugcaaggcaccccuguacuuuguuggacucucuguuuucugucucuccaaugggcuggacucuccagccuccgggccucugcccaaccaugaccagaagguccucuccuuucucuuucucuuaacugucucuagugauucucugaucccagcucaggcaggaugucucccuccggcgccuccaggcuggcugggugugucugcugcaugcuccuguggcucccuggacuauaacucccugucuucuugucucacaagaguaaaauaagcuucuuaaagguaggaaccuugucugccugcuuauuacugaauccccaagacauggcacaggaucugagaugcauaguuccucaaauacuucugaauaaauaucagaugagugaaucaaugaauuucaaguggacuugaggagaaggaggggggguggcaaaauaaaacaaacaauaaacacuauggcagagagggacacaggaccuggagauggggccuggauaaacagccugccaugcucuucauauuuccugagugcuaccacaaggaagaggggcagcuggaggccagagggccugcagaggagucagcaggucuagcaaggagugccuuggguggagacucccuggggcuaauuuuggugucaccacugacuuccuugagggugcugagccuugggaucuucauguguugguagcuuuugggugcuguccuuccacagacacaucaacaaguucaugggggucuccuguaauaggguccugugacuugccucuuuuuggaggucagucuucaauauuuuggaacaaugucgguauucggccucuccagaucacauuuuuacuugucccuuccuuuucugaguaacucuauggaacaaggacuccugacccagcacuccaggaagccaaacacaaaaccauccccgucuucguuauuguauuaccuuugguucccucccacagccucauucauucauucauucaacauuuuugggaacccuggccacaaucuaggcucuaugccaugugcuggagucccagaugcagucccugccauccgguaauuagcgaugcuagugaguguccaaggaaccaaucauuaaagaacacgugcuggaagaaagagaggaaagccaagcagaagagagguggacuagcuuggccugggguggacagaaggcuuccuggaggagguagcauuucagcugggugggucuugcaggaagccaaaggugcaggcagaugcacagggaggaagugauucucaccuaggcaaggggcaucauaggacagguucauauagugaugggggcuggaagcuucagagugauaggguuugagguauggucccagcucugaagagccauauauaugccaccgagcuaugcagaauaauccuguagauacugcaaacccaagggagguguaggugaggauguaaaugaggguuguggaucccauuuguuccugggagaaugugggggacuuaggggagaaggacuguguuucccacugucuauccuuuggggcuuugacauuucccaccugacagccauuugcagaguaaaagccucagggauucuaaucaugcuuggugaacacuuugagguagucgccucauuggacccuuagaaacccaggucacagaaacaccaucacccuucugagauucacaguccucccuccccagguaagucggcccugaauccaggaaucagccagcccuaggacuuuugcccugucccaggccaagguaucuguaccuuucuuccaaauugcugguggccccaggaagaaaucaagaguggcugacuuuaagcaguuagauuaaacaucaaaugcauucaucccaaguccaggcauauaccuagaaggagcgacucuuaaauuuugucauuucauuguguaaaacugagguugccccuuaacacaugaaggccagcaugggaugcuaauuuuguguuguguucuuuuggguaaucucaaaguuccaggaagccugaccuuccuaagccuguguuuccuugccuccccuucccggccccuucauuucaucuacaacagacgucagcaggggcccugaguuuuucccagaccgcucaagcagaaacccauccugcucacaaggugaggagagccaggagcucacaaaggccccuccuccccuuccccgggagguccaggacagggcauccccaggacagaccugcccuggggaccccggaacacaaggcagguacugagaaacaggaaucucugggcagggagguuuucauauccuccagguuuaauagcuuucccugagauggaaacuuggguugaaaugauuugcagcuuuccagauuuucugagugugugucuuuggguuuauuuuuagccacaggcauucauuucuugccaaaaaaaccugcuuaaauaaaaccaagauuaauauuuuuacuuaacggaaagaguuagucaggacaggcuuugaacugggacuccuuaucuugauggggagugcauguuaacggucuggccuuggcguugacaucaacgaaaagggccuuugaaacggacaagagagaagggcccugggggaccaggguaggaugcaggaaaagccuauuugugggacuucucugaagagagagaguuccucuucacucaggcugcucgccgcuccccacccccagcccccagcccccaugcucuugcagugggaggggggucaucaucuuccuggaaaggcgggagaucggcucuggcuuugcucagagcccggcugugauucugccucacuuccagcugcucuccuuaccgccgcccccuccgccccccacccagaucagauccagacuucuuccuccucuggauucagacgcagcaaacugagucucuucugcaggaugggcugaggcucagaucugaugccaucuccagggcgauucccugacaccccuccccugagauggacuucaucucuucuuggcucuguccuggcuuuccguccuugcuuauauugcugagccugccuuacuugagugucauugcuggucucucucaccucuggcccuugaguuccuaggagccuuauguaucucucuaucccuguauacgucuucacaauacugaaacaccuuccugguugcugaagaguuguguaucugacccugugaaccgagaauugcuguuacccccuuuugauugaauaagacuuagaaagacuggucauuugacagagcuugcacaggaauuauuuaucuguuuuuaaaucacucuguguguggcacuuuauacaagaaaucacacguagcuucccauauucagcaaauacauaugaggugccuguuaugugccaggcacucuucgggcagcuuuggcuacagcaauagguaaagcaaagaaccugcugcccggggaggcuuacauuuuaauggggagagaugaucaguaaagaagcaaguuaauguauaaugucagaugguggccagugucugauagagcacagugucaggggccaagggauugcgaggagggggaggaaugugcauggaucaggaucagggaaggucccccgcccaagugaagaaagaguguuccagcagagggaacugcaaggucagagacccugagagcaugcuugggugcuagggugugcaguagagugagcuacaauuuccugagauuaagaaggccaugagagccccgggugcagggaaggccuguuaucuggagcucaguguuggaugggucgaauuugagauguuuuauuaggcuugcagguauaaauguagacuaaauguagacucugggauauauaaguaaaaagaucaucagggaggggaacaacauacacuggggccuguuggugggugggguaggggagggagagcauuaggaaaaauagcuaaugcacacucggcuuaauaccucagugauggguugauaggugcagcaaaucacuaugguacauguuuaccuuuguaacaagccugcacauccugcacauguaccccagaacuuaaaauaaaaauacaauuuguuuaaaaaaaaaguucaugagaguucuagguuggcgguggcaaaagcgugggagcugucaguugugcagauggugcugagacccacaagcuggaagaacauagcaggaccacgagccugcaccucgaugaccggacugagcaccaagaaggucaugggugacuucgacaagcacugcuuuggagagguuaggggggaggcugccuagguuauugcaggcaccuuuggaggcugguaauuaucacccacaauuuaucugcugggaugggaagugacuugcccaaggucacagagaaacagggcagcgacuucacccagaccccacgugcuccaugccuguuuuucauuccaguacgccgugaucacuucuccaguuuucuugaucuguccuuucagcuucugagucuuucaggaggguuuuuuugggaguugggauuguggugaucaauaggcugggaaucagagggacccaguccaggcaggccccucaggccucugcuuuucacccuuaguuccgaaggcccuuuccucucaccuagacaucaucaaagcauccccagagaggcagcagauaucugagaaggaccuugggaagggucacugaggaagguucucaagauccuggggggaugaggaaaugcugaaucacaagaaucuuucggguuccucuugcuguuuuccucugauuaguaaauuuaagaaucuacaagucaucaccaucagcaauauaacaguguaucauuugucuagcuucaggguuacaaaguaccuuuguacauauacauugucucauuuaauuaaucaaucuaauuaacuucaaacuuccuguguugggagaacccuuagggagccugugguuuugugguuucuaaguuauuuguuuuuauuccaugaaagccuugccggggagcacaaaggucuaaacagaugauacgauauacuguuauacugcugauggcgaugacuucuagauuuuuauuacuaaucagaggacauguguuugugugucuguguaagugauugggaaggguggugggugggugaucaaagggauguggggcucacugggagcuuaucaaggguccuuccuuuuagguaucaaucuucuucucugauccucugcagugaaaguggggaaugcaguaaaauuaugaacuauuuugcaaccagugugaaaucccauguaaagguuuuuagguggucugcuguccugggggaccucccauuuuuuuuuuucccccacuaggaugcaaaacugcuuacaggcuaccugauccucauuguccacaguuggaaaguagggacauuaacagccacaacaguagccaccuuaccagcuugccaugaggacagaguuaaagaacaugcacacguugcuuggcaccuaagaggcauucgauaaaugguagugguuguuaucaguauguucuaguucccuuccuucuccucuagauucacuaaugugaugcuaagaaaagcaagcaguuuguaauucuugaaugggugagcagcuggaagagugagagagccuggcucugcccuccuugggcaggcuacauuguagaguguccaaggugggcaggaaaaaggcuugcuuggcgggcuccaggccgaccucccugugggucccugaccuauugccuuugccaugagcacuccggccucagcaaggccgcucccuuugucauccugugggagaugauaaaauacacacgaaggggccgugagacaagcugggugacagggaucccucuuuccuccuuuuugguguguuuucauggguagggcaucauuccaacacuuccagaucccucuuuuccuccaagucuaggccgaagaugcgagcccaugguccaggcuuuucuuccuaccuagagccugccugcuggggucccaucagaagagcagccccuucccugggacugacacuaacagugacuucugcauuugaagaaaugcagucuacccacuaaccagacgucccuuacuuauccuugcuguccuuuuaaaaaccaugccuuaaagcagcaaaaucauucuauggggucuuuggagagacaggaauggggguguugugugugugugugggguggcggugguaucucaccugcuagauagcaugaaucaacuccuaagucauggagaggauuuguacugcucuuccguugaugcuaccauggguggaaccuggacuccuaaguuaguauacauuaauuaguuaaggaguccuugauccccagaccagccaaauggguagcauuguugcucggccuucuagucugccaguaggaaaguccaaccauuaggucggggaagaagggucuggauuugguugacaaugguuggaugggggauagaagcagagagagagagggagggcagcucaaggguaucuugccccacucuguuuaugcugaugaacagcacaugugcaauuucuggagacacaccaguaagcuuuucuggaaacucaaucccaauugccauuggaaaauuguucuuuguucaaaacuugugccacugugguccauacugcuagagcuggagguggggagaggcagcaugaagguauauuuauggaagaggugugccuuguuugccuugcuuuuguaagcucuuacuagcacucuugcccaaacaaauauucaaaggaagcaaagacaguucaauagagauauaugccucuaugccuggcuucucaggcgcaugauauauucaagagggccccauauauauuuauagaucaaugugcccauuauauaaguucacacauccuaguuaguuucuucuuagauacuuuuacauugaaauacugcuuauuccuuaaucaaucucuuccuuguuucuucuucuuccuuuuuuuuuuuugcugagacagagucuugcucugucacccaggcuggaguguaauggcaugagauauagcucacuguagccucgaacuccugggcucaagcaauccucccaccucagccuccugaguagcugagacuacagauacacggcaccaugccuggcuaauuguuuuaaauuuuuauaauuuuuuauuuuuuauagagacaaggucucacuguguugcccaggcuggucuggaacuccugagcucaagugauccuccugccuuggccucccaaagugaugagauuauaggcaugugccaccacacccagccucuuccuugcuucuuuugaccaccagaucccuagaagcccagauucucuuccuaagagcaaaagaaauucuagagagacaagagaggcucagaggcugagauucacacugagccucaccucucccuucucugauuggugcuucuguaccuuggagacuaguccucuagccauaaacuuuuuuuuuuugagauggaaucucgcucuguuuccaggcuggaguacggugaugcaaucucggcucacugcaaccuccaccuccuggguucaagugauucuccugccucagccucccaaguagcugggacuacaggcggccccaugcccagcuaauuuuuguauuuuaguagagaugggguuucaccaugcuggccaggauggucucaaucucuugaccucgugaucugcccaccucagccucccaaagugcugggauuacaguggugagccuccacacccggccagccauaaacuuuuaaaccuuaucuccccacuagacuagccaucaguggaagcgggaaauaggacuucuauuucuuguugucacccucaccagcacccaacccaauguuccagacaccaaccuaguucaugccuauguugguuugauuguugggggcacuggguagacaguguaggggccauacuccagcaugaaugggaauaaagacaaccuguguccagccuggcccaucuguaaagcuggcuucuagccaccacaacaagguggaaggaauggcuagacaugcugccaguuaccaguuugaaaagugucuucuguuguuggaaaagcacaaccuccucccaccccacuucccuuguucccuguggccccugggccagcgaaugccucgggagaacccugauugccaaacaggagaguacaaaauagcacacauuugaauuacagaggagaaacuggagcaaauacggacagauuaaugcacaaaccaaauagguggaucugggguuggccagcaauucuacuuuggaaggacuuugagaaucuauuuggagggcagaauguaacuuaauuuuaguucaguuuagugaaguuuuguuuuuguaaggaaaacacugauguggccucuucacugggccaucucugccucagacuuuuggaaccaugacugugaucuuguuuggcuggucuuaguaggcaauucuuggguuacacaugggugauaaggugggauggguacaugugauagaguaggcacuccugaucccaaaauaccuccuauacuuguucugacuacuucaucugugcuucuccaccucucccugaaguucuguaaggcuagaauauuuuuaugagguugccuuucuucucauccuagggagaacucccaggccuuagcuuacagugcauguuagaagucugaagaugguaugcccuaagauggaauaaaaauagacaucaccauaguggugauaaugcuaauaacagugguagcaaacacaugagguuugggauggacuacauacuguucucagcgcuuauauuaauacgacccucacagcaacuuuaugaggcauuguuucaucauucccaucuuacagauugggaaaccaaggcauagagagguuuagcaacuuccugaaggucacccagcaccagggcugggauuugaacccuggcucucaggcuccagagaccaggcucuuuaaugcaaugcuauguugcugcuccaauaguaauaagcaaaucacuuguuagccacaugagaggcacugggcuaagaaagccagagagauucaggaggaaagagccccagagagaucauacaguaaugguggaacccaaacuucaaugcagcuuccugacuacaaaaacguauucuuuucacugaacuauccucagaugaaaagguuccaagcucaggcuauuugggguaaggaaggaguuggcugguuguaugugcagaagcuuccagcaguacucagcuuuauggggcaggucugcuugugacaucuucugucuaaaucaagucaagccauuuuugaaccaggauguugcuauuuaaaggaaucccuuuugccuugccccucccacaccccccggccaagacucgcucccuuguuuaccuucuguguuaaugaggcagagaagauggguccaaaucauuucaggaagaaucagugguaaaggcuggcagacaugccucugcacggaggugaagcuguuauaaccugccugugagaguuaauauggaggaaacaguccccggggccuccgggaggcuggcuugucgccgagaauacuaccgcaauguuagaaacagagguggaugcaggaucuugacagacauuggccugggaucuugccaaccucucguuuuuacagcagacuuggaaacaaccacucgccuccuccuaauuugagcugccuccgcuaaauugcucacuuugccaaugacuguguguuuugccaucgccggcagggaaggucugaaggggccauugauucaucugaacccugacuucaugucugacugcaaggguaggauccaagcucauuuggaaagaaacaagacagaauccaguauggaugaggaaucaguucuuaguaaagauuuuuuaaaaacagagauuagagucaaauaacugggauacauaguggagcauccacaaugaggaaggauaauggagcuaccaaaauguguguguguguguuuguguuugugugugugaaggguauuuuacuuaacaagcauuuauugaguaucuacuccuuuuugggcuaagugcaacuugagauaagaaagauugauaggaucucagggcugaaggaguucaauuuguaauucaaaguaugacugcauaagcaagccccauuccaauuccuguugaggucuuagcauggaaguauccagcacccucaucacacccccugauagaggcacucucugcccuaauggcagccccccugccuuuuguugcugguucuuauuauuagacgauuuuuuucuuugguugagccaaugaauguuacucucugcaauuuccaguuuugguauucaagaccuguccauuugcuccuccaugugccaauuuuacaaauaccugaagacagcucuugggugcuucuuuuucacacaacguagaaagagaagcacaaccuuguagaaucuaaaagucaaguccucuccucuuucuguucccagugcaugugguaaaugccucucuuucagcccucaacccacuggguguaauuacuuuuguauucauaguuaacuaguaucuacuggguaaauccuuucugccagacauuguagugggaaauuucauaagaucuuucguucaauccugauuccaauucccugauguaaagagaguuauacccucuuuauagaugagaaaauugaggcucagaaagaggaagugguuucacuucuuggucuguuaccuuaucuagaucauguggaugcuaauacugcccuuguaagacaguuaagagcaguaaauaagugaaauguacauggcacauaguaggugugcaauaaaugggagcuguuuucauuggaacagcccuuccaugguuagcccauuucauuuuuggugaugauaaugaugaugauauuaauaauauuugucuagugcaaacuauguccaagacaguaucaagaguuucacauuugucaucuugacuaaucccuucaguucaagagauuaguaucauuaugauuccuguuuuauagaagaggaggccagaaacaaaguuacuuacuugcauacagucgcaauagccauaaacagcagagcugagauuggaacaguucugucuggcuccugagccccgacucccaauugcuccuucuucuaaccacauccccauagagcucagacucuauugcaucccuugcuaucuaagcacuggauaccaagggcucaaucagaaugcuaacugggggcacugugggaagcuagggugcaccacaacccuguagacaugucaagauguggugaauuaaugcaugcaaaggaagagccccaaaugaggugguuagaaagggguccuaguggaaagagaacagaucugggagaccauggcauugucagauggacaagggaggggggacaauggcucuaacaggagaaguagguuuuggauuaugguaaagucacaaagucaagaaaauccucagggucggcggggguugacuauagccuuggaaguucuggagcuggcaauugugaauauuugggguaauuaacuugaaugguggcuguuucuuuuuccuccaaccucccucucaccccagggaauucccacucuuguaaacacaaucaucuauuccaguuggcuccaagguaagagugcaauuccaggcuccacagaggcuagcgugcccgcccugagaugcuguuccugaugugguucaggccuuccuaaccucuuauugucuccuucugucucugcagugauccgggccaaggugguggggaagaagcugguaaaggaggggcccuucggcacgcuggucuacaccaucaagcagaugaagguagguaaugucaucacccuggcuccgggaagguuuuuggguuuuugccagaagaguccuggcuaagggaggcaaaguggguuggaacuggggugugugucuaagcaccagccagacccagcccuucugccugcuggagagggagcugcuaaggcugcauaaagggauggguagggagggggcauggggcugccuuguccaagagcccaugcagguggagucacuccaaggcacuuguuaggaagcugagcucuggagccagauggcagauagccuuguuagcucguaaccaugagaccuuggucaagucacugccccucucugggcuuuaaucuucccaauugugaaaugaggggguuggacuagaucaucucuaugaacucuucugagcucugacuaucugggacucaacagugcuuacagguuucaugcagccacugagguuacagcuuagguuuacagcccucaaaucuuuacauggaaacugugcugaucacaggaaccucaucccaaggcaggaacuucaccuucuuucccuauuuucccagcugauugucuucuugcauccuagauaguuagcaauguuugcuaagcauauucuuaucauuaaacauauuacugaggauaugaacaucaugaaguacaggaaggagguaugcccuuaagaaaaagaacaccagauuugaaaucuagagaaccugccuccuagucucaccucuacuccuaaauagccugcuuaccuugggcuugucccuuuuccugggccgcaguuuugccaccuguuaacagugugggguugggcuuggugcuccuaacauccucucuagcucaggcauucuaagcacccugggaugcgggccauguuacuuguaaggaggagcgggugguauacaauggaaggguguacuggugauugccuuagcacagaagacuggggcuucaccuugaauaacucagcaacugguucaucaccccaucuuuguaagcaccucucuacaugcagagcucccagcuaggagccagggaggccgugagggagauacaguuuccaucuuuaggaacuagagucagguugggagagaagaggcagguaugugugugacucaucagaaguucaauguggggugugcugagguccacaggaacuguccagcccuuuaacuuauugcucauauuugcaucccuagcaauuaggguaggaccuggcaugcaaaagugacuuggugaaugcuuaucugucuaauacgggcaugagggugagaccccacaggccuggaaacuccccagaggagacaagccgcaauguccagguagaagggaguggaggagugacgcagcccacggugguacccaaccauccccaaggccaaccuccaggcuuucuuauuccuguguccugaggcuggauguacuaauuuuguggaaccuguugcuuuggauucaauuuugcaaacauccacagccuucugguuauguaauguccagagucagcccuggccaguugcccuuggcugccuaagcuuggucaugagaccagcuuaugucuucagacagcccuggggagagaaaaaugggcagggguggggaaccagcaagagcaacaacaacgcaaaaagcccacuuugcaaccucuggcagacagcgcgggaaugccaaagcauauuagaccaaagcagagguucagaaaacacacgaaccugccuggucuggaacaauccucauuacgagacacucgguggucagcagagagcugagagggaaauagcugggaggcagcaguuccuaagccugccugguuuccuuccuaccaucagggccuggagaccagggugaccagaggcccuuccuguggacauaaugucccauucccccuugcuggugucagaccagccacgggugguuguuuagagaccaaacaacacuugcuagccuaucagcaucagacacucccacucccaggcuggugggcuuagaagacacacucccacucccagacuggugggcuuaggcuuucgguucaccauccuucgccugagcucaugaaucauggugcugggaauuagauguaggaucccucgucuuacuucugacagaggcgcaaaggggaaaugacuuacucagagucaagcauuuaacuaagggcagaucugauccccaagcugaggcaucggaauuucuucccaauccuguguucuuuauaugacucccaaaucucccugccaucuuaaucaucagucaccaucucaugccuuucauucacucugacccuccauagaggguaucaugauccauagaacuggucagugcccuucuauccagagacaccacuggaaucugcuugucucuagguaccagccugcaagucagacaagauacaggcuagaaguaauaguccguccauccauccucucgugcuuccuucccacccucucucugugcuuaguacuguacuaugaacuggggauacaaagauaacacugcuuauaauuaugauaagacuuggcaucaguuaacauuuacugagcaauugcuuagugccaggcauucugcuaggucuuugcauagaucaguacuuauacuaacacuguaaaauagauaacaccuuguccucuguuugacaggugaggcaacugagaccugggaggucauauaacuguuaagauuauauggccacaaaguggcaaaccugagcaaaacuacagggucuuugccuauaaggagauaauacaguauggagcagcaggcugauucaucauuccuacccacuuugggguauauaaaugcccacuccauauguuuuuaguucccagggaacaaaaagaggucaguuuggguuuguugguuuaucauccagcaguguagggcuggacuuguaauauccugcaaaggguguaucagaaaaaucuuuguaggagggaagagagagaggccagagaggcaagccugcaugaguuuuggcacuggucccugggagacuuuguucuagcagauuagacagucuacccuagagagucagaaggggugagcaagggcuuccuuagagcaggacuaaaggaacuuggagaaccugagacuccgagccgcccugucugaccucucucuucucucacugauggaaggcaggcagaccuucucccgucugcuaacucuggagccucugacccaucucucaggaacacuucaguacacagagaccugcgauaugugugugugugugagggagcaggguguuagaauguugagagagcuuauugcaaucccaaacuuggaaauuagcugggcuguggggugaaggugaaaguuuccagaacuggcugcucuaagcuguggggaccuuaucucccaucaggaccaugagaaaccgauccacugugccaggaguuauuguuuauguagcggagacaugcucuccagcuggcugcaggggacagaacgugggggacauuaugucccagcugguccugggagggucccauggggagacccgcuggucaugugcuuugcauguccugacuguaggcagagcagaccuccagggacuuccuuccuuuagugguuugucuaaccaaaugagcaauagcagggucucgccuuugaagcucuagcuggaagcaucuuugacccccagcccacagggaaccauucuucuugcaaugcccgugguucuuccugccuuaggacucucauccagcccucugcagagacuggcuccauuucuacauucucugccuguccugcuagacaaauugcuguauagagaaagaucauggccgugauagcucggucggucuguaaauaagaauuuguggguuuaaaugaguccgugauguacaccagcauccagaacaguguugaucuuugguaggcaugcaagacauaguuggaaucauugaggcaacucaugcugucaauguagagugaaggccagacauuucauaagaaauaugcaaauguccccagacucagaaacuucuuuuuuacuuuauuugucccuucacuccaagggaagcuaacaucuuggaacuuuguguagaugcuaccaagaagaagaagaggggcccagaggcaugcagaacccagcugaaaaagaacaacccacuuaugucugaaguucuaaaccagcuuuaacuacucuuguuaagagcugaggaagggacuuaggagaaaggggaccaaacucauuccuccucuccuuacgaauuucaguauaacuuguucuaagcuaacuuuuauugaauguugugggcugacugcuauucuaagucauuugcuucucucaaacacccuaagaagugcuuugacccauuuuacagaugaagaaacugagacccaaagagguuaaguaacuuuccaaguggcgaacacagguggcagagaagauugaagauucaaacucuggcugucagccuccaaaaccugaauuuaccacugaucuccauggcauugguuuggauuagauuaccuuuaacaucuuuuccaacucugagauucuaggauucucugaugucaggacauuauaaaccuauuauaacucuccuaaauuugucaaaccaauucuagaucucuaugauuacagacaugauacuuuuagaaucaauauuuaaaucaagguaggauuauuacacagaaaacacaacugaguagaaucuaccuuugccauguuguucuuuucagaauugacccuaaaacacagcgcuauguuugucagagccagucauuuguaaugugucagaauuucgacucuaggcaagugcuaggagcuaaaaugcagguuccuucaaacuuccaaguagcugcggugccaagcugauuucgaugaguugaguucuuacugagcaguucaaaugaccagacuguaaccaggggcuucauucucucacccacgaagcacuagggcagucaaggggaaagacugacgcagaaggaaugagguucccaugggcuggguccaaaagaccuagagcgagugcuuaguugaaacauuugccaaaaccucaaggaacacccacacaaaaauaagaaguugcucggcacagaagucaggguaggggauguucuucgaaggccacacuccauggcaggcauacagcagcacgcuuaaacaugguuccuguuaaggcuagagaggcaccauucacauagaagaagucaucaucgugacucuacccaccccgcgcccccaccgcguaauugaaugcugaguguggacggcacuucuuccagcacuuggcugcguuaccgugcucaguuggcaagccuugggggagaagagagguucagaaggaagaccaucugaguccaucagaacaaugugugcuuuuaacaaggcaggggcgcccaaacucaguagguccaacagaccaaguuaugcuaugaaggucuuguggaccaccuacccccgccaaccagucaccacuuaaaagaugagaaaacgccagcucacaggccaaaugggaggcauuuagaagagacaccaaugaagagaugucuggcuuuguauuaauuacuguagguaaauuaauaccaaaugccaggaaguaaaguagaggcauuuuccuauuauaaacccuugggacaagcccagagaccaccagcaguccagggcuuguguacgcugagaacugaggggauaacagaauugugcaacaccuuggugccccaccgcccccguuaccaaaucucacaguucacaguaucgccuuggcacacugggcuuguguaauacucauggacuugaccuggaaucacaaagcggacucagcuucuguuacauucauucaccccagugacucugggcacacacugugccucugaaggaggcacaguggccauaaauggaaauagcauuugccugcuucuggggaccuuggucauagacuucugaggcuuuccugggagccagucuaagauaauggguaagaguauggacucugaaggcagaguccucugcuuggaauccuagcccugccauuucccaacuguguggccuuaacaagcuacuuagccugccugugacucaggcuccucaucuauaaaaugggcauaauaguuccuaccucauaggguugucauggugauucgugggcuaauauuaaaggagauuucucaaccucaguaccauugacauuuggggccggauaauucuuuguucugggggcuguccugaguauuaugggauguuuagcaaccucccuacccucuacgaacuguugugacaaccaaaauugucuccagacauugccacaugucccaaauauuuccuaggggggcaaaauugccuccaguugagaaccacuguauuagauuaugucguagauacaaauagccaaauaucagcaauuucacgugguucaaucuaacaauuauaaaguauuuaacaguuaaaacucuuugaacuuuguagauacauuuaugugcuucaucugggauaaacgaacccaaugcuuucaccagacgcucagaagaauaaaaaacauggagaauuucuagcuugaauucaacguucaccagccaaauagaauuucuauaaagugggguuuguaauacaucccucccagggcucuuuuaaggauacugcaaggagaaugugagugagaauguuuuugugggcuggaaagugucacagagauaucaugagaaugcuggcugaguucacgggacucagguccuaagguugacaaagaaaaaggaccuuugucacagcuacuucucuggauuucugaaaaggugcugggaugucagacauguguagccgaaggaguguuguggggcaguuggaaugggggguauggcuggcugcacaggaagguuucucugggaaggcaccaaccuggcuagucaagaggaucgguggcuucaucuggggugaagggggcccugggguggguagaucagugaccggccacuggacagcugaauaggggagcgagauucccucagauccaaugucagcaagccuucuggguacugagacuccucuccuguguuccucuuauuuuauugauacauaauaaauggacauauuuugagaguccaugugguauuuugauauauucaaaaauguauaguaaucaaaucaggguaauugggauauucauaaccuuaaacauuuaucguuucuucaugcugggaacaucugaauuauccucuacuagcuacuuugagauauacaauaaguuauuguuuacuguagucauucuacugauucaaugaacacugggucuuacuuguucugcguacucguauuuuuguacccauuaauuauaucucuuugccccaauccuuauuaccuuucuugccucugguaaccaccaauccacuguccaucuuuaugagauuuacuuucuuagcucccacaugagugagaacaugguguauuugucuuucugugccuggcuuauuccgcuuagcaaaacgaccuccaguuccagcugcauugccacaaaugacaagauuucauucuuuuuucuggaugaaucauauuccauuggguauagauaccagguuuugucuauccauucaucuguugaugggcacuuagguugauuucauaucuuggcuauugugaauauugcugcagucaacaugagagugcagaccccucuuccauauuccgauuuccuuuccuuuggauacauacccagcagugggauuagggaucauacggguguccaaacugggaaagaagaagucaugauguuccuuuugcccacagauguaccgaggcuucaccaagaugccccaugugcaguacauccauacggaagcuuccgagagucucuguggccuuaagcuggaggucaacaaguaccaguaccugcugacagguaauggccaacucuagcuucuaggccaggguuuggccaagguccacuguuucuugacuucagaagaacacauacggaguaguugacucaccaaauguccaguaaauuguaaggagucucuaauguugaauucaucccacuuacccagugcuaggagcuugaggcuccuacacuuaggcuggacuuuggaauuagcuccaccacucaccugggggaggaaaucuccuaauuuguagcuucucaacuuuacuguaaauaaaaagggaguaucuguuccucuccaccucacacucgaccuguuaggcccgucuuugaaaguuauucaucuuuaggcagucaguguaguaaaggagaaaacaaaaacaaaaaucauuauaaagggagugaagaguuggccucuaguccuagcuccaguauuuaaugggcuugggaccuuuggcaaaucacuuuaccucuccaagccucauuauccucaucuggaaaauggggcuacaguccauuuuaaaagguguuggguagggugaaauaaaaucaugggucugaaaaguacccagccacagugccugggcuaagugggaacauaguaggugugaauucucucugggcuaggcucuggacaaaacaaccucuccuuguuuucuucuuuccuccuguaggucgcgucuaugauggcaagauguacacggggcugugcaacuucguggagaggugggaccagcucacccucucccagcgcaaggggcugaacuaucgguaucaccuggguuguaacugcaagguaagcucuggggucacugggggaaggaggggaggugcugacuugcagcccuagaaacaucagcucccaaugcacugggugccaggcccucggcugggaaggguaugcauguguuaggccagggcagaggggcaggucugagcagauauaguaaggauuguugccccagguggggcagugaggaaggcagggaaggaagaaugccuuucugcuguaaucggcugccuccaugaugaccacuuggaagcugcuggggcaugagggcucuugagucccuggccccaccuggcaguucaaggcuggagguauaggauccugacacuggcagguucucccaagugguuucaagugggcucacccugguagcugacucaucgcuaaccccaccccagguaggcaaaugggcccaggacugcagagaccagaugcuacagaaggucucucuuuaccaggcccaucccccugacccaaguauagggccaaggugcagccugccugcugugggaggaaguugggccauucucucacuucaucuucaaaacaguccugugugguuuuaauuacuaugaucuccauucugcagaugagagcucagagaacuuaaguaacuagcccuaggucccacaguucacugaaucugguuuccaaccuagggcagcuagacuccaaaguuuaugcucuaaccuuucuaauuccucgauucccuaaaacaacugagaucucccaccugagacgaaaaaguccucucaguagucuaauucugcuacuuacuggcugugugaccugcagcaaguuacuuaaccucucagagccuccuaaaacugugauaagaauuaaagagaauaauaucaaagcacuuaucagaaugucuguuagacagcagaugcucaagcuagugcuauuuauauuaugaucacugagggacugauguggcuaggcuucccaugcaguggccccagggucugaauccaggcucgguagccucaggccugggcauaccauggcagaguccaucaacugcugccuguuaucuaauugcagaucaaguccugcuacuaccugccuugcuuugugacuuccaagaacgagugucucuggaccgacaugcucuccaauuucgguuacccuggcuaccaguccaaacacuacgccugcauccggcagaagggcggcuacugcagcugguaccgaggaugggcccccccggauaaaagcaucaucaaugccacagaccccugagcgccagacccugccccaccucacuucccucccuucccgcugagcuucccuuggacacuaacucuucccagaugaugacaaugaaauuagugccuguuuucuugcaaauuuagcacuuggaacauuuaaagaaaggucuaugcugucauaugggguuuauugggaacuauccuccuggccccacccugccccuucuuuuugguuuugacaucauucauuuccaccugggaauuucuggugccaugccagaaagaaugaggaaccuguauuccucuucuucgugauaauauaaucucuauuuuuuuaggaaaacaaaaaugaaaaacuacuccauuugaggauuguaauucccaccccucuugcuucuuccccaccucaccaucucccagacccucuucccuuugcccuucuccuccaauacauaaaggacacagacaaggaacuugcugaaaggccaaccauuucaggaucagucaaaggcagcaagcagauagacucaaggugugugaaagauguuauacaccaggagcugccacugcaugucccaaccagacugugucugucugugucugcauguaagagugagggagggaaggaaggaacuacaagagagucggagaugaugcagcacacacacaauuccccagcccagugaugcuuguguugaccagauguuccugagucuggagcaagcacccaggccagaauaacagagcuuucuuaguuggugaagacuuaaacaucugccugaggucaggaggcaauuugccugccuuguacaaaagcucaggugaaagacugagaugaaugucuuuccucucccugccucccaccagacuuccuccuggaaaacgcuuugguagauuuggccaggagcuuucuuuuauguaaauuggauaaauacacacaccauacacuauccacagauauagccaaguagauuuggguagaggauacuauuuccagaauaguguuuagcucaccuagggggauauguuuguauacacauuugcauauacccacauggggacauaagcuaauuuuuuuacaggacacagaauucuguucaaugcuguuaaauaugccaauaguuuaaucucuucuauuuuguugucguugcuuguuugaagaaaaucaugacauuccaaguugacauuuuuuuuucauuuuaauuaaaauuugaaauucugaacaccgucagcacccucucuucccuaucaugggucaucugaccccuguccgucuccuugucccugcuucauguuugggggccuuucuuuaacugccuuccuggcuuagcucagauggcagaugagaguguagucaagggccugggcacaggagggagagcugcagaguguccugccugccuuggcuggagggacaccucuccuggguguggagacagcuugguucccuuucccuagcucccuggugggugaaugccaccuccugagauccucaccucuuggaauuaaaauuguuggucacuggggaaagccugaguuugcaaccaguuguaggguuucuguuguguuuuuuuuuuuuuuuuugaaauaaaacuauaauauaaauucuccuauuaaauaaaauuauuuuaaguuuuagugucaaaagugagaugcugagaguaggugauaauguauauuuuacagaguggggguuggcaggauggugacauugaacaugauugcucucugucucuuuuuucagcuuauggguauuuaucuucuauuaguauuuguaucuucaguucauuccacuuuaggaaacagagcugccaauugaaacagaagaagaaaaaaaaaaaaagcagcagacaacacacuguagagucuugcacacacacaagugcccaggcaaggugcuuggcagaaccgcagagugggaagagaguaccggcaucggguuuccuugggaucaauuucauuaccguguaccuuucccauuguggucaugccauuuggcagggggagaaugggaggcuuggccuucuuugugaggcagugugagcagaagcugaugccagcaugucacugguuuugaagggaugagcccagacuugauguuuugggauuguccuuauuuuaaccucaaggucucgcaugguggggccccugaccaaccuacacaaguucccucccacaaguggacaucagugucuucucugugaggcaucuggccauucgcacucccugguguggucagccucucucacacaaggaggaacuugggugaaggcugagugugaggcaccugaaguuucccugcggagucgauaaauuagcagaaccacauccccaucuguuaggccuuggugaggaggcccugggcaaagaagggucuuucgcaaagcgaugucagagggcgguuuugagcuuucuauaagcuauagcuuuguuuauuucacccguucacuuacuguauaauuuaaaaucauuuauguagcugagacacuucuguauuucaaucauaucaugaacauuuuauuuugcuaaaucuugugucauguguaggcuguaauauguguacauuguguuuaagagaaaaaugaaacccacaugccgccauuuuccugaaucaaauucugcaguggaauggagaggaaaauacuucuaggcaagcagcuagacuggugaauugggggaaauagaaggaacuaguaacugagacuccuccagccuccucccuauuggaaucccaauggcuccuggaguaggaaaaaaguuuaaacuacauucauguucuuguucugugucacucggcccuggguagucuaccauuuacuucaccccaaguccugcugcccauccaguugggaagccaugauuuuccuaagaauccagggccaugggagauacaauuccaaguucucgcuuccuccuuugggcaucucuucugccucccaaucaaggaagcuccaugcucaggcucucagcucucgggccagugcucugcucuguccaggguagguaauacugggagacuccugucuuuuacccuccccucguuccagaccugccucaugguggcaacaugguucuugaacaauuaaagaaacaaaugacuuuuuggaauagcccugucuagggcaaacuguggcccccaggagacacuacccuuccaugccccagaccucugucuugcaugugacaauugacaaucuggacuaccccaagauggcacccaaguguuuggcuucuggcuaccuaagguuaacaugucacuagaguauuuuuaugagagacaaacauuauaaaaaucugauggcaaaagcaaaacaaaauggaaaguaggggagguggaugugacaacaacuuccaaauuggcucuuuggaggcgagaggaaggggagaacuuggagaauaguuuuugcuuuggggguagaggcuucuuagauucucccagcauccgccuuucccuuuagccagucugcuguccugaaacccagaagugauggagagaaaccaacaagagaucucgaacccugucuagaaggaauguauuuguugcuaaauuucguagcacuguuuacaguuuuccuccauguuauuuaugaauuuuauauuccgugaauguauauugucuuguaauguugcauaauguucacuuuuuauaguguguccuuuauucuaaacaguaaagugguuuuauuucuaucac
